United States Patent 11,640,849 (METHODS FOR HISTOLOGICAL DIAGNOSIS AND TREATMENT OF DISEASES) - sequence listing, part 37

SEQ ID NO: 1440485 - protein, 89 aa, Mycobacterium tuberculosis
  misc_feature (37)..(37): Xaa can be any naturally occurring amino acid
AGGAGGAGGVGGAGGAGGTGGGGGNGGAIFNAGTPGXAGTGGDGGVGGTGAAGGKGGAGGSGGVNGATGADGAKGLDGATGGKGNNGNP

SEQ ID NO: 1440486 - protein, 8 aa, Mycobacterium tuberculosis
AGGAGGNA

SEQ ID NO: 1440487 - protein, 15 aa, Mycobacterium tuberculosis
AGGAGGNGGAGGAAG

SEQ ID NO: 1440488 - protein, 10 aa, Mycobacterium tuberculosis
AGGAGGNGGL

SEQ ID NO: 1440489 - protein, 46 aa, Mycobacterium tuberculosis
AGGAGGQLYGNGGDGGNGGAGGANIAGGNGSDGGAAGHGGAGGSAR

SEQ ID NO: 1440490 - protein, 24 aa, Mycobacterium tuberculosis
AGGAGGSGGGGSVAGDSGAGGNAG

SEQ ID NO: 1440491 - protein, 7 aa, Mycobacterium tuberculosis
AGGAGQP

SEQ ID NO: 1440492 - protein, 9 aa, Mycobacterium tuberculosis
AGGASHRRR

SEQ ID NO: 1440493 - protein, 16 aa, Mycobacterium tuberculosis
AGGAWSNDSVSCPRSG

SEQ ID NO: 1440494 - protein, 7 aa, Mycobacterium tuberculosis
AGGDAEG

SEQ ID NO: 1440495 - protein, 22 aa, Mycobacterium tuberculosis
AGGDGGTGGVGGHGGLIGVGGH

SEQ ID NO: 1440496 - protein, 8 aa, Mycobacterium tuberculosis
AGGDIKSL

SEQ ID NO: 1440497 - protein, 7 aa, Mycobacterium tuberculosis
AGGDRTA

SEQ ID NO: 1440498 - protein, 46 aa, Mycobacterium tuberculosis
AGGFGDTGGTGGAGGAGGLFGPGGGSGGVGGFGDTGGTGGDGGNGR

SEQ ID NO: 1440499 - protein, 6 aa, Mycobacterium tuberculosis
AGGFGG

SEQ ID NO: 1440500 - protein, 14 aa, Mycobacterium tuberculosis
AGGFGRNGNDASRG

SEQ ID NO: 1440501 - protein, 17 aa, Mycobacterium tuberculosis
AGGFPAGDSMTSTPERT

SEQ ID NO: 1440502 - protein, 19 aa, Mycobacterium tuberculosis
AGGGADGDDGDDGQPGNNG

SEQ ID NO: 1440503 - protein, 12 aa, Mycobacterium tuberculosis
AGGGAPVGNPAD

SEQ ID NO: 1440504 - protein, 12 aa, Mycobacterium tuberculosis
AGGGGVGGTGGT

SEQ ID NO: 1440505 - protein, 27 aa, Mycobacterium tuberculosis
AGGGHGGTGGLSTNGDGGVGGAGGNAG

SEQ ID NO: 1440506 - protein, 7 aa, Mycobacterium tuberculosis
AGGGLAS

SEQ ID NO: 1440507 - protein, 16 aa, Mycobacterium tuberculosis
AGGGPSQLASMGSQQA

SEQ ID NO: 1440508 - protein, 8 aa, Mycobacterium tuberculosis
AGGGVDPR

SEQ ID NO: 1440509 - protein, 68 aa, Mycobacterium tuberculosis
AGGHGGAGGAGGNQTGGVGNGGAGGNGGAGGAGGQLYGNGGAGGANIAGGNGSDGGAAGHGGAGGSAR

SEQ ID NO: 1440510 - protein, 49 aa, Mycobacterium tuberculosis
AGGHGGDGGAGGNTAGRRADAIAGTGGDGGNGGNGGLLSGNAGAGGHGG

SEQ ID NO: 1440511 - protein, 6 aa, Mycobacterium tuberculosis
AGGHGT

SEQ ID NO: 1440512 - protein, 5 aa, Mycobacterium tuberculosis
AGGHP

SEQ ID NO: 1440513 - protein, 4 aa, Mycobacterium tuberculosis
AGGL

SEQ ID NO: 1440514 - protein, 7 aa, Mycobacterium tuberculosis
AGGLPGD

SEQ ID NO: 1440515 - protein, 11 aa, Mycobacterium tuberculosis
AGGLPSAAIGG

SEQ ID NO: 1440516 - protein, 4 aa, Mycobacterium tuberculosis
AGGN

SEQ ID NO: 1440517 - protein, 8 aa, Mycobacterium tuberculosis
AGGNGGDA

SEQ ID NO: 1440518 - protein, 6 aa, Mycobacterium tuberculosis
AGGNNW

SEQ ID NO: 1440519 - protein, 15 aa, Mycobacterium tuberculosis
AGGPDGGWNKPPTPL

SEQ ID NO: 1440520 - protein, 9 aa, Mycobacterium tuberculosis
AGGPSDALA

SEQ ID NO: 1440521 - protein, 5 aa, Mycobacterium tuberculosis
AGGPV

SEQ ID NO: 1440522 - protein, 6 aa, Mycobacterium tuberculosis
AGGPVR

SEQ ID NO: 1440523 - protein, 68 aa, Mycobacterium tuberculosis
AGGQGGVGGSAGMLSGSGGSGGAGGSGGPAGTAAGGAGGAGGAPGLIGNGGNGGESGGTGGVGGAGGN

SEQ ID NO: 1440524 - protein, 7 aa, Mycobacterium tuberculosis
AGGQLTE

SEQ ID NO: 1440525 - protein, 9 aa, Mycobacterium tuberculosis
AGGRRRRGG

SEQ ID NO: 1440526 - protein, 5 aa, Mycobacterium tuberculosis
AGGRT

SEQ ID NO: 1440527 - protein, 25 aa, Mycobacterium tuberculosis
AGGSARGGGCSAGSCRAGRCRAAGT

SEQ ID NO: 1440528 - protein, 6 aa, Mycobacterium tuberculosis
AGGSDV

SEQ ID NO: 1440529 - protein, 9 aa, Mycobacterium tuberculosis
AGGSGKTTA

SEQ ID NO: 1440530 - protein, 7 aa, Mycobacterium tuberculosis
AGGSPER

SEQ ID NO: 1440531 - protein, 8 aa, Mycobacterium tuberculosis
AGGSPYAL

SEQ ID NO: 1440532 - protein, 7 aa, Mycobacterium tuberculosis
AGGSRPL

SEQ ID NO: 1440533 - protein, 24 aa, Mycobacterium tuberculosis
AGGTGGAGTLGADGGAGGHGGCSA

SEQ ID NO: 1440534 - protein, 40 aa, Mycobacterium tuberculosis
AGGTGGTGGIGGQNTETGPAASNGGAGGAGGGGGYLVGDG

SEQ ID NO: 1440535 - protein, 66 aa, Mycobacterium tuberculosis
AGGVFSGGGAGGAGDAIGGSGGAGGTGGLLGGGGGAGGAGGAGGNGGGASNSASIGGDGGSGGAGG

SEQ ID NO: 1440536 - protein, 13 aa, Mycobacterium tuberculosis
AGGVGGDGGRGGL

SEQ ID NO: 1440537 - protein, 22 aa, Mycobacterium tuberculosis
AGGVGGSSEDVGGTGGAGGAGR

SEQ ID NO: 1440538 - protein, 22 aa, Mycobacterium tuberculosis
AGGVGGSSEDVGGTGGGGGAGR

SEQ ID NO: 1440539 - protein, 12 aa, Mycobacterium tuberculosis
AGGVLGAPASLE

SEQ ID NO: 1440540 - protein, 12 aa, Mycobacterium tuberculosis
AGGYRQSRPARC

SEQ ID NO: 1440541 - protein, 6 aa, Mycobacterium tuberculosis
AGHKPA

SEQ ID NO: 1440542 - protein, 27 aa, Mycobacterium tuberculosis
AGHPRAEVGDARAATAAGVEEARRRQL

SEQ ID NO: 1440543 - protein, 31 aa, Mycobacterium tuberculosis
AGHPRHQRRRPGRRRRPDQGCRGRSLGDPEA

SEQ ID NO: 1440544 - protein, 15 aa, Mycobacterium tuberculosis
AGHRERGSSRKSGKI

SEQ ID NO: 1440545 - protein, 8 aa, Mycobacterium tuberculosis
AGHSAYPG

SEQ ID NO: 1440546 - protein, 9 aa, Mycobacterium tuberculosis
AGHSGRGGA

SEQ ID NO: 1440547 - protein, 24 aa, Mycobacterium tuberculosis
AGHYPRGRRPYRRAPKDRGRLANS

SEQ ID NO: 1440548 - protein, 13 aa, Mycobacterium tuberculosis
AGIAGGSGGAAGL

SEQ ID NO: 1440549 - protein, 18 aa, Mycobacterium tuberculosis
AGIEEPSAARSAIADAGV

SEQ ID NO: 1440550 - protein, 7 aa, Mycobacterium tuberculosis
AGIESRS

SEQ ID NO: 1440551 - protein, 8 aa, Mycobacterium tuberculosis
AGIGDDGD

SEQ ID NO: 1440552 - protein, 14 aa, Mycobacterium tuberculosis
AGIGGAGGNGGNAG

SEQ ID NO: 1440553 - protein, 6 aa, Mycobacterium tuberculosis
AGIPHE

SEQ ID NO: 1440554 - protein, 17 aa, Mycobacterium tuberculosis
AGIQPSVGAVGSSYDDA

SEQ ID NO: 1440555 - protein, 5 aa, Mycobacterium tuberculosis
AGIRS

SEQ ID NO: 1440556 - protein, 16 aa, Mycobacterium tuberculosis
AGISAESGVPTFRDDK

SEQ ID NO: 1440557 - protein, 7 aa, Mycobacterium tuberculosis
AGKADAC

SEQ ID NO: 1440558 - protein, 15 aa, Mycobacterium tuberculosis
AGKAGGTAGAGGAGG

SEQ ID NO: 1440559 - protein, 45 aa, Mycobacterium tuberculosis
AGKAGPAVAAASTAPPAPTAPRASTVPPAAKATTATPAESGFTES

SEQ ID NO: 1440560 - protein, 9 aa, Mycobacterium tuberculosis
AGKDRGDLV

SEQ ID NO: 1440561 - protein, 37 aa, Mycobacterium tuberculosis
AGKGGARGSGGVNGATGADGAKGLDGATGGKGNNGNP

SEQ ID NO: 1440562 - protein, 85 aa, Mycobacterium tuberculosis
AGKGGNGGAGGNGGSIGANSGIVGGSGGAGGAGGAGGNGSLSSGEGGKGGDGGHGGDGVGGNSSVTQGGSGGGGGAGGAGGSGFF

SEQ ID NO: 1440563 - protein, 7 aa, Mycobacterium tuberculosis
AGKGKWD

SEQ ID NO: 1440564 - protein, 6 aa, Mycobacterium tuberculosis
AGKPLT

SEQ ID NO: 1440565 - protein, 9 aa, Mycobacterium tuberculosis
AGKRLSGGG

SEQ ID NO: 1440566 - protein, 11 aa, Mycobacterium tuberculosis
AGKTGTAQQIN

SEQ ID NO: 1440567 - protein, 7 aa, Mycobacterium tuberculosis
AGKYGVR

SEQ ID NO: 1440568 - protein, 8 aa, Mycobacterium tuberculosis
AGLDSDTA

SEQ ID NO: 1440569 - protein, 7 aa, Mycobacterium tuberculosis
AGLGSAS

SEQ ID NO: 1440570 - protein, 24 aa, Mycobacterium tuberculosis
AGLRGRGGRGRPAARLPARGPGRR

SEQ ID NO: 1440571 - protein, 12 aa, Mycobacterium tuberculosis
AGLSGGGASAGL

SEQ ID NO: 1440572 - protein, 9 aa, Mycobacterium tuberculosis
AGNDERAAG

SEQ ID NO: 1440573 - protein, 12 aa, Mycobacterium tuberculosis
AGNGGAGGNAGL

SEQ ID NO: 1440574 - protein, 13 aa, Mycobacterium tuberculosis
AGNGGGDLVSGSS

SEQ ID NO: 1440575 - protein, 10 aa, Mycobacterium tuberculosis
AGNGGPPVTR

SEQ ID NO: 1440576 - protein, 76 aa, Mycobacterium tuberculosis
AGNGGTGGAGGNGGTGGAGAPGGAGGAGGKADIANSLGDNATVTGGNGGTGGDGGSALGTGAAGGAGGLGGHGGAG

SEQ ID NO: 1440577 - protein, 7 aa, Mycobacterium tuberculosis
AGNGGVA

SEQ ID NO: 1440578 - protein, 20 aa, Mycobacterium tuberculosis
AGNGKATAAPAKAADSGGAA

SEQ ID NO: 1440579 - protein, 15 aa, Mycobacterium tuberculosis
AGNGLLRSTADLEGA

SEQ ID NO: 1440580 - protein, 26 aa, Mycobacterium tuberculosis
AGNGMAGHTAPAGPWGDRLDHLVALV

SEQ ID NO: 1440581 - protein, 19 aa, Mycobacterium tuberculosis
AGNNPQGQSRTSRRTDHVT

SEQ ID NO: 1440582 - protein, 9 aa, Mycobacterium tuberculosis
AGNPARRTQ

SEQ ID NO: 1440583 - protein, 7 aa, Mycobacterium tuberculosis
AGNPGTI

SEQ ID NO: 1440584 - protein, 6 aa, Mycobacterium tuberculosis
AGNPIS

SEQ ID NO: 1440585 - protein, 6 aa, Mycobacterium tuberculosis
AGNQGC

SEQ ID NO: 1440586 - protein, 32 aa, Mycobacterium tuberculosis
AGNRWQPAARGRSTPRGGAAIGANDRSRHPGH

SEQ ID NO: 1440587 - protein, 31 aa, Mycobacterium tuberculosis; identical to SEQ ID NO: 149655

SEQ ID NO: 1440588 - protein, 26 aa, Mycobacterium tuberculosis
AGNTNTASFNPGDYNTGGFNPGNYNT

SEQ ID NO: 1440589 - protein, 19 aa, Mycobacterium tuberculosis
AGNTVAKDHAAGHRPHPAA

SEQ ID NO: 1440590 - protein, 14 aa, Mycobacterium tuberculosis
AGPAGGAWVHYLLP

SEQ ID NO: 1440591 - protein, 17 aa, Mycobacterium tuberculosis
AGPAGVGQAGGAGGSAG

SEQ ID NO: 1440592 - protein, 52 aa, Mycobacterium tuberculosis
AGPAPTPTESQLAPPRPPTPQTPTGAPQQPESPAPHVPSHGPHQPRRTAPAP

SEQ ID NO: 1440593 - protein, 32 aa, Mycobacterium tuberculosis
AGPAPTPTESQLAPPRPPTPQTPTGSAAATGI

SEQ ID NO: 1440594 - protein, 8 aa, Mycobacterium tuberculosis
AGPARLSN

SEQ ID NO: 1440595 - protein, 5 aa, Mycobacterium tuberculosis
AGPAV

SEQ ID NO: 1440596 - protein, 6 aa, Mycobacterium tuberculosis
AGPDRQ

SEQ ID NO: 1440597 - protein, 28 aa, Mycobacterium tuberculosis
AGPGGAGGAGGDGENLDTGGDGGAGGSA

SEQ ID NO: 1440598 - protein, 28 aa, Mycobacterium tuberculosis
AGPGGAGGAGGHGENLDTGGDGGAGGSA

SEQ ID NO: 1440599 - protein, 24 aa, Mycobacterium tuberculosis
AGPGRAGIGGSRGRRRQTPTPTGH

SEQ ID NO: 1440600 - protein, 8 aa, Mycobacterium tuberculosis
AGPGSGPL

SEQ ID NO: 1440601 - protein, 9 aa, Mycobacterium tuberculosis
AGPGSGPML

SEQ ID NO: 1440602 - protein, 8 aa, Mycobacterium tuberculosis
AGPHGASW

SEQ ID NO: 1440603 - protein, 7 aa, Mycobacterium tuberculosis
AGPIGVP

SEQ ID NO: 1440604 - protein, 6 aa, Mycobacterium tuberculosis
AGPMHR

SEQ ID NO: 1440605 - protein, 22 aa, Mycobacterium tuberculosis
AGPPGNLDPAPTRWRPRGTRRR

SEQ ID NO: 1440606 - protein, 5 aa, Mycobacterium tuberculosis
AGPQL

SEQ ID NO: 1440607 - protein, 40 aa, Mycobacterium tuberculosis
AGPQPAGPRRAGMERRRQPAPLAGPAAGAAADRTGPGLSD

SEQ ID NO: 1440608 - protein, 6 aa, Mycobacterium tuberculosis
AGPQVR

SEQ ID NO: 1440609 - protein, 7 aa, Mycobacterium tuberculosis
AGPRPHC

SEQ ID NO: 1440610 - protein, 21 aa, Mycobacterium tuberculosis
AGPRRTASGSVAVPGARARVA

SEQ ID NO: 1440611 - protein, 8 aa, Mycobacterium tuberculosis
AGPSAPRR

SEQ ID NO: 1440612 - protein, 8 aa, Mycobacterium tuberculosis
AGPSGRAG

SEQ ID NO: 1440613 - protein, 24 aa, Mycobacterium tuberculosis
AGPSSTSTNRVGNARRAGRAPSGW

SEQ ID NO: 1440614 - protein, 7 aa, Mycobacterium tuberculosis
AGPSVQN

SEQ ID NO: 1440615 - protein, 9 aa, Mycobacterium tuberculosis
AGPTGTSRT

SEQ ID NO: 1440616 - protein, 7 aa, Mycobacterium tuberculosis
AGPTGVE

SEQ ID NO: 1440617 - protein, 7 aa, Mycobacterium tuberculosis
AGPTNSW

SEQ ID NO: 1440618 - protein, 16 aa, Mycobacterium tuberculosis
AGPVGGRAGQGGEQVT

SEQ ID NO: 1440619 - protein, 14 aa, Mycobacterium tuberculosis
AGPVPSASSVLPAG

SEQ ID NO: 1440620 - protein, 46 aa, Mycobacterium tuberculosis
AGQAEGHRSLGGNGPAIREEGPGGGAQRKAQGNWGPNTEAADLGAG

SEQ ID NO: 1440621 - protein, 9 aa, Mycobacterium tuberculosis
AGQAGDNPQ

SEQ ID NO: 1440622 - protein, 18 aa, Mycobacterium tuberculosis
AGQAGVAEQRKPSRQVGG

SEQ ID NO: 1440623 - protein, 16 aa, Mycobacterium tuberculosis
AGQAMASTEGNVTGMF

SEQ ID NO: 1440624 - protein, 29 aa, Mycobacterium tuberculosis
AGQCQPRSRVGQRPGGNSAQRTGRAGDQD

SEQ ID NO: 1440625 - protein, 6 aa, Mycobacterium tuberculosis
AGQFGK

SEQ ID NO: 1440626 - protein, 16 aa, Mycobacterium tuberculosis
AGQGEPGCAALPRGIS

SEQ ID NO: 1440627 - protein, 24 aa, Mycobacterium tuberculosis
AGQGKGARMTHSPGGPGGVGGHGG

SEQ ID NO: 1440628 - protein, 14 aa, Mycobacterium tuberculosis
AGQGPVQPAGRARL

SEQ ID NO: 1440629 - protein, 13 aa, Mycobacterium tuberculosis
AGQGRRPSDRPDL

SEQ ID NO: 1440630 - protein, 18 aa, Mycobacterium tuberculosis
AGQLEGQHGPGSLGRQPL

SEQ ID NO: 1440631 - protein, 40 aa, Mycobacterium tuberculosis
AGQPAGRPAVATAPAGSGSRRRRRSRRARPGRRLLSLILL

SEQ ID NO: 1440632 - protein, 6 aa, Mycobacterium tuberculosis
AGQPDL

SEQ ID NO: 1440633 - protein, 8 aa, Mycobacterium tuberculosis
AGQPGGAW

SEQ ID NO: 1440634 - protein, 11 aa, Mycobacterium tuberculosis
AGQPHGGGPRV

SEQ ID NO: 1440635 - protein, 9 aa, Mycobacterium tuberculosis
AGQPSMHGT

SEQ ID NO: 1440636 - protein, 13 aa, Mycobacterium tuberculosis
AGQQIADEEVDAG

SEQ ID NO: 1440637 - protein, 4 aa, Mycobacterium tuberculosis
AGQR

SEQ ID NO: 1440638 - protein, 9 aa, Mycobacterium tuberculosis
AGQRAQRVD

SEQ ID NO: 1440639 - protein, 16 aa, Mycobacterium tuberculosis
AGQRCSRSADPDIPAE

SEQ ID NO: 1440640 - protein, 14 aa, Mycobacterium tuberculosis
AGQRRIAKGERDFK

SEQ ID NO: 1440641 - protein, 14 aa, Mycobacterium tuberculosis
AGQRSPGDHRPRSR

SEQ ID NO: 1440642 - protein, 11 aa, Mycobacterium tuberculosis
AGQRSRGHVEA

SEQ ID NO: 1440643 - protein, 14 aa, Mycobacterium tuberculosis
AGQSAPGGGGTPRR

SEQ ID NO: 1440644 - protein, 16 aa, Mycobacterium tuberculosis
AGQSWGGPSPIPERPL

SEQ ID NO: 1440645 - protein, 78 aa, Mycobacterium tuberculosis
AGRAAADRRAAGRLGRRPRTRAGAGGSGLHPGPPARTPAGAHRRTGRHHRGADRGAAGKSPTGENPLTHPRPAKTTAG

SEQ ID NO: 1440646 - protein, 14 aa, Mycobacterium tuberculosis
AGRAARACRADRAA

SEQ ID NO: 1440647 - protein, 22 aa, Mycobacterium tuberculosis
AGRADALQAGPPPPAAADYGNP

SEQ ID NO: 1440648 - protein, 20 aa, Mycobacterium tuberculosis
AGRAGPRRRPPAPAGLPIQP

SEQ ID NO: 1440649 - protein, 7 aa, Mycobacterium tuberculosis
AGRAGRR

SEQ ID NO: 1440650 - protein, 8 aa, Mycobacterium tuberculosis
AGRAPVGT

SEQ ID NO: 1440651 - protein, 14 aa, Mycobacterium tuberculosis
AGRATEAIGAGNKL

SEQ ID NO: 1440652 - protein, 10 aa, Mycobacterium tuberculosis
AGRDGQGVDP

SEQ ID NO: 1440653 - protein, 8 aa, Mycobacterium tuberculosis
AGRDPYGV

SEQ ID NO: 1440654 - protein, 10 aa, Mycobacterium tuberculosis
AGRDSNSRGV

SEQ ID NO: 1440655 - protein, 11 aa, Mycobacterium tuberculosis
AGREPPPGLSA

SEQ ID NO: 1440656 - protein, 24 aa, Mycobacterium tuberculosis
AGRGAAPRRGRRVQDGQLARHGDG

SEQ ID NO: 1440657 - protein, 10 aa, Mycobacterium tuberculosis
AGRGERESTW

SEQ ID NO: 1440658 - protein, 20 aa, Mycobacterium tuberculosis
AGRGESLAGQPRGSGSACRA

SEQ ID NO: 1440659 - protein, 17 aa, Mycobacterium tuberculosis
AGRGGGGLCDGGGLGPQ

SEQ ID NO: 1440660 - protein, 10 aa, Mycobacterium tuberculosis
AGRGHASRGD

SEQ ID NO: 1440661 - protein, 8 aa, Mycobacterium tuberculosis
AGRGPGDV

SEQ ID NO: 1440662 - protein, 18 aa, Mycobacterium tuberculosis
AGRGPQTGKARGDTTGAH

SEQ ID NO: 1440663 - protein, 15 aa, Mycobacterium tuberculosis
AGRHHQPRGDRKPRA

SEQ ID NO: 1440664 - protein, 13 aa, Mycobacterium tuberculosis
AGRMRVQATGFQF

SEQ ID NO: 1440665 - protein, 13 aa, Mycobacterium tuberculosis
AGRNAPTVLTPAR

SEQ ID NO: 1440666 - protein, 13 aa, Mycobacterium tuberculosis
AGRNAPTVLTPHA

SEQ ID NO: 1440667 - protein, 22 aa, Mycobacterium tuberculosis
AGRPCGGGRDPRQPDAAAGRSR

SEQ ID NO: 1440668 - protein, 13 aa, Mycobacterium tuberculosis
AGRPGEPAPAVPG

SEQ ID NO: 1440669 - protein, 29 aa, Mycobacterium tuberculosis
AGRPGEVPPNVPGTPVPIPQEAPPGARTL

SEQ ID NO: 1440670 - protein, 11 aa, Mycobacterium tuberculosis
AGRPGPAGPAV

SEQ ID NO: 1440671 - protein, 7 aa, Mycobacterium tuberculosis
AGRPLGT

SEQ ID NO: 1440672 - protein, 19 aa, Mycobacterium tuberculosis
AGRPPADRRRPGSQRAGPL

SEQ ID NO: 1440673 - protein, 6 aa, Mycobacterium tuberculosis
AGRPRA

SEQ ID NO: 1440674 - protein, 6 aa, Mycobacterium tuberculosis
AGRPVQ

SEQ ID NO: 1440675 - protein, 5 aa, Mycobacterium tuberculosis
AGRQG

SEQ ID NO: 1440676 - protein, 10 aa, Mycobacterium tuberculosis
AGRQSSQSVP

SEQ ID NO: 1440677 - protein, 13 aa, Mycobacterium tuberculosis
AGRRAAGFRAGTS

SEQ ID NO: 1440678 - protein, 17 aa, Mycobacterium tuberculosis
AGRRPEHTGSHGKVILL

SEQ ID NO: 1440679 - protein, 7 aa, Mycobacterium tuberculosis
AGRRPKK

SEQ ID NO: 1440680 - protein, 25 aa, Mycobacterium tuberculosis
AGRRPPGQPPRRSDQQPGRSRGRRR

SEQ ID NO: 1440681 - protein, 32 aa, Mycobacterium tuberculosis
AGRRPPRPQPDTPPWPGRPGGHSVGYDSQGRG

SEQ ID NO: 1440682 - protein, 13 aa, Mycobacterium tuberculosis
AGRRSTSSSRMVP

SEQ ID NO: 1440683 - protein, 14 aa, Mycobacterium tuberculosis
AGRRVGPGGRGAGA

SEQ ID NO: 1440684 - protein, 8 aa, Mycobacterium tuberculosis
AGRSAHGW

SEQ ID NO: 1440685 - protein, 32 aa, Mycobacterium tuberculosis
AGRSGGLRAAAGHPAPTSISGPATRGGPGCSS

SEQ ID NO: 1440686 - protein, 5 aa, Mycobacterium tuberculosis
AGRTH

SEQ ID NO: 1440687 - protein, 6 aa, Mycobacterium tuberculosis
AGRVAT

SEQ ID NO: 1440688 - protein, 7 aa, Mycobacterium tuberculosis
AGRVRAE

SEQ ID NO: 1440689 - protein, 6 aa, Mycobacterium tuberculosis
AGRYAA

SEQ ID NO: 1440690 - protein, 14 aa, Mycobacterium tuberculosis
AGRYQRDRGPQPSG

SEQ ID NO: 1440691 - protein, 5 aa, Mycobacterium tuberculosis
AGRYS

SEQ ID NO: 1440692 - protein, 16 aa, Mycobacterium tuberculosis
AGSAASVRTQRERGRP

SEQ ID NO: 1440693 - protein, 5 aa, Mycobacterium tuberculosis
AGSAC

SEQ ID NO: 1440694 - protein, 26 aa, Mycobacterium tuberculosis
AGSADCSSATAATASAGGLGTGPVGA

SEQ ID NO: 1440695 - protein, 41 aa, Mycobacterium tuberculosis
AGSADCSSATAATAVPADSVPDPSALPVGSAGPVEPPSGCS

SEQ ID NO: 1440696 - protein, 44 aa, Mycobacterium tuberculosis
AGSADCSSATAATAVPGGLGTGTRRRYRGDRRPGGAAVGLFGHG

SEQ ID NO: 1440697 - protein, 12 aa, Mycobacterium tuberculosis
AGSARGGPQRDP

SEQ ID NO: 1440698 - protein, 58 aa, Mycobacterium tuberculosis
AGSAVTADATSAAGPAGPAGALAAQQADQAAGPADPADPTGTAATTGTAGLSGGNHQR

SEQ ID NO: 1440699 - protein, 18 aa, Mycobacterium tuberculosis
AGSAVTADATSAAVPAVT

SEQ ID NO: 1440700 - protein, 9 aa, Mycobacterium tuberculosis
AGSDDQKAA

SEQ ID NO: 1440701 - protein, 54 aa, Mycobacterium tuberculosis
AGSDDRAHPAADHPTRASGQLTADLGGQPEGRASHQRTVGQAGQQGRLSRADGV

SEQ ID NO: 1440702 - protein, 5 aa, Mycobacterium tuberculosis
AGSEV

SEQ ID NO: 1440703 - protein, 4 aa, Mycobacterium tuberculosis
AGSF

SEQ ID NO: 1440704 - protein, 4 aa, Mycobacterium tuberculosis
AGSG

SEQ ID NO: 1440705 - protein, 18 aa, Mycobacterium tuberculosis
AGSGGGTGFEGSAGQGGA

SEQ ID NO: 1440706 - protein, 9 aa, Mycobacterium tuberculosis
AGSGQPGPG

SEQ ID NO: 1440707 - protein, 4 aa, Mycobacterium tuberculosis
AGSH

SEQ ID NO: 1440708 - protein, 8 aa, Mycobacterium tuberculosis
AGSHETRI

SEQ ID NO: 1440709 - protein, 6 aa, Mycobacterium tuberculosis
AGSHTL

SEQ ID NO: 1440710 - protein, 7 aa, Mycobacterium tuberculosis
AGSKTQT

SEQ ID NO: 1440711 - protein, 7 aa, Mycobacterium tuberculosis
AGSNNQT

SEQ ID NO: 1440712 - protein, 8 aa, Mycobacterium tuberculosis
AGSNTATT

SEQ ID NO: 1440713 - protein, 6 aa, Mycobacterium tuberculosis
AGSPGR

SEQ ID NO: 1440714 - protein, 14 aa, Mycobacterium tuberculosis
AGSPTTSPPIWSGN

SEQ ID NO: 1440715 - protein, 16 aa, Mycobacterium tuberculosis
AGSPTWPLSPTPTLAG

SEQ ID NO: 1440716 - protein, 13 aa, Mycobacterium tuberculosis
AGSRLAGRKSMPC

SEQ ID NO: 1440717 - protein, 41 aa, Mycobacterium tuberculosis
AGSSASASAVTPFSTPPQIANPTAQGTQAVATAAGTAQSTL

SEQ ID NO: 1440718 - protein, 46 aa, Mycobacterium tuberculosis
AGSSATATKVTPFAPPPNTTSPSAGGSSVRSRKAPAPQPARAERNS

SEQ ID NO: 1440719 - protein, 9 aa, Mycobacterium tuberculosis
AGSSLAGSA

SEQ ID NO: 1440720 - protein, 6 aa, Mycobacterium tuberculosis
AGSSQI

SEQ ID NO: 1440721 - protein, 8 aa, Mycobacterium tuberculosis
AGSSTRYT

SEQ ID NO: 1440722 - protein, 19 aa, Mycobacterium tuberculosis
AGSTRPSSRSTTYGPLSRS

SEQ ID NO: 1440723 - protein, 10 aa, Mycobacterium tuberculosis
AGSVPDPSKW

SEQ ID NO: 1440724 - protein, 9 aa, Mycobacterium tuberculosis
AGTAAPDEI

SEQ ID NO: 1440725 - protein, 13 aa, Mycobacterium tuberculosis
AGTAPCASSTVPT

SEQ ID NO: 1440726 - protein, 36 aa, Mycobacterium tuberculosis
AGTASAAGAPGLRDPDAPTRGGVAPSPPAPDCIILG

SEQ ID NO: 1440727 - protein, 17 aa, Mycobacterium tuberculosis
AGTASPPSSPAGSGSGW

SEQ ID NO: 1440728 - protein, 4 aa, Mycobacterium tuberculosis
AGTD

SEQ ID NO: 1440729 - protein, 15 aa, Mycobacterium tuberculosis
AGTDGSVTYDRGSDG

SEQ ID NO: 1440730 - protein, 18 aa, Mycobacterium tuberculosis
AGTDRPDGYRAILESHRR

SEQ ID NO: 1440731 - protein, 5 aa, Mycobacterium tuberculosis
AGTDT

SEQ ID NO: 1440732 - protein, 28 aa, Mycobacterium tuberculosis
AGTEPRPPAGAAPGAAPSPAAPRPGPQR

SEQ ID NO: 1440733 - protein, 22 aa, Mycobacterium tuberculosis
AGTGDTESFGGHGGAGGDGGAV

SEQ ID NO: 1440734 - protein, 15 aa, Mycobacterium tuberculosis
AGTGGAGGPGGAGGL

SEQ ID NO: 1440735 - protein, 52 aa, Mycobacterium tuberculosis
AGTGGDGGVGGTGAAGGKAGAGGSGGVNGATGADGAKGLDGATGGKGNNGNP

SEQ ID NO: 1440736 - protein, 53 aa, Mycobacterium tuberculosis
AGTGGEGGTGGAAGAGGAAGARGALTSGGLAGGVGAGGTGGTGGTGGNGADAA

SEQ ID NO: 1440737 - protein, 19 aa, Mycobacterium tuberculosis
AGTGGHGAAGGVPAGAIGS

SEQ ID NO: 1440738 - protein, 9 aa, Mycobacterium tuberculosis
AGTGGNGGF

SEQ ID NO: 1440739 - protein, 77 aa, Mycobacterium tuberculosis
AGTGGTGGNGGTGGTGGAGGAGGTGSTLGATGATGAAGRAGNGGVGGSGGLGSAFGPGGTGGMGGAGGTSTVSAGGD

SEQ ID NO: 1440740 - protein, 13 aa, Mycobacterium tuberculosis
AGTGSVGVGGAGG

SEQ ID NO: 1440741 - protein, 21 aa, Mycobacterium tuberculosis
AGTGVAGGFGAGTGGSGGVGG

SEQ ID NO: 1440742 - protein, 26 aa, Mycobacterium tuberculosis
AGTGVAPTAVAAPGDAGLSQEGEPFP

SEQ ID NO: 1440743 - protein, 121 aa, Mycobacterium tuberculosis
AGTNPTPIGTAAPGSDGVNQIGNGGNTDLTGGAGGDGNAGSTTVNGGNGGTGGAARNSSGGTGNSFGGAGGAGGDGANGGDGGAGGEALTEGGATAVSGAGGKGGNAEASGGAGGNGGKKW

SEQ ID NO: 1440744 - protein, 164 aa, Mycobacterium tuberculosis
AGTNPTPIGTAAPGSDGVNQIGNGGNTDLTGGAGGDGNAGSTTVNGGNGGTGGAPRNSSGGTGNSFGGAGGAGGDGANGGDGGAGGEALTEGGATAVSGAGGKGGNAEASGGAGGNGGKGGFAQATTSVTGGNGVNGSNGHDSNAPGGAGGSGGVRGDGGRGGL

SEQ ID NO: 1440745 - protein, 55 aa, Mycobacterium tuberculosis
AGTNPTPIGTAAPGSDGVNQIGNGGNTDLTGGAGGDGNAGSTTVNGGNGGYRAGA

SEQ ID NO: 1440746 - protein, 8 aa, Mycobacterium tuberculosis
AGTPATTM

SEQ ID NO: 1440747 - protein, 28 aa, Mycobacterium tuberculosis
AGTPGAAGTGGDGGVGGTGAAGGERRGR

SEQ ID NO: 1440748 - protein, 66 aa, Mycobacterium tuberculosis
AGTPGAAGTGGDGGVGGTGAAGGKGGAGGSGGVNGATGPTAPRASTVPPAAKATTATPAESGFTES

SEQ ID NO: 1440749 - protein, 17 aa, Mycobacterium tuberculosis
AGTPPITPEMVRRALDK

SEQ ID NO: 1440750 - protein, 8 aa, Mycobacterium tuberculosis
AGTPRRRR

SEQ ID NO: 1440751 - protein, 21 aa, Mycobacterium tuberculosis
AGTPSQAAIEADTRSAGQRHH

SEQ ID NO: 1440752 - protein, 6 aa, Mycobacterium tuberculosis
AGTQGL

SEQ ID NO: 1440753 - protein, 10 aa, Mycobacterium tuberculosis
AGTRDADMAA

SEQ ID NO: 1440754 - protein, 28 aa, Mycobacterium tuberculosis
AGTRYQPLPQHRGAAHRGGPRCGVHHPV

SEQ ID NO: 1440755 - protein, 16 aa, Mycobacterium tuberculosis
AGTSPRWPAGAAGRSL

SEQ ID NO: 1440756 - protein, 4 aa, Mycobacterium tuberculosis
AGTV

SEQ ID NO: 1440757 - protein, 14 aa, Mycobacterium tuberculosis
AGTVDHRADRRRGV

SEQ ID NO: 1440758 - protein, 8 aa, Mycobacterium tuberculosis
AGVDPDRL

SEQ ID NO: 1440759 - protein, 7 aa, Mycobacterium tuberculosis
AGVEAST

SEQ ID NO: 1440760 - protein, 4 aa, Mycobacterium tuberculosis
AGVG

SEQ ID NO: 1440761 - protein, 25 aa, Mycobacterium tuberculosis
AGVGDGDASSGSPLRARSGPGEGRA

SEQ ID NO: 1440762 - protein, 64 aa, Mycobacterium tuberculosis
AGVGGGSANPPDAADAGADQSEGIAARSRHGRRYQPKRRPPGPPAPPAPPSSPTPNPPAPPDAA

SEQ ID NO: 1440763 - protein, 7 aa, Mycobacterium tuberculosis
AGVPGGN

SEQ ID NO: 1440764 - protein, 16 aa, Mycobacterium tuberculosis
AGVRPDQIDVFVPHQA

SEQ ID NO: 1440765 - protein, 29 aa, Mycobacterium tuberculosis
AGVTTDAAAPAAKLPGDQAQSSASKATRL

SEQ ID NO: 1440766 - protein, 12 aa, Mycobacterium tuberculosis
AGYRDDSPAGHA

SEQ ID NO: 1440767 - protein, 7 aa, Mycobacterium tuberculosis
AGYTGHS

SEQ ID NO: 1440768 - protein, 13 aa, Mycobacterium tuberculosis
AHAAGATHRDVKP

SEQ ID NO: 1440769 - protein, 10 aa, Mycobacterium tuberculosis
AHAEAANAAR

SEQ ID NO: 1440770 - protein, 4 aa, Mycobacterium tuberculosis
AHAG

SEQ ID NO: 1440771 - protein, 13 aa, Mycobacterium tuberculosis
AHASAGAAASAVS

SEQ ID NO: 1440772 - protein, 15 aa, Mycobacterium tuberculosis
AHDPAKSFRRRRSCP

SEQ ID NO: 1440773 - protein, 6 aa, Mycobacterium tuberculosis
AHERTD

SEQ ID NO: 1440774 - protein, 10 aa, Mycobacterium tuberculosis
AHGGPGGRPG

SEQ ID NO: 1440775 - protein, 5 aa, Mycobacterium tuberculosis
AHGGQ

SEQ ID NO: 1440776 - protein, 123 aa, Mycobacterium tuberculosis
AHGPAGATPTSGGNGGDGGIGATANSPLQAGGAGGNGGHGGLVGNGGTGGAGGAGHAGSTGATGTALQPTGGNGTNGGAGGHGGNGGNGGAQHGDGGVGGKGGAGGSGGAGGNGFDAATLGSP

SEQ ID NO: 1440777 - protein, 6 aa, Mycobacterium tuberculosis
AHGQLG

SEQ ID NO: 1440778 - protein, 17 aa, Mycobacterium tuberculosis
AHGSELQKKKFLPAILG

SEQ ID NO: 1440779 - protein, 5 aa, Mycobacterium tuberculosis
AHGTG

SEQ ID NO: 1440780 - protein, 29 aa, Mycobacterium tuberculosis
AHHPGRSGHHTRPADRAERGTAECREWVA

SEQ ID NO: 1440781 - protein, 10 aa, Mycobacterium tuberculosis
AHNPPAGVDN

SEQ ID NO: 1440782 - protein, 11 aa, Mycobacterium tuberculosis
AHPEFQPRAGS

SEQ ID NO: 1440783 - protein, 7 aa, Mycobacterium tuberculosis
AHPGDAK

SEQ ID NO: 1440784 - protein, 6 aa, Mycobacterium tuberculosis
AHPGVN

SEQ ID NO: 1440785 - protein, 9 aa, Mycobacterium tuberculosis
AHPKARDMA

SEQ ID NO: 1440786 - protein, 22 aa, Mycobacterium tuberculosis
AHPLQQARQRPPPNQRHDHDPN

SEQ ID NO: 1440787 - protein, 36 aa, Mycobacterium tuberculosis
AHPPRRPSDRGNRPVPPPKKSRVSSRSTPSVPSTGS

SEQ ID NO: 1440788 - protein, 5 aa, Mycobacterium tuberculosis
AHQAG

SEQ ID NO: 1440789 - protein, 5 aa, Mycobacterium tuberculosis
AHQRQ

SEQ ID NO: 1440790 - protein, 27 aa, Mycobacterium tuberculosis
AHQSRGGRQIAGDRGEVERRDRVDETV

SEQ ID NO: 1440791 - protein, 6 aa, Mycobacterium tuberculosis
AHRAGR

SEQ ID NO: 1440792 - protein, 17 aa, Mycobacterium tuberculosis
AHRDEASRPQVTARPSA

SEQ ID NO: 1440793 - protein, 7 aa, Mycobacterium tuberculosis
AHREHGV

SEQ ID NO: 1440794 - protein, 31 aa, Mycobacterium tuberculosis
AHRGRDHPAVADGRRAAQADHRARGRRQGRF

SEQ ID NO: 1440795 - protein, 6 aa, Mycobacterium tuberculosis
AHRPSR

SEQ ID NO: 1440796 - protein, 20 aa, Mycobacterium tuberculosis
AHRRTSGDACGPVAKRGRGR

SEQ ID NO: 1440797 - protein, 6 aa, Mycobacterium tuberculosis
AHRTGA

SEQ ID NO: 1440798 - protein, 18 aa, Mycobacterium tuberculosis
AHSGPGSPPSAPSAPAAA

SEQ ID NO: 1440799 - protein, 15 aa, Mycobacterium tuberculosis
AHSGPLSIVRPSLRR

SEQ ID NO: 1440800 - protein, 15 aa, Mycobacterium tuberculosis
AHSRPSAARRRPQVD

SEQ ID NO: 1440801 - protein, 12 aa, Mycobacterium tuberculosis
AHTAGERTVTDH

SEQ ID NO: 1440802 - protein, 6 aa, Mycobacterium tuberculosis
AHTDRL

SEQ ID NO: 1440803 - protein, 8 aa, Mycobacterium tuberculosis
AHTGANSD

SEQ ID NO: 1440804 - protein, 25 aa, Mycobacterium tuberculosis
AIAAGTGATLAPPAPPSPPLPTSRT

SEQ ID NO: 1440805 - protein, 6 aa, Mycobacterium tuberculosis
AIAATE

SEQ ID NO: 1440806 - protein, 16 aa, Mycobacterium tuberculosis
AIADGDSVTILPTVAG

SEQ ID NO: 1440807 - protein, 18 aa, Mycobacterium tuberculosis
AIAPGESAYDNTHAASDI

SEQ ID NO: 1440808 - protein, 22 aa, Mycobacterium tuberculosis
AIDASPVRAYDKAAEADMIAQI

SEQ ID NO: 1440809 - protein, 13 aa, Mycobacterium tuberculosis
AIEPADLDDPDAV

SEQ ID NO: 1440810 - protein, 13 aa, Mycobacterium tuberculosis
AIGAANAAAGAPT

SEQ ID NO: 1440811 - protein, 15 aa, Mycobacterium tuberculosis
AIGEQGDDPHPPVCM

SEQ ID NO: 1440812 - protein, 25 aa, Mycobacterium tuberculosis
AIGPGGAGSSPCRGRAPTATTMPRR

SEQ ID NO: 1440813 - protein, 25 aa, Mycobacterium tuberculosis
AIGPGRAVPRPAGGARRRPRPCRVG

SEQ ID NO: 1440814 - protein, 8 aa, Mycobacterium tuberculosis
AIGRGDPS

SEQ ID NO: 1440815 - protein, 12 aa, Mycobacterium tuberculosis
AIGRPEDFSEPP

SEQ ID NO: 1440816 - protein, 5 aa, Mycobacterium tuberculosis
AIPDR

SEQ ID NO: 1440817 - protein, 6 aa, Mycobacterium tuberculosis
AIPEDY

SEQ ID NO: 1440818 - protein, 13 aa, Mycobacterium tuberculosis
AIPTTTSGKLKRR

SEQ ID NO: 1440819 - protein, 14 aa, Mycobacterium tuberculosis
AIRAPGARVTSPGV

SEQ ID NO: 1440820 - protein, 6 aa, Mycobacterium tuberculosis
AITGEN

SEQ ID NO: 1440821 - protein, 7 aa, Mycobacterium tuberculosis
AITGKST

SEQ ID NO: 1440822 - protein, 8 aa, Mycobacterium tuberculosis
AITGSGDD

SEQ ID NO: 1440823 - protein, 7 aa, Mycobacterium tuberculosis
AITNPGH

SEQ ID NO: 1440824 - protein, 9 aa, Mycobacterium tuberculosis
AIYGSGLPS

SEQ ID NO: 1440825 - protein, 17 aa, Mycobacterium tuberculosis
AKAAASGCYGGQGGDGC

SEQ ID NO: 1440826 - protein, 13 aa, Mycobacterium tuberculosis
AKALSGELSRETL

SEQ ID NO: 1440827 - protein, 12 aa, Mycobacterium tuberculosis
AKASEKARKSVA

SEQ ID NO: 1440828 - protein, 8 aa, Mycobacterium tuberculosis
AKDGTRMR

SEQ ID NO: 1440829 - protein, 16 aa, Mycobacterium tuberculosis
AKDHQDRRDRCWRRAD

SEQ ID NO: 1440830 - protein, 8 aa, Mycobacterium tuberculosis
AKERLSTD

SEQ ID NO: 1440831 - protein, 11 aa, Mycobacterium tuberculosis
AKETRDERCSN

SEQ ID NO: 1440832 - protein, 18 aa, Mycobacterium tuberculosis
AKGGPGGRPGCGPLPDAT

SEQ ID NO: 1440833 - protein, 16 aa, Mycobacterium tuberculosis
AKGKEARGTGNAAATV

SEQ ID NO: 1440834 - protein, 28 aa, Mycobacterium tuberculosis
AKGLPTATAATGFPKPPPGSPRVPAGRP

SEQ ID NO: 1440835 - protein, 4 aa, Mycobacterium tuberculosis
AKGN

SEQ ID NO: 1440836 - protein, 5 aa, Mycobacterium tuberculosis
AKHRR

SEQ ID NO: 1440837 - protein, 8 aa, Mycobacterium tuberculosis
AKIGYPPT

SEQ ID NO: 1440838 - protein, 13 aa, Mycobacterium tuberculosis
AKKPEDRYASAGD

SEQ ID NO: 1440839 - protein, 10 aa, Mycobacterium tuberculosis
AKLSDGSERD

SEQ ID NO: 1440840 - protein, 6 aa, Mycobacterium tuberculosis
AKLSDT

SEQ ID NO: 1440841 - protein, 15 aa, Mycobacterium tuberculosis
AKLSRVSGRGNPPDI

SEQ ID NO: 1440842 - protein, 9 aa, Mycobacterium tuberculosis
AKNEAAAGV

SEQ ID NO: 1440843 - protein, 8 aa, Mycobacterium tuberculosis
AKNPEDRY

SEQ ID NO: 1440844 - protein, 8 aa, Mycobacterium tuberculosis
AKNRDPIA

SEQ ID NO: 1440845 - protein, 8 aa, Mycobacterium tuberculosis
AKPAAAAS

SEQ ID NO: 1440846 - protein, 9 aa, Mycobacterium tuberculosis
AKPDAQALT

SEQ ID NO: 1440847 - protein, 8 aa, Mycobacterium tuberculosis
AKPGARFR

SEQ ID NO: 1440848 - protein, 7 aa, Mycobacterium tuberculosis
AKPNGEL

SEQ ID NO: 1440849 - protein, 14 aa, Mycobacterium tuberculosis
AKPPSTSAVASRTG

SEQ ID NO: 1440850 - protein, 7 aa, Mycobacterium tuberculosis
AKPQRID

SEQ ID NO: 1440851 - protein, 25 aa, Mycobacterium tuberculosis
AKPTRHARERAHRPYQSEGGLQPTS

SEQ ID NO: 1440852 - protein, 7 aa, Mycobacterium tuberculosis
AKPVGTL

SEQ ID NO: 1440853 - protein, 6 aa, Mycobacterium tuberculosis
AKQAAP

SEQ ID NO: 1440854 - protein, 6 aa, Mycobacterium tuberculosis
AKRAIG

SEQ ID NO: 1440855 - protein, 15 aa, Mycobacterium tuberculosis
AKRDNSGFCRSTPPP

SEQ ID NO: 1440856 - protein, 7 aa, Mycobacterium tuberculosis
AKREKQK

SEQ ID NO: 1440857 - protein, 11 aa, Mycobacterium tuberculosis
AKRLGDDRRPL

SEQ ID NO: 1440858 - protein, 53 aa, Mycobacterium tuberculosis
AKRPGAKKTPPPAPGLAEPAAQPQPEAKPQPEPAAPPKPQTDGDPAAPAAPVK

SEQ ID NO: 1440859 - protein, 15 aa, Mycobacterium tuberculosis
AKRQQPNKGHPITTL

SEQ ID NO: 1440860 - protein, 23 aa, Mycobacterium tuberculosis
AKRRVAEAADLGQRRALTGEPLP

SEQ ID NO: 1440861 - protein, 9 aa, Mycobacterium tuberculosis
AKSAQFSAS

SEQ ID NO: 1440862 - protein, 17 aa, Mycobacterium tuberculosis
AKSPASSDGPRRAERPA

SEQ ID NO: 1440863 - protein, 8 aa, Mycobacterium tuberculosis
AKSPISGT

SEQ ID NO: 1440864 - protein, 34 aa, Mycobacterium tuberculosis
AKTDEDKLSGRVGPVGRRRPDTADRAKSRDPSGR

SEQ ID NO: 1440865 - protein, 10 aa, Mycobacterium tuberculosis
AKTPDDRTQI

SEQ ID NO: 1440866 - protein, 10 aa, Mycobacterium tuberculosis
AKVPEATGGV

SEQ ID NO: 1440867 - protein, 9 aa, Mycobacterium tuberculosis
AKVSGAERL

SEQ ID NO: 1440868 - protein, 19 aa, Mycobacterium tuberculosis
AKVTKTTLTPNRRPGMAVA

SEQ ID NO: 1440869 - protein, 12 aa, Mycobacterium tuberculosis
ALADAGARLTLA

SEQ ID NO: 1440870 - protein, 16 aa, Mycobacterium tuberculosis
ALAEESRESGWDKPSF

SEQ ID NO: 1440871 - protein, 6 aa, Mycobacterium tuberculosis
ALAGPG

SEQ ID NO: 1440872 - protein, 39 aa, Mycobacterium tuberculosis
ALAGTAGGCSATAVSAERAEPAGGAGGTGGNPAWLLGGG

SEQ ID NO: 1440873 - protein, 29 aa, Mycobacterium tuberculosis
ALAPGSISRATRRSAASISARRASRSPAS

SEQ ID NO: 1440874 - protein, 13 aa, Mycobacterium tuberculosis
ALAPREHPDESLA

SEQ ID NO: 1440875 - protein, 11 aa, Mycobacterium tuberculosis
ALAPSADNRRE

SEQ ID NO: 1440876 - protein, 18 aa, Mycobacterium tuberculosis
ALDAPTSSTRSAPRCRCW

SEQ ID NO: 1440877 - protein, 5 aa, Mycobacterium tuberculosis
ALDDE

SEQ ID NO: 1440878 - protein, 26 aa, Mycobacterium tuberculosis
ALDNPGARVRPGRNGLAQGGAHRGCA

SEQ ID NO: 1440879 - protein, 16 aa, Mycobacterium tuberculosis
ALDPPQVAEPHTRPPI

SEQ ID NO: 1440880 - protein, 6 aa, Mycobacterium tuberculosis
ALEPQG

SEQ ID NO: 1440881 - protein, 4 aa, Mycobacterium tuberculosis
ALEQ

SEQ ID NO: 1440882 - protein, 32 aa, Mycobacterium tuberculosis
ALGAAPDPRLSGPEPALAPEAPATPAVKPPAA

SEQ ID NO: 1440883 - protein, 6 aa, Mycobacterium tuberculosis
ALGDQM

SEQ ID NO: 1440884 - protein, 21 aa, Mycobacterium tuberculosis
ALGDTQGGRVRADLGRSCAPP

SEQ ID NO: 1440885 - protein, 26 aa, Mycobacterium tuberculosis
ALGGNGGGGGVGGNAGAGGTGGSAGW

SEQ ID NO: 1440886 - protein, 10 aa, Mycobacterium tuberculosis
ALGGPGPQHV

SEQ ID NO: 1440887 - protein, 12 aa, Mycobacterium tuberculosis
ALGGQECRRRRV

SEQ ID NO: 1440888 - protein, 12 aa, Mycobacterium tuberculosis
ALGNGISSTAYD

SEQ ID NO: 1440889 - protein, 30 aa, Mycobacterium tuberculosis
ALGRGDDRKRGEAGRGGSSPIELGAPGSVD

SEQ ID NO: 1440890 - protein, 35 aa, Mycobacterium tuberculosis
ALGSPAAVGRPIPVPTANTAAARHDTERKKAIVCA

SEQ ID NO: 1440891 - protein, 25 aa, Mycobacterium tuberculosis
ALNEGSGKQPTAGRPGHRRPAGGEC

SEQ ID NO: 1440892 - protein, 8 aa, Mycobacterium tuberculosis
ALNGTKNI

SEQ ID NO: 1440893 - protein, 22 aa, Mycobacterium tuberculosis
ALNNADTIRDRARQRAAARHGA

SEQ ID NO: 1440894 - protein, 58 aa, Mycobacterium tuberculosis
ALNPPAPPAPPLANSPPLPPAPPTPAGTPPAAPWPPVPAAPKSKPASPPRPPAPPMPA

SEQ ID NO: 1440895 - protein, 9 aa, Mycobacterium tuberculosis
ALPAGLPPL

SEQ ID NO: 1440896 - protein, 13 aa, Mycobacterium tuberculosis
ALPAPPAPPWPPV

SEQ ID NO: 1440897 - protein, 16 aa, Mycobacterium tuberculosis
ALPAPPPLPGPPPLPA

SEQ ID NO: 1440898 - protein, 8 aa, Mycobacterium tuberculosis
ALPGDRTR

SEQ ID NO: 1440899 - protein, 13 aa, Mycobacterium tuberculosis
ALPKSSAGHSRVR

SEQ ID NO: 1440900 - protein, 5 aa, Mycobacterium tuberculosis
ALPNL

SEQ ID NO: 1440901 - protein, 23 aa, Mycobacterium tuberculosis
ALPNPTLPRPGTPAVRPELPTPT

SEQ ID NO: 1440902 - protein, 48 aa, Mycobacterium tuberculosis
ALPPAPPAWLGPPAAPLPPLPYSNPPGPPACPGVDPSAPLPISGRPSS

SEQ ID NO: 1440903 - protein, 17 aa, Mycobacterium tuberculosis
ALPPAPPPGLGPPAAPF

SEQ ID NO: 1440904 - protein, 6 aa, Mycobacterium tuberculosis
ALPQGH

SEQ ID NO: 1440905 - protein, 14 aa, Mycobacterium tuberculosis
ALPQSGPTADAAAL

SEQ ID NO: 1440906 - protein, 4 aa, Mycobacterium tuberculosis
ALPR

SEQ ID NO: 1440907 - protein, 16 aa, Mycobacterium tuberculosis
ALPSEKEIARRSEAGI

SEQ ID NO: 1440908 - protein, 7 aa, Mycobacterium tuberculosis
ALPSGAS

SEQ ID NO: 1440909 - protein, 21 aa, Mycobacterium tuberculosis
ALPSPDEQAPAKAPPSPYPAR

SEQ ID NO: 1440910 - protein, 14 aa, Mycobacterium tuberculosis
ALPTGSTATAGSTV

SEQ ID NO: 1440911 - protein, 5 aa, Mycobacterium tuberculosis
ALPTR

SEQ ID NO: 1440912 - protein, 5 aa, Mycobacterium tuberculosis
ALPTS

SEQ ID NO: 1440913 - protein, 5 aa, Mycobacterium tuberculosis
ALPVP

SEQ ID NO: 1440914 - protein, 5 aa, Mycobacterium tuberculosis
ALQNG

SEQ ID NO: 1440915 - protein, 9 aa, Mycobacterium tuberculosis
ALQPPGNPL

SEQ ID NO: 1440916 - protein, 4 aa, Mycobacterium tuberculosis
ALRA

SEQ ID NO: 1440917 - protein, 6 aa, Mycobacterium tuberculosis
ALRADA

SEQ ID NO: 1440918 - protein, 13 aa, Mycobacterium tuberculosis
ALRGGSGRSATAD

SEQ ID NO: 1440919 - protein, 25 aa, Mycobacterium tuberculosis
ALRPPKNKCGPTSTPSPLCCRRIRT

SEQ ID NO: 1440920 - protein, 10 aa, Mycobacterium tuberculosis
ALSDPDQDHA

SEQ ID NO: 1440921 - protein, 12 aa, Mycobacterium tuberculosis
ALSRAPETYLTQ

SEQ ID NO: 1440922 - protein, 8 aa, Mycobacterium tuberculosis
ALSSTGQC

SEQ ID NO: 1440923 - protein, 10 aa, Mycobacterium tuberculosis
ALSSVQGEYG

SEQ ID NO: 1440924 - protein, 12 aa, Mycobacterium tuberculosis
ALSTSLDDAGPW

SEQ ID NO: 1440925 - protein, 194 aa, Mycobacterium tuberculosis
ALTGGAGDTRSAVSAGTTVPAHAQQPGRTPDTAVSTHTTDRAGPAGTSVPAGPVEGPAQATGTTGTADPAGPAGPAGPAGSADPEQSGVAAGPAGCPAQQALPAGPADSTIAQQPAAATPGPTGGAGPTGPTGPAGAEQPGGPAGPADLAGRARAAGPTVAPQDPAGPAGLPGAGCSSRPITDQRATQQRLGGR

SEQ ID NO: 1440926 - protein, 9 aa, Mycobacterium tuberculosis
ALTGPSRRR

SEQ ID NO: 1440927 - protein, 9 aa, Mycobacterium tuberculosis
ALTSPQRLP

SEQ ID NO: 1440928 - protein, 7 aa, Mycobacterium tuberculosis
ALTVGEG

SEQ ID NO: 1440929 - protein, 8 aa, Mycobacterium tuberculosis
AMETDAET

SEQ ID NO: 1440930 - protein, 34 aa, Mycobacterium tuberculosis
AMGGSRAGLPSVPASTTPDRGAGKAGRRFVRLRN

SEQ ID NO: 1440931 - protein, 9 aa, Mycobacterium tuberculosis
AMKTQDKLR

SEQ ID NO: 1440932 - protein, 9 aa, Mycobacterium tuberculosis
AMNGRPKSM

SEQ ID NO: 1440933 - protein, 7 aa, Mycobacterium tuberculosis
AMPPGPL

SEQ ID NO: 1440934 - protein, 6 aa, Mycobacterium tuberculosis
AMPPSS

SEQ ID NO: 1440935 - protein, 15 aa, Mycobacterium tuberculosis
AMRERSELARKGIAR

SEQ ID NO: 1440936 - protein, 12 aa, Mycobacterium tuberculosis
AMSEGPKKAGVL

SEQ ID NO: 1440937 - protein, 16 aa, Mycobacterium tuberculosis
AMSNGRTDSRFTEAKR

SEQ ID NO: 1440938 - protein, 5 aa, Mycobacterium tuberculosis
AMTAR

SEQ ID NO: 1440939 - protein, 15 aa, Mycobacterium tuberculosis
AMTSDPGVAQRATAR

SEQ ID NO: 1440940 - protein, 11 aa, Mycobacterium tuberculosis
ANAAAAAPTAG

SEQ ID NO: 1440941 - protein, 9 aa, Mycobacterium tuberculosis
ANAAAAGPT

SEQ ID NO: 1440942 - protein, 11 aa, Mycobacterium tuberculosis
ANAGSYNTGSL

SEQ ID NO: 1440943 - protein, 7 aa, Mycobacterium tuberculosis
ANALPRR

SEQ ID NO: 1440944 - protein, 18 aa, Mycobacterium tuberculosis
ANDAKSSSTWSGGTRRSW

SEQ ID NO: 1440945 - protein, 10 aa, Mycobacterium tuberculosis
ANDDEPLGLP

SEQ ID NO: 1440946 - protein, 6 aa, Mycobacterium tuberculosis
ANDIQA

SEQ ID NO: 1440947 - protein, 17 aa, Mycobacterium tuberculosis
ANDPRFGASRSRVANRS

SEQ ID NO: 1440948 - protein, 7 aa, Mycobacterium tuberculosis
ANDPTSV

SEQ ID NO: 1440949 - protein, 4 aa, Mycobacterium tuberculosis
ANEH

SEQ ID NO: 1440950 - protein, 10 aa, Mycobacterium tuberculosis
ANGAGGNPVA

SEQ ID NO: 1440951 - protein, 492 aa, Mycobacterium tuberculosis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGHGGNGTGGVNGADNTLNPDTPGGAGEPGGAGGAGGAGGAAGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNGGNAGAGGNGGSGDFGGNTTSGASGSGGNGGNAGTAGSGGAGGTGGTGLSGGNGGNGGNGGNGGDGGNGAHGTV

SEQ ID NO: 1440952 - protein, 374 aa, Mycobacterium tuberculosis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKCGDGGDGGAGGAGGNAGGAGGNGGAGGQGGNAGQGGAGGAGGNAVIPGDGVGKAPHGDAGGSGGYGGKSGQGGSGGTGGSGAP

SEQ ID NO: 1440953 - protein, 498 aa, Mycobacterium tuberculosis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNGGNAGAGGNGGSGDFGGNTTSGASGSGGNGGNAGTAGSGGAGGTGGTGLSGGNGGNGGNGGNGGDGGNGAHGTV

SEQ ID NO: 1440954 - protein, 492 aa, Mycobacterium tuberculosis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAAGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNGGNAGAGGNGGSGDFGGNTTSGASGSGGNGGNAGTAGSGGAGGTGGTGLSGGNGGNGGNGGNGGDGGNGAHGTV

SEQ ID NO: 1440955 - protein, 498 aa, Mycobacterium tuberculosis
ANGDPGFAGGKGGNGGIGGAAVTGGVAGDGGTGGKGGTGGAGGAGNDAGSTGNPGGKGGDGGIGGAGGAGGAAGTGNGGHAGNTGDGGDGGTGGNGGNGTGGVNGADNTLNPDTPGGAGEPGGAGGAGGAGGAGGGPGGTGGTGGNGGNGGNGGNGGNGGNGGNGGNAGNNSTNAPVGGEGGAGGDGGAGGAGGAANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGDAGGSGGDGGKGGQGGSGGTGGSGAPIGGGAGGTGGSGGHAGKGGAGGIGAQGTTITVPGNGGNAGDGGNGGNAGAGGNGGSGDFGGNTTSGASGSGGNGGNAGTAGSGGAGGTGGTGLSGGNGGNGGNGGNGGDGGNGAHGTV

SEQ ID NO: 1440956 - protein, 5 aa, Mycobacterium tuberculosis
ANGDR

SEQ ID NO: 1440957 - protein, 32 aa, Mycobacterium tuberculosis
ANGGAGGNGGIGGAGPQPSLSAGHGGNGRQRP

SEQ ID NO: 1440958 - protein, 12 aa, Mycobacterium tuberculosis
ANGGATDARGTA

SEQ ID NO: 1440959 - protein, 13 aa, Mycobacterium tuberculosis
ANGINRDALADAA

SEQ ID NO: 1440960 - protein, 7 aa, Mycobacterium tuberculosis
ANGPERD

SEQ ID NO: 1440961 - protein, 7 aa, Mycobacterium tuberculosis
ANIGSSN

SEQ ID NO: 1440962 - protein, 13 aa, Mycobacterium tuberculosis
ANKPSDVSNSSAR

SEQ ID NO: 1440963 - protein, 8 aa, Mycobacterium tuberculosis
ANKRPATS

SEQ ID NO: 1440964 - protein, 9 aa, Mycobacterium tuberculosis
ANLAPTRID

SEQ ID NO: 1440965 - protein, 5 aa, Mycobacterium tuberculosis
ANPAA

SEQ ID NO: 1440966 - protein, 26 aa, Mycobacterium tuberculosis
ANPAPGDNAARKAGRGGARQSPQSRV

SEQ ID NO: 1440967 - protein, 41 aa, Mycobacterium tuberculosis
ANPAPGDNAARKTAEEEPGNHPRAGCSGSPPSAPWRSQTPR

SEQ ID NO: 1440968 - protein, 8 aa, Mycobacterium tuberculosis
ANPAQSVQ

SEQ ID NO: 1440969 - protein, 7 aa, Mycobacterium tuberculosis
ANPKLPG

SEQ ID NO: 1440970 - protein, 43 aa, Mycobacterium tuberculosis
ANPPFPPSPPRPPGAPAPPMPPLPPAPPAPPLPINPALLPAPR

SEQ ID NO: 1440971 - protein, 6 aa, Mycobacterium tuberculosis
ANPRER

SEQ ID NO: 1440972 - protein, 12 aa, Mycobacterium tuberculosis
ANPVDPARISAG

SEQ ID NO: 1440973 - protein, 12 aa, Mycobacterium tuberculosis
ANPVRASRPPCT

SEQ ID NO: 1440974 - protein, 5 aa, Mycobacterium tuberculosis
ANQLP

SEQ ID NO: 1440975 - protein, 6 aa, Mycobacterium tuberculosis
ANQQAA

SEQ ID NO: 1440976 - protein, 7 aa, Mycobacterium tuberculosis
ANRDDRV

SEQ ID NO: 1440977 - protein, 4 aa, Mycobacterium tuberculosis
ANRS

SEQ ID NO: 1440978 - protein, 13 aa, Mycobacterium tuberculosis
ANSAAAAQTTAVA

SEQ ID NO: 1440979 - protein, 9 aa, Mycobacterium tuberculosis
ANSDARPAA

SEQ ID NO: 1440980 - protein, 11 aa, Mycobacterium tuberculosis
ANSGNINTGFG

SEQ ID NO: 1440981 - protein, 7 aa, Mycobacterium tuberculosis
ANSGQPI

SEQ ID NO: 1440982 - protein, 6 aa, Mycobacterium tuberculosis
ANSGSL

SEQ ID NO: 1440983 - protein, 8 aa, Mycobacterium tuberculosis
ANSRDSPH

SEQ ID NO: 1440984 - protein, 10 aa, Mycobacterium tuberculosis
ANSSPGRPNG

SEQ ID NO: 1440985 - protein, 12 aa, Mycobacterium tuberculosis
ANTKARSPIRAK

SEQ ID NO: 1440986 - protein, 16 aa, Mycobacterium tuberculosis
ANTSWTDNTGQPRRAA

SEQ ID NO: 1440987 - protein, 22 aa, Mycobacterium tuberculosis
ANYPPDDANYRRSRRPPPMPSA

SEQ ID NO: 1440988 - protein, 5 aa, Mycobacterium tuberculosis
APAAA

SEQ ID NO: 1440989 - protein, 14 aa, Mycobacterium tuberculosis
APAAAQAVETAAQN

SEQ ID NO: 1440990 - protein, 12 aa, Mycobacterium tuberculosis
APAADPRGRSDC

SEQ ID NO: 1440991 - protein, 14 aa, Mycobacterium tuberculosis
APAANGGNGGAGGT

SEQ ID NO: 1440992 - protein, 8 aa, Mycobacterium tuberculosis
APAAPRRP

SEQ ID NO: 1440993 - protein, 50 aa, Mycobacterium tuberculosis
APAAPVGPAESGTPAQAGSAATAGRPGCSEPVASAGPAGQASTVAPAGPA

SEQ ID NO: 1440994 - protein, 52 aa, Mycobacterium tuberculosis
APAAPVGPAESGTPAQAGSAATAGRPGCSEPVASAGPAGQASTVAPAGPAVA

SEQ ID NO: 1440995 - protein, 16 aa, Mycobacterium tuberculosis
APAARPKSTCAQVTTS

SEQ ID NO: 1440996 - protein, 15 aa, Mycobacterium tuberculosis
APAASSAGGGAGGRA

SEQ ID NO: 1440997 - protein, 19 aa, Mycobacterium tuberculosis
APAETAALAPARAARAATV

SEQ ID NO: 1440998 - protein, 25 aa, Mycobacterium tuberculosis
APAGKGGTGGVGGDGGGGGAGGGGG

SEQ ID NO: 1440999 - protein, 8 aa, Mycobacterium tuberculosis
APAGPSAV

SEQ ID NO: 1441000 - protein, 18 aa, Mycobacterium tuberculosis
APAGPVGCSPPAVSAAPV

SEQ ID NO: 1441001 - protein, 8 aa, Mycobacterium tuberculosis
APAGRNWT

SEQ ID NO: 1441002 - protein, 16 aa, Mycobacterium tuberculosis
APANHCQGESAPGYCS

SEQ ID NO: 1441003 - protein, 12 aa, Mycobacterium tuberculosis
APANPGAGPRIG

SEQ ID NO: 1441004 - protein, 29 aa, Mycobacterium tuberculosis
APAPGTQQQRVPGLRGDQRATAVDQPGVQ

SEQ ID NO: 1441005 - protein, 24 aa, Mycobacterium tuberculosis
APAPPAPPAPPCPPVPPAPPEPLV

SEQ ID NO: 1441006 - protein, 8 aa, Mycobacterium tuberculosis
APAPPESY

SEQ ID NO: 1441007 - protein, 47 aa, Mycobacterium tuberculosis
APAPPLAPTPPLPPAPPLPPAPPSPDTDPPAPPAPPAPPAPPACPAS

SEQ ID NO: 1441008 - protein, 30 aa, Mycobacterium tuberculosis
APAPTGCTTGIPPSPTCSPSPRCAKAGWSP

SEQ ID NO: 1441009 - protein, 31 aa, Mycobacterium tuberculosis
APAPTTRSHASTWPPPSTCWPSPSTRIRSPS

SEQ ID NO: 1441010 - protein, 5 aa, Mycobacterium tuberculosis
APAPV

SEQ ID NO: 1441011 - protein, 5 aa, Mycobacterium tuberculosis
APARP

SEQ ID NO: 1441012 - protein, 8 aa, Mycobacterium tuberculosis
APARSERV

SEQ ID NO: 1441013 - protein, 22 aa, Mycobacterium tuberculosis
APASDPEAPTTGYETIGADTRD

SEQ ID NO: 1441014 - protein, 12 aa, Mycobacterium tuberculosis
APASDTEGLGSV

SEQ ID NO: 1441015 - protein, 22 aa, Mycobacterium tuberculosis
APATDDDDKYDGSQTSSHASCT

SEQ ID NO: 1441016 - protein, 5 aa, Mycobacterium tuberculosis
APATF

SEQ ID NO: 1441017 - protein, 25 aa, Mycobacterium tuberculosis
APATRAISSASSSCSGSCRNRSKRW

SEQ ID NO: 1441018 - protein, 13 aa, Mycobacterium tuberculosis
APATRPPPITSSR

SEQ ID NO: 1441019 - protein, 8 aa, Mycobacterium tuberculosis
APATTRLS

SEQ ID NO: 1441020 - protein, 7 aa, Mycobacterium tuberculosis
APAVPAA

SEQ ID NO: 1441021 - protein, 15 aa, Mycobacterium tuberculosis
APAVPAAQRTFLVPR

SEQ ID NO: 1441022 - protein, 5 aa, Mycobacterium tuberculosis
APDAV

SEQ ID NO: 1441023 - protein, 5 aa, Mycobacterium tuberculosis
APDET

SEQ ID NO: 1441024 - protein, 6 aa, Mycobacterium tuberculosis
APDEVS

SEQ ID NO: 1441025 - protein, 6 aa, Mycobacterium tuberculosis
APDKVN

SEQ ID NO: 1441026 - protein, 11 aa, Mycobacterium tuberculosis
APDPPAPPLPI

SEQ ID NO: 1441027 - protein, 27 aa, Mycobacterium tuberculosis
APDPPAPPLPINQPPGAPSAPVPGAPL

SEQ ID NO: 1441028 - protein, 24 aa, Mycobacterium tuberculosis
APDPVVSTTTPDDADAAAPEPSST

SEQ ID NO: 1441029 - protein, 10 aa, Mycobacterium tuberculosis
APEASEEPES

SEQ ID NO: 1441030 - protein, 9 aa, Mycobacterium tuberculosis
APEDGADVD

SEQ ID NO: 1441031 - protein, 8 aa, Mycobacterium tuberculosis
APEEPANL

SEQ ID NO: 1441032 - protein, 18 aa, Mycobacterium tuberculosis
APEHQPGARASDCGAGPI

SEQ ID NO: 1441033 - protein, 7 aa, Mycobacterium tuberculosis
APEPGRV

SEQ ID NO: 1441034 - protein, 7 aa, Mycobacterium tuberculosis
APEPHGI

SEQ ID NO: 1441035 - protein, 6 aa, Mycobacterium tuberculosis
APEPPA

SEQ ID NO: 1441036 - protein, 23 aa, Mycobacterium tuberculosis
APEPPMPPAPPWPPVPPAPPEPL

SEQ ID NO: 1441037 - protein, 6 aa, Mycobacterium tuberculosis
APEQAG

SEQ ID NO: 1441038 - protein, 13 aa, Mycobacterium tuberculosis
APESPAEPPRASR

SEQ ID NO: 1441039 - protein, 9 aa, Mycobacterium tuberculosis
APETHGRTV

SEQ ID NO: 1441040 - protein, 5 aa, Mycobacterium tuberculosis
APFQP

SEQ ID NO: 1441041 - protein, 5 aa, Mycobacterium tuberculosis
APGAA

SEQ ID NO: 1441042 - protein, 11 aa, Mycobacterium tuberculosis
APGARCDQPVK

SEQ ID NO: 1441043 - protein, 17 aa, Mycobacterium tuberculosis
APGASSAPPPAPGRPSA

SEQ ID NO: 1441044 - protein, 4 aa, Mycobacterium tuberculosis
APGD

SEQ ID NO: 1441045 - protein, 25 aa, Mycobacterium tuberculosis
APGENIASVSNSGDGALANGLPDAH

SEQ ID NO: 1441046 - protein, 11 aa, Mycobacterium tuberculosis
APGESVRAGYP

SEQ ID NO: 1441047 - protein, 15 aa, Mycobacterium tuberculosis
APGFGGPGGSDGASL

SEQ ID NO: 1441048 - protein, 11 aa, Mycobacterium tuberculosis
APGGAAGGVDG

SEQ ID NO: 1441049 - protein, 6 aa, Mycobacterium tuberculosis
APGGAG

SEQ ID NO: 1441050 - protein, 49 aa, Mycobacterium tuberculosis
APGGGALAAGPAGHRRARPVPHQQPGGAALAAGAARARQRPLSPPAPGR

SEQ ID NO: 1441051 - protein, 16 aa, Mycobacterium tuberculosis
APGGPGGVRNSFFLCG

SEQ ID NO: 1441052 - protein, 8 aa, Mycobacterium tuberculosis
APGGRREL

SEQ ID NO: 1441053 - protein, 6 aa, Mycobacterium tuberculosis
APGHTE

SEQ ID NO: 1441054 - protein, 5 aa, Mycobacterium tuberculosis
APGNG

SEQ ID NO: 1441055 - protein, 23 aa, Mycobacterium tuberculosis
APGPAADRAQRGCSRGPNRHRGV

SEQ ID NO: 1441056 - protein, 7 aa, Mycobacterium tuberculosis
APGPGEI

SEQ ID NO: 1441057 - protein, 15 aa, Mycobacterium tuberculosis
APGPLPSNQAAKATV

SEQ ID NO: 1441058 - protein, 7 aa, Mycobacterium tuberculosis
APGPRMT

SEQ ID NO: 1441059 - protein, 15 aa, Mycobacterium tuberculosis
APGSAGSGGGALAAG

SEQ ID NO: 1441060 - protein, 12 aa, Mycobacterium tuberculosis
APGSAPAPGDVS

SEQ ID NO: 1441061 - protein, 16 aa, Mycobacterium tuberculosis
APGSSERERADRASLS

SEQ ID NO: 1441062 - protein, 18 aa, Mycobacterium tuberculosis
APGTGAETDGEHAGDHHR

SEQ ID NO: 1441063 - protein, 7 aa, Mycobacterium tuberculosis
APGTQSQ

SEQ ID NO: 1441064 - protein, 4 aa, Mycobacterium tuberculosis
APGV

SEQ ID NO: 1441065 - protein, 6 aa, Mycobacterium tuberculosis
APGVDT

SEQ ID NO: 1441066 - protein, 6 aa, Mycobacterium tuberculosis
APGVGK

SEQ ID NO: 1441067 - protein, 8 aa, Mycobacterium tuberculosis
APHADAQP

SEQ ID NO: 1441068 - protein, 6 aa, Mycobacterium tuberculosis
APHPRH

SEQ ID NO: 1441069 - protein, 6 aa, Mycobacterium tuberculosis
APHPRV

SEQ ID NO: 1441070 - protein, 4 aa, Mycobacterium tuberculosis
APHS

SEQ ID NO: 1441071 - protein, 8 aa, Mycobacterium tuberculosis
APHVPRGR

SEQ ID NO: 1441072 - protein, 29 aa, Mycobacterium tuberculosis
APIDDPMRATSGTAVTTNSGATLTNDIET

SEQ ID NO: 1441073 - protein, 11 aa, Mycobacterium tuberculosis
APIGAPPGDGF

SEQ ID NO: 1441074 - protein, 6 aa, Mycobacterium tuberculosis
APIPAD

SEQ ID NO: 1441075 - protein, 5 aa, Mycobacterium tuberculosis
APIQT

SEQ ID NO: 1441076 - protein, 6 aa, Mycobacterium tuberculosis
APIQTV

SEQ ID NO: 1441077 - protein, 4 aa, Mycobacterium tuberculosis
APIR

SEQ ID NO: 1441078 - protein, 8 aa, Mycobacterium tuberculosis
APKAPLGY

SEQ ID NO: 1441079 - protein, 8 aa, Mycobacterium tuberculosis
APKPPHTK

SEQ ID NO: 1441080 - protein, 5 aa, Mycobacterium tuberculosis
APKRW

SEQ ID NO: 1441081 - protein, 7 aa, Mycobacterium tuberculosis
APKSDRF

SEQ ID NO: 1441082 - protein, 20 aa, Mycobacterium tuberculosis
APLAQEREEDDEDDWDEEDD

SEQ ID NO: 1441083 - protein, 23 aa, Mycobacterium tuberculosis
APLASPNRGQDNFHTSPMKIAIW

SEQ ID NO: 1441084 - protein, 9 aa, Mycobacterium tuberculosis
APLPSGSTV

SEQ ID NO: 1441085 - protein, 62 aa, Mycobacterium tuberculosis
APLQSGGNGATGGNGGVGAPGGAGGNGGHVSGGSVNTAGAGGKGGNGGTGGAGGPGGHGGSV

SEQ ID NO: 1441086 - protein, 4 aa, Mycobacterium tuberculosis
APLR

SEQ ID NO: 1441087 - protein, 24 aa, Mycobacterium tuberculosis
APLSPTDPAGPAGCRRSRSWLRRV

SEQ ID NO: 1441088 - protein, 6 aa, Mycobacterium tuberculosis
APMGGM

SEQ ID NO: 1441089 - protein, 7 aa, Mycobacterium tuberculosis
APMPARS

SEQ ID NO: 1441090 - protein, 5 aa, Mycobacterium tuberculosis
APNCP

SEQ ID NO: 1441091 - protein, 8 aa, Mycobacterium tuberculosis
APNEPTPT

SEQ ID NO: 1441092 - protein, 11 aa, Mycobacterium tuberculosis
APNHPDPAVAP

SEQ ID NO: 1441093 - protein, 16 aa, Mycobacterium tuberculosis
APPAKQSGTTSGTSKM

SEQ ID NO: 1441094 - protein, 18 aa, Mycobacterium tuberculosis
APPAPPAPAAPPVPPVPP

SEQ ID NO: 1441095 - protein, 16 aa, Mycobacterium tuberculosis
APPAPPAPPAPPMPPE

SEQ ID NO: 1441096 - protein, 18 aa, Mycobacterium tuberculosis
APPAPPLPINPALLPAPR

SEQ ID NO: 1441097 - protein, 32 aa, Mycobacterium tuberculosis
APPAPPLPPLPPAPASPNNPAAPPAPPLPPAL

SEQ ID NO: 1441098 - protein, 31 aa, Mycobacterium tuberculosis
APPAPPRTGGSAGTRRSPPLPPVPPGPASSP

SEQ ID NO: 1441099 - protein, 29 aa, Mycobacterium tuberculosis
APPAPPSPISSPPAPPAPPAPPAPPMPPE

SEQ ID NO: 1441100 - protein, 20 aa, Mycobacterium tuberculosis
APPAPSGSTSASAVPAGTAA

SEQ ID NO: 1441101 - protein, 15 aa, Mycobacterium tuberculosis
APPAPVPANGEQFGP

SEQ ID NO: 1441102 - protein, 5 aa, Mycobacterium tuberculosis
APPDV

SEQ ID NO: 1441103 - protein, 6 aa, Mycobacterium tuberculosis
APPEPF

SEQ ID NO: 1441104 - protein, 5 aa, Mycobacterium tuberculosis
APPGP

SEQ ID NO: 1441105 - protein, 75 aa, Mycobacterium tuberculosis
APPLAPAAPGAWAAPAAPAPSAPAVTAKRGGFGGDGLDASSGGNGGDGGHGGDGFRTAGAGGRGGDGGKGADPGG

SEQ ID NO: 1441106 - protein, 18 aa, Mycobacterium tuberculosis
APPLCGGRSHGDRQLVGV

SEQ ID NO: 1441107 - protein, 16 aa, Mycobacterium tuberculosis
APPLPPGPPVPPVPPL

SEQ ID NO: 1441108 - protein, 15 aa, Mycobacterium tuberculosis
APPPPPPPPPPPPQL

SEQ ID NO: 1441109 - protein, 17 aa, Mycobacterium tuberculosis
APPPPPPPSPPPPPTPM

SEQ ID NO: 1441110 - protein, 66 aa, Mycobacterium tuberculosis
APPPPRPAPPQQPPPPPPEVEPPAGVPQSGGAAGSGGAGSGGAGGGDGPVEPSPARPMPPGFIRLA

SEQ ID NO: 1441111 - protein, 66 aa, Mycobacterium tuberculosis; identical to SEQ ID NO: 229109

SEQ ID NO: 1441112 - protein, 8 aa, Mycobacterium tuberculosis
APPPQRAA

SEQ ID NO: 1441113 - protein, 7 aa, Mycobacterium tuberculosis
APPRLGP

SEQ ID NO: 1441114 - protein, 6 aa, Mycobacterium tuberculosis
APPRPA

SEQ ID NO: 1441115 - protein, 21 aa, Mycobacterium tuberculosis
APPRSSAGPGLWSGPSWGFAA

SEQ ID NO: 1441116 - protein, 76 aa, Mycobacterium tuberculosis
APPSDWGTGGTGGTGGTGGQGANGGLTGGRGGTGGNGGNGNTGGTGGAGGTGGTGHNGSQPGMGGNGGAGGFGGNG

SEQ ID NO: 1441117 - protein, 15 aa, Mycobacterium tuberculosis
APPSVASGAAAALAG

SEQ ID NO: 1441118 - protein, 10 aa, Mycobacterium tuberculosis
APPTEASAAL

SEQ ID NO: 1441119 - protein, 15 aa, Mycobacterium tuberculosis
APPVDRSHTGPLQPP

SEQ ID NO: 1441120 - protein, 10 aa, Mycobacterium tuberculosis
APPVPPMPPL

SEQ ID NO: 1441121 - protein, 26 aa, Mycobacterium tuberculosis
APPWPPDPPLPKRCPPAPPAPPAAPL

SEQ ID NO: 1441122 - protein, 50 aa, Mycobacterium tuberculosis
APPWPPSPPLPPSLPDPPTPPAPPMPPAPPLPNSRPPLPPAPPSLPSPPA

SEQ ID NO: 1441123 - protein, 23 aa, Mycobacterium tuberculosis
APQGQFDRKPRRGRGDPRRAAAA

SEQ ID NO: 1441124 - protein, 7 aa, Mycobacterium tuberculosis
APQKAQQ

SEQ ID NO: 1441125 - protein, 15 aa, Mycobacterium tuberculosis
APQPCRRSVRDSAPA

SEQ ID NO: 1441126 - protein, 11 aa, Mycobacterium tuberculosis
APQPSSPRLPD

SEQ ID NO: 1441127 - protein, 5 aa, Mycobacterium tuberculosis
APQTI

SEQ ID NO: 1441128 - protein, 6 aa, Mycobacterium tuberculosis
APRAPN

SEQ ID NO: 1441129 - protein, 9 aa, Mycobacterium tuberculosis
APRARTAAR

SEQ ID NO: 1441130 - protein, 18 aa, Mycobacterium tuberculosis
APRDRRQVAGRRGANGRR

SEQ ID NO: 1441131 - protein, 7 aa, Mycobacterium tuberculosis
APREISR

SEQ ID NO: 1441132 - protein, 21 aa, Mycobacterium tuberculosis
APRHRPRSRPTPAAPANATTT

SEQ ID NO: 1441133 - protein, 6 aa, Mycobacterium tuberculosis
APRMRT

SEQ ID NO: 1441134 - protein, 14 aa, Mycobacterium tuberculosis
APRQGARRTQRGVR

SEQ ID NO: 1441135 - protein, 11 aa, Mycobacterium tuberculosis
APRQRPADRFQ

SEQ ID NO: 1441136 - protein, 8 aa, Mycobacterium tuberculosis
APRRAGGA

SEQ ID NO: 1441137 - protein, 14 aa, Mycobacterium tuberculosis
APRRRRPPDRPGFR

SEQ ID NO: 1441138 - protein, 7 aa, Mycobacterium tuberculosis
APRSPNG

SEQ ID NO: 1441139 - protein, 14 aa, Mycobacterium tuberculosis
APRSSNCVTVSWRP

SEQ ID NO: 1441140 - protein, 6 aa, Mycobacterium tuberculosis
APRTTT

SEQ ID NO: 1441141 - protein, 5 aa, Mycobacterium tuberculosis
APRYI

SEQ ID NO: 1441142 - protein, 5 aa, Mycobacterium tuberculosis
APSCT

SEQ ID NO: 1441143 - protein, 9 aa, Mycobacterium tuberculosis
APSGGQEAQ

SEQ ID NO: 1441144 - protein, 5 aa, Mycobacterium tuberculosis
APSGS

SEQ ID NO: 1441145 - protein, 15 aa, Mycobacterium tuberculosis
APSLPTPVPHNEKPQ

SEQ ID NO: 1441146 - protein, 6 aa, Mycobacterium tuberculosis
APSNLT

SEQ ID NO: 1441147 - protein, 20 aa, Mycobacterium tuberculosis
APSPAPSCRGRSPPSLRRSP

SEQ ID NO: 1441148 - protein, 6 aa, Mycobacterium tuberculosis
APSPDQ

SEQ ID NO: 1441149 - protein, 20 aa, Mycobacterium tuberculosis
APSPDQRAPEQRLGRRVDEV

SEQ ID NO: 1441150 - protein, 18 aa, Mycobacterium tuberculosis
APSPPMPPLPPTPPEPPV

SEQ ID NO: 1441151 - protein, 24 aa, Mycobacterium tuberculosis
APSPPMPPLPPTPPEPPVPPLPPL

SEQ ID NO: 1441152 - protein, 8 aa, Mycobacterium tuberculosis
APSPPSVT

SEQ ID NO: 1441153 - protein, 8 aa, Mycobacterium tuberculosis
APSSDRRV

SEQ ID NO: 1441154 - protein, 26 aa, Mycobacterium tuberculosis
APSSPAGKDHGPSSIGCTGTATPRMP

SEQ ID NO: 1441155 - protein, 8 aa, Mycobacterium tuberculosis
APSSQVSA

SEQ ID NO: 1441156 - protein, 12 aa, Mycobacterium tuberculosis
APSTGTGPNAAP

SEQ ID NO: 1441157 - protein, 12 aa, Mycobacterium tuberculosis
APSTTRASGDSD

SEQ ID NO: 1441158 - protein, 8 aa, Mycobacterium tuberculosis
APSVMPGP

SEQ ID NO: 1441159 - protein, 4 aa, Mycobacterium tuberculosis
APTG

SEQ ID NO: 1441160 - protein, 6 aa, Mycobacterium tuberculosis
APTHRS

SEQ ID NO: 1441161 - protein, 15 aa, Mycobacterium tuberculosis
APTKLTSPGINGSTV

SEQ ID NO: 1441162 - protein, 21 aa, Mycobacterium tuberculosis
APTPASSTPAWSTPALATPVT

SEQ ID NO: 1441163 - protein, 11 aa, Mycobacterium tuberculosis
APTPAVPSTAP

SEQ ID NO: 1441164 - protein, 13 aa, Mycobacterium tuberculosis
APTPRGAQPPRPD

SEQ ID NO: 1441165 - protein, 6 aa, Mycobacterium tuberculosis
APTRHV

SEQ ID NO: 1441166 - protein, 8 aa, Mycobacterium tuberculosis
APTRRQVD

SEQ ID NO: 1441167 - protein, 11 aa, Mycobacterium tuberculosis
APTSAAGSAPI

SEQ ID NO: 1441168 - protein, 22 aa, Mycobacterium tuberculosis
APTSDTEGLGSVPSRILCAGKL

SEQ ID NO: 1441169 - protein, 10 aa, Mycobacterium tuberculosis
APTTTQSTPW

SEQ ID NO: 1441170 - protein, 7 aa, Mycobacterium tuberculosis
APVAEQQ

SEQ ID NO: 1441171 - protein, 12 aa, Mycobacterium tuberculosis
APVDECKDKDMT

SEQ ID NO: 1441172 - protein, 8 aa, Mycobacterium tuberculosis
APVHEGDT

SEQ ID NO: 1441173 - protein, 7 aa, Mycobacterium tuberculosis
APVNSEE

SEQ ID NO: 1441174 - protein, 13 aa, Mycobacterium tuberculosis
APVPPGPPAPPWP

SEQ ID NO: 1441175 - protein, 6 aa, Mycobacterium tuberculosis
APVPQH

SEQ ID NO: 1441176 - protein, 7 aa, Mycobacterium tuberculosis
APVPQPV

SEQ ID NO: 1441177 - protein, 9 aa, Mycobacterium tuberculosis
APVPSAPLA

SEQ ID NO: 1441178 - protein, 8 aa, Mycobacterium tuberculosis
APVPTGAT

SEQ ID NO: 1441179 - protein, 9 aa, Mycobacterium tuberculosis
APVRPRRQR

SEQ ID NO: 1441180 - protein, 10 aa, Mycobacterium tuberculosis
APVSAVPPSY

SEQ ID NO: 1441181 - protein, 4 aa, Mycobacterium tuberculosis
APVT

SEQ ID NO: 1441182 - protein, 6 aa, Mycobacterium tuberculosis
APWDLS

SEQ ID NO: 1441183 - protein, 8 aa, Mycobacterium tuberculosis
APWPGPSF

SEQ ID NO: 1441184 - protein, 26 aa, Mycobacterium tuberculosis
APWPQCPAKPRGYPRPSAPTRSLPAP

SEQ ID NO: 1441185 - protein, 11 aa, Mycobacterium tuberculosis
APWQEQREPGW

SEQ ID NO: 1441186 - protein, 12 aa, Mycobacterium tuberculosis
APWSPPASTGCR

SEQ ID NO: 1441187 - protein, 7 aa, Mycobacterium tuberculosis
APYASTM

SEQ ID NO: 1441188 - protein, 5 aa, Mycobacterium tuberculosis
APYDD

SEQ ID NO: 1441189 - protein, 12 aa, Mycobacterium tuberculosis
APYETTNRVDPY

SEQ ID NO: 1441190 - protein, 10 aa, Mycobacterium tuberculosis
AQAADTAARI

SEQ ID NO: 1441191 - protein, 7 aa, Mycobacterium tuberculosis
AQAAGNA

SEQ ID NO: 1441192 - protein, 8 aa, Mycobacterium tuberculosis
AQAANGAP

SEQ ID NO: 1441193 - protein, 16 aa, Mycobacterium tuberculosis
AQADPHSPSAQCAATP

SEQ ID NO: 1441194 - protein, 10 aa, Mycobacterium tuberculosis
AQAEAQGATQ

SEQ ID NO: 1441195 - protein, 9 aa, Mycobacterium tuberculosis
AQAEPLSTA

SEQ ID NO: 1441196 - protein, 13 aa, Mycobacterium tuberculosis
AQAKTRSAAHTPT

SEQ ID NO: 1441197 - protein, 7 aa, Mycobacterium tuberculosis
AQAPHRH

SEQ ID NO: 1441198 - protein, 9 aa, Mycobacterium tuberculosis
AQAPRPAPA

SEQ ID NO: 1441199 - protein, 6 aa, Mycobacterium tuberculosis
AQARAA

SEQ ID NO: 1441200 - protein, 27 aa, Mycobacterium tuberculosis
AQARPDDPGLHPPGRRRGGRGDDLRPV

SEQ ID NO: 1441201 - protein, 23 aa, Mycobacterium tuberculosis
AQARSGAPGFGASQQHHAGPPAL

SEQ ID NO: 1441202 - protein, 18 aa, Mycobacterium tuberculosis
AQASPDKLRGSLSDVHRK

SEQ ID NO: 1441203 - protein, 48 aa, Mycobacterium tuberculosis; identical to SEQ ID NO: 1366033

SEQ ID NO: 1441204 - protein, 8 aa, Mycobacterium tuberculosis
AQCRPSGD

SEQ ID NO: 1441205 - protein, 5 aa, Mycobacterium tuberculosis
AQDDF

SEQ ID NO: 1441206 - protein, 104 aa, Mycobacterium tuberculosis
AQDGGQGGTGGTGGNAGAGGTGFTQGADGNAGNGGDGGVGGNGGNGADNTTTAAAGTTGGAGGAGGAGGTGGAAGTGTGGQQGNGGNGGNGGTGGKGGTGGAGM

SEQ ID NO: 1441207 - protein, 107 aa, Mycobacterium tuberculosis
AQDGGQGGTGGTGGNAGAGGTGFTQGADGNAGNGGDGGVGGNGGNGADNTTTAAAGTTGGAGGAGGAGGTGGAAGTGTGGQQGTGGQQGNGGNGGTGGKGGTGGAGM

SEQ ID NO: 1441208 - protein, 110 aa, Mycobacterium tuberculosis
AQDGGQGGTGGTGGNAGAGGTGFTQGADGNAGNGGDGGVGGNGGNGADNTTTAAAGTTGGAGGAGGAGGTGGAAGTGTGGQQGTGGQQGNGGNGGTGGTGGKGGTGGAGM

SEQ ID NO: 1441209 - protein, 1081 aa, Mycobacterium tuberculosis
AQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGGAGGNGGTGGAGGSGIDGVGGGTGGTGGNGGNGAIGGAGGDAGGSGNSGGNGGTGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGAGAASSATNGGSGGAGGTGGDGGSGGAGGTGGAGGTGGAAGDGGQGGQGGAGGGAGGQGGAGGAGGTGGNGGNITGGTAGTAGAAGNGGAAGKGGAGGQGGTGGGTGGQGGAGGDGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGNGGTGGEGGEVGGAGGTGGAAGNGGDGGTGGTGGGDGGAGGTGGTGGSGGAAGNGGNGGNAGAGGNGNGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGG

SEQ ID NO: 1441210 - protein, 972 aa, Mycobacterium tuberculosis
AQDGGQGGTGGTGGNAGAGGTGFTQGADGNAGNGGDGGVGGNGGNGADNTTTAAAGTTGGAGGAGGAGGTGGTGGAAGTGTGGQQGNGGNGGNGGTGGKGGTGGDGALAGSSGGAGGKGGNGGDAGKAGTGSAPGTAGTGGDGGKGGNGGIGAAGTTGPVGTGASGGTGGSGGAGGTGGDGGAANGGTAGAGGAGGNGGKGGDGGAGVTSSTAGNSGGAGGSGGKGGDAGAGGAGATPGANGIAGNGGDGGDGAAGAVGISGATGAGDGGHGGTGGAGGNGGTGGAGGSGIDGVGGGTGGTGGNGGNGAIGGAGGDAGGSGNSGGNGGTGGKGGNAGAGGAAGSNGGTVGANGTGGDGGNGGAAGAATAGSNGGAGTGSAGGNGGTGGRGGSGGAGGDGIGGVGGGKGGNGADGEVGGAGGAGGSGPNTSPGGNGGQGGQGGSGGAGGAAGAGGAGGGANGTAGNGGQGGAGGTGGDRTVGGGTVPAGSGGQGGNAGGGGAGGQGGADGGSGGDGGDAGTGGNGGNGGNRNSGNGTGGAGGNGGGGANGGAGGAGGSGGGTGGNGGAGGDAGDAGNGGNGNGTGNGGNGGNGGIAGMGGNGGAGTGSGNGGNGGSGGNGGNAGMGGNSGTGSGDGGAGGNGGAAGTGGTGGDGGLTGTGGTGGSGGTGGDGGNGGNGADNTANMTAQAGGDGGNGGDGGFGGGAGAGGGGLTAGANGTGGQGGAGGDGGNGAIGGHGPLTDDPGGNGGTGGNGGTGGTGGAGIGSLGGGTGGDGGNGGNGGTGGEGGEVGGAGGTGGAAGNGGDGGTGGTGGGDGGAGGTGGTGGDGGDAGTGGNGGNGGNRNSGNGTGGAGGNGGGGANGGTGGAGGIGGTGGNGGDAEPGVPPGAGGAGGAGTTGGKGGTGGNGSGTGSGGTGGDGGTGGGGGNGGTGWNGGKGDTGSGGGAGDGGKAPAGGTGGAGGDGGAGGKGGSGG

SEQ ID NO: 1441211 - protein, 110 aa, Mycobacterium tuberculosis
AQDGGQGGTGGTGGNAGAGGTGFTQGADGNAGNGGDGGVGGNGGNGADNTTTAAAGTTGGAGGAGGAGGTGGTGGAAGTGTGGQQGTGGQQGNGGNGGTGGKGGTGGAGM

SEQ ID NO: 1441212 - protein, 4 aa, Mycobacterium tuberculosis
AQDP

SEQ ID NO: 1441213 - protein, 5 aa, Mycobacterium tuberculosis
AQDPV

SEQ ID NO: 1441214 - protein, 13 aa, Mycobacterium tuberculosis
AQDRTGGRAPGNL

SEQ ID NO: 1441215 - protein, 66 aa, Mycobacterium tuberculosis
AQDRTGGTGTGQSRGAGGFGGVGQAGGKGWDGGPIGNGQVGEQHGAGQLGSTDGNPGVAGAAHGSG

SEQ ID NO: 1441216 - protein, 4 aa, Mycobacterium tuberculosis
AQDV

SEQ ID NO: 1441217 - protein, 4 aa, Mycobacterium tuberculosis
AQEY

SEQ ID NO: 1441218 - protein, 17 aa, Mycobacterium tuberculosis
AQGAGPGHRGRRSRDRE

SEQ ID NO: 1441219 - protein, 12 aa, Mycobacterium tuberculosis
AQGAIQGPDTPP

SEQ ID NO: 1441220 - protein, 12 aa, Mycobacterium tuberculosis
AQGDEPGLGRRP

SEQ ID NO: 1441221 - protein, 8 aa, Mycobacterium tuberculosis
AQGDRARQ

SEQ ID NO: 1441222 - protein, 6 aa, Mycobacterium tuberculosis
AQGIRS

SEQ ID NO: 1441223 - protein, 9 aa, Mycobacterium tuberculosis
AQGTPEDVS

SEQ ID NO: 1441224 - protein, 7 aa, Mycobacterium tuberculosis
AQGYQAA

SEQ ID NO: 1441225 - protein, 8 aa, Mycobacterium tuberculosis
AQGYQAAA

SEQ ID NO: 1441226 - protein, 7 aa, Mycobacterium tuberculosis
AQKAGLP

SEQ ID NO: 1441227 - protein, 19 aa, Mycobacterium tuberculosis
AQKPAARNALRDTPLDPER

SEQ ID NO: 1441228 - protein, 13 aa, Mycobacterium tuberculosis
AQLGGTDIPPTEP

SEQ ID NO: 1441229 - protein, 14 aa, Mycobacterium tuberculosis
AQLTSQIAERDQAI

SEQ ID NO: 1441230 - protein, 26 aa, Mycobacterium tuberculosis
AQNGGPGSDGLGGDAFNGSRGTDGNP

SEQ ID NO: 1441231 - protein, 12 aa, Mycobacterium tuberculosis
AQNTKDAGGTRL

SEQ ID NO: 1441232 - protein, 23 aa, Mycobacterium tuberculosis
AQPDIAQAGQARPQTGVAEPDIP

SEQ ID NO: 1441233 - protein, 20 aa, Mycobacterium tuberculosis
AQPGGQAAGAIDSPGVTGYP

SEQ ID NO: 1441234 - protein, 10 aa, Mycobacterium tuberculosis
AQPGIGQRRP

SEQ ID NO: 1441235 - protein, 21 aa, Mycobacterium tuberculosis
AQPGPGQCRGRQPGVGQHRPW

SEQ ID NO: 1441236 - protein, 14 aa, Mycobacterium tuberculosis
AQPGQLDRRGRRPG

SEQ ID NO: 1441237 - protein, 12 aa, Mycobacterium tuberculosis
AQPGRRRGRQRR

SEQ ID NO: 1441238 - protein, 6 aa, Mycobacterium tuberculosis
AQPPGC

SEQ ID NO: 1441239 - protein, 6 aa, Mycobacterium tuberculosis
AQPPLG

SEQ ID NO: 1441240 - protein, 11 aa, Mycobacterium tuberculosis
AQPQPGQSAPS

SEQ ID NO: 1441241 - protein, 16 aa, Mycobacterium tuberculosis
AQPRDSPAKRSLNYAP

SEQ ID NO: 1441242 - protein, 7 aa, Mycobacterium tuberculosis
AQPRPML

SEQ ID NO: 1441243 - protein, 6 aa, Mycobacterium tuberculosis
AQPRQV

SEQ ID NO: 1441244 - protein, 5 aa, Mycobacterium tuberculosis
AQPSI

SEQ ID NO: 1441245 - protein, 8 aa, Mycobacterium tuberculosis
AQQHAPQD

SEQ ID NO: 1441246 - protein, 13 aa, Mycobacterium tuberculosis
AQQHRAGRGHSRV

SEQ ID NO: 1441247 - protein, 12 aa, Mycobacterium tuberculosis
AQQPTSARPGGE

SEQ ID NO: 1441248 - protein, 7 aa, Mycobacterium tuberculosis
AQQRESF

SEQ ID NO: 1441249 - protein, 6 aa, Mycobacterium tuberculosis
AQQSYF

SEQ ID NO: 1441250 - protein, 7 aa, Mycobacterium tuberculosis
AQRDSEL

SEQ ID NO: 1441251 - protein, 122 aa, Mycobacterium tuberculosis
AQRLPAEGPAVKRGVGASAAKKVAKKAPAKKATKAAKKAATKAPAKKAATKAPAKKAATKAPAKKAVKATKSPAKKVTKAVKKTAVKASVRKAATKAPAKKAAAKRPATKAPAKKATARRGR

SEQ ID NO: 1441252 - protein, 20 aa, Mycobacterium tuberculosis
AQRPRDRRPGSSAGHGRTGI

SEQ ID NO: 1441253 - protein, 7 aa, Mycobacterium tuberculosis
AQRRDPD

SEQ ID NO: 1441254 - protein, 18 aa, Mycobacterium tuberculosis
AQRRGRRGGDHQRHQGQG

SEQ ID NO: 1441255 - protein, 13 aa, Mycobacterium tuberculosis
AQRTAEAQAKANE

SEQ ID NO: 1441256 - protein, 10 aa, Mycobacterium tuberculosis
AQRYQTENYR

SEQ ID NO: 1441257 - protein, 4 aa, Mycobacterium tuberculosis
AQSG

SEQ ID NO: 1441258 - protein, 5 aa, Mycobacterium tuberculosis
AQSRG

SEQ ID NO: 1441259 - protein, 7 aa, Mycobacterium tuberculosis
AQTAQTV

SEQ ID NO: 1441260 - protein, 92 aa, Mycobacterium tuberculosis
AQTGGAGGAGGAGGDGAPGGNGGNGGSVEHTGATGSSASGGNGATGGNGGVGAPGGAGGNGGHVSGGSVNTAGAGGKGGTGGAGGPGGHGGS

SEQ ID NO: 1441261 - protein, 96 aa, Mycobacterium tuberculosis
AQTGGAGGAGGAGGDGAPGGNGGNGGSVEHTGATGSSASGGNGATGGNGGVGAPGGAGGNGGHVSGGSVNTAGAGGKGGTGGTGGAGGPGGHGGSV

SEQ ID NO: 1441262 - protein, 10 aa, Mycobacterium tuberculosis
AQTPIERKPP

SEQ ID NO: 1441263 - protein, 5 aa, Mycobacterium tuberculosis
AQTVT

SEQ ID NO: 1441264 - protein, 22 aa, Mycobacterium tuberculosis
AQVASGAQGAKAASAPGAAPAV

SEQ ID NO: 1441265 - protein, 7 aa, Mycobacterium tuberculosis
AQVGVDP

SEQ ID NO: 1441266 - protein, 4 aa, Mycobacterium tuberculosis
AQYS

SEQ ID NO: 1441267 - protein, 85 aa, Mycobacterium tuberculosis
ARAAAVAPSGTAVGAGARSSVGTAAASGAGSHAATGRAPVATSDKAAAPSTRAASARTAPPARPPSTDHIDKPDRSESADDGTPV

SEQ ID NO: 1441268 - protein, 21 aa, Mycobacterium tuberculosis
ARAADGAPFAGGGQPQCVLRS

SEQ ID NO: 1441269 - protein, 13 aa, Mycobacterium tuberculosis
ARAAFGRNRNTGS

SEQ ID NO: 1441270 - protein, 20 aa, Mycobacterium tuberculosis
ARAAGPAGPAGLPDADGGVG

SEQ ID NO: 1441271 - protein, 13 aa, Mycobacterium tuberculosis
ARAAPGPGVAELS

SEQ ID NO: 1441272 - protein, 17 aa, Mycobacterium tuberculosis
ARAARQRGNEISGGASA

SEQ ID NO: 1441273 - protein, 8 aa, Mycobacterium tuberculosis
ARAATEAM

SEQ ID NO: 1441274 - protein, 9 aa, Mycobacterium tuberculosis
ARADGTSQL

SEQ ID NO: 1441275 - protein, 13 aa, Mycobacterium tuberculosis
ARADRAGSTHRDP

SEQ ID NO: 1441276 - protein, 33 aa, Mycobacterium tuberculosis
ARADRARSTHRDPFAGRQPEGSGRRPHRELFGR

SEQ ID NO: 1441277 - protein, 23 aa, Mycobacterium tuberculosis
ARADRPGGIPQRQPAGEVGRRGL

SEQ ID NO: 1441278 - protein, 16 aa, Mycobacterium tuberculosis
ARAEAEAAQQRLDAGE

SEQ ID NO: 1441279 - protein, 6 aa, Mycobacterium tuberculosis
ARAETA

SEQ ID NO: 1441280 - protein, 8 aa, Mycobacterium tuberculosis
ARAGGGLS

SEQ ID NO: 1441281 - protein, 8 aa, Mycobacterium tuberculosis
ARAGGTTP

SEQ ID NO: 1441282 - protein, 11 aa, Mycobacterium tuberculosis
ARAGPAPRRCR

SEQ ID NO: 1441283 - protein, 5 aa, Mycobacterium tuberculosis
ARAGR

SEQ ID NO: 1441284 - protein, 34 aa, Mycobacterium tuberculosis
ARAGTAGGAGGGPAGGIGGAGGVGGAGGAAGAVT

SEQ ID NO: 1441285 - protein, 34 aa, Mycobacterium tuberculosis
ARAGTAGGAGGGPAGGIGGTGGVGGAGGAAGAVT

SEQ ID NO: 1441286 - protein, 16 aa, Mycobacterium tuberculosis
ARAKYDSAQFYDVTTT

SEQ ID NO: 1441287 - protein, 9 aa, Mycobacterium tuberculosis
ARAPHSAGV

SEQ ID NO: 1441288 - protein, 8 aa, Mycobacterium tuberculosis
ARAPKHSY

SEQ ID NO: 1441289 - protein, 8 aa, Mycobacterium tuberculosis
ARAQGRSH

SEQ ID NO: 1441290 - protein, 20 aa, Mycobacterium tuberculosis
ARARSRCTKGSRRYRERTTE

SEQ ID NO: 1441291 - protein, 22 aa, Mycobacterium tuberculosis
ARAVPEGTSSAMAGPAATPVSV

SEQ ID NO: 1441292 - protein, 6 aa, Mycobacterium tuberculosis
ARAVTR

SEQ ID NO: 1441293 - protein, 4 aa, Mycobacterium tuberculosis
ARCT

SEQ ID NO: 1441294 - protein, 34 aa, Mycobacterium tuberculosis
ARDAERGCRSAAAAGSAHRRRDRCPGGRARGQRL

SEQ ID NO: 1441295 - protein, 5 aa, Mycobacterium tuberculosis
ARDGC

SEQ ID NO: 1441296 - protein, 18 aa, Mycobacterium tuberculosis
ARDGGGQGGGLAGQPGVG

SEQ ID NO: 1441297 - protein, 10 aa, Mycobacterium tuberculosis
ARDPLTGGQS

SEQ ID NO: 1441298 - protein, 8 aa, Mycobacterium tuberculosis
ARDRGKPV

SEQ ID NO: 1441299 - protein, 8 aa, Mycobacterium tuberculosis
AREHPKPA

SEQ ID NO: 1441300 - protein, 14 aa, Mycobacterium tuberculosis
AREHRPRHGREIDG

SEQ ID NO: 1441301 - protein, 5 aa, Mycobacterium tuberculosis
ARERA

SEQ ID NO: 1441302 - protein, 28 aa, Mycobacterium tuberculosis
ARESATRLGPPAGGLAAANTPNPSGAAI

SEQ ID NO: 1441303 - protein, 5 aa, Mycobacterium tuberculosis
ARESE

SEQ ID NO: 1441304 - protein, 7 aa, Mycobacterium tuberculosis
ARETGAD

SEQ ID NO: 1441305 - protein, 22 aa, Mycobacterium tuberculosis
ARFSRRPGHRPRRRRIRFGEVS

SEQ ID NO: 1441306 - protein, 5 aa, Mycobacterium tuberculosis
ARGAA

SEQ ID NO: 1441307 - protein, 7 aa, Mycobacterium tuberculosis
ARGAARP

SEQ ID NO: 1441308 - protein, 11 aa, Mycobacterium tuberculosis
ARGAHAGPAHP

SEQ ID NO: 1441309 - protein, 18 aa, Mycobacterium tuberculosis
ARGARARSAEIERDRRLP

SEQ ID NO: 1441310 - protein, 16 aa, Mycobacterium tuberculosis
ARGASSAASAASATID

SEQ ID NO: 1441311 - protein, 18 aa, Mycobacterium tuberculosis
ARGCGDAAPRRRRRGRRA

SEQ ID NO: 1441312 - protein, 9 aa, Mycobacterium tuberculosis
ARGDGPLAG

SEQ ID NO: 1441313 - protein, 8 aa, Mycobacterium tuberculosis
ARGDRIPD

SEQ ID NO: 1441314 - protein, 9 aa, Mycobacterium tuberculosis
ARGDTIGGN

SEQ ID NO: 1441315 - protein, 26 aa, Mycobacterium tuberculosis
ARGGARGLAGRPRRARNARRGRTDAR

SEQ ID NO: 1441316 - protein, 17 aa, Mycobacterium tuberculosis
ARGGGIGTLGTTTTEPA

SEQ ID NO: 1441317 - protein, 7 aa, Mycobacterium tuberculosis
ARGGGVG

SEQ ID NO: 1441318 - protein, 36 aa, Mycobacterium tuberculosis
ARGGVPRSAGRGRFAGGPRHRRQRHPSHPRRQGDAE

SEQ ID NO: 1441319 - protein, 10 aa, Mycobacterium tuberculosis
ARGHPPSPVH

SEQ ID NO: 1441320 - protein, 10 aa, Mycobacterium tuberculosis
ARGHRRRPGR

SEQ ID NO: 1441321 - protein, 15 aa, Mycobacterium tuberculosis
ARGPLHQTRRRTHPR

SEQ ID NO: 1441322 - protein, 14 aa, Mycobacterium tuberculosis
ARGPRGHLREEPPR

SEQ ID NO: 1441323 - protein, 5 aa, Mycobacterium tuberculosis
ARGQD

SEQ ID NO: 1441324 - protein, 33 aa, Mycobacterium tuberculosis
ARGRGSGRSRRTAACGGPQQNRCAGGPRARGVR

SEQ ID NO: 1441325 - protein, 18 aa, Mycobacterium tuberculosis
ARGRIGEEAPLPAGARVD

SEQ ID NO: 1441326 - protein, 93 aa, Mycobacterium tuberculosis
ARGVGGPGGAGGAGGRGGAGGRGGAGGRGGDGGQGGRGGAGGRGGDGGIGGAAGPGGQPGQGGVGGAPGPGGTPGEPGQPGKPGQPGQPGSPG

SEQ ID NO: 1441327 - protein, 78 aa, Mycobacterium tuberculosis
ARGVGGPGGAGGAGGRGGAGGRGGAGVRGGDGGIGGAAGPGGQPGEGGVGGAPGPGGTPGEPGQPGKPGQPGQPGSPG

SEQ ID NO: 1441328 - protein, 26 aa, Mycobacterium tuberculosis
ARGVGRPGGAGGAGGSGWCRRSRRGG

SEQ ID NO: 1441329 - protein, 13 aa, Mycobacterium tuberculosis
ARGVSGDQHAGGS

SEQ ID NO: 1441330 - protein, 7 aa, Mycobacterium tuberculosis
ARGWQPS

SEQ ID NO: 1441331 - protein, 17 aa, Mycobacterium tuberculosis
ARHGGGAFSGQDPVPRV

SEQ ID NO: 1441332 - protein, 7 aa, Mycobacterium tuberculosis
ARHPATG

SEQ ID NO: 1441333 - protein, 72 aa, Mycobacterium tuberculosis
ARHPPRTPATAGPPCPPAPPSPNNIPPAPPLPPAAPAPPRPPTPPLPINSGPAPASPPGAPSPPTPPPTPVP

SEQ ID NO: 1441334 - protein, 9 aa, Mycobacterium tuberculosis
ARHPRPRAT

SEQ ID NO: 1441335 - protein, 14 aa, Mycobacterium tuberculosis
ARHQRRRPKRQRAG

SEQ ID NO: 1441336 - protein, 4 aa, Mycobacterium tuberculosis
ARHR

SEQ ID NO: 1441337 - protein, 9 aa, Mycobacterium tuberculosis
ARHRRGHRA

SEQ ID NO: 1441338 - protein, 13 aa, Mycobacterium tuberculosis
ARHSRTSGDHRAD

SEQ ID NO: 1441339 - protein, 8 aa, Mycobacterium tuberculosis
ARIPAKPA

SEQ ID NO: 1441340 - protein, 29 aa, Mycobacterium tuberculosis
ARIPPVANRPAQGRRRRRRAGRPRHRRGN

SEQ ID NO: 1441341 - protein, 8 aa, Mycobacterium tuberculosis
ARKASLPF

SEQ ID NO: 1441342 - protein, 4 aa, Mycobacterium tuberculosis
ARKG

SEQ ID NO: 1441343 - protein, 8 aa, Mycobacterium tuberculosis
ARKQTMSA

SEQ ID NO: 1441344 - protein, 9 aa, Mycobacterium tuberculosis
ARKQTMSAQ

SEQ ID NO: 1441345 - protein, 9 aa, Mycobacterium tuberculosis
ARKTADSTV

SEQ ID NO: 1441346 - protein, 4 aa, Mycobacterium tuberculosis
ARKV

SEQ ID NO: 1441347 - protein, 10 aa, Mycobacterium tuberculosis
ARLPGRAAGA

SEQ ID NO: 1441348 - protein, 17 aa, Mycobacterium tuberculosis
ARNADGRRTTGSGGGVP

SEQ ID NO: 1441349 - protein, 15 aa, Mycobacterium tuberculosis
ARNCRKQQGSLPPLA

SEQ ID NO: 1441350 - protein, 9 aa, Mycobacterium tuberculosis
ARNPGPTSV

SEQ ID NO: 1441351 - protein, 6 aa, Mycobacterium tuberculosis
ARNRAV

SEQ ID NO: 1441352 - protein, 5 aa, Mycobacterium tuberculosis
ARNRP

SEQ ID NO: 1441353 - protein, 27 aa, Mycobacterium tuberculosis
ARNSGSRSRAPELRRAGGDPALLSPRD

SEQ ID NO: 1441354 - protein, 4 aa, Mycobacterium tuberculosis
ARPA

SEQ ID NO: 1441355 - protein, 13 aa, Mycobacterium tuberculosis
ARPAARPEFPNPK

SEQ ID NO: 1441356 - protein, 6 aa, Mycobacterium tuberculosis
ARPADL

SEQ ID NO: 1441357 - protein, 51 aa, Mycobacterium tuberculosis
ARPASPGGAAVGGAAVTAGSAGATTTTGAAGRAGAYGAGCAGRANAADAAL

SEQ ID NO: 1441358 - protein, 47 aa, Mycobacterium tuberculosis
ARPASPGGAAVGGAAVTAGSAGATTTTGAAGRAGAYGAGCAGSANAA

SEQ ID NO: 1441359 - protein, 12 aa, Mycobacterium tuberculosis
ARPDASLAQGNL

SEQ ID NO: 1441360 - protein, 17 aa, Mycobacterium tuberculosis
ARPDPAGPDRRPGTRRR

SEQ ID NO: 1441361 - protein, 37 aa, Mycobacterium tuberculosis
ARPGGGWRGDGTATAAVPGPGAANGRAGGQLTGRRRH

SEQ ID NO: 1441362 - protein, 15 aa, Mycobacterium tuberculosis
ARPGIAAGPTRMPAP

SEQ ID NO: 1441363 - protein, 11 aa, Mycobacterium tuberculosis
ARPGNSGGPIV

SEQ ID NO: 1441364 - protein, 20 aa, Mycobacterium tuberculosis
ARPGRGDTRAASLPRREYEC

SEQ ID NO: 1441365 - protein, 7 aa, Mycobacterium tuberculosis
ARPGTEI

SEQ ID NO: 1441366 - protein, 50 aa, Mycobacterium tuberculosis
ARPIRNSSTKPGAARMSSKRRLPGWKSGRRSSKGLNRHGAPSATTGGRHR

SEQ ID NO: 1441367 - protein, 10 aa, Mycobacterium tuberculosis
ARPPARAPDM

SEQ ID NO: 1441368 - protein, 32 aa, Mycobacterium tuberculosis
ARPRRRNRGGPADRKAQGADPRFGAQSDRPGY

SEQ ID NO: 1441369 - protein, 14 aa, Mycobacterium tuberculosis
ARPRYPPRNARCAR

SEQ ID NO: 1441370 - protein, 16 aa, Mycobacterium tuberculosis
ARPSGVLRPGTTSGYA

SEQ ID NO: 1441371 - protein, 30 aa, Mycobacterium tuberculosis
ARPSNDRLTPTKAVTTRATSKAPRHTAGKT

SEQ ID NO: 1441372 - protein, 39 aa, Mycobacterium tuberculosis
ARPSPPCPPAPPLPNSRPPVPPLPPTAPTPPAPPAPPLP

SEQ ID NO: 1441373 - protein, 10 aa, Mycobacterium tuberculosis
ARPTSARTTW

SEQ ID NO: 1441374 - protein, 29 aa, Mycobacterium tuberculosis
ARPVPGTAARLSATPPRPVSRPAAGACET

SEQ ID NO: 1441375 - protein, 12 aa, Mycobacterium tuberculosis
ARQDLGRDGDDL

SEQ ID NO: 1441376 - protein, 12 aa, Mycobacterium tuberculosis
ARQHRRRPERQH

SEQ ID NO: 1441377 - protein, 14 aa, Mycobacterium tuberculosis
ARQPLPESAAARLR

SEQ ID NO: 1441378 - protein, 5 aa, Mycobacterium tuberculosis
ARQRL

SEQ ID NO: 1441379 - protein, 5 aa, Mycobacterium tuberculosis
ARQRP

SEQ ID NO: 1441380 - protein, 6 aa, Mycobacterium tuberculosis
ARQRRE

SEQ ID NO: 1441381 - protein, 6 aa, Mycobacterium tuberculosis
ARQRWP

SEQ ID NO: 1441382 - protein, 22 aa, Mycobacterium tuberculosis
ARQTPPEARAKKAAPESAAAQA

SEQ ID NO: 1441383 - protein, 5 aa, Mycobacterium tuberculosis
ARQTQ

SEQ ID NO: 1441384 - protein, 33 aa, Mycobacterium tuberculosis
ARQVRPDVSEPRHPTGAGVEEPRRRGRRGVAEP

SEQ ID NO: 1441385 - protein, 34 aa, Mycobacterium tuberculosis
ARRAGRLGAAGRAQGGRQPAGSRQRAAGPTRRGG

SEQ ID NO: 1441386 - protein, 7 aa, Mycobacterium tuberculosis
ARRAPAD

SEQ ID NO: 1441387 - protein, 12 aa, Mycobacterium tuberculosis
ARRARPDDVSAG

SEQ ID NO: 1441388 - protein, 5 aa, Mycobacterium tuberculosis
ARRCP

SEQ ID NO: 1441389 - protein, 15 aa, Mycobacterium tuberculosis
ARRCTRRSHADNWPT

SEQ ID NO: 1441390 - protein, 18 aa, Mycobacterium tuberculosis
ARRDEGHPSVGDMRLGHA

SEQ ID NO: 1441391 - protein, 10 aa, Mycobacterium tuberculosis
ARRGAGAHPY

SEQ ID NO: 1441392 - protein, 27 aa, Mycobacterium tuberculosis
ARRGGRQRRGQRPRWRPRRHGRRFGDG

SEQ ID NO: 1441393 - protein, 13 aa, Mycobacterium tuberculosis
ARRGRGAEACRAQ

SEQ ID NO: 1441394 - protein, 9 aa, Mycobacterium tuberculosis
ARRGRTDAR

SEQ ID NO: 1441395 - protein, 6 aa, Mycobacterium tuberculosis
ARRLPT

SEQ ID NO: 1441396 - protein, 34 aa, Mycobacterium tuberculosis
ARRLSRSGAPGSASRGAWPRSGGASGRDAGGRRD

SEQ ID NO: 1441397 - protein, 22 aa, Mycobacterium tuberculosis
ARRNTRRRGAPVSTWPVAPSYR

SEQ ID NO: 1441398 - protein, 21 aa, Mycobacterium tuberculosis
ARRPDRSRGSRSCSRPRPWAS

SEQ ID NO: 1441399 - protein, 16 aa, Mycobacterium tuberculosis
ARRPFGAGNGPDPKTR

SEQ ID NO: 1441400 - protein, 8 aa, Mycobacterium tuberculosis
ARRPPGSA

SEQ ID NO: 1441401 - protein, 6 aa, Mycobacterium tuberculosis
ARRPPT

SEQ ID NO: 1441402 - protein, 16 aa, Mycobacterium tuberculosis
ARRPRLGVDTDERTIP

SEQ ID NO: 1441403 - protein, 7 aa, Mycobacterium tuberculosis
ARRPRRC

SEQ ID NO: 1441404 - protein, 13 aa, Mycobacterium tuberculosis
ARRPSGRPPTSPT

SEQ ID NO: 1441405 - protein, 10 aa, Mycobacterium tuberculosis
ARRQKGAGGD

SEQ ID NO: 1441406 - protein, 6 aa, Mycobacterium tuberculosis
ARRQQG

SEQ ID NO: 1441407 - protein, 6 aa, Mycobacterium tuberculosis
ARRRAL

SEQ ID NO: 1441408 - protein, 7 aa, Mycobacterium tuberculosis
ARRRAQA

SEQ ID NO: 1441409 - protein, 6 aa, Mycobacterium tuberculosis
ARRRGG

SEQ ID NO: 1441410 - protein, 18 aa, Mycobacterium tuberculosis
ARRRGHQRRGQAAGDRRA

SEQ ID NO: 1441411 - protein, 8 aa, Mycobacterium tuberculosis
ARRRGREY

SEQ ID NO: 1441412 - protein, 15 aa, Mycobacterium tuberculosis
ARRRHRAHSRRRGAS

SEQ ID NO: 1441413 - protein, 8 aa, Mycobacterium tuberculosis
ARRRKSGA

SEQ ID NO: 1441414 - protein, 7 aa, Mycobacterium tuberculosis
ARRRPAG

SEQ ID NO: 1441415 - protein, 21 aa, Mycobacterium tuberculosis
ARRRPPSQPQRRCRRGGVCWG

SEQ ID NO: 1441416 - protein, 18 aa, Mycobacterium tuberculosis
ARRRPTHRRRRRSRTSSS

SEQ ID NO: 1441417 - protein, 25 aa, Mycobacterium tuberculosis
ARRRRPPGLAGGAEQPRSRPRPTTT

SEQ ID NO: 1441418 - protein, 31 aa, Mycobacterium tuberculosis
ARRRRRSGHGRRPDREGDAGWQGDSHGAPRR

SEQ ID NO: 1441419 - protein, 6 aa, Mycobacterium tuberculosis
ARRRTR

SEQ ID NO: 1441420 - protein, 7 aa, Mycobacterium tuberculosis
ARRSADL

SEQ ID NO: 1441421 - protein, 6 aa, Mycobacterium tuberculosis
ARRSDG

SEQ ID NO: 1441422 - protein, 6 aa, Mycobacterium tuberculosis
ARRSEL

SEQ ID NO: 1441423 - protein, 8 aa, Mycobacterium tuberculosis
ARRSRQLR

SEQ ID NO: 1441424 - protein, 8 aa, Mycobacterium tuberculosis
ARRSTTAV

SEQ ID NO: 1441425 - protein, 25 aa, Mycobacterium tuberculosis
ARRTGVSGGGPGRSRTGQTGCRPPY

SEQ ID NO: 1441426 - protein, 124 aa, Mycobacterium tuberculosis
ARSAGAGGARSAGAGGARSAGGAGSAGAAGRGSPSGAGRSFTASSTGGATSAGAGGARSAGGAGSAGAAGRGSPSGAGRSLAASSTGGAGSAGGGASGAGSPLTAAASNGASIAAEAGSTSRGV

SEQ ID NO: 1441427 - protein, 8 aa, Mycobacterium tuberculosis
ARSAGNEP

SEQ ID NO: 1441428 - protein, 32 aa, Mycobacterium tuberculosis
ARSCGGVEGQGPLSNAARAAATAASTSAAAAI

SEQ ID NO: 1441429 - protein, 9 aa, Mycobacterium tuberculosis
ARSGAQPRV

SEQ ID NO: 1441430 - protein, 12 aa, Mycobacterium tuberculosis
ARSGDGPGGASV

SEQ ID NO: 1441431 - protein, 14 aa, Mycobacterium tuberculosis
ARSGPANSSNKSRH

SEQ ID NO: 1441432 - protein, 4 aa, Mycobacterium tuberculosis
ARSH

SEQ ID NO: 1441433 - protein, 10 aa, Mycobacterium tuberculosis
ARSREDHRTL

SEQ ID NO: 1441434 - protein, 12 aa, Mycobacterium tuberculosis
ARSRHRRGLQGR

SEQ ID NO: 1441435 - protein, 18 aa, Mycobacterium tuberculosis
ARSTGRSNRAHQGYNRRE

SEQ ID NO: 1441436 - protein, 13 aa, Mycobacterium tuberculosis
ARSTPKPLVRSPG

SEQ ID NO: 1441437 - protein, 13 aa, Mycobacterium tuberculosis
ARTARPAPPPPAV

SEQ ID NO: 1441438 - protein, 4 aa, Mycobacterium tuberculosis
ARTE

SEQ ID NO: 1441439 - protein, 15 aa, Mycobacterium tuberculosis
ARTEHSRRSSALPPQ

SEQ ID NO: 1441440 - protein, 8 aa, Mycobacterium tuberculosis
ARTGKIGD

SEQ ID NO: 1441441 - protein, 15 aa, Mycobacterium tuberculosis
ARTGPVGSAPTPSGW

SEQ ID NO: 1441442 - protein, 6 aa, Mycobacterium tuberculosis
ARTHPG

SEQ ID NO: 1441443 - protein, 9 aa, Mycobacterium tuberculosis
ARTHTPFTT

SEQ ID NO: 1441444 - protein, 16 aa, Mycobacterium tuberculosis
ARTIGGDPARTRRATA

SEQ ID NO: 1441445 - protein, 5 aa, Mycobacterium tuberculosis
ARTPA

SEQ ID NO: 1441446 - protein, 6 aa, Mycobacterium tuberculosis
ARTPAY

SEQ ID NO: 1441447 - protein, 10 aa, Mycobacterium tuberculosis
ARTQREQRAK

SEQ ID NO: 1441448 - protein, 11 aa, Mycobacterium tuberculosis
ARTSPRSARAD

SEQ ID NO: 1441449 - protein, 8 aa, Mycobacterium tuberculosis
ARTTPEAT

SEQ ID NO: 1441450 - protein, 10 aa, Mycobacterium tuberculosis
ARTTPTSTCS

SEQ ID NO: 1441451 - protein, 5 aa, Mycobacterium tuberculosis
ARTVQ

SEQ ID NO: 1441452 - protein, 24 aa, Mycobacterium tuberculosis
ARVATRPAGATTSPTDTAEAVATR

SEQ ID NO: 1441453 - protein, 23 aa, Mycobacterium tuberculosis
ARVATRPAGATTSPTHTDDAALS

SEQ ID NO: 1441454 - protein, 4 aa, Mycobacterium tuberculosis
ARVD

SEQ ID NO: 1441455 - protein, 6 aa, Mycobacterium tuberculosis
ARVDAA

SEQ ID NO: 1441456 - protein, 41 aa, Mycobacterium tuberculosis
ARVEDPADEPDSRGATQRRPGSGLRPPPRGLRSAAGADAAV

SEQ ID NO: 1441457 - protein, 4 aa, Mycobacterium tuberculosis
ARVG

SEQ ID NO: 1441458 - protein, 8 aa, Mycobacterium tuberculosis
ARVGDDEA

SEQ ID NO: 1441459 - protein, 13 aa, Mycobacterium tuberculosis
ARVRAKRPDGDWG

SEQ ID NO: 1441460 - protein, 5 aa, Mycobacterium tuberculosis
ARWSS

SEQ ID NO: 1441461 - protein, 4 aa, Mycobacterium tuberculosis
ARYN

SEQ ID NO: 1441462 - protein, 32 aa, Mycobacterium tuberculosis
ASAAKPGAGGTSRVRGTGRRHQPFSEAGSRCG

SEQ ID NO: 1441463 - protein, 22 aa, Mycobacterium tuberculosis
ASAAPTARSDVGSRRKPTEQHG

SEQ ID NO: 1441464 - protein, 17 aa, Mycobacterium tuberculosis
ASAAPTSTGHASRRPGC

SEQ ID NO: 1441465 - protein, 7 aa, Mycobacterium tuberculosis
ASAARGW

SEQ ID NO: 1441466 - protein, 14 aa, Mycobacterium tuberculosis
ASAARNSAGFGAPR

SEQ ID NO: 1441467 - protein, 23 aa, Mycobacterium tuberculosis
ASAARSAIDTGSDTTTASVRAEA

SEQ ID NO: 1441468 - protein, 10 aa, Mycobacterium tuberculosis
ASAEAANVQQ

SEQ ID NO: 1441469 - protein, 16 aa, Mycobacterium tuberculosis
ASAESSAEKARDSEDR

SEQ ID NO: 1441470 - protein, 9 aa, Mycobacterium tuberculosis
ASAGPGRPA

SEQ ID NO: 1441471 - protein, 12 aa, Mycobacterium tuberculosis
ASAGPRRRRHQV

SEQ ID NO: 1441472 - protein, 22 aa, Mycobacterium tuberculosis
ASAGSNTVTSTPARAETSAMPD

SEQ ID NO: 1441473 - protein, 9 aa, Mycobacterium tuberculosis
ASAGTGKPF

SEQ ID NO: 1441474 - protein, 7 aa, Mycobacterium tuberculosis
ASAGTGN

SEQ ID NO: 1441475 - protein, 28 aa, Mycobacterium tuberculosis
ASAGVDSGERNGGDGDIGDVAGDGDVDR

SEQ ID NO: 1441476 - protein, 29 aa, Mycobacterium tuberculosis
ASAGVDSGERNGGDGDIGDVAGDGDVDRD

SEQ ID NO: 1441477 - protein, 6 aa, Mycobacterium tuberculosis
ASAGVS

SEQ ID NO: 1441478 - protein, 4 aa, Mycobacterium tuberculosis
ASAM

SEQ ID NO: 1441479 - protein, 22 aa, Mycobacterium tuberculosis
ASAPAPAAAAGATAAGPDAAGE

SEQ ID NO: 1441480 - protein, 9 aa, Mycobacterium tuberculosis
ASAPASKAT

SEQ ID NO: 1441481 - protein, 19 aa, Mycobacterium tuberculosis
ASAPITAGTTGAGVAGGRA

SEQ ID NO: 1441482 - protein, 10 aa, Mycobacterium tuberculosis
ASARASPQRV

SEQ ID NO: 1441483 - protein, 11 aa, Mycobacterium tuberculosis
ASARRAGKFAG

SEQ ID NO: 1441484 - protein, 37 aa, Mycobacterium tuberculosis
ASARTQKGGKMSEQVETRVDPTRAADPGLAYSAWVRW

SEQ ID NO: 1441485 - protein, 28 aa, Mycobacterium tuberculosis
ASASPATDKSASASLPTPTSWWWATAAR

SEQ ID NO: 1441486 - protein, 15 aa, Mycobacterium tuberculosis
ASATQLPTQGTTSNT

SEQ ID NO: 1441487 - protein, 5 aa, Mycobacterium tuberculosis
ASAVA

SEQ ID NO: 1441488 - protein, 5 aa, Mycobacterium tuberculosis
ASDAA

SEQ ID NO: 1441489 - protein, 5 aa, Mycobacterium tuberculosis
ASDAH

SEQ ID NO: 1441490 - protein, 5 aa, Mycobacterium tuberculosis
ASDAL

SEQ ID NO: 1441491 - protein, 4 aa, Mycobacterium tuberculosis
ASDD

SEQ ID NO: 1441492 - protein, 6 aa, Mycobacterium tuberculosis
ASDDRA

SEQ ID NO: 1441493 - protein, 12 aa, Mycobacterium tuberculosis
ASDLTQADTVYG

SEQ ID NO: 1441494 - protein, 11 aa, Mycobacterium tuberculosis
ASDRGDAERGS

SEQ ID NO: 1441495 - protein, 19 aa, Mycobacterium tuberculosis
ASDTHGGGGGRPVTPPPPG

SEQ ID NO: 1441496 - protein, 10 aa, Mycobacterium tuberculosis
ASDTNRGGHD

SEQ ID NO: 1441497 - protein, 5 aa, Mycobacterium tuberculosis
ASEAA

SEQ ID NO: 1441498 - protein, 5 aa, Mycobacterium tuberculosis
ASEKA

SEQ ID NO: 1441499 - protein, 7 aa, Mycobacterium tuberculosis
ASENGVP

SEQ ID NO: 1441500 - protein, 20 aa, Mycobacterium tuberculosis
ASERDGCSDVHASASGALGQ

SEQ ID NO: 1441501 - protein, 14 aa, Mycobacterium tuberculosis
ASERTGPSRACQGD

SEQ ID NO: 1441502 - protein, 27 aa, Mycobacterium tuberculosis
ASETERSGPGTQPADAQTATSATVRPL

SEQ ID NO: 1441503 - protein, 15 aa, Mycobacterium tuberculosis
ASEYEINGSSCRLMD

SEQ ID NO: 1441504 - protein, 5 aa, Mycobacterium tuberculosis
ASFNS

SEQ ID NO: 1441505 - protein, 35 aa, Mycobacterium tuberculosis
ASFPPAPASANLPKPNGQTPPPTSDDLSERFVSAP

SEQ ID NO: 1441506 - protein, 6 aa, Mycobacterium tuberculosis
ASFTPS

SEQ ID NO: 1441507 - protein, 15 aa, Mycobacterium tuberculosis
ASGAAGTTKGVTGTT

SEQ ID NO: 1441508 - protein, 14 aa, Mycobacterium tuberculosis
ASGDGCDSEPALTY

SEQ ID NO: 1441509 - protein, 25 aa, Mycobacterium tuberculosis
ASGDRKRGGAGRGGSPPGGAPVTNV

SEQ ID NO: 1441510 - protein, 5 aa, Mycobacterium tuberculosis
ASGES

SEQ ID NO: 1441511 - protein, 26 aa, Mycobacterium tuberculosis
ASGGAGGAGGAATTGTGGAGGAGGKA

SEQ ID NO: 1441512 - protein, 25 aa, Mycobacterium tuberculosis
ASGGAGGSGGSSLTDGGGIGGVGGA

SEQ ID NO: 1441513 - protein, 23 aa, Mycobacterium tuberculosis
ASGGGRPGRANRGAKRGPGDELA

SEQ ID NO: 1441514 - protein, 8 aa, Mycobacterium tuberculosis
ASGGYPVE

SEQ ID NO: 1441515 - protein, 7 aa, Mycobacterium tuberculosis
ASGIGSH

SEQ ID NO: 1441516 - protein, 6 aa, Mycobacterium tuberculosis
ASGIGT

SEQ ID NO: 1441517 - protein, 9 aa, Mycobacterium tuberculosis
ASGIPKANY

SEQ ID NO: 1441518 - protein, 9 aa, Mycobacterium tuberculosis
ASGLDAAGV

SEQ ID NO: 1441519 - protein, 11 aa, Mycobacterium tuberculosis
ASGNGGNAGQV

SEQ ID NO: 1441520 - protein, 10 aa, Mycobacterium tuberculosis
ASGPETAAQG

SEQ ID NO: 1441521 - protein, 7 aa, Mycobacterium tuberculosis
ASGPGLI

SEQ ID NO: 1441522 - protein, 12 aa, Mycobacterium tuberculosis
ASGPLTQPTGRG

SEQ ID NO: 1441523 - protein, 15 aa, Mycobacterium tuberculosis
ASGPVPPGRSAAPQC

SEQ ID NO: 1441524 - protein, 11 aa, Mycobacterium tuberculosis
ASGSGPTFGST

SEQ ID NO: 1441525 - protein, 12 aa, Mycobacterium tuberculosis
ASGTDPHQTPVR

SEQ ID NO: 1441526 - protein, 6 aa, Mycobacterium tuberculosis
ASGTSA

SEQ ID NO: 1441527 - protein, 8 aa, Mycobacterium tuberculosis
ASGTVTTN

SEQ ID NO: 1441528 - protein, 4 aa, Mycobacterium tuberculosis
ASGV

SEQ ID NO: 1441529 - protein, 73 aa, Mycobacterium tuberculosis
ASGVDASDHGPGSGGNGGNGGNGAQASVAGGAGGNGGDGGNAGRVGDGGAGGNGGDGAAGANGANSGAPGSDA

SEQ ID NO: 1441530 - protein, 7 aa, Mycobacterium tuberculosis
ASHDQSL

SEQ ID NO: 1441531 - protein, 7 aa, Mycobacterium tuberculosis
ASHPRPG

SEQ ID NO: 1441532 - protein, 8 aa, Mycobacterium tuberculosis
ASHSGSGL

SEQ ID NO: 1441533 - protein, 4 aa, Mycobacterium tuberculosis
ASIP

SEQ ID NO: 1441534 - protein, 16 aa, Mycobacterium tuberculosis
ASIPADRAQRGDQHRH

SEQ ID NO: 1441535 - protein, 21 aa, Mycobacterium tuberculosis
ASIPGMNGDHRNGSRTTSRSR

SEQ ID NO: 1441536 - protein, 12 aa, Mycobacterium tuberculosis
ASKADTPDGCGR

SEQ ID NO: 1441537 - protein, 13 aa, Mycobacterium tuberculosis
ASKGKWDTFARHG

SEQ ID NO: 1441538 - protein, 7 aa, Mycobacterium tuberculosis
ASKLDEE

SEQ ID NO: 1441539 - protein, 7 aa, Mycobacterium tuberculosis
ASKNSRL

SEQ ID NO: 1441540 - protein, 4 aa, Mycobacterium tuberculosis
ASLA

SEQ ID NO: 1441541 - protein, 5 aa, Mycobacterium tuberculosis
ASLAP

SEQ ID NO: 1441542 - protein, 5 aa, Mycobacterium tuberculosis
ASLEA

SEQ ID NO: 1441543 - protein, 34 aa, Mycobacterium tuberculosis
ASLGGGGGGGVPSAPLGSAIGGAESVRPAGAGDI

SEQ ID NO: 1441544 - protein, 6 aa, Mycobacterium tuberculosis
ASLPST

SEQ ID NO: 1441545 - protein, 12 aa, Mycobacterium tuberculosis
ASLRGRPGSGAT

SEQ ID NO: 1441546 - protein, 5 aa, Mycobacterium tuberculosis
ASLSD

SEQ ID NO: 1441547 - protein, 6 aa, Mycobacterium tuberculosis
ASLTEM

SEQ ID NO: 1441548 - protein, 22 aa, Mycobacterium tuberculosis
ASNPPRPPVPACPPSPPSPPVP

SEQ ID NO: 1441549 - protein, 22 aa, Mycobacterium tuberculosis
ASNPPRPPVPTCPPSPQSPPVP

SEQ ID NO: 1441550 - protein, 24 aa, Mycobacterium tuberculosis
ASNRRRPSPTRSRPRAPMPGSSTR

SEQ ID NO: 1441551 - protein, 12 aa, Mycobacterium tuberculosis
ASNSARSKPRCS

SEQ ID NO: 1441552 - protein, 39 aa, Mycobacterium tuberculosis
ASNSSVRPLTTGGSWTPTSISSTDGGKAQGHDTHDRQIS

SEQ ID NO: 1441553 - protein, 20 aa, Mycobacterium tuberculosis
ASPADPPPPDASASHSPVDM

SEQ ID NO: 1441554 - protein, 12 aa, Mycobacterium tuberculosis
ASPAHTPEPFDS

SEQ ID NO: 1441555 - protein, 7 aa, Mycobacterium tuberculosis
ASPDPAL

SEQ ID NO: 1441556 - protein, 18 aa, Mycobacterium tuberculosis
ASPGGTGGAGGHGGAGGL

SEQ ID NO: 1441557 - protein, 26 aa, Mycobacterium tuberculosis
ASPGGTGGAGGPGGAGGLIWGNGGAG

SEQ ID NO: 1441558 - protein, 7 aa, Mycobacterium tuberculosis
ASPGSLD

SEQ ID NO: 1441559 - protein, 10 aa, Mycobacterium tuberculosis
ASPHRRPPGS

SEQ ID NO: 1441560 - protein, 14 aa, Mycobacterium tuberculosis
ASPKLRNRQYRTQF

SEQ ID NO: 1441561 - protein, 11 aa, Mycobacterium tuberculosis
ASPPTPPAPPI

SEQ ID NO: 1441562 - protein, 4 aa, Mycobacterium tuberculosis
ASPS

SEQ ID NO: 1441563 - protein, 6 aa, Mycobacterium tuberculosis
ASPSNR

SEQ ID NO: 1441564 - protein, 12 aa, Mycobacterium tuberculosis
ASPSRRPGSDLA

SEQ ID NO: 1441565 - protein, 10 aa, Mycobacterium tuberculosis
ASPTCPTRSS

SEQ ID NO: 1441566 - protein, 7 aa, Mycobacterium tuberculosis
ASPTRSV

SEQ ID NO: 1441567 - protein, 7 aa, Mycobacterium tuberculosis
ASQPGCA

SEQ ID NO: 1441568 - protein, 23 aa, Mycobacterium tuberculosis
ASQPSYPAPELSAGADVDGRADQ

SEQ ID NO: 1441569 - protein, 5 aa, Mycobacterium tuberculosis
ASQQI

SEQ ID NO: 1441570 - protein, 14 aa, Mycobacterium tuberculosis
ASRAANSVNTSSRR

SEQ ID NO: 1441571 - protein, 12 aa, Mycobacterium tuberculosis
ASRAGAPPMTTR

SEQ ID NO: 1441572 - protein, 21 aa, Mycobacterium tuberculosis
ASRARSRCTKGSRHYRERTTE

SEQ ID NO: 1441573 - protein, 10 aa, Mycobacterium tuberculosis
ASRAVSASLA

SEQ ID NO: 1441574 - protein, 12 aa, Mycobacterium tuberculosis
ASRDTRQGVGAG

SEQ ID NO: 1441575 - protein, 13 aa, Mycobacterium tuberculosis
ASRGKWDTLHTMG

SEQ ID NO: 1441576 - protein, 25 aa, Mycobacterium tuberculosis
ASRGREGPRPARGDPGYRRRWSDHP

SEQ ID NO: 1441577 - protein, 9 aa, Mycobacterium tuberculosis
ASRGRTGRF

SEQ ID NO: 1441578 - protein, 5 aa, Mycobacterium tuberculosis
ASRIP

SEQ ID NO: 1441579 - protein, 12 aa, Mycobacterium tuberculosis
ASRNSTTINPGT

SEQ ID NO: 1441580 - protein, 15 aa, Mycobacterium tuberculosis
ASRPEHPAPNSDARV

SEQ ID NO: 1441581 - protein, 12 aa, Mycobacterium tuberculosis
ASRPSTTTWATP

SEQ ID NO: 1441582 - protein, 13 aa, Mycobacterium tuberculosis
ASRRTARRGGGGR

SEQ ID NO: 1441583 - protein, 5 aa, Mycobacterium tuberculosis
ASRTP

SEQ ID NO: 1441584 - protein, 7 aa, Mycobacterium tuberculosis
ASRTRLH

SEQ ID NO: 1441585 - protein, 12 aa, Mycobacterium tuberculosis
ASRTRPGRGSDA

SEQ ID NO: 1441586 - protein, 11 aa, Mycobacterium tuberculosis
ASRYPTPERAI

SEQ ID NO: 1441587 - protein, 8 aa, Mycobacterium tuberculosis
ASSAAAGR

SEQ ID NO: 1441588 - protein, 23 aa, Mycobacterium tuberculosis
ASSADGGAGGARAASRFRTVPAC

SEQ ID NO: 1441589 - protein, 9 aa, Mycobacterium tuberculosis
ASSAPVGAA

SEQ ID NO: 1441590 - protein, 35 aa, Mycobacterium tuberculosis
ASSASSYAATEVANAAAGQLSQEQSARETTRNRTR

SEQ ID NO: 1441591 - protein, 27 aa, Mycobacterium tuberculosis
ASSFPPGTPPPPNYPKHQRQQSTSTHA

SEQ ID NO: 1441592 - protein, 5 aa, Mycobacterium tuberculosis
ASSGL

SEQ ID NO: 1441593 - protein, 18 aa, Mycobacterium tuberculosis
ASSGTPTSASRSGSSQRW

SEQ ID NO: 1441594 - protein, 4 aa, Mycobacterium tuberculosis
ASSH

SEQ ID NO: 1441595 - protein, 6 aa, Mycobacterium tuberculosis
ASSIEA

SEQ ID NO: 1441596 - protein, 4 aa, Mycobacterium tuberculosis
ASSM

SEQ ID NO: 1441597 - protein, 8 aa, Mycobacterium tuberculosis
ASSNARHR

SEQ ID NO: 1441598 - protein, 8 aa, Mycobacterium tuberculosis
ASSQLEDN

SEQ ID NO: 1441599 - protein, 42 aa, Mycobacterium tuberculosis
ASSTPGLPTSGCSTPAATTPVSATPGWPAPGWSTPAASTPVW

SEQ ID NO: 1441600 - protein, 7 aa, Mycobacterium tuberculosis
ASSVASA

SEQ ID NO: 1441601 - protein, 18 aa, Mycobacterium tuberculosis
ASSWTPSPTDSAPTPASG

SEQ ID NO: 1441602 - protein, 8 aa, Mycobacterium tuberculosis
ASTAARRG

SEQ ID NO: 1441603 - protein, 63 aa, Mycobacterium tuberculosis
ASTARPSVTAGGVGGRPAGNSFASGAAGTALTARTAGAARTDEAASATGAAVANQQPACTPVT

SEQ ID NO: 1441604 - protein, 61 aa, Mycobacterium tuberculosis
ASTARPSVTAGGVGGRPAGNSFASGAAGTGPHRPHRRRRPHRRGRTAPPAPPLPISSPPAP

SEQ ID NO: 1441605 - protein, 12 aa, Mycobacterium tuberculosis
ASTATRIGQNGF

SEQ ID NO: 1441606 - protein, 7 aa, Mycobacterium tuberculosis
ASTDDVR

SEQ ID NO: 1441607 - protein, 5 aa, Mycobacterium tuberculosis
ASTDT

SEQ ID NO: 1441608 - protein, 10 aa, Mycobacterium tuberculosis
ASTGKRRPAY

SEQ ID NO: 1441609 - protein, 5 aa, Mycobacterium tuberculosis
ASTLG

SEQ ID NO: 1441610 - protein, 6 aa, Mycobacterium tuberculosis
ASTPIT

SEQ ID NO: 1441611 - protein, 12 aa, Mycobacterium tuberculosis
ASTRKPDRLRQT

SEQ ID NO: 1441612 - protein, 6 aa, Mycobacterium tuberculosis
ASTRTF

SEQ ID NO: 1441613 - protein, 21 aa, Mycobacterium tuberculosis
ASTRTLTGATLPTWSAAADCR

SEQ ID NO: 1441614 - protein, 35 aa, Mycobacterium tuberculosis
ASTRVAATSASGTRAPATSAYSTPAAETSASGIRA

SEQ ID NO: 1441615 - protein, 7 aa, Mycobacterium tuberculosis
ASTTSAT

SEQ ID NO: 1441616 - protein, 14 aa, Mycobacterium tuberculosis
ASVAEDVPPSHDDI

SEQ ID NO: 1441617 - protein, 27 aa, Mycobacterium tuberculosis
ASVAGSQQADGVATTKITGNSSADDIA

SEQ ID NO: 1441618 - protein, 7 aa, Mycobacterium tuberculosis
ASVAGTA

SEQ ID NO: 1441619 - protein, 14 aa, Mycobacterium tuberculosis
ASVKRAARQRGVSE

SEQ ID NO: 1441620 - protein, 17 aa, Mycobacterium tuberculosis
ASVPPRAPAGGGAAVGG

SEQ ID NO: 1441621 - protein, 13 aa, Mycobacterium tuberculosis
ASVQRGSRRDTGN

SEQ ID NO: 1441622 - protein, 8 aa, Mycobacterium tuberculosis
ASVRQGDR

SEQ ID NO: 1441623 - protein, 7 aa, Mycobacterium tuberculosis
ASVTDGA

SEQ ID NO: 1441624 - protein, 6 aa, Mycobacterium tuberculosis
ASYRDG

SEQ ID NO: 1441625 - protein, 13 aa, Mycobacterium tuberculosis
ATAAAQREGKMGR

SEQ ID NO: 1441626 - protein, 19 aa, Mycobacterium tuberculosis
ATAAKAPTLSAADRPARTV

SEQ ID NO: 1441627 - protein, 12 aa, Mycobacterium tuberculosis
ATAATAAMSHRE

SEQ ID NO: 1441628 - protein, 12 aa, Mycobacterium tuberculosis
ATADGADKSGLT

SEQ ID NO: 1441629 - protein, 8 aa, Mycobacterium tuberculosis
ATADLSQR

SEQ ID NO: 1441630 - protein, 10 aa, Mycobacterium tuberculosis
ATADQDRATD

SEQ ID NO: 1441631 - protein, 6 aa, Mycobacterium tuberculosis
ATADTS

SEQ ID NO: 1441632 - protein, 19 aa, Mycobacterium tuberculosis
ATADVGGAGGFGGSGGRGG

SEQ ID NO: 1441633 - protein, 15 aa, Mycobacterium tuberculosis
ATAELAPAAADEVSA

SEQ ID NO: 1441634 - protein, 74 aa, Mycobacterium tuberculosis
ATAGAPGALGGKGGSGGLIGRAGSDGGVGAGGAGGAGGAGGTGGEGGTGGDGKTTDGNPGMGGSPGSAGQPGQP

SEQ ID NO: 1441635 - protein, 31 aa, Mycobacterium tuberculosis
ATAGKLKGAASSEESTEVDPTVAQARQQLED

SEQ ID NO: 1441636 - protein, 20 aa, Mycobacterium tuberculosis
ATAGTAEVGLPAEPPATPGR

SEQ ID NO: 1441637 - protein, 8 aa, Mycobacterium tuberculosis
ATAGTPRR

SEQ ID NO: 1441638 - protein, 66 aa, Mycobacterium tuberculosis
ATAHQPQWATTPAAPAAAPHSTPGGVHSTESGPHGRSLSAHGSEPTHDGASHGSGHGSGSEPPGLH

SEQ ID NO: 1441639 - protein, 7 aa, Mycobacterium tuberculosis
ATAIQRE

SEQ ID NO: 1441640 - protein, 15 aa, Mycobacterium tuberculosis
ATAITPGLESPTIAP

SEQ ID NO: 1441641 - protein, 10 aa, Mycobacterium tuberculosis
ATALPATTRA

SEQ ID NO: 1441642 - protein, 5 aa, Mycobacterium tuberculosis
ATAPE

SEQ ID NO: 1441643 - protein, 6 aa, Mycobacterium tuberculosis
ATAPGN

SEQ ID NO: 1441644 - protein, 21 aa, Mycobacterium tuberculosis
ATAPGNDGGDGGDGGRGGDAQ

SEQ ID NO: 1441645 - protein, 5 aa, Mycobacterium tuberculosis
ATAPR

SEQ ID NO: 1441646 - protein, 17 aa, Mycobacterium tuberculosis
ATAPTAPRGPGSPVGPG

SEQ ID NO: 1441647 - protein, 5 aa, Mycobacterium tuberculosis
ATAQR

SEQ ID NO: 1441648 - protein, 12 aa, Mycobacterium tuberculosis
ATARCTRSCWIV

SEQ ID NO: 1441649 - protein, 9 aa, Mycobacterium tuberculosis
ATARGRNQN

SEQ ID NO: 1441650 - protein, 36 aa, Mycobacterium tuberculosis
ATASPADTGGRSEPASAQEATAGSAAPAATVAACRE

SEQ ID NO: 1441651 - protein, 12 aa, Mycobacterium tuberculosis
ATATAIQREYSG

SEQ ID NO: 1441652 - protein, 8 aa, Mycobacterium tuberculosis
ATATATAT

SEQ ID NO: 1441653 - protein, 10 aa, Mycobacterium tuberculosis
ATATSASSAL

SEQ ID NO: 1441654 - protein, 6 aa, Mycobacterium tuberculosis
ATDELP

SEQ ID NO: 1441655 - protein, 8 aa, Mycobacterium tuberculosis
ATDGDGEA

SEQ ID NO: 1441656 - protein, 10 aa, Mycobacterium tuberculosis
ATDPAGDGFG

SEQ ID NO: 1441657 - protein, 7 aa, Mycobacterium tuberculosis
ATDPDGN

SEQ ID NO: 1441658 - protein, 17 aa, Mycobacterium tuberculosis
ATDTHGPPPDPNDDPPP

SEQ ID NO: 1441659 - protein, 7 aa, Mycobacterium tuberculosis
ATDVRDE

SEQ ID NO: 1441660 - protein, 16 aa, Mycobacterium tuberculosis
ATEAIGAGRYERSDGG

SEQ ID NO: 1441661 - protein, 11 aa, Mycobacterium tuberculosis
ATEQANNTQPI

SEQ ID NO: 1441662 - protein, 13 aa, Mycobacterium tuberculosis
ATEQVPGESYEHG

SEQ ID NO: 1441663 - protein, 11 aa, Mycobacterium tuberculosis
ATETDGTSDDG

SEQ ID NO: 1441664 - protein, 17 aa, Mycobacterium tuberculosis
ATETLDAETTDSDATSL

SEQ ID NO: 1441665 - protein, 4 aa, Mycobacterium tuberculosis
ATFR

SEQ ID NO: 1441666 - protein, 11 aa, Mycobacterium tuberculosis
ATFSDAAARDA

SEQ ID NO: 1441667 - protein, 10 aa, Mycobacterium tuberculosis
ATGAADPRAP

SEQ ID NO: 1441668 - protein, 9 aa, Mycobacterium tuberculosis
ATGAAQAAA

SEQ ID NO: 1441669 - protein, 17 aa, Mycobacterium tuberculosis
ATGADGGDGGSGGAGGI

SEQ ID NO: 1441670 - protein, 11 aa, Mycobacterium tuberculosis
ATGADNVSQEA

SEQ ID NO: 1441671 - protein, 83 aa, Mycobacterium tuberculosis
ATGAPGGNGGNGGSVEHTGATGSSASGGNGATGGNGGVGAPGGAGGNGGHVSGGSVNTAGAGGKGGNGGTGGAGGPGGHGGSV

SEQ ID NO: 1441672 - protein, 13 aa, Mycobacterium tuberculosis
ATGASAGAQQTTL

SEQ ID NO: 1441673 - protein, 11 aa, Mycobacterium tuberculosis
ATGASTGPDVH

SEQ ID NO: 1441674 - protein, 6 aa, Mycobacterium tuberculosis
ATGEFE

SEQ ID NO: 1441675 - protein, 21 aa, Mycobacterium tuberculosis
ATGGQAGGPRRRQRPRPGQHA

SEQ ID NO: 1441676 - protein, 12 aa, Mycobacterium tuberculosis
ATGGSGGTGRQR

SEQ ID NO: 1441677 - protein, 14 aa, Mycobacterium tuberculosis
ATGKGVTGGGSRVP

SEQ ID NO: 1441678 - protein, 5 aa, Mycobacterium tuberculosis
ATGLT

SEQ ID NO: 1441679 - protein, 6 aa, Mycobacterium tuberculosis
ATGMMS

SEQ ID NO: 1441680 - protein, 4 aa, Mycobacterium tuberculosis
ATGN

SEQ ID NO: 1441681 - protein, 8 aa, Mycobacterium tuberculosis
ATGPTGAR

SEQ ID NO: 1441682 - protein, 19 aa, Mycobacterium tuberculosis
ATGSLGPSCPPAAGPMRER

SEQ ID NO: 1441683 - protein, 21 aa, Mycobacterium tuberculosis
ATGSRSSSTSCGTARRRATPQ

SEQ ID NO: 1441684 - protein, 8 aa, Mycobacterium tuberculosis
ATGSTGTT

SEQ ID NO: 1441685 - protein, 41 aa, Mycobacterium tuberculosis
ATGSWANSPGCGTPTRPKPTPGPTSSGRRPNDPRTTSSSSL

SEQ ID NO: 1441686 - protein, 7 aa, Mycobacterium tuberculosis
ATGTTAA

SEQ ID NO: 1441687 - protein, 8 aa, Mycobacterium tuberculosis
ATGVPRGL

SEQ ID NO: 1441688 - protein, 8 aa, Mycobacterium tuberculosis
ATHATLPG

SEQ ID NO: 1441689 - protein, 28 aa, Mycobacterium tuberculosis
ATHGPVDTPANTPGAPPASTGTTGPVAP

SEQ ID NO: 1441690 - protein, 4 aa, Mycobacterium tuberculosis
ATHH

SEQ ID NO: 1441691 - protein, 5 aa, Mycobacterium tuberculosis
ATHNA

SEQ ID NO: 1441692 - protein, 25 aa, Mycobacterium tuberculosis
ATHPRREQGADFTPGARGSRRCTTS

SEQ ID NO: 1441693 - protein, 23 aa, Mycobacterium tuberculosis
ATIGSSTMTGTSVRSSGSESRYG

SEQ ID NO: 1441694 - protein, 14 aa, Mycobacterium tuberculosis
ATIGTRRAPRPDGP

SEQ ID NO: 1441695 - protein, 5 aa, Mycobacterium tuberculosis
ATISQ

SEQ ID NO: 1441696 - protein, 8 aa, Mycobacterium tuberculosis
ATKAGLPA

SEQ ID NO: 1441697 - protein, 10 aa, Mycobacterium tuberculosis
ATKANADPRS

SEQ ID NO: 1441698 - protein, 11 aa, Mycobacterium tuberculosis
ATKGASHTSQM

SEQ ID NO: 1441699 - protein, 10 aa, Mycobacterium tuberculosis
ATKPTKPNWA

SEQ ID NO: 1441700 - protein, 15 aa, Mycobacterium tuberculosis
ATKTNDVAGDGTTTA

SEQ ID NO: 1441701 - protein, 5 aa, Mycobacterium tuberculosis
ATLEQ

SEQ ID NO: 1441702 - protein, 5 aa, Mycobacterium tuberculosis
ATLPK

SEQ ID NO: 1441703 - protein, 24 aa, Mycobacterium tuberculosis
ATLPSGVGGVGGARWGTAGDGRCR

SEQ ID NO: 1441704 - protein, 4 aa, Mycobacterium tuberculosis
ATLR

SEQ ID NO: 1441705 - protein, 4 aa, Mycobacterium tuberculosis
ATLT

SEQ ID NO: 1441706 - protein, 8 aa, Mycobacterium tuberculosis
ATLTGASI

SEQ ID NO: 1441707 - protein, 12 aa, Mycobacterium tuberculosis
ATMPGGGATPAL

SEQ ID NO: 1441708 - protein, 25 aa, Mycobacterium tuberculosis
ATNPKRRHPRTTRPSTSRPHPRRGQ

SEQ ID NO: 1441709 - protein, 64 aa, Mycobacterium tuberculosis
ATPAAATSATTTSATTTSAAATPAPATSAAATPAAATWASATSATGISASATPVAGISGSGSPV

SEQ ID NO: 1441710 - protein, 7 aa, Mycobacterium tuberculosis
ATPAARR

SEQ ID NO: 1441711 - protein, 23 aa, Mycobacterium tuberculosis
ATPADTGLSQSESGIAGAGTDPG

SEQ ID NO: 1441712 - protein, 59 aa, Mycobacterium tuberculosis
ATPADTGLSQSESGIAGAGTGPPTPGAARWSPGDSATVTPRPPDRRKPVANPSQTVRSH

SEQ ID NO: 1441713 - protein, 4 aa, Mycobacterium tuberculosis
ATPD

SEQ ID NO: 1441714 - protein, 9 aa, Mycobacterium tuberculosis
ATPDKRSTT

SEQ ID NO: 1441715 - protein, 11 aa, Mycobacterium tuberculosis
ATPDNPYPTTT

SEQ ID NO: 1441716 - protein, 7 aa, Mycobacterium tuberculosis
ATPDVDA

SEQ ID NO: 1441717 - protein, 23 aa, Mycobacterium tuberculosis
ATPGPSGPATPGTPGGEPAPHVK

SEQ ID NO: 1441718 - protein, 16 aa, Mycobacterium tuberculosis
ATPHPASAAPISGGTD

SEQ ID NO: 1441719 - protein, 12 aa, Mycobacterium tuberculosis
ATPKASRTTPEA

SEQ ID NO: 1441720 - protein, 7 aa, Mycobacterium tuberculosis
ATPLGPL

SEQ ID NO: 1441721 - protein, 11 aa, Mycobacterium tuberculosis
ATPNADGSYSL

SEQ ID NO: 1441722 - protein, 15 aa, Mycobacterium tuberculosis
ATQAEQAATQARAAA

SEQ ID NO: 1441723 - protein, 5 aa, Mycobacterium tuberculosis
ATQAG

SEQ ID NO: 1441724 - protein, 20 aa, Mycobacterium tuberculosis
ATQDGRPAVAAGSVRVESLL

SEQ ID NO: 1441725 - protein, 7 aa, Mycobacterium tuberculosis
ATQGGVG

SEQ ID NO: 1441726 - protein, 31 aa, Mycobacterium tuberculosis
ATQGRQPHLADGPAAGRAHRGAARHQADEPD

SEQ ID NO: 1441727 - protein, 9 aa, Mycobacterium tuberculosis
ATQNDAAPP

SEQ ID NO: 1441728 - protein, 4 aa, Mycobacterium tuberculosis
ATQQ

SEQ ID NO: 1441729 - protein, 6 aa, Mycobacterium tuberculosis
ATRDEL

SEQ ID NO: 1441730 - protein, 17 aa, Mycobacterium tuberculosis
ATRENAAKALRPGCWCC

SEQ ID NO: 1441731 - protein, 6 aa, Mycobacterium tuberculosis
ATRGAG

SEQ ID NO: 1441732 - protein, 15 aa, Mycobacterium tuberculosis
ATRGEGLDPGTGPGH

SEQ ID NO: 1441733 - protein, 19 aa, Mycobacterium tuberculosis
ATRGQRNGLPPAMSGERIG

SEQ ID NO: 1441734 - protein, 6 aa, Mycobacterium tuberculosis
ATRGRS

SEQ ID NO: 1441735 - protein, 5 aa, Mycobacterium tuberculosis
ATRIP

SEQ ID NO: 1441736 - protein, 10 aa, Mycobacterium tuberculosis
ATRPAQQSGA

SEQ ID NO: 1441737 - protein, 9 aa, Mycobacterium tuberculosis
ATRPGTSVK

SEQ ID NO: 1441738 - protein, 30 aa, Mycobacterium tuberculosis
ATRQPAATARPPTHRYRSGTHRQHIVARAV

SEQ ID NO: 1441739 - protein, 23 aa, Mycobacterium tuberculosis
ATRQPVATAGRPTHRYRSGTHPT

SEQ ID NO: 1441740 - protein, 12 aa, Mycobacterium tuberculosis
ATRRRCGHRRSA

SEQ ID NO: 1441741 - protein, 13 aa, Mycobacterium tuberculosis
ATRSSGQDSAGYG

SEQ ID NO: 1441742 - protein, 10 aa, Mycobacterium tuberculosis
ATRVGDPALE

SEQ ID NO: 1441743 - protein, 23 aa, Mycobacterium tuberculosis
ATSAAASRHRKPTHPTTIATSAQ

SEQ ID NO: 1441744 - protein, 12 aa, Mycobacterium tuberculosis
ATSAAPCRICWA

SEQ ID NO: 1441745 - protein, 6 aa, Mycobacterium tuberculosis
ATSAEQ

SEQ ID NO: 1441746 - protein, 9 aa, Mycobacterium tuberculosis
ATSAQVTAN

SEQ ID NO: 1441747 - protein, 16 aa, Mycobacterium tuberculosis
ATSKPRRRSPARCSPR

SEQ ID NO: 1441748 - protein, 6 aa, Mycobacterium tuberculosis
ATSPMD

SEQ ID NO: 1441749 - protein, 17 aa, Mycobacterium tuberculosis
ATSPPNPDGPPPAPGLP

SEQ ID NO: 1441750 - protein, 10 aa, Mycobacterium tuberculosis
ATSPTSGRLT

SEQ ID NO: 1441751 - protein, 7 aa, Mycobacterium tuberculosis
ATSQRKI

SEQ ID NO: 1441752 - protein, 9 aa, Mycobacterium tuberculosis
ATSSADQRV

SEQ ID NO: 1441753 - protein, 36 aa, Mycobacterium tuberculosis
ATSTGGSGDFGGNGAASAASGADGGAGGAGGNGGAG

SEQ ID NO: 1441754 - protein, 37 aa, Mycobacterium tuberculosis
ATSTGGSGGFGGNGAASAASGADGGAGGVGGNGGAGG

SEQ ID NO: 1441755 - protein, 7 aa, Mycobacterium tuberculosis
ATSTRFG

SEQ ID NO: 1441756 - protein, 6 aa, Mycobacterium tuberculosis
ATSVVA

SEQ ID NO: 1441757 - protein, 6 aa, Mycobacterium tuberculosis
ATTADM

SEQ ID NO: 1441758 - protein, 11 aa, Mycobacterium tuberculosis
ATTASPGATAA

SEQ ID NO: 1441759 - protein, 14 aa, Mycobacterium tuberculosis
ATTATGAADTPRAA

SEQ ID NO: 1441760 - protein, 14 aa, Mycobacterium tuberculosis
ATTATGSTRLPRTG

SEQ ID NO: 1441761 - protein, 30 aa, Mycobacterium tuberculosis
ATTDTRRSHHASSDPVTDYSAATRSTRQRY

SEQ ID NO: 1441762 - protein, 12 aa, Mycobacterium tuberculosis
ATTGRSAAATAA

SEQ ID NO: 1441763 - protein, 9 aa, Mycobacterium tuberculosis
ATTGSAEGA

SEQ ID NO: 1441764 - protein, 4 aa, Mycobacterium tuberculosis
ATTI

SEQ ID NO: 1441765 - protein, 6 aa, Mycobacterium tuberculosis
ATTLRQ

SEQ ID NO: 1441766 - protein, 5 aa, Mycobacterium tuberculosis
ATTMP

SEQ ID NO: 1441767 - protein, 21 aa, Mycobacterium tuberculosis
ATTPASPPETAPQAVPKSPSG

SEQ ID NO: 1441768 - protein, 16 aa, Mycobacterium tuberculosis
ATTPPTRHRPPGGSAT

SEQ ID NO: 1441769 - protein, 15 aa, Mycobacterium tuberculosis
ATTRAAAGPGPLVRF

SEQ ID NO: 1441770 - protein, 14 aa, Mycobacterium tuberculosis
ATVAPAGPPAKGGP

SEQ ID NO: 1441771 - protein, 7 aa, Mycobacterium tuberculosis
ATVDPTS

SEQ ID NO: 1441772 - protein, 14 aa, Mycobacterium tuberculosis
ATVNPANPTPGLAA

SEQ ID NO: 1441773 - protein, 6 aa, Mycobacterium tuberculosis
ATVPPA

SEQ ID NO: 1441774 - protein, 13 aa, Mycobacterium tuberculosis
ATVPSAPAPRPVR

SEQ ID NO: 1441775 - protein, 12 aa, Mycobacterium tuberculosis
ATVTSLNHGCDL

SEQ ID NO: 1441776 - protein, 6 aa, Mycobacterium tuberculosis
ATWTEP

SEQ ID NO: 1441777 - protein, 17 aa, Mycobacterium tuberculosis
ATYAPAPQRFEAGTPMT

SEQ ID NO: 1441778 - protein, 4 aa, Mycobacterium tuberculosis
ATYG

SEQ ID NO: 1441779 - protein, 12 aa, Mycobacterium tuberculosis
AVAAAAGQSWED

SEQ ID NO: 1441780 - protein, 10 aa, Mycobacterium tuberculosis
AVAAPTTGLA

SEQ ID NO: 1441781 - protein, 14 aa, Mycobacterium tuberculosis
AVAARGADAAVAAG

SEQ ID NO: 1441782 - protein, 9 aa, Mycobacterium tuberculosis
AVAARGGNG

SEQ ID NO: 1441783 - protein, 14 aa, Mycobacterium tuberculosis
AVAEDQPRRESGLG

SEQ ID NO: 1441784 - protein, 6 aa, Mycobacterium tuberculosis
AVAGAA

SEQ ID NO: 1441785 - protein, 67 aa, Mycobacterium tuberculosis
AVAPGSGGTGGDGGTGGGGGNGGTGWNGGKGDTGSGGGAGDGGKAPAGGTGGAGGDGGAGGKGGSGG

SEQ ID NO: 1441786 - protein, 12 aa, Mycobacterium tuberculosis
AVAPNSAPALSG

SEQ ID NO: 1441787 - protein, 8 aa, Mycobacterium tuberculosis
AVAQPGDG

SEQ ID NO: 1441788 - protein, 7 aa, Mycobacterium tuberculosis
AVATGTA

SEQ ID NO: 1441789 - protein, 10 aa, Mycobacterium tuberculosis
AVDADPLSER

SEQ ID NO: 1441790 - protein, 9 aa, Mycobacterium tuberculosis
AVDGTPVGN

SEQ ID NO: 1441791 - protein, 7 aa, Mycobacterium tuberculosis
AVDQAGN

SEQ ID NO: 1441792 - protein, 5 aa, Mycobacterium tuberculosis
AVDRG

SEQ ID NO: 1441793 - protein, 19 aa, Mycobacterium tuberculosis
AVEGPAGRVRAEHTGRAGV

SEQ ID NO: 1441794 - protein, 5 aa, Mycobacterium tuberculosis
AVEPV

SEQ ID NO: 1441795 - protein, 4 aa, Mycobacterium tuberculosis
AVGA

SEQ ID NO: 1441796 - protein, 12 aa, Mycobacterium tuberculosis
AVGASRTAEGPH

SEQ ID NO: 1441797 - protein, 27 aa, Mycobacterium tuberculosis
AVGGAGAAGGDATSGTGGFGGAGGSAR

SEQ ID NO: 1441798 - protein, 28 aa, Mycobacterium tuberculosis
AVGGGLRSAGEEPESGAALRAATPVRGA

SEQ ID NO: 1441799 - protein, 8 aa, Mycobacterium tuberculosis
AVGGPGAA

SEQ ID NO: 1441800 - protein, 12 aa, Mycobacterium tuberculosis
AVGGRGRAVGRG

SEQ ID NO: 1441801 - protein, 5 aa, Mycobacterium tuberculosis
AVGKS

SEQ ID NO: 1441802 - protein, 8 aa, Mycobacterium tuberculosis
AVGPASPV

SEQ ID NO: 1441803 - protein, 9 aa, Mycobacterium tuberculosis
AVGPQASAL

SEQ ID NO: 1441804 - protein, 7 aa, Mycobacterium tuberculosis
AVGPVGT

SEQ ID NO: 1441805 - protein, 10 aa, Mycobacterium tuberculosis
AVGQAGASAF

SEQ ID NO: 1441806 - protein, 13 aa, Mycobacterium tuberculosis
AVGQAGASASARQ

SEQ ID NO: 1441807 - protein, 37 aa, Mycobacterium tuberculosis
AVGRPSGAGRERRRRRYPARPACDGRLEPQAVRGTRV

SEQ ID NO: 1441808 - protein, 11 aa, Mycobacterium tuberculosis
AVGTAGSANAA

SEQ ID NO: 1441809 - protein, 9 aa, Mycobacterium tuberculosis
AVHRGSSTS

SEQ ID NO: 1441810 - protein, 8 aa, Mycobacterium tuberculosis
AVKPATAR

SEQ ID NO: 1441811 - protein, 8 aa, Mycobacterium tuberculosis
AVKPSYGL

SEQ ID NO: 1441812 - protein, 8 aa, Mycobacterium tuberculosis
AVNGDRRA

SEQ ID NO: 1441813 - protein, 10 aa, Mycobacterium tuberculosis
AVNPDSGAGV

SEQ ID NO: 1441814 - protein, 21 aa, Mycobacterium tuberculosis
AVNQDGASNGLTAPNGSSQQR

SEQ ID NO: 1441815 - protein, 9 aa, Mycobacterium tuberculosis
AVNRPTPDR

SEQ ID NO: 1441816 - protein, 29 aa, Mycobacterium tuberculosis
AVPAEPAATPVCSPAPPGPAVPAGSASAL

SEQ ID NO: 1441817 - protein, 7 aa, Mycobacterium tuberculosis
AVPASYT

SEQ ID NO: 1441818 - protein, 13 aa, Mycobacterium tuberculosis
AVPAVPRAPFSRS

SEQ ID NO: 1441819 - protein, 5 aa, Mycobacterium tuberculosis
AVPGA

SEQ ID NO: 1441820 - protein, 18 aa, Mycobacterium tuberculosis
AVPGPQPGACRPAAEQGG

SEQ ID NO: 1441821 - protein, 18 aa, Mycobacterium tuberculosis
AVPGRDHRRTRRRRPTLR

SEQ ID NO: 1441822 - protein, 31 aa, Mycobacterium tuberculosis
AVPNPDQVPRRGAAAGRHPARSGVRHEGLLL

SEQ ID NO: 1441823 - protein, 6 aa, Mycobacterium tuberculosis
AVPQPV

SEQ ID NO: 1441824 - protein, 25 aa, Mycobacterium tuberculosis
AVPSVPTAPVSGAPVAPSASSAHRR

SEQ ID NO: 1441825 - protein, 5 aa, Mycobacterium tuberculosis
AVPVR

SEQ ID NO: 1441826 - protein, 17 aa, Mycobacterium tuberculosis
AVQESKPQTADKRHRAH

SEQ ID NO: 1441827 - protein, 5 aa, Mycobacterium tuberculosis
AVQTG

SEQ ID NO: 1441828 - protein, 8 aa, Mycobacterium tuberculosis
AVRGGSCP

SEQ ID NO: 1441829 - protein, 9 aa, Mycobacterium tuberculosis
AVRGPGGLS

SEQ ID NO: 1441830 - protein, 16 aa, Mycobacterium tuberculosis
AVRGQGERIGQATTDL

SEQ ID NO: 1441831 - protein, 9 aa, Mycobacterium tuberculosis
AVRGRGGLS

SEQ ID NO: 1441832 - protein, 19 aa, Mycobacterium tuberculosis
AVSESRDFGPSPESGPPVH

SEQ ID NO: 1441833 - protein, 14 aa, Mycobacterium tuberculosis
AVSGAAADLAAGRG

SEQ ID NO: 1441834 - protein, 8 aa, Mycobacterium tuberculosis
AVSGETAA

SEQ ID NO: 1441835 - protein, 12 aa, Mycobacterium tuberculosis
AVSGETQQKGSQ

SEQ ID NO: 1441836 - protein, 8 aa, Mycobacterium tuberculosis
AVSGGDAG

SEQ ID NO: 1441837 - protein, 17 aa, Mycobacterium tuberculosis
AVSKGNGLRGDRWQRSQ

SEQ ID NO: 1441838 - protein, 6 aa, Mycobacterium tuberculosis
AVSTDD

SEQ ID NO: 1441839 - protein, 16 aa, Mycobacterium tuberculosis
AVTAAPAGYSTVTARP

SEQ ID NO: 1441840 - protein, 18 aa, Mycobacterium tuberculosis
AVTAGTAGAEVTADAVPV

SEQ ID NO: 1441841 - protein, 24 aa, Mycobacterium tuberculosis
AVTDQPRPSTQTAIASPAASTEVS

SEQ ID NO: 1441842 - protein, 6 aa, Mycobacterium tuberculosis
AVTGET

SEQ ID NO: 1441843 - protein, 46 aa, Mycobacterium tuberculosis
AVTGSSAVTAATASPAGAVAAAEAEQTVAAAGPADPAGPASPTIPA

SEQ ID NO: 1441844 - protein, 39 aa, Mycobacterium tuberculosis
AVTGSSAVTAATASPAGAVSAAEPEQTCGRRRSRRPRRV

SEQ ID NO: 1441845 - protein, 6 aa, Mycobacterium tuberculosis
AVTNPL

SEQ ID NO: 1441846 - protein, 9 aa, Mycobacterium tuberculosis
AVTPEQAPL

SEQ ID NO: 1441847 - protein, 9 aa, Mycobacterium tuberculosis
AVTSTTPMK

SEQ ID NO: 1441848 - protein, 42 aa, Mycobacterium tuberculosis
AVTSVATSAAVTPVGVEGDARRARGVSAAGAVTADASIAADT

SEQ ID NO: 1441849 - protein, 4 aa, Mycobacterium tuberculosis
AVTT

SEQ ID NO: 1441850 - protein, 7 aa, Mycobacterium tuberculosis
AVTTNET

SEQ ID NO: 1441851 - protein, 10 aa, Mycobacterium tuberculosis
AVYSDGRPVT

SEQ ID NO: 1441852 - protein, 8 aa, Mycobacterium tuberculosis
AWEPSASA

SEQ ID NO: 1441853 - protein, 25 aa, Mycobacterium tuberculosis
AWEPSASARCAAPSYTVPQRFSLST

SEQ ID NO: 1441854 - protein, 14 aa, Mycobacterium tuberculosis
AWGGAAPGGFDCSG

SEQ ID NO: 1441855 - protein, 15 aa, Mycobacterium tuberculosis
AWGRSSNGSAVLTRT

SEQ ID NO: 1441856 - protein, 13 aa, Mycobacterium tuberculosis
AWSNDSVSCPRSG

SEQ ID NO: 1441857 - protein, 19 aa, Mycobacterium tuberculosis
AWSPHGPTKLPFPRQQKVT

SEQ ID NO: 1441858 - protein, 5 aa, Mycobacterium tuberculosis
AYAAY

SEQ ID NO: 1441859 - protein, 11 aa, Mycobacterium tuberculosis
AYAGAGPHTQS

SEQ ID NO: 1441860 - protein, 18 aa, Mycobacterium tuberculosis
AYDASVTDSLTEVPPAAR

SEQ ID NO: 1441861 - protein, 13 aa, Mycobacterium tuberculosis
AYDDKAKKTTKAV

SEQ ID NO: 1441862 - protein, 9 aa, Mycobacterium tuberculosis
AYDEPASVA

SEQ ID NO: 1441863 - protein, 17 aa, Mycobacterium tuberculosis
AYGEAKSALDAVGGEPL

SEQ ID NO: 1441864 - protein, 69 aa, Mycobacterium tuberculosis
AYGGAGGAGGSAASIGNAAIGGNGGAGGNAQAPGGVGGAGGEGGDAQVGTNSPSNAEAGNGGSGGNGFD

SEQ ID NO: 1441865 - protein, 11 aa, Mycobacterium tuberculosis
AYGGQGLPDGT

SEQ ID NO: 1441866 - protein, 5 aa, Mycobacterium tuberculosis
AYGTP

SEQ ID NO: 1441867 - protein, 4 aa, Mycobacterium tuberculosis
AYNS

SEQ ID NO: 1441868 - protein, 26 aa, Mycobacterium tuberculosis
AYPAARRSRKASERNAGAYDSTHAYT

SEQ ID NO: 1441869 - protein, 8 aa, Mycobacterium tuberculosis
AYQKERVS

SEQ ID NO: 1441870 - protein, 13 aa, Mycobacterium tuberculosis
AYRGGPDHRGGLV

SEQ ID NO: 1441871 - protein, 34 aa, Mycobacterium tuberculosis
AYSASGSEDYPDIPPRPDWKPTGAEPIAAAPAAA

SEQ ID NO: 1441872 - protein, 8 aa, Mycobacterium tuberculosis
AYSDSYND

SEQ ID NO: 1441873 - protein, 10 aa, Mycobacterium tuberculosis
AYSGAPPGYV

SEQ ID NO: 1441874 - protein, 17 aa, Mycobacterium tuberculosis
AYSQAASGRLPDPLPGE

SEQ ID NO: 1441875 - protein, 13 aa, Mycobacterium tuberculosis
AYSYASAEAAAVT

SEQ ID NO: 1441876 - protein, 14 aa, Mycobacterium tuberculosis
CAAESGRAPCALRF

SEQ ID NO: 1441877 - protein, 9 aa, Mycobacterium tuberculosis
CAAGTRNAA

SEQ ID NO: 1441878 - protein, 7 aa, Mycobacterium tuberculosis
CAGPEPN

SEQ ID NO: 1441879 - protein, 18 aa, Mycobacterium tuberculosis
CAGRQADVGPTPQHRCRG

SEQ ID NO: 1441880 - protein, 8 aa, Mycobacterium tuberculosis
CANTREAS

SEQ ID NO: 1441881 - protein, 5 aa, Mycobacterium tuberculosis
CAPGG

SEQ ID NO: 1441882 - protein, 7 aa, Mycobacterium tuberculosis
CAPPEQG

SEQ ID NO: 1441883 - protein, 16 aa, Mycobacterium tuberculosis
CAPSASAVRSAERRAA

SEQ ID NO: 1441884 - protein, 17 aa, Mycobacterium tuberculosis
CCDGSAPDVLPAGGLPG

SEQ ID NO: 1441885 - protein, 26 aa, Mycobacterium tuberculosis
CDAPPRMSSPRSTKEPRRPNCAICAT

SEQ ID NO: 1441886 - protein, 20 aa, Mycobacterium tuberculosis
CDAVGNARPLQGAGNRGEQL

SEQ ID NO: 1441887 - protein, 6 aa, Mycobacterium tuberculosis
CDEADR

SEQ ID NO: 1441888 - protein, 11 aa, Mycobacterium tuberculosis
CDEAGRQPGQR

SEQ ID NO: 1441889 - protein, 8 aa, Mycobacterium tuberculosis
CDGPLGSH

SEQ ID NO: 1441890 - protein, 15 aa, Mycobacterium tuberculosis
CDGQAGSICRAAARV

SEQ ID NO: 1441891 - protein, 5 aa, Mycobacterium tuberculosis
CDPAR

SEQ ID NO: 1441892 - protein, 6 aa, Mycobacterium tuberculosis
CDQQGG

SEQ ID NO: 1441893 - protein, 14 aa, Mycobacterium tuberculosis
CDRQPDPPVSSGNQ

SEQ ID NO: 1441894 - protein, 11 aa, Mycobacterium tuberculosis
CDRRRASTAGR

SEQ ID NO: 1441895 - protein, 15 aa, Mycobacterium tuberculosis
CDSHNSGSLGADPRQ

SEQ ID NO: 1441896 - protein, 12 aa, Mycobacterium tuberculosis
CDYGGSSPVAAG

SEQ ID NO: 1441897 - protein, 5 aa, Mycobacterium tuberculosis
CEAGG

SEQ ID NO: 1441898 - protein, 11 aa, Mycobacterium tuberculosis
CEATREEGEGV

SEQ ID NO: 1441899 - protein, 5 aa, Mycobacterium tuberculosis
CEDQA

SEQ ID NO: 1441900 - protein, 5 aa, Mycobacterium tuberculosis
CELPG

SEQ ID NO: 1441901 - protein, 12 aa, Mycobacterium tuberculosis
CEPTGRLTGPPG

SEQ ID NO: 1441902 - protein, 7 aa, Mycobacterium tuberculosis
CERAAAD

SEQ ID NO: 1441903 - protein, 12 aa, Mycobacterium tuberculosis
CERKPSPGKRNS

SEQ ID NO: 1441904 - protein, 20 aa, Mycobacterium tuberculosis
CGAAEGPYGFTGTSNSFASG

SEQ ID NO: 1441905 - protein, 8 aa, Mycobacterium tuberculosis
CGAAPEPW

SEQ ID NO: 1441906 - protein, 10 aa, Mycobacterium tuberculosis
CGAGARRPDQ

SEQ ID NO: 1441907 - protein, 9 aa, Mycobacterium tuberculosis
CGAGGGASY

SEQ ID NO: 1441908 - protein, 19 aa, Mycobacterium tuberculosis
CGAGRRTRGGDGQGTARSF

SEQ ID NO: 1441909 - protein, 8 aa, Mycobacterium tuberculosis
CGASRARV

SEQ ID NO: 1441910 - protein, 8 aa, Mycobacterium tuberculosis
CGASRGRV

SEQ ID NO: 1441911 - protein, 5 aa, Mycobacterium tuberculosis
CGCPT

SEQ ID NO: 1441912 - protein, 5 aa, Mycobacterium tuberculosis
CGCQP

SEQ ID NO: 1441913 - protein, 8 aa, Mycobacterium tuberculosis
CGDPHPAA

SEQ ID NO: 1441914 - protein, 17 aa, Mycobacterium tuberculosis
CGDRQRSPSAVKTCVMS

SEQ ID NO: 1441915 - protein, 14 aa, Mycobacterium tuberculosis
CGEEPDARSARSRH

SEQ ID NO: 1441916 - protein, 30 aa, Mycobacterium tuberculosis
CGGAGGAAGHGAGAECRRTGGGSFGGLRGR

SEQ ID NO: 1441917 - protein, 8 aa, Mycobacterium tuberculosis
CGGPPGVA

SEQ ID NO: 1441918 - protein, 16 aa, Mycobacterium tuberculosis
CGKTATAIGKPASEGF

SEQ ID NO: 1441919 - protein, 36 aa, Mycobacterium tuberculosis
CGPGPARVVGPGGSGVRYSRPKQPGALDSRTPVRGP

SEQ ID NO: 1441920 - protein, 16 aa, Mycobacterium tuberculosis
CGPGSPMGFRPMVRAR

SEQ ID NO: 1441921 - protein, 9 aa, Mycobacterium tuberculosis
CGPPDPRSR

SEQ ID NO: 1441922 - protein, 22 aa, Mycobacterium tuberculosis
CGPRSGPRRSRTARQLNADPQH

SEQ ID NO: 1441923 - protein, 8 aa, Mycobacterium tuberculosis
CGQRGGKG

SEQ ID NO: 1441924 - protein, 21 aa, Mycobacterium tuberculosis
CGRRPKSSGWQPGPVFELTAT

SEQ ID NO: 1441925 - protein, 9 aa, Mycobacterium tuberculosis
CGSAPARNR

SEQ ID NO: 1441926 - protein, 8 aa, Mycobacterium tuberculosis
CGSPKGLP

SEQ ID NO: 1441927 - protein, 16 aa, Mycobacterium tuberculosis
CGSPLAPEKEGDADIR

SEQ ID NO: 1441928 - protein, 7 aa, Mycobacterium tuberculosis
CGSRRGH

SEQ ID NO: 1441929 - protein, 25 aa, Mycobacterium tuberculosis
CGTGGAGGAGEDGTTPGGNGGAGGV

SEQ ID NO: 1441930 - protein, 22 aa, Mycobacterium tuberculosis
CGTRGGDHDRGLAPRPAGTVDS

SEQ ID NO: 1441931 - protein, 9 aa, Mycobacterium tuberculosis
CGTSTSEVT

SEQ ID NO: 1441932 - protein, 11 aa, Mycobacterium tuberculosis
CHEGAADRRGR

SEQ ID NO: 1441933 - protein, 7 aa, Mycobacterium tuberculosis
CHPDREG

SEQ ID NO: 1441934 - protein, 28 aa, Mycobacterium tuberculosis
CHQSRRRLPAPPAVRGGAGLRGAGHAGT

SEQ ID NO: 1441935 - protein, 25 aa, Mycobacterium tuberculosis
CHRPGRAGGGPGGCAPAGGRRPRGR

SEQ ID NO: 1441936 - protein, 9 aa, Mycobacterium tuberculosis
CLQGSGEQP

SEQ ID NO: 1441937 - protein, 14 aa, Mycobacterium tuberculosis
CNADGSLRKPGQDY

SEQ ID NO: 1441938 - protein, 7 aa, Mycobacterium tuberculosis
CNASRAA

SEQ ID NO: 1441939 - protein, 5 aa, Mycobacterium tuberculosis
CNDPF

SEQ ID NO: 1441940 - protein, 18 aa, Mycobacterium tuberculosis
CNEADAGLPARRRGRGVA

SEQ ID NO: 1441941 - protein, 19 aa, Mycobacterium tuberculosis
CNESSTRAQSQQWATEKGD

SEQ ID NO: 1441942 - protein, 13 aa, Mycobacterium tuberculosis
CNSSNSRRLVEPP

SEQ ID NO: 1441943 - protein, 12 aa, Mycobacterium tuberculosis
CPCAPADPQDCI

SEQ ID NO: 1441944 - protein, 4 aa, Mycobacterium tuberculosis
CPEG

SEQ ID NO: 1441945 - protein, 19 aa, Mycobacterium tuberculosis
CPGRADRRQGQAPTSAERL

SEQ ID NO: 1441946 - protein, 27 aa, Mycobacterium tuberculosis
CPGRADRRQGQAPTSAERLAPHADAQP

SEQ ID NO: 1441947 - protein, 9 aa, Mycobacterium tuberculosis
CPKTSNTPS

SEQ ID NO: 1441948 - protein, 9 aa, Mycobacterium tuberculosis
CPPAGQAPW

SEQ ID NO: 1441949 - protein, 16 aa, Mycobacterium tuberculosis
CPPAPPAPPANPVPPV

SEQ ID NO: 1441950 - protein, 15 aa, Mycobacterium tuberculosis
CPPGRSPFGCPERST

SEQ ID NO: 1441951 - protein, 5 aa, Mycobacterium tuberculosis
CPPGT

SEQ ID NO: 1441952 - protein, 15 aa, Mycobacterium tuberculosis
CPPNAEPKGLASGAA

SEQ ID NO: 1441953 - protein, 14 aa, Mycobacterium tuberculosis
CPPSPIRTAPRCGP

SEQ ID NO: 1441954 - protein, 5 aa, Mycobacterium tuberculosis
CPRNP

SEQ ID NO: 1441955 - protein, 29 aa, Mycobacterium tuberculosis
CPRPVTATAGPELEPADRGQCAGCLGRRS

SEQ ID NO: 1441956 - protein, 15 aa, Mycobacterium tuberculosis
CPSRGPDSGSAATHQ

SEQ ID NO: 1441957 - protein, 8 aa, Mycobacterium tuberculosis
CPVGRDDR

SEQ ID NO: 1441958 - protein, 12 aa, Mycobacterium tuberculosis
CQSARSRCGCGA

SEQ ID NO: 1441959 - protein, 9 aa, Mycobacterium tuberculosis
CQSGQRKPR

SEQ ID NO: 1441960 - protein, 12 aa, Mycobacterium tuberculosis
CQTPQAQGELPV

SEQ ID NO: 1441961 - protein, 9 aa, Mycobacterium tuberculosis
CQTRKTNAH

SEQ ID NO: 1441962 - protein, 25 aa, Mycobacterium tuberculosis
CRADGPAHRRRAGLGGPGCRHHRHQ

SEQ ID NO: 1441963 - protein, 7 aa, Mycobacterium tuberculosis
CRASGAV

SEQ ID NO: 1441964 - protein, 14 aa, Mycobacterium tuberculosis
CRDESDRHGDGPLD

SEQ ID NO: 1441965 - protein, 22 aa, Mycobacterium tuberculosis
CRGDNGAGVGAAGQNRSGHLGG

SEQ ID NO: 1441966 - protein, 30 aa, Mycobacterium tuberculosis
CRGESLAGQPRGSGRPVARGDRRVRRRARH

SEQ ID NO: 1441967 - protein, 11 aa, Mycobacterium tuberculosis
CRGGAPGTRET

SEQ ID NO: 1441968 - protein, 5 aa, Mycobacterium tuberculosis
CRGRT

SEQ ID NO: 1441969 - protein, 28 aa, Mycobacterium tuberculosis
CRGSGRADAGHGRRVGAPPRQKRRGVGR

SEQ ID NO: 1441970 - protein, 19 aa, Mycobacterium tuberculosis
CRGSTGPSSLARDGKPWGS

SEQ ID NO: 1441971 - protein, 14 aa, Mycobacterium tuberculosis
CRKTTSSTPGPTVT

SEQ ID NO: 1441972 - protein, 9 aa, Mycobacterium tuberculosis
CRPARRGNR

SEQ ID NO: 1441973 - protein, 19 aa, Mycobacterium tuberculosis
CRPGPDSGRHGRRCREDAR

SEQ ID NO: 1441974 - protein, 18 aa, Mycobacterium tuberculosis
CRPGPSRYTQLESPGYRS

SEQ ID NO: 1441975 - protein, 17 aa, Mycobacterium tuberculosis
CRPGRRDRPDRAGCRRG

SEQ ID NO: 1441976 - protein, 17 aa, Mycobacterium tuberculosis
CRPGRSGVGDPHCDDPA

SEQ ID NO: 1441977 - protein, 25 aa, Mycobacterium tuberculosis
CRPGVDAGGAVSVGPRRDAQSDEQR

SEQ ID NO: 1441978 - protein, 11 aa, Mycobacterium tuberculosis
CRPPSLPYSGA

SEQ ID NO: 1441979 - protein, 14 aa, Mycobacterium tuberculosis
CRPRRTRCALGRSH

SEQ ID NO: 1441980 - protein, 28 aa, Mycobacterium tuberculosis
CRPSRGRGDDGQLPGGDRGLRPTPGPAA

SEQ ID NO: 1441981 - protein, 34 aa, Mycobacterium tuberculosis
CRQGHRRAAPRSNGVRAGRGRLGDHGSNPLAPVR

SEQ ID NO: 1441982 - protein, 23 aa, Mycobacterium tuberculosis
CRQTQNPERGRKPDDEQRHTEPR

SEQ ID NO: 1441983 - protein, 13 aa, Mycobacterium tuberculosis
CRQTQNPERGRKR

SEQ ID NO: 1441984 - protein, 17 aa, Mycobacterium tuberculosis
CRSGPLTNTAPHTPLNE

SEQ ID NO: 1441985 - protein, 31 aa, Mycobacterium tuberculosis
CRSTGERSPPHAHPASSSNGGVAVGGNPAAV

SEQ ID NO: 1441986 - protein, 28 aa, Mycobacterium tuberculosis
CSAGATSPTGATSPTVAASNGEPSEGTV

SEQ ID NO: 1441987 - protein, 10 aa, Mycobacterium tuberculosis
CSAPDRSLGY

SEQ ID NO: 1441988 - protein, 13 aa, Mycobacterium tuberculosis
CSATPKRRCGRLR

SEQ ID NO: 1441989 - protein, 8 aa, Mycobacterium tuberculosis
CSDDGAAI

SEQ ID NO: 1441990 - protein, 5 aa, Mycobacterium tuberculosis
CSDER

SEQ ID NO: 1441991 - protein, 20 aa, Mycobacterium tuberculosis
CSGEACRPAHGSGGLPAPCG

SEQ ID NO: 1441992 - protein, 14 aa, Mycobacterium tuberculosis
CSGSGPDRGLSASR

SEQ ID NO: 1441993 - protein, 10 aa, Mycobacterium tuberculosis
CSKTSAPHRL

SEQ ID NO: 1441994 - protein, 13 aa, Mycobacterium tuberculosis
CSLGRSPSTTRKR

SEQ ID NO: 1441995 - protein, 8 aa, Mycobacterium tuberculosis
CSNNYGPY

SEQ ID NO: 1441996 - protein, 7 aa, Mycobacterium tuberculosis
CSNPKRG

SEQ ID NO: 1441997 - protein, 17 aa, Mycobacterium tuberculosis
CSNTGRQVGRCPPSRWT

SEQ ID NO: 1441998 - protein, 10 aa, Mycobacterium tuberculosis
CSPKSTRALR

SEQ ID NO: 1441999 - protein, 18 aa, Mycobacterium tuberculosis
CSPPRRKPPRSAQRSRRY

SEQ ID NO: 1442000 - protein, 25 aa, Mycobacterium tuberculosis
CSQPAPRAIGASSRHASAGPVRPAP

SEQ ID NO: 1442001 - protein, 19 aa, Mycobacterium tuberculosis
CSRGSASRRASSSTMRCTR

SEQ ID NO: 1442002 - protein, 21 aa, Mycobacterium tuberculosis
CSRSARANRSPLSDRYSGRPT

SEQ ID NO: 1442003 - protein, 22 aa, Mycobacterium tuberculosis
CSRSTPAPVAPPTRRNRPSGHE

SEQ ID NO: 1442004 - protein, 10 aa, Mycobacterium tuberculosis
CSRTGEIRGY

SEQ ID NO: 1442005 - protein, 8 aa, Mycobacterium tuberculosis
CSRTVGRG

SEQ ID NO: 1442006 - protein, 15 aa, Mycobacterium tuberculosis
CSSPRRWPSTGTGGS

SEQ ID NO: 1442007 - protein, 31 aa, Mycobacterium tuberculosis
CSSSATSPGPSSTRSRGCRASNRRARCMRFP

SEQ ID NO: 1442008 - protein, 21 aa, Mycobacterium tuberculosis
CSSSSTSRASSTSRTGIPSSM

SEQ ID NO: 1442009 - protein, 35 aa, Mycobacterium tuberculosis
CSTASTCPGSPSWTPTSTAASTRDLRPSRCRPLMR

SEQ ID NO: 1442010 - protein, 23 aa, Mycobacterium tuberculosis
CSTSTKSSRSDPSPSRRSMFPRY

SEQ ID NO: 1442011 - protein, 8 aa, Mycobacterium tuberculosis
CTAGQKKA

SEQ ID NO: 1442012 - protein, 19 aa, Mycobacterium tuberculosis
CTATGGPGVRPGSAPPGAS

SEQ ID NO: 1442013 - protein, 7 aa, Mycobacterium tuberculosis
CTDGDSE

SEQ ID NO: 1442014 - protein, 19 aa, Mycobacterium tuberculosis
CTGPAAQVGDQSRSPQRDY

SEQ ID NO: 1442015 - protein, 14 aa, Mycobacterium tuberculosis
CTRSPGTGELAIVV

SEQ ID NO: 1442016 - protein, 16 aa, Mycobacterium tuberculosis
CTSPAAGCATALECPA

SEQ ID NO: 1442017 - protein, 9 aa, Mycobacterium tuberculosis
CTTGDTRAG

SEQ ID NO: 1442018 - protein, 7 aa, Mycobacterium tuberculosis
CTTTRSP

SEQ ID NO: 1442019 - protein, 15 aa, Mycobacterium tuberculosis
CYPSAGAIVVLRVPA

SEQ ID NO: 1442020 - protein, 35 aa, Mycobacterium tuberculosis
CYSGDGGNGGAGGAGGIGGDGATGGPGGSGGNAGI

SEQ ID NO: 1442021 - protein, 8 aa, Mycobacterium tuberculosis
DAAAAGPD

SEQ ID NO: 1442022 - protein, 17 aa, Mycobacterium tuberculosis
DAAARALDRARGAADPL

SEQ ID NO: 1442023 - protein, 15 aa, Mycobacterium tuberculosis
DAADAGDRVRDDDSR

SEQ ID NO: 1442024 - protein, 12 aa, Mycobacterium tuberculosis
DAADLGPRRALT

SEQ ID NO: 1442025 - protein, 16 aa, Mycobacterium tuberculosis
DAADSVDDTLESTAAG

SEQ ID NO: 1442026 - protein, 9 aa, Mycobacterium tuberculosis
DAAGDARPP

SEQ ID NO: 1442027 - protein, 19 aa, Mycobacterium tuberculosis
DAAGLAETRYGAGKNNPWL

SEQ ID NO: 1442028 - protein, 18 aa, Mycobacterium tuberculosis
DAAGLAETRYGAGKNSPG

SEQ ID NO: 1442029 - protein, 14 aa, Mycobacterium tuberculosis
DAAGSGEGGSPAAI

SEQ ID NO: 1442030 - protein, 7 aa, Mycobacterium tuberculosis
DAAGSSA

SEQ ID NO: 1442031 - protein, 5 aa, Mycobacterium tuberculosis
DAAHP

SEQ ID NO: 1442032 - protein, 8 aa, Mycobacterium tuberculosis
DAAKNDDS

SEQ ID NO: 1442033 - protein, 5 aa, Mycobacterium tuberculosis
DAALS

SEQ ID NO: 1442034 - protein, 6 aa, Mycobacterium tuberculosis
DAALSA

SEQ ID NO: 1442035 - protein, 8 aa, Mycobacterium tuberculosis
DAANRGAD

SEQ ID NO: 1442036 - protein, 11 aa, Mycobacterium tuberculosis
DAAPDSATAAK

SEQ ID NO: 1442037 - protein, 7 aa, Mycobacterium tuberculosis
DAARQLP

SEQ ID NO: 1442038 - protein, 6 aa, Mycobacterium tuberculosis
DAASQR

SEQ ID NO: 1442039 - protein, 19 aa, Mycobacterium tuberculosis
DAATGSQGAGAVHATSDRR

SEQ ID NO: 1442040 - protein, 5 aa, Mycobacterium tuberculosis
DAAVP

SEQ ID NO: 1442041 - protein, 46 aa, Mycobacterium tuberculosis
DADAGGGEPDEERPAPRSGQLTGTGALSTSTTRSGSSGAPAGVNPA

SEQ ID NO: 1442042 - protein, 5 aa, Mycobacterium tuberculosis
DADEV

SEQ ID NO: 1442043 - protein, 10 aa, Mycobacterium tuberculosis
DADEVTAAAR

SEQ ID NO: 1442044 - protein, 4 aa, Mycobacterium tuberculosis
DADG

SEQ ID NO: 1442045 - protein, 11 aa, Mycobacterium tuberculosis
DADIVGPGEGI

SEQ ID NO: 1442046 - protein, 8 aa, Mycobacterium tuberculosis
DADLRGAT

SEQ ID NO: 1442047 - protein, 6 aa, Mycobacterium tuberculosis
DADNPC

SEQ ID NO: 1442048 - protein, 20 aa, Mycobacterium tuberculosis
DADRPGVPEMSTPNHRPTQH

SEQ ID NO: 1442049 - protein, 12 aa, Mycobacterium tuberculosis
DADSAVPPRLDE

SEQ ID NO: 1442050 - protein, 6 aa, Mycobacterium tuberculosis
DAEESG

SEQ ID NO: 1442051 - protein, 15 aa, Mycobacterium tuberculosis
DAELNGDPGPPDAPN

SEQ ID NO: 1442052 - protein, 7 aa, Mycobacterium tuberculosis
DAELTER

SEQ ID NO: 1442053 - protein, 9 aa, Mycobacterium tuberculosis
DAEQSGAYP

SEQ ID NO: 1442054 - protein, 10 aa, Mycobacterium tuberculosis
DAETAPLPNP

SEQ ID NO: 1442055 - protein, 5 aa, Mycobacterium tuberculosis
DAEVP

SEQ ID NO: 1442056 - protein, 26 aa, Mycobacterium tuberculosis
DAGAAKTRRCRASGLGSSSGCARPST

SEQ ID NO: 1442057 - protein, 8 aa, Mycobacterium tuberculosis
DAGAAPCR

SEQ ID NO: 1442058 - protein, 33 aa, Mycobacterium tuberculosis
DAGAGGNEALGSKNGCAAISSGASIPSCGRKSL

SEQ ID NO: 1442059 - protein, 13 aa, Mycobacterium tuberculosis
DAGASSPRLTPAS

SEQ ID NO: 1442060 - protein, 46 aa, Mycobacterium tuberculosis
DAGDGGNGGIGGDGGAGGDGGAGGAGGAGGLFGSPGAPGWAVSLVL

SEQ ID NO: 1442061 - protein, 71 aa, Mycobacterium tuberculosis
DAGGAGGAGGKAGLLSGAGGAGGAGGGSFAGAGGTGGAGGAPGLVGNAGNGGNGGASANGAGAAGGAGGSG

SEQ ID NO: 1442062 - protein, 6 aa, Mycobacterium tuberculosis
DAGGDL

SEQ ID NO: 1442063 - protein, 8 aa, Mycobacterium tuberculosis
DAGGYKAS

SEQ ID NO: 1442064 - protein, 8 aa, Mycobacterium tuberculosis
DAGIDPRT

SEQ ID NO: 1442065 - protein, 5 aa, Mycobacterium tuberculosis
DAGIT

SEQ ID NO: 1442066 - protein, 5 aa, Mycobacterium tuberculosis
DAGLP

SEQ ID NO: 1442067 - protein, 14 aa, Mycobacterium tuberculosis
DAGPKNVKTQIQGD

SEQ ID NO: 1442068 - protein, 5 aa, Mycobacterium tuberculosis
DAGPT

SEQ ID NO: 1442069 - protein, 14 aa, Mycobacterium tuberculosis
DAGPVGCRPTPARR

SEQ ID NO: 1442070 - protein, 13 aa, Mycobacterium tuberculosis
DAGPWQRDGALSR

SEQ ID NO: 1442071 - protein, 5 aa, Mycobacterium tuberculosis
DAGQP

SEQ ID NO: 1442072 - protein, 16 aa, Mycobacterium tuberculosis
DAGQRGETRPGGSQVR

SEQ ID NO: 1442073 - protein, 7 aa, Mycobacterium tuberculosis
DAGRAIA

SEQ ID NO: 1442074 - protein, 50 aa, Mycobacterium tuberculosis
DAGRPDSRRHPRIGDQQRRIGEDGGMRRQTRPLKPMSSPKPMRCPASIRR

SEQ ID NO: 1442075 - protein, 16 aa, Mycobacterium tuberculosis
DAGTKGAMRDICGRSR

SEQ ID NO: 1442076 - protein, 18 aa, Mycobacterium tuberculosis
DAHARPGGRDRRHPARSG

SEQ ID NO: 1442077 - protein, 14 aa, Mycobacterium tuberculosis
DAHHAGTAWPRRRA

SEQ ID NO: 1442078 - protein, 19 aa, Mycobacterium tuberculosis
DAHRAAGRDRAYPAETLPE

SEQ ID NO: 1442079 - protein, 16 aa, Mycobacterium tuberculosis
DAHTTRCPSPARPMEN

SEQ ID NO: 1442080 - protein, 20 aa, Mycobacterium tuberculosis
DAIRDGASGRPAPSHFSTRT

SEQ ID NO: 1442081 - protein, 5 aa, Mycobacterium tuberculosis
DAIRE

SEQ ID NO: 1442082 - protein, 15 aa, Mycobacterium tuberculosis
DAKAQADRMVSEARQ

SEQ ID NO: 1442083 - protein, 26 aa, Mycobacterium tuberculosis
DAKPHVEAEPDDKHHAPMSTSGLSPD

SEQ ID NO: 1442084 - protein, 8 aa, Mycobacterium tuberculosis
DAKPPPTF

SEQ ID NO: 1442085 - protein, 11 aa, Mycobacterium tuberculosis
DAKRGHEQRGR

SEQ ID NO: 1442086 - protein, 8 aa, Mycobacterium tuberculosis
DALARTDR

SEQ ID NO: 1442087 - protein, 13 aa, Mycobacterium tuberculosis
DALPNAYPRAGPR

SEQ ID NO: 1442088 - protein, 27 aa, Mycobacterium tuberculosis
DANAADSGHGHRDGKTARSAKRGGIPP

SEQ ID NO: 1442089 - protein, 15 aa, Mycobacterium tuberculosis
DANASIPTPQPGLPR

SEQ ID NO: 1442090 - protein, 12 aa, Mycobacterium tuberculosis
DANASIPTPQPV

SEQ ID NO: 1442091 - protein, 9 aa, Mycobacterium tuberculosis
DANPRPSRL

SEQ ID NO: 1442092 - protein, 15 aa, Mycobacterium tuberculosis
DAPAQPMHRSPGGER

SEQ ID NO: 1442093 - protein, 6 aa, Mycobacterium tuberculosis
DAPDCG

SEQ ID NO: 1442094 - protein, 8 aa, Mycobacterium tuberculosis
DAPGTDWA

SEQ ID NO: 1442095 - protein, 11 aa, Mycobacterium tuberculosis
DAPHGSKQGQY

SEQ ID NO: 1442096 - protein, 7 aa, Mycobacterium tuberculosis
DAPNAVA

SEQ ID NO: 1442097 - protein, 16 aa, Mycobacterium tuberculosis
DAPPGTCRASRSMPNS

SEQ ID NO: 1442098 - protein, 7 aa, Mycobacterium tuberculosis
DAPPPHQ

SEQ ID NO: 1442099 - protein, 4 aa, Mycobacterium tuberculosis
DAPR

SEQ ID NO: 1442100 - protein, 7 aa, Mycobacterium tuberculosis
DAPVEQA

SEQ ID NO: 1442101 - protein, 13 aa, Mycobacterium tuberculosis
DAPVQRPDYSETD

SEQ ID NO: 1442102 - protein, 15 aa, Mycobacterium tuberculosis
DAQGTAAGGKSTDDV

SEQ ID NO: 1442103 - protein, 25 aa, Mycobacterium tuberculosis
DAQITRGVPDRKGNQPRRRGLGGED

SEQ ID NO: 1442104 - protein, 20 aa, Mycobacterium tuberculosis
DAQLVGDGGNGGNGGKGGAG

SEQ ID NO: 1442105 - protein, 21 aa, Mycobacterium tuberculosis
DAREQTRQEATKDRDRPPGTA

SEQ ID NO: 1442106 - protein, 12 aa, Mycobacterium tuberculosis
DARGPRADPTVG

SEQ ID NO: 1442107 - protein, 20 aa, Mycobacterium tuberculosis
DARGSRPVDAAAGRRKVATS

SEQ ID NO: 1442108 - protein, 6 aa, Mycobacterium tuberculosis
DARLPA

SEQ ID NO: 1442109 - protein, 8 aa, Mycobacterium tuberculosis
DARPRRTR

SEQ ID NO: 1442110 - protein, 13 aa, Mycobacterium tuberculosis
DARPVRKGRLGKP

SEQ ID NO: 1442111 - protein, 10 aa, Mycobacterium tuberculosis
DARRAARERG

SEQ ID NO: 1442112 - protein, 9 aa, Mycobacterium tuberculosis
DARRQPRVG

SEQ ID NO: 1442113 - protein, 15 aa, Mycobacterium tuberculosis
DARSRRLRSRGRSFQ

SEQ ID NO: 1442114 - protein, 11 aa, Mycobacterium tuberculosis
DASADGYVRGE

SEQ ID NO: 1442115 - protein, 5 aa, Mycobacterium tuberculosis
DASAL

SEQ ID NO: 1442116 - protein, 14 aa, Mycobacterium tuberculosis
DASEAKNDDRRSDG

SEQ ID NO: 1442117 - protein, 9 aa, Mycobacterium tuberculosis
DASRGHARG

SEQ ID NO: 1442118 - protein, 12 aa, Mycobacterium tuberculosis
DASTGGGSNALS

SEQ ID NO: 1442119 - protein, 8 aa, Mycobacterium tuberculosis
DATATELN

SEQ ID NO: 1442120 - protein, 11 aa, Mycobacterium tuberculosis
DATAVESAMTG

SEQ ID NO: 1442121 - protein, 8 aa, Mycobacterium tuberculosis
DATGAVGG

SEQ ID NO: 1442122 - protein, 8 aa, Mycobacterium tuberculosis
DATGGPVE

SEQ ID NO: 1442123 - protein, 23 aa, Mycobacterium tuberculosis
DATRTGSAPMTVSRSSSAPSLAR

SEQ ID NO: 1442124 - protein, 10 aa, Mycobacterium tuberculosis
DATSRQARAH

SEQ ID NO: 1442125 - protein, 8 aa, Mycobacterium tuberculosis
DATTGTAR

SEQ ID NO: 1442126 - protein, 5 aa, Mycobacterium tuberculosis
DAVGT

SEQ ID NO: 1442127 - protein, 6 aa, Mycobacterium tuberculosis
DAVRDG

SEQ ID NO: 1442128 - protein, 4 aa, Mycobacterium tuberculosis
DAVS

SEQ ID NO: 1442129 - protein, 7 aa, Mycobacterium tuberculosis
DCAPAAA

SEQ ID NO: 1442130 - protein, 19 aa, Mycobacterium tuberculosis
DCESGDATRRCGVARFTVA

SEQ ID NO: 1442131 - protein, 6 aa, Mycobacterium tuberculosis
DCGHRR

SEQ ID NO: 1442132 - protein, 9 aa, Mycobacterium tuberculosis
DDAADLSDR

SEQ ID NO: 1442133 - protein, 11 aa, Mycobacterium tuberculosis
DDADTRAAVTA

SEQ ID NO: 1442134 - protein, 6 aa, Mycobacterium tuberculosis
DDAEQT

SEQ ID NO: 1442135 - protein, 17 aa, Mycobacterium tuberculosis
DDAGPGRPKVPTITPAR

SEQ ID NO: 1442136 - protein, 10 aa, Mycobacterium tuberculosis
DDAKEGPRAF

SEQ ID NO: 1442137 - protein, 7 aa, Mycobacterium tuberculosis
DDANQRA

SEQ ID NO: 1442138 - protein, 32 aa, Mycobacterium tuberculosis
DDAVDKDQRGTCATTTVARPTSWSTTPASPVT

SEQ ID NO: 1442139 - protein, 8 aa, Mycobacterium tuberculosis
DDDDRTRL

SEQ ID NO: 1442140 - protein, 33 aa, Mycobacterium tuberculosis
DDDPRQRAARPTPAEQCRRTRDGHRLADIRVDL

SEQ ID NO: 1442141 - protein, 5 aa, Mycobacterium tuberculosis
DDEPG

SEQ ID NO: 1442142 - protein, 12 aa, Mycobacterium tuberculosis
DDGLTALDVGWR

SEQ ID NO: 1442143 - protein, 8 aa, Mycobacterium tuberculosis
DDGPGPYT

SEQ ID NO: 1442144 - protein, 4 aa, Mycobacterium tuberculosis
DDGS

SEQ ID NO: 1442145 - protein, 9 aa, Mycobacterium tuberculosis
DDGSGRTYQ

SEQ ID NO: 1442146 - protein, 6 aa, Mycobacterium tuberculosis
DDGVRR

SEQ ID NO: 1442147 - protein, 18 aa, Mycobacterium tuberculosis
DDHPPHYSEPDAAAAGYP

SEQ ID NO: 1442148 - protein, 38 aa, Mycobacterium tuberculosis; identical to SEQ ID NO: 1366068

SEQ ID NO: 1442149 - protein, 16 aa, Mycobacterium tuberculosis
DDHRRTRCAGHGRLPV

SEQ ID NO: 1442150 - protein, 19 aa, Mycobacterium tuberculosis
DDIEGGEDEDEEGVRTPKV

SEQ ID NO: 1442151 - protein, 15 aa, Mycobacterium tuberculosis
DDIPDRRTRRHSSAA

SEQ ID NO: 1442152 - protein, 6 aa, Mycobacterium tuberculosis
DDKERA

SEQ ID NO: 1442153 - protein, 5 aa, Mycobacterium tuberculosis
DDLPE

SEQ ID NO: 1442154 - protein, 7 aa, Mycobacterium tuberculosis
DDNSGRT

SEQ ID NO: 1442155 - protein, 8 aa, Mycobacterium tuberculosis
DDPDAAGH

SEQ ID NO: 1442156 - protein, 7 aa, Mycobacterium tuberculosis
DDPDTSL

SEQ ID NO: 1442157 - protein, 6 aa, Mycobacterium tuberculosis
DDPDVA

SEQ ID NO: 1442158 - protein, 5 aa, Mycobacterium tuberculosis
DDPEY

SEQ ID NO: 1442159 - protein, 17 aa, Mycobacterium tuberculosis
DDPGRRAAARTSRPATA

SEQ ID NO: 1442160 - protein, 8 aa, Mycobacterium tuberculosis
DDPGRSGE

SEQ ID NO: 1442161 - protein, 5 aa, Mycobacterium tuberculosis
DDPLG

SEQ ID NO: 1442162 - protein, 13 aa, Mycobacterium tuberculosis
DDPLGKVGRPRGY

SEQ ID NO: 1442163 - protein, 13 aa, Mycobacterium tuberculosis
DDPNIQQSDRNGA

SEQ ID NO: 1442164 - protein, 9 aa, Mycobacterium tuberculosis
DDPRGATPW

SEQ ID NO: 1442165 - protein, 8 aa, Mycobacterium tuberculosis
DDPSASPL

SEQ ID NO: 1442166 - protein, 11 aa, Mycobacterium tuberculosis
DDQLRSDKLNG

SEQ ID NO: 1442167 - protein, 10 aa, Mycobacterium tuberculosis
DDQLSTEARS

SEQ ID NO: 1442168 - protein, 12 aa, Mycobacterium tuberculosis
DDQPAGAAGAGC

SEQ ID NO: 1442169 - protein, 5 aa, Mycobacterium tuberculosis
DDQRH

SEQ ID NO: 1442170 - protein, 12 aa, Mycobacterium tuberculosis
DDRNVANGIGRG

SEQ ID NO: 1442171 - protein, 13 aa, Mycobacterium tuberculosis
DDRPDSAGPMELP

SEQ ID NO: 1442172 - protein, 13 aa, Mycobacterium tuberculosis
DDRPDSAGPMKLP

SEQ ID NO: 1442173 - protein, 25 aa, Mycobacterium tuberculosis
DDRPDSAGPMKLPGAKRLGDDRRPL

SEQ ID NO: 1442174 - protein, 5 aa, Mycobacterium tuberculosis
DDRQV

SEQ ID NO: 1442175 - protein, 7 aa, Mycobacterium tuberculosis
DDRRPRL

SEQ ID NO: 1442176 - protein, 9 aa, Mycobacterium tuberculosis
DDRRRQHGR

SEQ ID NO: 1442177 - protein, 8 aa, Mycobacterium tuberculosis
DDRTGDGV

SEQ ID NO: 1442178 - protein, 7 aa, Mycobacterium tuberculosis
DDSFSDG

SEQ ID NO: 1442179 - protein, 12 aa, Mycobacterium tuberculosis
DDSQDGDARLLL

SEQ ID NO: 1442180 - protein, 12 aa, Mycobacterium tuberculosis
DDTAPTDATEAT

SEQ ID NO: 1442181 - protein, 6 aa, Mycobacterium tuberculosis
DDTGEL

SEQ ID NO: 1442182 - protein, 5 aa, Mycobacterium tuberculosis
DDTLK

SEQ ID NO: 1442183 - protein, 12 aa, Mycobacterium tuberculosis
DDVAEPTYTRSC

SEQ ID NO: 1442184 - protein, 12 aa, Mycobacterium tuberculosis
DDVDPASTAAVG

SEQ ID NO: 1442185 - protein, 17 aa, Mycobacterium tuberculosis
DDVDSTRVSLWPGEQVG

SEQ ID NO: 1442186 - protein, 6 aa, Mycobacterium tuberculosis
DDVEKL

SEQ ID NO: 1442187 - protein, 22 aa, Mycobacterium tuberculosis
DDVGTVGDGPVDRVSGSRVAES

SEQ ID NO: 1442188 - protein, 12 aa, Mycobacterium tuberculosis
DDVKPGAGEDAY

SEQ ID NO: 1442189 - protein, 6 aa, Mycobacterium tuberculosis
DDYHDP

SEQ ID NO: 1442190 - protein, 6 aa, Mycobacterium tuberculosis
DDYPSS

SEQ ID NO: 1442191 - protein, 8 aa, Mycobacterium tuberculosis
DEAAEDNY

SEQ ID NO: 1442192 - protein, 16 aa, Mycobacterium tuberculosis
DEAAGAPGTGQAGGAG

SEQ ID NO: 1442193 - protein, 7 aa, Mycobacterium tuberculosis
DEAGGTE

SEQ ID NO: 1442194 - protein, 6 aa, Mycobacterium tuberculosis
DEAHER

SEQ ID NO: 1442195 - protein, 24 aa, Mycobacterium tuberculosis
DEDAPGPIPDVPQPSSEEITFLLI

SEQ ID NO: 1442196 - protein, 9 aa, Mycobacterium tuberculosis
DEDGTITDA

SEQ ID NO: 1442197 - protein, 79 aa, Mycobacterium tuberculosis
DEEERRLTSAGDDAERSDEEERRLTSAGDDAERNDEEERRLTSAGDDAERSDEEERRLTSAGDDAERSDEEERRLTSAE

SEQ ID NO: 1442198 - protein, 23 aa, Mycobacterium tuberculosis
DEELTGPPQKPAYAAEPATPEEV

SEQ ID NO: 1442199 - protein, 5 aa, Mycobacterium tuberculosis
DEGHQ

SEQ ID NO: 1442200 - protein, 7 aa, Mycobacterium tuberculosis
DEGHSAK

SEQ ID NO: 1442201 - protein, 30 aa, Mycobacterium tuberculosis
DEGRSGRRAAGAPDRARPRCPASGTSEGRQ

SEQ ID NO: 1442202 - protein, 4 aa, Mycobacterium tuberculosis
DEGV

SEQ ID NO: 1442203 - protein, 11 aa, Mycobacterium tuberculosis
DEGYQQTENGY

SEQ ID NO: 1442204 - protein, 12 aa, Mycobacterium tuberculosis
DEHGKPVKQGEV

SEQ ID NO: 1442205 - protein, 19 aa, Mycobacterium tuberculosis
DEIASSRAAHRVPQARPAV

SEQ ID NO: 1442206 - protein, 6 aa, Mycobacterium tuberculosis
DEIDGP

SEQ ID NO: 1442207 - protein, 5 aa, Mycobacterium tuberculosis
DEKVE

SEQ ID NO: 1442208 - protein, 5 aa, Mycobacterium tuberculosis
DELNN

SEQ ID NO: 1442209 - protein, 11 aa, Mycobacterium tuberculosis
DELPTSRPGSL

SEQ ID NO: 1442210 - protein, 4 aa, Mycobacterium tuberculosis
DELQ

SEQ ID NO: 1442211 - protein, 17 aa, Mycobacterium tuberculosis
DENGRMTGYDLKYPDGG

SEQ ID NO: 1442212 - protein, 22 aa, Mycobacterium tuberculosis
DEPADAAKVGASAGLRPIPAAR

SEQ ID NO: 1442213 - protein, 10 aa, Mycobacterium tuberculosis
DEPADQPQSL

SEQ ID NO: 1442214 - protein, 20 aa, Mycobacterium tuberculosis
DEPALTASDDQTPGLGSGRL

SEQ ID NO: 1442215 - protein, 7 aa, Mycobacterium tuberculosis
DEPDAER

SEQ ID NO: 1442216 - protein, 18 aa, Mycobacterium tuberculosis
DEPEKRDSHHNSDRRRGA

SEQ ID NO: 1442217 - protein, 4 aa, Mycobacterium tuberculosis
DEPP

SEQ ID NO: 1442218 - protein, 6 aa, Mycobacterium tuberculosis
DEPPRH

SEQ ID NO: 1442219 - protein, 12 aa, Mycobacterium tuberculosis
DEPPTGTAPNQV

SEQ ID NO: 1442220 - protein, 22 aa, Mycobacterium tuberculosis
DEPSAITNPGADRRRRPGSGAG

SEQ ID NO: 1442221 - protein, 16 aa, Mycobacterium tuberculosis
DEQGPGPGDGCGGRHR

SEQ ID NO: 1442222 - protein, 4 aa, Mycobacterium tuberculosis
DEQR

SEQ ID NO: 1442223 - protein, 9 aa, Mycobacterium tuberculosis
DEQTGAESV

SEQ ID NO: 1442224 - protein, 8 aa, Mycobacterium tuberculosis
DEQTHQPV

SEQ ID NO: 1442225 - protein, 4 aa, Mycobacterium tuberculosis
DEQV

SEQ ID NO: 1442226 - protein, 16 aa, Mycobacterium tuberculosis
DERDEEATTAVREDEV

SEQ ID NO: 1442227 - protein, 14 aa, Mycobacterium tuberculosis
DERQRQRSTQGTTA

SEQ ID NO: 1442228 - protein, 16 aa, Mycobacterium tuberculosis
DERSADFTARPAPDDV

SEQ ID NO: 1442229 - protein, 4 aa, Mycobacterium tuberculosis
DESA

SEQ ID NO: 1442230 - protein, 5 aa, Mycobacterium tuberculosis
DESDQ

SEQ ID NO: 1442231 - protein, 6 aa, Mycobacterium tuberculosis
DETSAA

SEQ ID NO: 1442232 - protein, 8 aa, Mycobacterium tuberculosis
DEVGRGAC

SEQ ID NO: 1442233 - protein, 14 aa, Mycobacterium tuberculosis
DEYDQAETAPVEDL

SEQ ID NO: 1442234 - protein, 6 aa, Mycobacterium tuberculosis
DEYRGQ

SEQ ID NO: 1442235 - protein, 44 aa, Mycobacterium tuberculosis; identical to SEQ ID NO: 1371304

SEQ ID NO: 1442236 - protein, 16 aa, Mycobacterium tuberculosis
DFATPANLSGLSNVGA

SEQ ID NO: 1442237 - protein, 8 aa, Mycobacterium tuberculosis
DFDTRSAT

SEQ ID NO: 1442238 - protein, 19 aa, Mycobacterium tuberculosis
DFRESSDPKPREGTETGNC

SEQ ID NO: 1442239 - protein, 4 aa, Mycobacterium tuberculosis
DFSR

SEQ ID NO: 1442240 - protein, 4 aa, Mycobacterium tuberculosis
DFTA

SEQ ID NO: 1442241 - protein, 16 aa, Mycobacterium tuberculosis
DGAAGAPGTGHAGGAG

SEQ ID NO: 1442242 - protein, 15 aa, Mycobacterium tuberculosis
DGAEALRSATENRPD

SEQ ID NO: 1442243 - protein, 21 aa, Mycobacterium tuberculosis
DGAGDGVGDRVDHRHRVAAPG

SEQ ID NO: 1442244 - protein, 7 aa, Mycobacterium tuberculosis
DGAGRSY

SEQ ID NO: 1442245 - protein, 14 aa, Mycobacterium tuberculosis
DGAHGAPGTDQRPG

SEQ ID NO: 1442246 - protein, 15 aa, Mycobacterium tuberculosis
DGAHGAPGTGQAGGA

SEQ ID NO: 1442247 - protein, 17 aa, Mycobacterium tuberculosis
DGAHGAPGTGQAGGAGG

SEQ ID NO: 1442248 - protein, 21 aa, Mycobacterium tuberculosis
DGAHGAPGTGQAGGAGGAAGL

SEQ ID NO: 1442249 - protein, 16 aa, Mycobacterium tuberculosis
DGAHGAPGTGQARGAG

SEQ ID NO: 1442250 - protein, 18 aa, Mycobacterium tuberculosis
DGANGIDGTGQAGGNGGW

SEQ ID NO: 1442251 - protein, 20 aa, Mycobacterium tuberculosis
DGANGIDGTGQAGGNGGWLW

SEQ ID NO: 1442252 - protein, 22 aa, Mycobacterium tuberculosis
DGAPVAPETPAEDADAETLSDS

SEQ ID NO: 1442253 - protein, 21 aa, Mycobacterium tuberculosis
DGAQQHGPLAAAPAGSPRGID

SEQ ID NO: 1442254 - protein, 19 aa, Mycobacterium tuberculosis
DGARAGLQTRGLADADNPW

SEQ ID NO: 1442255 - protein, 9 aa, Mycobacterium tuberculosis
DGARGRGRG

SEQ ID NO: 1442256 - protein, 16 aa, Mycobacterium tuberculosis
DGARRQRRRGRGGGLP

SEQ ID NO: 1442257 - protein, 13 aa, Mycobacterium tuberculosis
DGCDAEAGSGRAR

SEQ ID NO: 1442258 - protein, 32 aa, Mycobacterium tuberculosis
DGCDGQRADVDGYADTAAEGGDHDVGNHQRAQ

SEQ ID NO: 1442259 - protein, 6 aa, Mycobacterium tuberculosis
DGCENT

SEQ ID NO: 1442260 - protein, 10 aa, Mycobacterium tuberculosis
DGDATRRGRS

SEQ ID NO: 1442261 - protein, 8 aa, Mycobacterium tuberculosis
DGDDDAVR

SEQ ID NO: 1442262 - protein, 6 aa, Mycobacterium tuberculosis
DGDEAL

SEQ ID NO: 1442263 - protein, 13 aa, Mycobacterium tuberculosis
DGDGLDPDTGNWA

SEQ ID NO: 1442264 - protein, 19 aa, Mycobacterium tuberculosis
DGDGPAGRDWPGSRRRRSA

SEQ ID NO: 1442265 - protein, 41 aa, Mycobacterium tuberculosis
DGDLRQRDNGLAGRDGCRPDRPAGRGGHRGRLTPGGSHGGI

SEQ ID NO: 1442266 - protein, 4 aa, Mycobacterium tuberculosis
DGDP

SEQ ID NO: 1442267 - protein, 5 aa, Mycobacterium tuberculosis
DGDRS

SEQ ID NO: 1442268 - protein, 4 aa, Mycobacterium tuberculosis
DGDT

SEQ ID NO: 1442269 - protein, 15 aa, Mycobacterium tuberculosis
DGDYGPGSAMARSTK

SEQ ID NO: 1442270 - protein, 23 aa, Mycobacterium tuberculosis
DGEGPGEDACSPSPGPASRRPSR

SEQ ID NO: 1442271 - protein, 34 aa, Mycobacterium tuberculosis
DGEPGGDGGDGGDGGWGRPGGQGGFGSTSGAHGK

SEQ ID NO: 1442272 - protein, 172 aa, Mycobacterium tuberculosis
DGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISINV

SEQ ID NO: 1442273 - protein, 9 aa, Mycobacterium tuberculosis
DGERVRARG

SEQ ID NO: 1442274 - protein, 6 aa, Mycobacterium tuberculosis
DGETRI

SEQ ID NO: 1442275 - protein, 7 aa, Mycobacterium tuberculosis
DGETTAF

SEQ ID NO: 1442276 - protein, 47 aa, Mycobacterium tuberculosis
DGFDGGSGGAGGDGGAGGAGGTQTGDGGDGGAGDLGGAGGVGGNGVD

SEQ ID NO: 1442277 - protein, 42 aa, Mycobacterium tuberculosis
DGFDGGSGGAGGDGGAGGAGGTQTGDGGDGGAGGLGGAGGVG

SEQ ID NO: 1442278 - protein, 20 aa, Mycobacterium tuberculosis
DGFEQQGRCRGDSGRGFDRT

SEQ ID NO: 1442279 - protein, 5 aa, Mycobacterium tuberculosis
DGFGP

SEQ ID NO: 1442280 - protein, 22 aa, Mycobacterium tuberculosis
DGFGTVTAADGSRRRAFATGDR

SEQ ID NO: 1442281 - protein, 5 aa, Mycobacterium tuberculosis
DGFVS

SEQ ID NO: 1442282 - protein, 13 aa, Mycobacterium tuberculosis
DGGAAARAGVGGP

SEQ ID NO: 1442283 - protein, 10 aa, Mycobacterium tuberculosis
DGGAGAPSPV

SEQ ID NO: 1442284 - protein, 20 aa, Mycobacterium tuberculosis
DGGAGGAALSTGSAGRGGDA

SEQ ID NO: 1442285 - protein, 31 aa, Mycobacterium tuberculosis
DGGAGGAGGNGSNGVTGVHGGNGGAGGAAGL

SEQ ID NO: 1442286 - protein, 40 aa, Mycobacterium tuberculosis
DGGAGGAGGVGSTTGGAGGAGGNAGLSTSPAARAAAPAHS

SEQ ID NO: 1442287 - protein, 31 aa, Mycobacterium tuberculosis
DGGAGGHGGQGAIGLGGGAGGDGGQGGAGRG

SEQ ID NO: 1442288 - protein, 93 aa, Mycobacterium tuberculosis
DGGAGGHGGQGGTGVSSGGNGGAGGTGGDGRGLSGSGGAGGHGGQTGVGGKVGENNFGGAGGAGGTGGLIGNGGAGGTGGQGAISGAGGAGGN

SEQ ID NO: 1442289 - protein, 19 aa, Mycobacterium tuberculosis
DGGAGGIGGTGGEGGIGAR

SEQ ID NO: 1442290 - protein, 22 aa, Mycobacterium tuberculosis
DGGAGGIGGTGGEGGIGARGGT

SEQ ID NO: 1442291 - protein, 40 aa, Mycobacterium tuberculosis
DGGAGGIGGTGGEGGIGARGGTGGQGGMGGAGQPGVGGDA

SEQ ID NO: 1442292 - protein, 68 aa, Mycobacterium tuberculosis
DGGAGGIGGTGGEGGIGARGGTGGQGGMGGAGQPGVGGDAGDGGNGGIGGDGGAGGDGGAGGAGGADG

SEQ ID NO: 1442293 - protein, 7 aa, Mycobacterium tuberculosis
DGGAPVG

SEQ ID NO: 1442294 - protein, 6 aa, Mycobacterium tuberculosis
DGGASA

SEQ ID NO: 1442295 - protein, 20 aa, Mycobacterium tuberculosis
DGGDGGAALSAGSAGRGGDA

SEQ ID NO: 1442296 - protein, 32 aa, Mycobacterium tuberculosis; identical to SEQ ID NO: 229392

SEQ ID NO: 1442297 - protein, 24 aa, Mycobacterium tuberculosis
DGGGGAGGAGGAGGAGGAGGAGGH

SEQ ID NO: 1442298 - protein, 12 aa, Mycobacterium tuberculosis
DGGGGDGGNGGL

SEQ ID NO: 1442299 - protein, 13 aa, Mycobacterium tuberculosis
DGGGGGDDGNGGL

SEQ ID NO: 1442300 - protein, 22 aa, Mycobacterium tuberculosis
DGGGRGTTAIGGDGGAGGAGVA

SEQ ID NO: 1442301 - protein, 15 aa, Mycobacterium tuberculosis
DGGHRDRAGVPGGEA

SEQ ID NO: 1442302 - protein, 49 aa, Mycobacterium tuberculosis
DGGNGGAGGAGGIGGTGASGGAGGKGGSGLVGGDGGAGGAGGAAGAGTV

SEQ ID NO: 1442303 - protein, 50 aa, Mycobacterium tuberculosis
DGGNGGAGGAGGIGGTGASGGAGGKGGSGLVGGDGGAGGRRGGAAGAGTV

SEQ ID NO: 1442304 - protein, 58 aa, Mycobacterium tuberculosis
DGGNGGAGGDSGIGGTGASGGAGGKGGSGLVGGDGGNGGAGGAGGAGGAGGAAGAGTV

SEQ ID NO: 1442305 - protein, 61 aa, Mycobacterium tuberculosis
DGGNGGHGGHGAASGGNGGPGGHGGNGGNGGTGATAATVASAGLGAPAAPAPRASSAPTRA

SEQ ID NO: 1442306 - protein, 22 aa, Mycobacterium tuberculosis
DGGPTPGSTGAGAAGGHGGDAQ

SEQ ID NO: 1442307 - protein, 30 aa, Mycobacterium tuberculosis
DGGQGDPGGNAGTVFGSGGAGGNGGVGQGF

SEQ ID NO: 1442308 - protein, 28 aa, Mycobacterium tuberculosis
DGGVGGAGESTDAGTGSDCGSGGNGQSV

SEQ ID NO: 1442309 - protein, 47 aa, Mycobacterium tuberculosis
DGGVGGTGAAGGKGGAGGSGGVNGATGADGAKGLDGATGGKGNNGNP

SEQ ID NO: 1442310 - protein, 5 aa, Mycobacterium tuberculosis
DGGWG

SEQ ID NO: 1442311 - protein, 10 aa, Mycobacterium tuberculosis
DGIGKSPQQL

SEQ ID NO: 1442312 - protein, 12 aa, Mycobacterium tuberculosis
DGITPPSAARAI

SEQ ID NO: 1442313 - protein, 5 aa, Mycobacterium tuberculosis
DGKAA

SEQ ID NO: 1442314 - protein, 26 aa, Mycobacterium tuberculosis
DGKAKPQRRNASTSPRVGQRRRHRRR

SEQ ID NO: 1442315 - protein, 79 aa, Mycobacterium tuberculosis; identical to SEQ ID NO: 229402

SEQ ID NO: 1442316 - protein, 17 aa, Mycobacterium tuberculosis
DGKPATLPISGPPTTHQ

SEQ ID NO: 1442317 - protein, 5 aa, Mycobacterium tuberculosis
DGKPI

SEQ ID NO: 1442318 - protein, 23 aa, Mycobacterium tuberculosis
DGLAGSDGGDGGAGGVGGNGGRG

SEQ ID NO: 1442319 - protein, 7 aa, Mycobacterium tuberculosis
DGLGEER

SEQ ID NO: 1442320 - protein, 12 aa, Mycobacterium tuberculosis
DGLGGHDADGFT

SEQ ID NO: 1442321 - protein, 13 aa, Mycobacterium tuberculosis
DGLGGHDADGFTD

SEQ ID NO: 1442322 - protein, 8 aa, Mycobacterium tuberculosis
DGLPGPTH

SEQ ID NO: 1442323 - protein, 8 aa, Mycobacterium tuberculosis
DGNAADIA

SEQ ID NO: 1442324 - protein, 7 aa, Mycobacterium tuberculosis
DGNAFGS

SEQ ID NO: 1442325 - protein, 10 aa, Mycobacterium tuberculosis
DGNDGPTKLG

SEQ ID NO: 1442326 - protein, 7 aa, Mycobacterium tuberculosis
DGPESRF

SEQ ID NO: 1442327 - protein, 7 aa, Mycobacterium tuberculosis
DGPGPYT

SEQ ID NO: 1442328 - protein, 10 aa, Mycobacterium tuberculosis
DGPGTPEVLG

SEQ ID NO: 1442329 - protein, 14 aa, Mycobacterium tuberculosis
DGPGTPEVLGDESR

SEQ ID NO: 1442330 - protein, 6 aa, Mycobacterium tuberculosis
DGPIDR

SEQ ID NO: 1442331 - protein, 5 aa, Mycobacterium tuberculosis
DGPMG

SEQ ID NO: 1442332 - protein, 14 aa, Mycobacterium tuberculosis
DGPPPSRDHPHRSS

SEQ ID NO: 1442333 - protein, 6 aa, Mycobacterium tuberculosis
DGPQRQ

SEQ ID NO: 1442334 - protein, 9 aa, Mycobacterium tuberculosis
DGQAKSGKD

SEQ ID NO: 1442335 - protein, 13 aa, Mycobacterium tuberculosis
DGQGIALNEDLHA

SEQ ID NO: 1442336 - protein, 7 aa, Mycobacterium tuberculosis
DGQKRLK

SEQ ID NO: 1442337 - protein, 8 aa, Mycobacterium tuberculosis
DGQPMPPL

SEQ ID NO: 1442338 - protein, 5 aa, Mycobacterium tuberculosis
DGQRG

SEQ ID NO: 1442339 - protein, 8 aa, Mycobacterium tuberculosis
DGRDDSGF

SEQ ID NO: 1442340 - protein, 10 aa, Mycobacterium tuberculosis
DGRGPGMPPA

SEQ ID NO: 1442341 - protein, 31 aa, Mycobacterium tuberculosis
DGRSAAQAIEDGVEPATSGGHCAPTSTFPTI

SEQ ID NO: 1442342 - protein, 9 aa, Mycobacterium tuberculosis
DGRSRSVAS

SEQ ID NO: 1442343 - protein, 12 aa, Mycobacterium tuberculosis
DGRTCRASGSGW

SEQ ID NO: 1442344 - protein, 11 aa, Mycobacterium tuberculosis
DGRVPNPGEFA

SEQ ID NO: 1442345 - protein, 5 aa, Mycobacterium tuberculosis
DGRYP

SEQ ID NO: 1442346 - protein, 4 aa, Mycobacterium tuberculosis
DGSA

SEQ ID NO: 1442347 - protein, 13 aa, Mycobacterium tuberculosis
DGSARATGSATIT

SEQ ID NO: 1442348 - protein, 26 aa, Mycobacterium tuberculosis
DGSATPAGVGSAGGFGDAGGTGGLGG

SEQ ID NO: 1442349 - protein, 4 aa, Mycobacterium tuberculosis
DGSD

SEQ ID NO: 1442350 - protein, 10 aa, Mycobacterium tuberculosis
DGSDVGGGAS

SEQ ID NO: 1442351 - protein, 10 aa, Mycobacterium tuberculosis
DGSGTSAAAR

SEQ ID NO: 1442352 - protein, 4 aa, Mycobacterium tuberculosis
DGSI

SEQ ID NO: 1442353 - protein, 9 aa, Mycobacterium tuberculosis
DGSPGARKD

SEQ ID NO: 1442354 - protein, 12 aa, Mycobacterium tuberculosis
DGSRHGSSEKPR

SEQ ID NO: 1442355 - protein, 7 aa, Mycobacterium tuberculosis
DGSRNGV

SEQ ID NO: 1442356 - protein, 30 aa, Mycobacterium tuberculosis
DGSVPRPPKLPPRRRRPSAPRLAVPDPYPR

SEQ ID NO: 1442357 - protein, 7 aa, Mycobacterium tuberculosis
DGTAPFT

SEQ ID NO: 1442358 - protein, 13 aa, Mycobacterium tuberculosis
DGTDAEGVARAVT

SEQ ID NO: 1442359 - protein, 6 aa, Mycobacterium tuberculosis
DGTDVD

SEQ ID NO: 1442360 - protein, 7 aa, Mycobacterium tuberculosis
DGTGDRV

SEQ ID NO: 1442361 - protein, 7 aa, Mycobacterium tuberculosis
DGTGQVA

SEQ ID NO: 1442362 - protein, 6 aa, Mycobacterium tuberculosis
DGTLPG

SEQ ID NO: 1442363 - protein, 13 aa, Mycobacterium tuberculosis
DGTPGTGGNGGYA

SEQ ID NO: 1442364 - protein, 9 aa, Mycobacterium tuberculosis
DGTPPRHHP

SEQ ID NO: 1442365 - protein, 4 aa, Mycobacterium tuberculosis
DGTT

SEQ ID NO: 1442366 - protein, 5 aa, Mycobacterium tuberculosis
DGTYV

SEQ ID NO: 1442367 - protein, 11 aa, Mycobacterium tuberculosis
DGVASRTHDDV

SEQ ID NO: 1442368 - protein, 9 aa, Mycobacterium tuberculosis
DGVGVTGDT

SEQ ID NO: 1442369 - protein, 11 aa, Mycobacterium tuberculosis
DGVPRSSENAS

SEQ ID NO: 1442370 - protein, 5 aa, Mycobacterium tuberculosis
DGVPS

SEQ ID NO: 1442371 - protein, 7 aa, Mycobacterium tuberculosis
DGVTTQL

SEQ ID NO: 1442372 - protein, 12 aa, Mycobacterium tuberculosis
DGYAQLDERGYA

SEQ ID NO: 1442373 - protein, 4 aa, Mycobacterium tuberculosis
DHAH

SEQ ID NO: 1442374 - protein, 13 aa, Mycobacterium tuberculosis
DHATASVNPPPEV

SEQ ID NO: 1442375 - protein, 6 aa, Mycobacterium tuberculosis
DHDLAD

SEQ ID NO: 1442376 - protein, 5 aa, Mycobacterium tuberculosis
DHDQM

SEQ ID NO: 1442377 - protein, 13 aa, Mycobacterium tuberculosis
DHGAGGGQPGAAG

SEQ ID NO: 1442378 - protein, 15 aa, Mycobacterium tuberculosis
DHGNPLPPHTEGAQH

SEQ ID NO: 1442379 - protein, 5 aa, Mycobacterium tuberculosis
DHPDE

SEQ ID NO: 1442380 - protein, 10 aa, Mycobacterium tuberculosis
DHPPADGKCG

SEQ ID NO: 1442381 - protein, 15 aa, Mycobacterium tuberculosis
DHPQPSPPVGSVCAG

SEQ ID NO: 1442382 - protein, 6 aa, Mycobacterium tuberculosis
DHPRTG

SEQ ID NO: 1442383 - protein, 26 aa, Mycobacterium tuberculosis
DHPSARHPAEAQPAQRGDPRQAAHRR

SEQ ID NO: 1442384 - protein, 7 aa, Mycobacterium tuberculosis
DHRLSDE

SEQ ID NO: 1442385 - protein, 20 aa, Mycobacterium tuberculosis
DHRPAPPETEAALVPVQATL

SEQ ID NO: 1442386 - protein, 19 aa, Mycobacterium tuberculosis
DHRPQRPAAASWPTGARPC

SEQ ID NO: 1442387 - protein, 6 aa, Mycobacterium tuberculosis
DHRRRD

SEQ ID NO: 1442388 - protein, 17 aa, Mycobacterium tuberculosis
DHRTAGDRQDPRRGPCR

SEQ ID NO: 1442389 - protein, 4 aa, Mycobacterium tuberculosis
DHRV

SEQ ID NO: 1442390 - protein, 11 aa, Mycobacterium tuberculosis
DHTRDGGTVPA

SEQ ID NO: 1442391 - protein, 6 aa, Mycobacterium tuberculosis
DIADSD

SEQ ID NO: 1442392 - protein, 7 aa, Mycobacterium tuberculosis
DIAPRRD

SEQ ID NO: 1442393 - protein, 7 aa, Mycobacterium tuberculosis
DIDASNE

SEQ ID NO: 1442394 - protein, 8 aa, Mycobacterium tuberculosis
DIDGDRDR

SEQ ID NO: 1442395 - protein, 6 aa, Mycobacterium tuberculosis
DIDTAV

SEQ ID NO: 1442396 - protein, 10 aa, Mycobacterium tuberculosis
DIGAGAVTPA

SEQ ID NO: 1442397 - protein, 10 aa, Mycobacterium tuberculosis
DIGDDPRTWA

SEQ ID NO: 1442398 - protein, 9 aa, Mycobacterium tuberculosis
DIGKGGSTF

SEQ ID NO: 1442399 - protein, 7 aa, Mycobacterium tuberculosis
DIGPRTL

SEQ ID NO: 1442400 - protein, 19 aa, Mycobacterium tuberculosis
DINSRDSRPIAASPAAPMG

SEQ ID NO: 1442401 - protein, 4 aa, Mycobacterium tuberculosis
DIPV

SEQ ID NO: 1442402 - protein, 20 aa, Mycobacterium tuberculosis
DIRSSERDAQSGRVNKARGV

SEQ ID NO: 1442403 - protein, 6 aa, Mycobacterium tuberculosis
DISKPV

SEQ ID NO: 1442404 - protein, 5 aa, Mycobacterium tuberculosis
DITPV

SEQ ID NO: 1442405 - protein, 29 aa, Mycobacterium tuberculosis
DKCRRDGGARSDRAARTASLQTVGEAVHR

SEQ ID NO: 1442406 - protein, 7 aa, Mycobacterium tuberculosis
DKDNLGR

SEQ ID NO: 1442407 - protein, 8 aa, Mycobacterium tuberculosis
DKGERARA

SEQ ID NO: 1442408 - protein, 18 aa, Mycobacterium tuberculosis
DKGKQAAARITEATPGAE

SEQ ID NO: 1442409 - protein, 6 aa, Mycobacterium tuberculosis
DKGTPF

SEQ ID NO: 1442410 - protein, 36 aa, Mycobacterium tuberculosis; identical to SEQ ID NO: 150412

SEQ ID NO: 1442411 - protein, 6 aa, Mycobacterium tuberculosis
DKPKPW

SEQ ID NO: 1442412 - protein, 7 aa, Mycobacterium tuberculosis
DKPTGVK

SEQ ID NO: 1442413 - protein, 4 aa, Mycobacterium tuberculosis
DKQQ

SEQ ID NO: 1442414 - protein, 7 aa, Mycobacterium tuberculosis
DKREQRR

SEQ ID NO: 1442415 - protein, 10 aa, Mycobacterium tuberculosis
DKRSRAVSKR

SEQ ID NO: 1442416 - protein, 8 aa, Mycobacterium tuberculosis
DKRTSLDD

SEQ ID NO: 1442417 - protein, 7 aa, Mycobacterium tuberculosis
DKTAGQA

SEQ ID NO: 1442418 - protein, 6 aa, Mycobacterium tuberculosis
DKTREL

SEQ ID NO: 1442419 - protein, 21 aa, Mycobacterium tuberculosis
DLAGIGSTLAQANAAALAPTT

SEQ ID NO: 1442420 - protein, 6 aa, Mycobacterium tuberculosis
DLAGTE

SEQ ID NO: 1442421 - protein, 11 aa, Mycobacterium tuberculosis
DLAGTGPAQQL

SEQ ID NO: 1442422 - protein, 22 aa, Mycobacterium tuberculosis
DLAPQSEDAEPLEAAPARGGVS

SEQ ID NO: 1442423 - protein, 4 aa, Mycobacterium tuberculosis
DLDK

SEQ ID NO: 1442424 - protein, 8 aa, Mycobacterium tuberculosis
DLDPRRRT

SEQ ID NO: 1442425 - protein, 14 aa, Mycobacterium tuberculosis
DLERRKREAQQAVQ

SEQ ID NO: 1442426 - protein, 5 aa, Mycobacterium tuberculosis
DLGAS

SEQ ID NO: 1442427 - protein, 8 aa, Mycobacterium tuberculosis
DLGATREQ

SEQ ID NO: 1442428 - protein, 5 aa, Mycobacterium tuberculosis
DLGGQ

SEQ ID NO: 1442429 - protein, 11 aa, Mycobacterium tuberculosis
DLGPADGHDAG

SEQ ID NO: 1442430 - protein, 52 aa, Mycobacterium tuberculosis
DLGPGRQLSPASVPAQPSATAAITPRARSSPAGSGAGRDLAASDAVGFWIGA

SEQ ID NO: 1442431 - protein, 24 aa, Mycobacterium tuberculosis
DLGPGRQPSPASVPAQPSATAAIT

SEQ ID NO: 1442432 - protein, 52 aa, Mycobacterium tuberculosis
DLGPGRQPSPASVPAQPSATAAITPAGRSSPAGSGAGRDLAPSDAVGFWIGA

SEQ ID NO: 1442433 - protein, 36 aa, Mycobacterium tuberculosis
DLGPGRQPSPASVPAQPSATAAITPRPLFPRRIRCR

SEQ ID NO: 1442434 - protein, 9 aa, Mycobacterium tuberculosis
DLHGKQGRL

SEQ ID NO: 1442435 - protein, 10 aa, Mycobacterium tuberculosis
DLPAAGSQDR

SEQ ID NO: 1442436 - protein, 7 aa, Mycobacterium tuberculosis
DLPARQV

SEQ ID NO: 1442437 - protein, 7 aa, Mycobacterium tuberculosis
DLPEQYR

SEQ ID NO: 1442438 - protein, 9 aa, Mycobacterium tuberculosis
DLPGAAASR

SEQ ID NO: 1442439 - protein, 10 aa, Mycobacterium tuberculosis
DLPGAAASRR

SEQ ID NO: 1442440 - protein, 7 aa, Mycobacterium tuberculosis
DLPGRRA

SEQ ID NO: 1442441 - protein, 5 aa, Mycobacterium tuberculosis
DLRES

SEQ ID NO: 1442442 - protein, 7 aa, Mycobacterium tuberculosis
DLRPGGP

SEQ ID NO: 1442443 - protein, 15 aa, Mycobacterium tuberculosis
DLRPGPGRLGAVLPT

SEQ ID NO: 1442444 - protein, 9 aa, Mycobacterium tuberculosis
DLSAPGAGS

SEQ ID NO: 1442445 - protein, 8 aa, Mycobacterium tuberculosis
DLSAPRPR

SEQ ID NO: 1442446 - protein, 12 aa, Mycobacterium tuberculosis
DLSEKALGWSTY

SEQ ID NO: 1442447 - protein, 6 aa, Mycobacterium tuberculosis
DLTART

SEQ ID NO: 1442448 - protein, 17 aa, Mycobacterium tuberculosis
DMDGTEPATANIGPGGD

SEQ ID NO: 1442449 - protein, 7 aa, Mycobacterium tuberculosis
DMPTRED

SEQ ID NO: 1442450 - protein, 9 aa, Mycobacterium tuberculosis
DNAAKSVSG

SEQ ID NO: 1442451 - protein, 12 aa, Mycobacterium tuberculosis
DNATRSELATGM

SEQ ID NO: 1442452 - protein, 7 aa, Mycobacterium tuberculosis
DNDDSVD

SEQ ID NO: 1442453 - protein, 14 aa, Mycobacterium tuberculosis
DNDYAAMPDIEVIT

SEQ ID NO: 1442454 - protein, 14 aa, Mycobacterium tuberculosis
DNEPQGVAGGGKAV

SEQ ID NO: 1442455 - protein, 16 aa, Mycobacterium tuberculosis
DNEQADGRSTQPRRTA

SEQ ID NO: 1442456 - protein, 14 aa, Mycobacterium tuberculosis
DNGAARDAGVPQPI

SEQ ID NO: 1442457 - protein, 10 aa, Mycobacterium tuberculosis
DNGDPERGDG

SEQ ID NO: 1442458 - protein, 6 aa, Mycobacterium tuberculosis
DNGPET

SEQ ID NO: 1442459 - protein, 17 aa, Mycobacterium tuberculosis
DNGRCDPVAGTNTGESL

SEQ ID NO: 1442460 - protein, 13 aa, Mycobacterium tuberculosis
DNGSTDGTPQAAV

SEQ ID NO: 1442461 - protein, 7 aa, Mycobacterium tuberculosis
DNHESAR

SEQ ID NO: 1442462 - protein, 9 aa, Mycobacterium tuberculosis
DNNGNGARV

SEQ ID NO: 1442463 - protein, 9 aa, Mycobacterium tuberculosis
DNNRQAPQD

SEQ ID NO: 1442464 - protein, 6 aa, Mycobacterium tuberculosis
DNPDFQ

SEQ ID NO: 1442465 - protein, 4 aa, Mycobacterium tuberculosis
DNPN

SEQ ID NO: 1442466 - protein, 41 aa, Mycobacterium tuberculosis
DNPPGGNSTGGNGGAGGDGGVGASADVGGAGGFGGSGGRGG

SEQ ID NO: 1442467 - protein, 4 aa, Mycobacterium tuberculosis
DNPQ

SEQ ID NO: 1442468 - protein, 8 aa, Mycobacterium tuberculosis
DNPRAERV

SEQ ID NO: 1442469 - protein, 13 aa, Mycobacterium tuberculosis
DNPTELSESGAGY

SEQ ID NO: 1442470 - protein, 12 aa, Mycobacterium tuberculosis
DNPTELSRSGGW

SEQ ID NO: 1442471 - protein, 7 aa, Mycobacterium tuberculosis
DNRVSAD

SEQ ID NO: 1442472 - protein, 9 aa, Mycobacterium tuberculosis
DNTHAASDI

SEQ ID NO: 1442473 - protein, 8 aa, Mycobacterium tuberculosis
DNVQNRGE

SEQ ID NO: 1442474 - protein, 12 aa, Mycobacterium tuberculosis
DPAAGHPPPRAA

SEQ ID NO: 1442475 - protein, 6 aa, Mycobacterium tuberculosis
DPAARL

SEQ ID NO: 1442476 - protein, 6 aa, Mycobacterium tuberculosis
DPAGPG

SEQ ID NO: 1442477 - protein, 16 aa, Mycobacterium tuberculosis
DPAGTTLAQGTAAKAQ

SEQ ID NO: 1442478 - protein, 5 aa, Mycobacterium tuberculosis
DPAKL

SEQ ID NO: 1442479 - protein, 9 aa, Mycobacterium tuberculosis
DPAKPLPAS

SEQ ID NO: 1442480 - protein, 12 aa, Mycobacterium tuberculosis
DPANSREAPRAA

SEQ ID NO: 1442481 - protein, 8 aa, Mycobacterium tuberculosis
DPANTTST

SEQ ID NO: 1442482 - protein, 14 aa, Mycobacterium tuberculosis
DPAPLAGPAGSAAT

SEQ ID NO: 1442483 - protein, 11 aa, Mycobacterium tuberculosis
DPAQKKSTSEW

SEQ ID NO: 1442484 - protein, 6 aa, Mycobacterium tuberculosis
DPAQRE

SEQ ID NO: 1442485 - protein, 7 aa, Mycobacterium tuberculosis
DPARDRA

SEQ ID NO: 1442486 - protein, 30 aa, Mycobacterium tuberculosis
DPARRHGRRSAFRDPRGWPHRGRRPGHQDH

SEQ ID NO: 1442487 - protein, 16 aa, Mycobacterium tuberculosis
DPARRPRPRWVWSASA

SEQ ID NO: 1442488 - protein, 9 aa, Mycobacterium tuberculosis
DPASQTKAG

SEQ ID NO: 1442489 - protein, 12 aa, Mycobacterium tuberculosis
DPAVPALPPSRL

SEQ ID NO: 1442490 - protein, 7 aa, Mycobacterium tuberculosis
DPDAEEA

SEQ ID NO: 1442491 - protein, 6 aa, Mycobacterium tuberculosis
DPDAVR

SEQ ID NO: 1442492 - protein, 6 aa, Mycobacterium tuberculosis
DPDEGF

SEQ ID NO: 1442493 - protein, 12 aa, Mycobacterium tuberculosis
DPDNRRPVDYGT

SEQ ID NO: 1442494 - protein, 9 aa, Mycobacterium tuberculosis
DPDPDAAGA

SEQ ID NO: 1442495 - protein, 7 aa, Mycobacterium tuberculosis
DPDPDVR

SEQ ID NO: 1442496 - protein, 8 aa, Mycobacterium tuberculosis
DPDQLGRR

SEQ ID NO: 1442497 - protein, 6 aa, Mycobacterium tuberculosis
DPDTPV

SEQ ID NO: 1442498 - protein, 8 aa, Mycobacterium tuberculosis
DPDTREIG

SEQ ID NO: 1442499 - protein, 11 aa, Mycobacterium tuberculosis
DPEPGVPGRSV

SEQ ID NO: 1442500 - protein, 17 aa, Mycobacterium tuberculosis
DPEQEAGAADSTGQDGD

SEQ ID NO: 1442501 - protein, 16 aa, Mycobacterium tuberculosis
DPERGGRCRRWCRTAA

SEQ ID NO: 1442502 - protein, 12 aa, Mycobacterium tuberculosis
DPERTRKSAQRR

SEQ ID NO: 1442503 - protein, 4 aa, Mycobacterium tuberculosis
DPES

SEQ ID NO: 1442504 - protein, 18 aa, Mycobacterium tuberculosis
DPETDHDPTGSPQGAGTL

SEQ ID NO: 1442505 - protein, 7 aa, Mycobacterium tuberculosis
DPEVQAP

SEQ ID NO: 1442506 - protein, 7 aa, Mycobacterium tuberculosis
DPEWRST

SEQ ID NO: 1442507 - protein, 4 aa, Mycobacterium tuberculosis
DPEY

SEQ ID NO: 1442508 - protein, 6 aa, Mycobacterium tuberculosis
DPFGAG

SEQ ID NO: 1442509 - protein, 11 aa, Mycobacterium tuberculosis
DPGALPPQERE

SEQ ID NO: 1442510 - protein, 10 aa, Mycobacterium tuberculosis
DPGDDAKEGA

SEQ ID NO: 1442511 - protein, 6 aa, Mycobacterium tuberculosis
DPGDPV

SEQ ID NO: 1442512 - protein, 6 aa, Mycobacterium tuberculosis
DPGDSW

SEQ ID NO: 1442513 - protein, 7 aa, Mycobacterium tuberculosis
DPGESQM

SEQ ID NO: 1442514 - protein, 204 aa, Mycobacterium tuberculosis
DPGGAWAGNGGTGGAGGTGGVGGAGGTGGVGGTGGSGSDGVNGSSAGADGHPGGTGGVGGTGGKGGDGGDGGAAPNGVAGSQGPGGAGGDGGTGGVGGNGGRGIDGADGATAGARGQDGGAGGAGGKGGRGGTGGPGGAGPAGTTGSQGAGGYGGSGGTGGDLGDGGNGANGSVFPNNGNGGNGGNGGNAGPSGAGGIVGSGST

SEQ ID NO: 1442515 - protein, 4 aa, Mycobacterium tuberculosis
DPGI

SEQ ID NO: 1442516 - protein, 6 aa, Mycobacterium tuberculosis
DPGISL

SEQ ID NO: 1442517 - protein, 7 aa, Mycobacterium tuberculosis
DPGPGVA

SEQ ID NO: 1442518 - protein, 6 aa, Mycobacterium tuberculosis
DPGPTL

SEQ ID NO: 1442519 - protein, 16 aa, Mycobacterium tuberculosis
DPGQPGGTTSIKATYY

SEQ ID NO: 1442520 - protein, 6 aa, Mycobacterium tuberculosis
DPGQVH

SEQ ID NO: 1442521 - protein, 8 aa, Mycobacterium tuberculosis
DPGRRRYP

SEQ ID NO: 1442522 - protein, 17 aa, Mycobacterium tuberculosis
DPHEHRGPADTDRRQRV

SEQ ID NO: 1442523 - protein, 17 aa, Mycobacterium tuberculosis
DPHSGDIVNPSGQHGDE

SEQ ID NO: 1442524 - protein, 21 aa, Mycobacterium tuberculosis
DPKHSGLNRPGMSGDSSSWKG

SEQ ID NO: 1442525 - protein, 4 aa, Mycobacterium tuberculosis
DPKL

SEQ ID NO: 1442526 - protein, 21 aa, Mycobacterium tuberculosis
DPKPREGTETFAKSPRPHRRS

SEQ ID NO: 1442527 - protein, 22 aa, Mycobacterium tuberculosis
DPKVDDGPSSDANLSAPLTPQQ

SEQ ID NO: 1442528 - protein, 7 aa, Mycobacterium tuberculosis
DPLPGTV

SEQ ID NO: 1442529 - protein, 31 aa, Mycobacterium tuberculosis
DPLTGSHREFASTRKLTGATLPTWSAAADCR

SEQ ID NO: 1442530 - protein, 14 aa, Mycobacterium tuberculosis
DPMRATSEAAAATV

SEQ ID NO: 1442531 - protein, 12 aa, Mycobacterium tuberculosis
DPNAPDQQWDSV

SEQ ID NO: 1442532 - protein, 9 aa, Mycobacterium tuberculosis
DPNGSNTEF

SEQ ID NO: 1442533 - protein, 5 aa, Mycobacterium tuberculosis
DPNLR

SEQ ID NO: 1442534 - protein, 26 aa, Mycobacterium tuberculosis
DPPAGGPGRRNRSAPGLPAPGPAQRC

SEQ ID NO: 1442535 - protein, 12 aa, Mycobacterium tuberculosis
DPPDRWRESRRQ

SEQ ID NO: 1442536 - protein, 6 aa, Mycobacterium tuberculosis
DPPPSV

SEQ ID NO: 1442537 - protein, 6 aa, Mycobacterium tuberculosis
DPPRAS

SEQ ID NO: 1442538 - protein, 5 aa, Mycobacterium tuberculosis
DPPTL

SEQ ID NO: 1442539 - protein, 10 aa, Mycobacterium tuberculosis
DPQLSRTGHR

SEQ ID NO: 1442540 - protein, 5 aa, Mycobacterium tuberculosis
DPQQR

SEQ ID NO: 1442541 - protein, 6 aa, Mycobacterium tuberculosis
DPQYAP

SEQ ID NO: 1442542 - protein, 15 aa, Mycobacterium tuberculosis
DPRARRYPTSGYCHR

SEQ ID NO: 1442543 - protein, 15 aa, Mycobacterium tuberculosis
DPRFGASRSRVANRS

SEQ ID NO: 1442544 - protein, 22 aa, Mycobacterium tuberculosis
DPRHRADGPQRCHRGRRRRGRG

SEQ ID NO: 1442545 - protein, 4 aa, Mycobacterium tuberculosis
DPRS

SEQ ID NO: 1442546 - protein, 16 aa, Mycobacterium tuberculosis
DPRTVNSREVMRWEEK

SEQ ID NO: 1442547 - protein, 12 aa, Mycobacterium tuberculosis
DPRVAGKPAPAL

SEQ ID NO: 1442548 - protein, 18 aa, Mycobacterium tuberculosis
DPRYVPAGGRRGAGPAGL

SEQ ID NO: 1442549 - protein, 11 aa, Mycobacterium tuberculosis
DPSAGSDAATE

SEQ ID NO: 1442550 - protein, 7 aa, Mycobacterium tuberculosis
DPSAPMP

SEQ ID NO: 1442551 - protein, 4 aa, Mycobacterium tuberculosis
DPSP

SEQ ID NO: 1442552 - protein, 7 aa, Mycobacterium tuberculosis
DPSPTLL

SEQ ID NO: 1442553 - protein, 5 aa, Mycobacterium tuberculosis
DPSTL

SEQ ID NO: 1442554 - protein, 8 aa, Mycobacterium tuberculosis
DPTEPGHY

SEQ ID NO: 1442555 - protein, 16 aa, Mycobacterium tuberculosis
DPTGAAVGPMARASPH

SEQ ID NO: 1442556 - protein, 7 aa, Mycobacterium tuberculosis
DPTQPRD

SEQ ID NO: 1442557 - protein, 5 aa, Mycobacterium tuberculosis
DPTSG

SEQ ID NO: 1442558 - protein, 22 aa, Mycobacterium tuberculosis
DPTSPRSSPRRSGRRASTTRRH

SEQ ID NO: 1442559 - protein, 6 aa, Mycobacterium tuberculosis
DPTWDS

SEQ ID NO: 1442560 - protein, 5 aa, Mycobacterium tuberculosis
DPVAN

SEQ ID NO: 1442561 - protein, 6 aa, Mycobacterium tuberculosis
DPVANE

SEQ ID NO: 1442562 - protein, 6 aa, Mycobacterium tuberculosis
DPVDPV

SEQ ID NO: 1442563 - protein, 10 aa, Mycobacterium tuberculosis
DPVDPVDPVD

SEQ ID NO: 1442564 - protein, 13 aa, Mycobacterium tuberculosis
DPVDPVDPVDPVD

SEQ ID NO: 1442565 - protein, 22 aa, Mycobacterium tuberculosis
DPVGPARRSDRGGQRYSWRRDS

SEQ ID NO: 1442566 - protein, 4 aa, Mycobacterium tuberculosis
DPVK

SEQ ID NO: 1442567 - protein, 6 aa, Mycobacterium tuberculosis
DPVRSA

SEQ ID NO: 1442568 - protein, 10 aa, Mycobacterium tuberculosis
DPVSTRRRAH

SEQ ID NO: 1442569 - protein, 38 aa, Mycobacterium tuberculosis
DPWSSRNSQNAARRPAWTPGSRWAASGRRRCPRVRRGC

SEQ ID NO: 1442570 - protein, 19 aa, Mycobacterium tuberculosis
DQARAAAAGDAEAMVLTRI

SEQ ID NO: 1442571 - protein, 13 aa, Mycobacterium tuberculosis
DQARAAAAGDDET

SEQ ID NO: 1442572 - protein, 9 aa, Mycobacterium tuberculosis
DQARAGGPA

SEQ ID NO: 1442573 - protein, 11 aa, Mycobacterium tuberculosis
DQDHSARTASS

SEQ ID NO: 1442574 - protein, 6 aa, Mycobacterium tuberculosis
DQDPGQ

SEQ ID NO: 1442575 - protein, 5 aa, Mycobacterium tuberculosis
DQENP

SEQ ID NO: 1442576 - protein, 10 aa, Mycobacterium tuberculosis
DQETAAAQAV

SEQ ID NO: 1442577 - protein, 5 aa, Mycobacterium tuberculosis
DQFSA

SEQ ID NO: 1442578 - protein, 18 aa, Mycobacterium tuberculosis
DQHGRDRHHRGRGDGRHR

SEQ ID NO: 1442579 - protein, 8 aa, Mycobacterium tuberculosis
DQHPAGAA

SEQ ID NO: 1442580 - protein, 12 aa, Mycobacterium tuberculosis
DQINTTRYNPDY

SEQ ID NO: 1442581 - protein, 9 aa, Mycobacterium tuberculosis
DQLGQTGRV

SEQ ID NO: 1442582 - protein, 8 aa, Mycobacterium tuberculosis
DQLPTDER

SEQ ID NO: 1442583 - protein, 13 aa, Mycobacterium tuberculosis
DQNPAPGPAPGVP

SEQ ID NO: 1442584 - protein, 5 aa, Mycobacterium tuberculosis
DQPAV

SEQ ID NO: 1442585 - protein, 5 aa, Mycobacterium tuberculosis
DQPGK

SEQ ID NO: 1442586 - protein, 7 aa, Mycobacterium tuberculosis
DQPGQED

SEQ ID NO: 1442587 - protein, 7 aa, Mycobacterium tuberculosis
DQPNAES

SEQ ID NO: 1442588 - protein, 12 aa, Mycobacterium tuberculosis
DQPPLFASDVFR

SEQ ID NO: 1442589 - protein, 29 aa, Mycobacterium tuberculosis
DQPQQGPHHPPTAHPPPPEATSAHPHHRV

SEQ ID NO: 1442590 - protein, 16 aa, Mycobacterium tuberculosis
DQPQYPYEQDGFSGSS

SEQ ID NO: 1442591 - protein, 4 aa, Mycobacterium tuberculosis
DQPT

SEQ ID NO: 1442592 - protein, 78 aa, Mycobacterium tuberculosis
DQRAGQSAQRTRRGTRAERRAAAARQAQRTIGSPDRVAETGIGRRGRRAVTARAPGHPPGIQDGGHLRGGVRSPNPLP

SEQ ID NO: 1442593 - protein, 21 aa, Mycobacterium tuberculosis
DQRCRRRGTNSSDNNTNASAK

SEQ ID NO: 1442594 - protein, 6 aa, Mycobacterium tuberculosis
DQREAP

SEQ ID NO: 1442595 - protein, 11 aa, Mycobacterium tuberculosis
DQRGGQPQPPF

SEQ ID NO: 1442596 - protein, 5 aa, Mycobacterium tuberculosis
DQRGI

SEQ ID NO: 1442597 - protein, 8 aa, Mycobacterium tuberculosis
DQRPNGSR

SEQ ID NO: 1442598 - protein, 6 aa, Mycobacterium tuberculosis
DQRQPG

SEQ ID NO: 1442599 - protein, 7 aa, Mycobacterium tuberculosis
DQSLGTS

SEQ ID NO: 1442600 - protein, 8 aa, Mycobacterium tuberculosis
DQTAARRE

SEQ ID NO: 1442601 - protein, 8 aa, Mycobacterium tuberculosis
DQTDANAP

SEQ ID NO: 1442602 - protein, 14 aa, Mycobacterium tuberculosis
DQTNSVNSSAKYGE

SEQ ID NO: 1442603 - protein, 15 aa, Mycobacterium tuberculosis
DQTNSVNSSAKYGEV

SEQ ID NO: 1442604 - protein, 5 aa, Mycobacterium tuberculosis
DQTYP

SEQ ID NO: 1442605 - protein, 19 aa, Mycobacterium tuberculosis
DQVDDDRLGRPRSDADVGP

SEQ ID NO: 1442606 - protein, 6 aa, Mycobacterium tuberculosis
DQVPPR

SEQ ID NO: 1442607 - protein, 5 aa, Mycobacterium tuberculosis
DQVSE

SEQ ID NO: 1442608 - protein, 13 aa, Mycobacterium tuberculosis
DQYAQRQRGAAER

SEQ ID NO: 1442609 - protein, 4 aa, Mycobacterium tuberculosis
DRAA

SEQ ID NO: 1442610 - protein, 10 aa, Mycobacterium tuberculosis
DRAGQHPACA

SEQ ID NO: 1442611 - protein, 9 aa, Mycobacterium tuberculosis
DRAKSYPLA

SEQ ID NO: 1442612 - protein, 15 aa, Mycobacterium tuberculosis
DRAPDRCRGRHHRPP

SEQ ID NO: 1442613 - protein, 6 aa, Mycobacterium tuberculosis
DRAPTW

SEQ ID NO: 1442614 - protein, 13 aa, Mycobacterium tuberculosis
DRATAARRPAHTT

SEQ ID NO: 1442615 - protein, 16 aa, Mycobacterium tuberculosis
DRATKSVVTAAGQRHR

SEQ ID NO: 1442616 - protein, 23 aa, Mycobacterium tuberculosis
DRCGSAAAAACDGTDHHGGHHQR

SEQ ID NO: 1442617 - protein, 6 aa, Mycobacterium tuberculosis
DRDDAM

SEQ ID NO: 1442618 - protein, 30 aa, Mycobacterium tuberculosis
DRDHLRRSGAGTAGTAGAGAADLAARGQHR

SEQ ID NO: 1442619 - protein, 16 aa, Mycobacterium tuberculosis
DRDHPGRGRSGTVGAL

SEQ ID NO: 1442620 - protein, 8 aa, Mycobacterium tuberculosis
DRDIEAGT

SEQ ID NO: 1442621 - protein, 44 aa, Mycobacterium tuberculosis
DRDPRSTASAGVPPASSSRACAAASAAARRTSGAVETPTPIRTH

SEQ ID NO: 1442622 - protein, 7 aa, Mycobacterium tuberculosis
DRDQVNT

SEQ ID NO: 1442623 - protein, 10 aa, Mycobacterium tuberculosis
DREGDRQPAR

SEQ ID NO: 1442624 - protein, 8 aa, Mycobacterium tuberculosis
DREKQRVA

SEQ ID NO: 1442625 - protein, 6 aa, Mycobacterium tuberculosis
DREPDP

SEQ ID NO: 1442626 - protein, 14 aa, Mycobacterium tuberculosis
DRESELRPPVRSGF

SEQ ID NO: 1442627 - protein, 7 aa, Mycobacterium tuberculosis
DRESIDD

SEQ ID NO: 1442628 - protein, 5 aa, Mycobacterium tuberculosis
DRFAT

SEQ ID NO: 1442629 - protein, 15 aa, Mycobacterium tuberculosis
DRGFARGEQAHERVS

SEQ ID NO: 1442630 - protein, 10 aa, Mycobacterium tuberculosis
DRGGPALGET

SEQ ID NO: 1442631 - protein, 7 aa, Mycobacterium tuberculosis
DRGISGR

SEQ ID NO: 1442632 - protein, 6 aa, Mycobacterium tuberculosis
DRGNNR

SEQ ID NO: 1442633 - protein, 8 aa, Mycobacterium tuberculosis
DRGPGIPV

SEQ ID NO: 1442634 - protein, 16 aa, Mycobacterium tuberculosis
DRGPGLHAAPRRPPPV

SEQ ID NO: 1442635 - protein, 10 aa, Mycobacterium tuberculosis
DRGSSMSSKP

SEQ ID NO: 1442636 - protein, 4 aa, Mycobacterium tuberculosis
DRHP

SEQ ID NO: 1442637 - protein, 14 aa, Mycobacterium tuberculosis
DRHRSHRDASLPPR

SEQ ID NO: 1442638 - protein, 18 aa, Mycobacterium tuberculosis
DRKAQDAKLLTYTSAPLD

SEQ ID NO: 1442639 - protein, 8 aa, Mycobacterium tuberculosis
DRKELQPR

SEQ ID NO: 1442640 - protein, 13 aa, Mycobacterium tuberculosis
DRKRSGAPHRGPE

SEQ ID NO: 1442641 - protein, 12 aa, Mycobacterium tuberculosis
DRKTDRAGDSLP

SEQ ID NO: 1442642 - protein, 11 aa, Mycobacterium tuberculosis
DRLTEGAAQRV

SEQ ID NO: 1442643 - protein, 18 aa, Mycobacterium tuberculosis
DRNLGPGHGARRISSDYS

SEQ ID NO: 1442644 - protein, 19 aa, Mycobacterium tuberculosis
DRNLGPGHGARRISSEDSP

SEQ ID NO: 1442645 - protein, 5 aa, Mycobacterium tuberculosis
DRNQH

SEQ ID NO: 1442646 - protein, 9 aa, Mycobacterium tuberculosis
DRPARPDET

SEQ ID NO: 1442647 - protein, 7 aa, Mycobacterium tuberculosis
DRPEQPR

SEQ ID NO: 1442648 - protein, 9 aa, Mycobacterium tuberculosis
DRPHPTEAD

SEQ ID NO: 1442649 - protein, 16 aa, Mycobacterium tuberculosis
DRPQATKAECGSPASN

SEQ ID NO: 1442650 - protein, 5 aa, Mycobacterium tuberculosis
DRPRI

SEQ ID NO: 1442651 - protein, 16 aa, Mycobacterium tuberculosis
DRPSASLTPSPSALTP

SEQ ID NO: 1442652 - protein, 21 aa, Mycobacterium tuberculosis
DRQTGEGHVDRAGDDSGVVVR

SEQ ID NO: 1442653 - protein, 11 aa, Mycobacterium tuberculosis
DRRASRPQEFR

SEQ ID NO: 1442654 - protein, 22 aa, Mycobacterium tuberculosis
DRRGHPDGTRPGGRLGATRRAG

SEQ ID NO: 1442655 - protein, 23 aa, Mycobacterium tuberculosis
DRRGHRRRPAGRADRAGSAAVRG

SEQ ID NO: 1442656 - protein, 19 aa, Mycobacterium tuberculosis
DRRKRSSRALPSAARRGRP

SEQ ID NO: 1442657 - protein, 12 aa, Mycobacterium tuberculosis
DRRPSPAPRADF

SEQ ID NO: 1442658 - protein, 8 aa, Mycobacterium tuberculosis
DRRPVGRK

SEQ ID NO: 1442659 - protein, 22 aa, Mycobacterium tuberculosis
DRRQRDALSRGGAAVDLDAKTP

SEQ ID NO: 1442660 - protein, 7 aa, Mycobacterium tuberculosis
DRRRGAE

SEQ ID NO: 1442661 - protein, 6 aa, Mycobacterium tuberculosis
DRRRRT

SEQ ID NO: 1442662 - protein, 71 aa, Mycobacterium tuberculosis
DRRSARKRNAPGGALTQADQPGGPGLGAEGNQPAEPDPQGRQRRYRRGAGRGPDGYPGGRRGGAAGDRPRC

SEQ ID NO: 1442663 - protein, 13 aa, Mycobacterium tuberculosis
DRRSTHVLLAVRR

SEQ ID NO: 1442664 - protein, 15 aa, Mycobacterium tuberculosis
DRRSTRVRGGPDLGR

SEQ ID NO: 1442665 - protein, 11 aa, Mycobacterium tuberculosis
DRSADDAAADV

SEQ ID NO: 1442666 - protein, 7 aa, Mycobacterium tuberculosis
DRSAEQH

SEQ ID NO: 1442667 - protein, 5 aa, Mycobacterium tuberculosis
DRSDV

SEQ ID NO: 1442668 - protein, 6 aa, Mycobacterium tuberculosis
DRSEQV

SEQ ID NO: 1442669 - protein, 7 aa, Mycobacterium tuberculosis
DRSGAGV

SEQ ID NO: 1442670 - protein, 7 aa, Mycobacterium tuberculosis
DRSGEQL

SEQ ID NO: 1442671 - protein, 13 aa, Mycobacterium tuberculosis
DRSHRQTRSQRVC

SEQ ID NO: 1442672 - protein, 7 aa, Mycobacterium tuberculosis
DRSLAGP

SEQ ID NO: 1442673 - protein, 15 aa, Mycobacterium tuberculosis
DRSPAPQCAARLYNA

SEQ ID NO: 1442674 - protein, 20 aa, Mycobacterium tuberculosis
DRSPGRASSAPRQEPPQSQR

SEQ ID NO: 1442675 - protein, 19 aa, Mycobacterium tuberculosis
DRSTTTTSPKPSHCCVAHR

SEQ ID NO: 1442676 - protein, 7 aa, Mycobacterium tuberculosis
DRTGAQL

SEQ ID NO: 1442677 - protein, 20 aa, Mycobacterium tuberculosis
DRTGGAGGTGASGGKGGTGG

SEQ ID NO: 1442678 - protein, 10 aa, Mycobacterium tuberculosis
DSAAAASGRV

SEQ ID NO: 1442679 - protein, 7 aa, Mycobacterium tuberculosis
DSAATDI

SEQ ID NO: 1442680 - protein, 5 aa, Mycobacterium tuberculosis
DSAGG

SEQ ID NO: 1442681 - protein, 16 aa, Mycobacterium tuberculosis
DSALRAGERTSRGSVQ

SEQ ID NO: 1442682 - protein, 4 aa, Mycobacterium tuberculosis
DSAT

SEQ ID NO: 1442683 - protein, 9 aa, Mycobacterium tuberculosis
DSDGAAPVI

SEQ ID NO: 1442684 - protein, 7 aa, Mycobacterium tuberculosis
DSDPQAG

SEQ ID NO: 1442685 - protein, 5 aa, Mycobacterium tuberculosis
DSDVA

SEQ ID NO: 1442686 - protein, 10 aa, Mycobacterium tuberculosis
DSEGTTAHRA

SEQ ID NO: 1442687 - protein, 6 aa, Mycobacterium tuberculosis
DSESAN

SEQ ID NO: 1442688 - protein, 20 aa, Mycobacterium tuberculosis
DSGATGQDHGVDGVAGESTI

SEQ ID NO: 1442689 - protein, 9 aa, Mycobacterium tuberculosis
DSGGLHKGD

SEQ ID NO: 1442690 - protein, 4 aa, Mycobacterium tuberculosis
DSGI

SEQ ID NO: 1442691 - protein, 11 aa, Mycobacterium tuberculosis
DSGLDPATAPG

SEQ ID NO: 1442692 - protein, 4 aa, Mycobacterium tuberculosis
DSGQ

SEQ ID NO: 1442693 - protein, 5 aa, Mycobacterium tuberculosis
DSGRA

SEQ ID NO: 1442694 - protein, 10 aa, Mycobacterium tuberculosis
DSGRRRSNTS

SEQ ID NO: 1442695 - protein, 33 aa, Mycobacterium tuberculosis
DSGYDDARDPARPAPHGYRSSRCAPRAQRCSPG

SEQ ID NO: 1442696 - protein, 5 aa, Mycobacterium tuberculosis
DSHDG

SEQ ID NO: 1442697 - protein, 5 aa, Mycobacterium tuberculosis
DSKPL

SEQ ID NO: 1442698 - protein, 7 aa, Mycobacterium tuberculosis
DSLDGNQ

SEQ ID NO: 1442699 - protein, 6 aa, Mycobacterium tuberculosis
DSLPQT

SEQ ID NO: 1442700 - protein, 7 aa, Mycobacterium tuberculosis
DSNRPYH

SEQ ID NO: 1442701 - protein, 5 aa, Mycobacterium tuberculosis
DSPAD

SEQ ID NO: 1442702 - protein, 13 aa, Mycobacterium tuberculosis
DSPALQGAFLCGD

SEQ ID NO: 1442703 - protein, 14 aa, Mycobacterium tuberculosis
DSPARGQPASGGLP

SEQ ID NO: 1442704 - protein, 17 aa, Mycobacterium tuberculosis
DSPGNSAGPPRRWPPDS

SEQ ID NO: 1442705 - protein, 9 aa, Mycobacterium tuberculosis
DSPPRPTPL

SEQ ID NO: 1442706 - protein, 14 aa, Mycobacterium tuberculosis
DSPRPRLPADHPGI

SEQ ID NO: 1442707 - protein, 10 aa, Mycobacterium tuberculosis
DSQGSVNVPT

SEQ ID NO: 1442708 - protein, 9 aa, Mycobacterium tuberculosis
DSQTHTSDA

SEQ ID NO: 1442709 - protein, 6 aa, Mycobacterium tuberculosis
DSRAAR

SEQ ID NO: 1442710 - protein, 7 aa, Mycobacterium tuberculosis
DSRDGQT

SEQ ID NO: 1442711 - protein, 16 aa, Mycobacterium tuberculosis
DSRDTGRIAAGPGEVH

SEQ ID NO: 1442712 - protein, 26 aa, Mycobacterium tuberculosis
DSRETPPYVPKATTVDATTPAPAAPS

SEQ ID NO: 1442713 - protein, 6 aa, Mycobacterium tuberculosis
DSRETW

SEQ ID NO: 1442714 - protein, 4 aa, Mycobacterium tuberculosis
DSSG

SEQ ID NO: 1442715 - protein, 56 aa, Mycobacterium tuberculosis
DSSGTGDEGGNRGKLGVGETGGHGGFGSAAGGDGGAGGAGGTVFGSGGAGGAGGVA

SEQ ID NO: 1442716 - protein, 13 aa, Mycobacterium tuberculosis
DSSNRQVREAATD

SEQ ID NO: 1442717 - protein, 18 aa, Mycobacterium tuberculosis
DSSSDGRSRSCLRHYPAR

SEQ ID NO: 1442718 - protein, 14 aa, Mycobacterium tuberculosis
DSSTAMDPARRPRP

SEQ ID NO: 1442719 - protein, 16 aa, Mycobacterium tuberculosis
DSTRPERSSVAPGHPG

SEQ ID NO: 1442720 - protein, 12 aa, Mycobacterium tuberculosis
DSVDAEYAAHRQ

SEQ ID NO: 1442721 - protein, 5 aa, Mycobacterium tuberculosis
DSYRL

SEQ ID NO: 1442722 - protein, 15 aa, Mycobacterium tuberculosis
DSYRTDSPGWGCADR

SEQ ID NO: 1442723 - protein, 10 aa, Mycobacterium tuberculosis
DTAAAADGTM

SEQ ID NO: 1442724 - protein, 12 aa, Mycobacterium tuberculosis
DTAAGPSAPDYY

SEQ ID NO: 1442725 - protein, 4 aa, Mycobacterium tuberculosis
DTAD

SEQ ID NO: 1442726 - protein, 23 aa, Mycobacterium tuberculosis
DTAGRRPPRPRTSPCSPARTTAC

SEQ ID NO: 1442727 - protein, 23 aa, Mycobacterium tuberculosis
DTAHEARVEGAADPLESQGAGDQ

SEQ ID NO: 1442728 - protein, 11 aa, Mycobacterium tuberculosis
DTAHTAEAGAA

SEQ ID NO: 1442729 - protein, 14 aa, Mycobacterium tuberculosis
DTAIETSRRTSRPL

SEQ ID NO: 1442730 - protein, 10 aa, Mycobacterium tuberculosis
DTASELPDGQ

SEQ ID NO: 1442731 - protein, 7 aa, Mycobacterium tuberculosis
DTATALR

SEQ ID NO: 1442732 - protein, 22 aa, Mycobacterium tuberculosis
DTCESKVPATPSISVWPSVTCF

SEQ ID NO: 1442733 - protein, 13 aa, Mycobacterium tuberculosis
DTCGLGGNIRLMK

SEQ ID NO: 1442734 - protein, 16 aa, Mycobacterium tuberculosis
DTCRGGRECDGPGQHQ

SEQ ID NO: 1442735 - protein, 35 aa, Mycobacterium tuberculosis
DTDARIKRAQRPAPPLPGRATAAGARRARAGRPAR

SEQ ID NO: 1442736 - protein, 4 aa, Mycobacterium tuberculosis
DTDN

SEQ ID NO: 1442737 - protein, 15 aa, Mycobacterium tuberculosis
DTEFSRAGIAGITPA

SEQ ID NO: 1442738 - protein, 6 aa, Mycobacterium tuberculosis
DTEHPD

SEQ ID NO: 1442739 - protein, 18 aa, Mycobacterium tuberculosis
DTERATLPATAGPSSCAK

SEQ ID NO: 1442740 - protein, 9 aa, Mycobacterium tuberculosis
DTETSEEDM

SEQ ID NO: 1442741 - protein, 8 aa, Mycobacterium tuberculosis
DTGHRGQR

SEQ ID NO: 1442742 - protein, 19 aa, Mycobacterium tuberculosis
DTGNRRTPGVEDWAPLRFC

SEQ ID NO: 1442743 - protein, 7 aa, Mycobacterium tuberculosis
DTGQAQG

SEQ ID NO: 1442744 - protein, 33 aa, Mycobacterium tuberculosis
DTGVAGGQQSTTRRARRKASRPAGPAECEASRP

SEQ ID NO: 1442745 - protein, 8 aa, Mycobacterium tuberculosis
DTHGGDRA

SEQ ID NO: 1442746 - protein, 11 aa, Mycobacterium tuberculosis
DTLGSPGDDSH

SEQ ID NO: 1442747 - protein, 11 aa, Mycobacterium tuberculosis
DTLRTDTGESV

SEQ ID NO: 1442748 - protein, 15 aa, Mycobacterium tuberculosis
DTMRNPGDRGNGGAQ

SEQ ID NO: 1442749 - protein, 5 aa, Mycobacterium tuberculosis
DTNNG

SEQ ID NO: 1442750 - protein, 10 aa, Mycobacterium tuberculosis
DTNPPPSAAA

SEQ ID NO: 1442751 - protein, 8 aa, Mycobacterium tuberculosis
DTPADLTA

SEQ ID NO: 1442752 - protein, 10 aa, Mycobacterium tuberculosis
DTPGPNHNRT

SEQ ID NO: 1442753 - protein, 9 aa, Mycobacterium tuberculosis
DTPTRSATA

SEQ ID NO: 1442754 - protein, 13 aa, Mycobacterium tuberculosis
DTPVQASRYLSPR

SEQ ID NO: 1442755 - protein, 5 aa, Mycobacterium tuberculosis
DTPWR

SEQ ID NO: 1442756 - protein, 8 aa, Mycobacterium tuberculosis
DTQDTRAV

SEQ ID NO: 1442757 - protein, 11 aa, Mycobacterium tuberculosis
DTQGADGPAGL

SEQ ID NO: 1442758 - protein, 14 aa, Mycobacterium tuberculosis
DTQPACPAPGPRNG

SEQ ID NO: 1442759 - protein, 6 aa, Mycobacterium tuberculosis
DTREIG

SEQ ID NO: 1442760 - protein, 31 aa, Mycobacterium tuberculosis
DTRSSTATRCSSCTSTRKPRPLRRSRGPRPN

SEQ ID NO: 1442761 - protein, 11 aa, Mycobacterium tuberculosis
DTRVDTDNAMP

SEQ ID NO: 1442762 - protein, 7 aa, Mycobacterium tuberculosis
DTSGPGA

SEQ ID NO: 1442763 - protein, 9 aa, Mycobacterium tuberculosis
DTSSAPAVN

SEQ ID NO: 1442764 - protein, 15 aa, Mycobacterium tuberculosis
DTSTAAGRWAKKGAN

SEQ ID NO: 1442765 - protein, 16 aa, Mycobacterium tuberculosis
DTSTAAGRWAKKGANH

SEQ ID NO: 1442766 - protein, 11 aa, Mycobacterium tuberculosis
DTTFDDRTRGQ

SEQ ID NO: 1442767 - protein, 19 aa, Mycobacterium tuberculosis
DTTGSRSSSRWRWRPKPVC

SEQ ID NO: 1442768 - protein, 21 aa, Mycobacterium tuberculosis
DTTRPRAGQRDRNPTRPSAGL

SEQ ID NO: 1442769 - protein, 16 aa, Mycobacterium tuberculosis
DTTTTRRQTQNPERGR

SEQ ID NO: 1442770 - protein, 50 aa, Mycobacterium tuberculosis
DTVASPTVTATADPTEAPLPIEQESADSSVHAADRPDPTGMSRGDSQKQR

SEQ ID NO: 1442771 - protein, 4 aa, Mycobacterium tuberculosis
DTVD

SEQ ID NO: 1442772 - protein, 26 aa, Mycobacterium tuberculosis
DVADRGEVHRDGRDVDGRNDGGGSPV

SEQ ID NO: 1442773 - protein, 6 aa, Mycobacterium tuberculosis
DVAEPD

SEQ ID NO: 1442774 - protein, 9 aa, Mycobacterium tuberculosis
DVAESDGYA

SEQ ID NO: 1442775 - protein, 7 aa, Mycobacterium tuberculosis
DVAETGF

SEQ ID NO: 1442776 - protein, 17 aa, Mycobacterium tuberculosis
DVATDETVHSAAAHAEA

SEQ ID NO: 1442777 - protein, 13 aa, Mycobacterium tuberculosis
DVDDGPTALRFPK

SEQ ID NO: 1442778 - protein, 5 aa, Mycobacterium tuberculosis
DVDDQ

SEQ ID NO: 1442779 - protein, 8 aa, Mycobacterium tuberculosis
DVDNAERV

SEQ ID NO: 1442780 - protein, 17 aa, Mycobacterium tuberculosis
DVDPGRLAATLAPPDVP

SEQ ID NO: 1442781 - protein, 20 aa, Mycobacterium tuberculosis
DVFSGPPCTGVPDATGAVGG

SEQ ID NO: 1442782 - protein, 12 aa, Mycobacterium tuberculosis
DVGGKSTHTQSR

SEQ ID NO: 1442783 - protein, 7 aa, Mycobacterium tuberculosis
DVGGNGL

SEQ ID NO: 1442784 - protein, 37 aa, Mycobacterium tuberculosis
DVGPAGPAVPPSPPCRTADHRAPPAPPFPPAPPLPTP

SEQ ID NO: 1442785 - protein, 6 aa, Mycobacterium tuberculosis
DVGRGC

SEQ ID NO: 1442786 - protein, 8 aa, Mycobacterium tuberculosis
DVGSPRRT

SEQ ID NO: 1442787 - protein, 31 aa, Mycobacterium tuberculosis
DVLPGGARSPRRQRDGRRRRQCDSQRPRMSA

SEQ ID NO: 1442788 - protein, 5 aa, Mycobacterium tuberculosis
DVNTG

SEQ ID NO: 1442789 - protein, 16 aa, Mycobacterium tuberculosis
DVPATAASARPRGPRF

SEQ ID NO: 1442790 - protein, 22 aa, Mycobacterium tuberculosis
DVRPAPPPERTAPILISGSVWS

SEQ ID NO: 1442791 - protein, 7 aa, Mycobacterium tuberculosis
DVRRGQR

SEQ ID NO: 1442792 - protein, 4 aa, Mycobacterium tuberculosis
DVSD

SEQ ID NO: 1442793 - protein, 10 aa, Mycobacterium tuberculosis
DVSKASTSRR

SEQ ID NO: 1442794 - protein, 6 aa, Mycobacterium tuberculosis
DVSSQT

SEQ ID NO: 1442795 - protein, 12 aa, Mycobacterium tuberculosis
DVTGPSEQSDID

SEQ ID NO: 1442796 - protein, 14 aa, Mycobacterium tuberculosis
DVVGGDSGRGFDRT

SEQ ID NO: 1442797 - protein, 5 aa, Mycobacterium tuberculosis
DVYGN

SEQ ID NO: 1442798 - protein, 8 aa, Mycobacterium tuberculosis
DWPETPRI

SEQ ID NO: 1442799 - protein, 5 aa, Mycobacterium tuberculosis
DWPSA

SEQ ID NO: 1442800 - protein, 5 aa, Mycobacterium tuberculosis
DYARM

SEQ ID NO: 1442801 - protein, 4 aa, Mycobacterium tuberculosis
DYGG

SEQ ID NO: 1442802 - protein, 5 aa, Mycobacterium tuberculosis
DYGIE

SEQ ID NO: 1442803 - protein, 6 aa, Mycobacterium tuberculosis
DYGIET

SEQ ID NO: 1442804 - protein, 7 aa, Mycobacterium tuberculosis
DYGPGGY

SEQ ID NO: 1442805 - protein, 4 aa, Mycobacterium tuberculosis
DYGT

SEQ ID NO: 1442806 - protein, 5 aa, Mycobacterium tuberculosis
DYHDP

SEQ ID NO: 1442807 - protein, 13 aa, Mycobacterium tuberculosis
DYPPGRKRSELAT

SEQ ID NO: 1442808 - protein, 7 aa, Mycobacterium tuberculosis
DYRTGIG

SEQ ID NO: 1442809 - protein, 18 aa, Mycobacterium tuberculosis
DYRTGIGGLNSGTGNLGL

SEQ ID NO: 1442810 - protein, 10 aa, Mycobacterium tuberculosis
DYTTPSGQHG

SEQ ID NO: 1442811 - protein, 11 aa, Mycobacterium tuberculosis
EAAAAAQASID

SEQ ID NO: 1442812 - protein, 9 aa, Mycobacterium tuberculosis
EAAAAGTPL

SEQ ID NO: 1442813 - protein, 9 aa, Mycobacterium tuberculosis
EAAAGPHDA

SEQ ID NO: 1442814 - protein, 8 aa, Mycobacterium tuberculosis
EAADDDHY

SEQ ID NO: 1442815 - protein, 7 aa, Mycobacterium tuberculosis
EAADPDL

SEQ ID NO: 1442816 - protein, 7 aa, Mycobacterium tuberculosis
EAADPTT

SEQ ID NO: 1442817 - protein, 14 aa, Mycobacterium tuberculosis
EAADQQPGQAGGTG

SEQ ID NO: 1442818 - protein, 5 aa, Mycobacterium tuberculosis
EAAET

SEQ ID NO: 1442819 - protein, 7 aa, Mycobacterium tuberculosis
EAAISDP

SEQ ID NO: 1442820 - protein, 9 aa, Mycobacterium tuberculosis
EAANASPLQ

SEQ ID NO: 1442821 - protein, 33 aa, Mycobacterium tuberculosis
EAAPAGPVCPGADRPRRPVRGGAGSAKRPRNST

SEQ ID NO: 1442822 - protein, 8 aa, Mycobacterium tuberculosis
EAAPRQPP

SEQ ID NO: 1442823 - protein, 28 aa, Mycobacterium tuberculosis
EAARGGWQTVSGSRRNAAYQDGRQTQIS

SEQ ID NO: 1442824 - protein, 18 aa, Mycobacterium tuberculosis
EAARRQGRGAKPPKSVKK

SEQ ID NO: 1442825 - protein, 5 aa, Mycobacterium tuberculosis
EAARV

SEQ ID NO: 1442826 - protein, 6 aa, Mycobacterium tuberculosis
EAASDI

SEQ ID NO: 1442827 - protein, 9 aa, Mycobacterium tuberculosis
EAATAQSVQ

SEQ ID NO: 1442828 - protein, 17 aa, Mycobacterium tuberculosis
EACPPRWPTASSTTPTY

SEQ ID NO: 1442829 - protein, 6 aa, Mycobacterium tuberculosis
EADIGV

SEQ ID NO: 1442830 - protein, 8 aa, Mycobacterium tuberculosis
EADRDGFY

SEQ ID NO: 1442831 - protein, 8 aa, Mycobacterium tuberculosis
EAGCQQGA

SEQ ID NO: 1442832 - protein, 8 aa, Mycobacterium tuberculosis
EAGGGNDQ

SEQ ID NO: 1442833 - protein, 6 aa, Mycobacterium tuberculosis
EAGGNA

SEQ ID NO: 1442834 - protein, 7 aa, Mycobacterium tuberculosis
EAGPDGL

SEQ ID NO: 1442835 - protein, 8 aa, Mycobacterium tuberculosis
EAGQRPPQ

SEQ ID NO: 1442836 - protein, 22 aa, Mycobacterium tuberculosis
EAGRGAGDRVHAGRGRGLHCAG

SEQ ID NO: 1442837 - protein, 8 aa, Mycobacterium tuberculosis
EAGRPTVR

SEQ ID NO: 1442838 - protein, 13 aa, Mycobacterium tuberculosis
EAGRQRDPPGPRC

SEQ ID NO: 1442839 - protein, 6 aa, Mycobacterium tuberculosis
EAKIEA

SEQ ID NO: 1442840 - protein, 5 aa, Mycobacterium tuberculosis
EAKSA

SEQ ID NO: 1442841 - protein, 6 aa, Mycobacterium tuberculosis
EALAAT

SEQ ID NO: 1442842 - protein, 5 aa, Mycobacterium tuberculosis
EALAD

SEQ ID NO: 1442843 - protein, 11 aa, Mycobacterium tuberculosis
EALGRSGTIAG

SEQ ID NO: 1442844 - protein, 12 aa, Mycobacterium tuberculosis
EAMRPGDALTGP

SEQ ID NO: 1442845 - protein, 13 aa, Mycobacterium tuberculosis
EANGDARERLPSR

SEQ ID NO: 1442846 - protein, 11 aa, Mycobacterium tuberculosis
EANGIDPQPLR

SEQ ID NO: 1442847 - protein, 18 aa, Mycobacterium tuberculosis
EANGPPRFNNVRCGPRAR

SEQ ID NO: 1442848 - protein, 18 aa, Mycobacterium tuberculosis
EAPAPFEEPLPPEATDQW

SEQ ID NO: 1442849 - protein, 10 aa, Mycobacterium tuberculosis
EAPAPLQNTP

SEQ ID NO: 1442850 - protein, 24 aa, Mycobacterium tuberculosis
EAPGGGVREDTATDADEADDQEER

SEQ ID NO: 1442851 - protein, 6 aa, Mycobacterium tuberculosis
EAPPLT

SEQ ID NO: 1442852 - protein, 4 aa, Mycobacterium tuberculosis
EAPT

SEQ ID NO: 1442853 - protein, 13 aa, Mycobacterium tuberculosis
EAPTGWRSTATSG

SEQ ID NO: 1442854 - protein, 6 aa, Mycobacterium tuberculosis
EAQRAG

SEQ ID NO: 1442855 - protein, 37 aa, Mycobacterium tuberculosis
EAQRLGRDRRSKSLQRSTIRSAGTRARPPTGRGRKIR

SEQ ID NO: 1442856 - protein, 18 aa, Mycobacterium tuberculosis
EAQRTADPVEGEQAYEWL

SEQ ID NO: 1442857 - protein, 9 aa, Mycobacterium tuberculosis
EAQRTHQAL

SEQ ID NO: 1442858 - protein, 9 aa, Mycobacterium tuberculosis
EARATATTI

SEQ ID NO: 1442859 - protein, 15 aa, Mycobacterium tuberculosis
EARGGVRRQPAGPTD

SEQ ID NO: 1442860 - protein, 30 aa, Mycobacterium tuberculosis
EARLRDRSARGRAAAERHQRGTPSAALAHP

SEQ ID NO: 1442861 - protein, 10 aa, Mycobacterium tuberculosis
EARSVRSPGR

SEQ ID NO: 1442862 - protein, 13 aa, Mycobacterium tuberculosis
EASGQSGVEKEDF

SEQ ID NO: 1442863 - protein, 16 aa, Mycobacterium tuberculosis
EASPPLPDDERRPRIG

SEQ ID NO: 1442864 - protein, 10 aa, Mycobacterium tuberculosis
EASQSFATPF

SEQ ID NO: 1442865 - protein, 15 aa, Mycobacterium tuberculosis
EATAGPAAPAASAPL

SEQ ID NO: 1442866 - protein, 21 aa, Mycobacterium tuberculosis
EATAGPAAPAASGAPPPRSIG

SEQ ID NO: 1442867 - protein, 11 aa, Mycobacterium tuberculosis
EATATNRLGPA

SEQ ID NO: 1442868 - protein, 7 aa, Mycobacterium tuberculosis
EATATRI

SEQ ID NO: 1442869 - protein, 23 aa, Mycobacterium tuberculosis
EATGEMSGQADTATTAEARTPAH

SEQ ID NO: 1442870 - protein, 34 aa, Mycobacterium tuberculosis
EATGEMSGQADTATTAKQGRRPTLPTTSSKVSPV

SEQ ID NO: 1442871 - protein, 35 aa, Mycobacterium tuberculosis
EATGEMSGQAGHRHHRGSKGRRPTLPTTSSKVSPV

SEQ ID NO: 1442872 - protein, 52 aa, Mycobacterium tuberculosis
EATLPPVAEPPPPAAPPVAEPPPPVAAPAPPGAPEPANGPSPEALSEGATPC

SEQ ID NO: 1442873 - protein, 18 aa, Mycobacterium tuberculosis
EATPSAGPRAAQPPYHGP

SEQ ID NO: 1442874 - protein, 7 aa, Mycobacterium tuberculosis
EATRQPD

SEQ ID NO: 1442875 - protein, 8 aa, Mycobacterium tuberculosis
EAVDGSIN

SEQ ID NO: 1442876 - protein, 6 aa, Mycobacterium tuberculosis
EAVEGR

SEQ ID NO: 1442877 - protein, 13 aa, Mycobacterium tuberculosis
EAVELTSSTEERV

SEQ ID NO: 1442878 - protein, 6 aa, Mycobacterium tuberculosis
ECGRTT

SEQ ID NO: 1442879 - protein, 5 aa, Mycobacterium tuberculosis
ECRAG

SEQ ID NO: 1442880 - protein, 4 aa, Mycobacterium tuberculosis
ECTG

SEQ ID NO: 1442881 - protein, 20 aa, Mycobacterium tuberculosis
EDAALSAGTGVAAAAAGAGV

SEQ ID NO: 1442882 - protein, 8 aa, Mycobacterium tuberculosis
EDAFGGTL

SEQ ID NO: 1442883 - protein, 4 aa, Mycobacterium tuberculosis
EDAL

SEQ ID NO: 1442884 - protein, 9 aa, Mycobacterium tuberculosis
EDASQSPCT

SEQ ID NO: 1442885 - protein, 17 aa, Mycobacterium tuberculosis
EDDASGYTRFYNPQGVY

SEQ ID NO: 1442886 - protein, 5 aa, Mycobacterium tuberculosis
EDDGR

SEQ ID NO: 1442887 - protein, 10 aa, Mycobacterium tuberculosis
EDDPRTLAQR

SEQ ID NO: 1442888 - protein, 15 aa, Mycobacterium tuberculosis
EDDRRRARRGGGRGR

SEQ ID NO: 1442889 - protein, 6 aa, Mycobacterium tuberculosis
EDGAES

SEQ ID NO: 1442890 - protein, 6 aa, Mycobacterium tuberculosis
EDGAGA

SEQ ID NO: 1442891 - protein, 4 aa, Mycobacterium tuberculosis
EDGR

SEQ ID NO: 1442892 - protein, 6 aa, Mycobacterium tuberculosis
EDGREG

SEQ ID NO: 1442893 - protein, 26 aa, Mycobacterium tuberculosis
EDHAGTGGCGKAPNEVGPGAGENVAG

SEQ ID NO: 1442894 - protein, 7 aa, Mycobacterium tuberculosis
EDHPPTC

SEQ ID NO: 1442895 - protein, 6 aa, Mycobacterium tuberculosis
EDKGMR

SEQ ID NO: 1442896 - protein, 4 aa, Mycobacterium tuberculosis
EDLA

SEQ ID NO: 1442897 - protein, 12 aa, Mycobacterium tuberculosis
EDLEQRDVEEVS

SEQ ID NO: 1442898 - protein, 8 aa, Mycobacterium tuberculosis
EDNPITVP

SEQ ID NO: 1442899 - protein, 6 aa, Mycobacterium tuberculosis
EDNREE

SEQ ID NO: 1442900 - protein, 13 aa, Mycobacterium tuberculosis
EDPAGRKADREGL

SEQ ID NO: 1442901 - protein, 14 aa, Mycobacterium tuberculosis
EDPIPPSARHEGLS

SEQ ID NO: 1442902 - protein, 19 aa, Mycobacterium tuberculosis
EDQRQRAPAGAEAEGPGRT

SEQ ID NO: 1442903 - protein, 27 aa, Mycobacterium tuberculosis
EDQYYSPDFGAATGAAVPLDDYGYSDY

SEQ ID NO: 1442904 - protein, 6 aa, Mycobacterium tuberculosis
EDRGQS

SEQ ID NO: 1442905 - protein, 6 aa, Mycobacterium tuberculosis
EDRPAL

SEQ ID NO: 1442906 - protein, 5 aa, Mycobacterium tuberculosis
EDTDT

SEQ ID NO: 1442907 - protein, 4 aa, Mycobacterium tuberculosis
EDTG

SEQ ID NO: 1442908 - protein, 20 aa, Mycobacterium tuberculosis
EEAADEAKAKLEAAGATVTV

SEQ ID NO: 1442909 - protein, 5 aa, Mycobacterium tuberculosis
EEAGM

SEQ ID NO: 1442910 - protein, 4 aa, Mycobacterium tuberculosis
EEDK

SEQ ID NO: 1442911 - protein, 15 aa, Mycobacterium tuberculosis
EEDTDAVDTTPTPVV

SEQ ID NO: 1442912 - protein, 6 aa, Mycobacterium tuberculosis
EEGPWG

SEQ ID NO: 1442913 - protein, 6 aa, Mycobacterium tuberculosis
EEHRDG

SEQ ID NO: 1442914 - protein, 8 aa, Mycobacterium tuberculosis
EEIRASGA

SEQ ID NO: 1442915 - protein, 4 aa, Mycobacterium tuberculosis
EELT

SEQ ID NO: 1442916 - protein, 4 aa, Mycobacterium tuberculosis
EEQA

SEQ ID NO: 1442917 - protein, 11 aa, Mycobacterium tuberculosis
EEQATADRLNR

SEQ ID NO: 1442918 - protein, 5 aa, Mycobacterium tuberculosis
EEQER

SEQ ID NO: 1442919 - protein, 8 aa, Mycobacterium tuberculosis
EERGGKYG

SEQ ID NO: 1442920 - protein, 9 aa, Mycobacterium tuberculosis
EETSTPQKL

SEQ ID NO: 1442921 - protein, 40 aa, Mycobacterium tuberculosis
EFESEIDEAAAKQDSESDDPPHRCQGPRQIARRRRDRLTR

SEQ ID NO: 1442922 - protein, 9 aa, Mycobacterium tuberculosis
EFGGGSGRR

SEQ ID NO: 1442923 - protein, 6 aa, Mycobacterium tuberculosis
EFPNTR

SEQ ID NO: 1442924 - protein, 7 aa, Mycobacterium tuberculosis
EFSSDPE

SEQ ID NO: 1442925 - protein, 5 aa, Mycobacterium tuberculosis
EGADL

SEQ ID NO: 1442926 - protein, 5 aa, Mycobacterium tuberculosis
EGAGG

SEQ ID NO: 1442927 - protein, 11 aa, Mycobacterium tuberculosis
EGANPSGEYGA

SEQ ID NO: 1442928 - protein, 16 aa, Mycobacterium tuberculosis
EGDAATACEASARSTT

SEQ ID NO: 1442929 - protein, 9 aa, Mycobacterium tuberculosis
EGDDCPDST

SEQ ID NO: 1442930 - protein, 5 aa, Mycobacterium tuberculosis
EGDDV

SEQ ID NO: 1442931 - protein, 5 aa, Mycobacterium tuberculosis
EGDEY

SEQ ID NO: 1442932 - protein, 10 aa, Mycobacterium tuberculosis
EGDGRDSARA

SEQ ID NO: 1442933 - protein, 5 aa, Mycobacterium tuberculosis
EGDID

SEQ ID NO: 1442934 - protein, 10 aa, Mycobacterium tuberculosis
EGDPATPEGI

SEQ ID NO: 1442935 - protein, 5 aa, Mycobacterium tuberculosis
EGDVH

SEQ ID NO: 1442936 - protein, 4 aa, Mycobacterium tuberculosis
EGED

SEQ ID NO: 1442937 - protein, 50 aa, Mycobacterium tuberculosis; identical to SEQ ID NO: 192413

SEQ ID NO: 1442938 - protein, 19 aa, Mycobacterium tuberculosis
EGGARDPASSPSCWPTSRA

SEQ ID NO: 1442939 - protein, 9 aa, Mycobacterium tuberculosis
EGGHAARKS

SEQ ID NO: 1442940 - protein, 11 aa, Mycobacterium tuberculosis
EGGLGSKSWTA

SEQ ID NO: 1442941 - protein, 16 aa, Mycobacterium tuberculosis
EGGPADGGDGQSDLRR

SEQ ID NO: 1442942 - protein, 4 aa, Mycobacterium tuberculosis
EGGS

SEQ ID NO: 1442943 - protein, 17 aa, Mycobacterium tuberculosis
EGGSAPRRRGFMPSSCR

SEQ ID NO: 1442944 - protein, 48 aa, Mycobacterium tuberculosis
EGGSGGADGAGASGAHATNLGADGQAGGNGGNGGAGGTGGVGGPGGGH

SEQ ID NO: 1442945 - protein, 5 aa, Mycobacterium tuberculosis
EGGYG

SEQ ID NO: 1442946 - protein, 8 aa, Mycobacterium tuberculosis
EGIGGHES

SEQ ID NO: 1442947 - protein, 36 aa, Mycobacterium tuberculosis
EGIGGSGGTGGQGGVGGGKSGDGGTGGIGGAGGGGG

SEQ ID NO: 1442948 - protein, 24 aa, Mycobacterium tuberculosis
EGKAGAGDAISAGTTRTAVTDRPA

SEQ ID NO: 1442949 - protein, 18 aa, Mycobacterium tuberculosis
EGKDGYLRSTATYNLCYG

SEQ ID NO: 1442950 - protein, 4 aa, Mycobacterium tuberculosis
EGKM

SEQ ID NO: 1442951 - protein, 4 aa, Mycobacterium tuberculosis
EGKT

SEQ ID NO: 1442952 - protein, 7 aa, Mycobacterium tuberculosis
EGLARAG

SEQ ID NO: 1442953 - protein, 7 aa, Mycobacterium tuberculosis
EGMEESQ

SEQ ID NO: 1442954 - protein, 7 aa, Mycobacterium tuberculosis
EGMTDQS

SEQ ID NO: 1442955 - protein, 18 aa, Mycobacterium tuberculosis
EGNDAMTSSHSYRRRAAS

SEQ ID NO: 1442956 - protein, 7 aa, Mycobacterium tuberculosis
EGPMTPK

SEQ ID NO: 1442957 - protein, 12 aa, Mycobacterium tuberculosis
EGPPDKYQTTGV

SEQ ID NO: 1442958 - protein, 8 aa, Mycobacterium tuberculosis
EGQEGDRG

SEQ ID NO: 1442959 - protein, 5 aa, Mycobacterium tuberculosis
EGQIE

SEQ ID NO: 1442960 - protein, 5 aa, Mycobacterium tuberculosis
EGQRG

SEQ ID NO: 1442961 - protein, 14 aa, Mycobacterium tuberculosis
EGQSAVKTAKTIDQ

SEQ ID NO: 1442962 - protein, 15 aa, Mycobacterium tuberculosis
EGQSAVKTAKTIDQA

SEQ ID NO: 1442963 - protein, 5 aa, Mycobacterium tuberculosis
EGRDA

SEQ ID NO: 1442964 - protein, 4 aa, Mycobacterium tuberculosis
EGRI

SEQ ID NO: 1442965 - protein, 4 aa, Mycobacterium tuberculosis
EGRT

SEQ ID NO: 1442966 - protein, 10 aa, Mycobacterium tuberculosis
EGSDGTEIDR

SEQ ID NO: 1442967 - protein, 9 aa, Mycobacterium tuberculosis
EGSGLSKKD

SEQ ID NO: 1442968 - protein, 9 aa, Mycobacterium tuberculosis
EGSGQDDFG

SEQ ID NO: 1442969 - protein, 5 aa, Mycobacterium tuberculosis
EGSGV

SEQ ID NO: 1442970 - protein, 6 aa, Mycobacterium tuberculosis
EGSHDR

SEQ ID NO: 1442971 - protein, 29 aa, Mycobacterium tuberculosis
EGSPSPLSRRERSGGDRGVYPGRRRAGRR

SEQ ID NO: 1442972 - protein, 6 aa, Mycobacterium tuberculosis
EGTAAV

SEQ ID NO: 1442973 - protein, 13 aa, Mycobacterium tuberculosis
EGTAQTDTSCGGA

SEQ ID NO: 1442974 - protein, 7 aa, Mycobacterium tuberculosis
EGTAVTP

SEQ ID NO: 1442975 - protein, 30 aa, Mycobacterium tuberculosis; identical to SEQ ID NO: 229607

SEQ ID NO: 1442976 - protein, 7 aa, Mycobacterium tuberculosis
EGTPYKE

SEQ ID NO: 1442977 - protein, 28 aa, Mycobacterium tuberculosis
EGTTTRIREPTSTREQTQKSPISGEISD

SEQ ID NO: 1442978 - protein, 7 aa, Mycobacterium tuberculosis
EGVSASA

SEQ ID NO: 1442979 - protein, 16 aa, Mycobacterium tuberculosis
EHAAIGGGGVDRTAGR

SEQ ID NO: 1442980 - protein, 17 aa, Mycobacterium tuberculosis
EHAANEPTTSSPASTAG

SEQ ID NO: 1442981 - protein, 4 aa, Mycobacterium tuberculosis
EHAH

SEQ ID NO: 1442982 - protein, 12 aa, Mycobacterium tuberculosis
EHAKARGRQAVG

SEQ ID NO: 1442983 - protein, 18 aa, Mycobacterium tuberculosis
EHAPDALGGPPGLPAPRG

SEQ ID NO: 1442984 - protein, 6 aa, Mycobacterium tuberculosis
EHGRWP

SEQ ID NO: 1442985 - protein, 9 aa, Mycobacterium tuberculosis
EHHSDSTES

SEQ ID NO: 1442986 - protein, 7 aa, Mycobacterium tuberculosis
EHPADRT

SEQ ID NO: 1442987 - protein, 11 aa, Mycobacterium tuberculosis
EHPPVQGSHVE

SEQ ID NO: 1442988 - protein, 5 aa, Mycobacterium tuberculosis
EHPTH

SEQ ID NO: 1442989 - protein, 5 aa, Mycobacterium tuberculosis
EHPVP

SEQ ID NO: 1442990 - protein, 4 aa, Mycobacterium tuberculosis
EHRA

SEQ ID NO: 1442991 - protein, 13 aa, Mycobacterium tuberculosis
EHRHRPGRRGRTG

SEQ ID NO: 1442992 - protein, 7 aa, Mycobacterium tuberculosis
EHRPAGL

SEQ ID NO: 1442993 - protein, 29 aa, Mycobacterium tuberculosis
EHRPSVGSGARQGQQEAHSTCSGSQPPMR

SEQ ID NO: 1442994 - protein, 6 aa, Mycobacterium tuberculosis
EHRQPR

SEQ ID NO: 1442995 - protein, 27 aa, Mycobacterium tuberculosis
EHRRGQRGRGGQHHSTAGAGADEVSPA

SEQ ID NO: 1442996 - protein, 14 aa, Mycobacterium tuberculosis
EHRRPDTPRPPGSA

SEQ ID NO: 1442997 - protein, 4 aa, Mycobacterium tuberculosis
EHYP

SEQ ID NO: 1442998 - protein, 14 aa, Mycobacterium tuberculosis
EIAARGGRARGQRL

SEQ ID NO: 1442999 - protein, 8 aa, Mycobacterium tuberculosis
EIAESGAA

SEQ ID NO: 1443000 - protein, 4 aa, Mycobacterium tuberculosis
EIGG

SEQ ID NO: 1443001 - protein, 9 aa, Mycobacterium tuberculosis
EIPADRRAL

SEQ ID NO: 1443002 - protein, 16 aa, Mycobacterium tuberculosis
EIPDTTSEDGELPTDH

SEQ ID NO: 1443003 - protein, 11 aa, Mycobacterium tuberculosis
EIQRRGGPAMA

SEQ ID NO: 1443004 - protein, 5 aa, Mycobacterium tuberculosis
EISDN

SEQ ID NO: 1443005 - protein, 8 aa, Mycobacterium tuberculosis
EKAAEPRR

SEQ ID NO: 1443006 - protein, 17 aa, Mycobacterium tuberculosis
EKAAPNPAGPRLRPPRP

SEQ ID NO: 1443007 - protein, 14 aa, Mycobacterium tuberculosis
EKAMRGGCAGDHRR

SEQ ID NO: 1443008 - protein, 8 aa, Mycobacterium tuberculosis
EKGQPRDL

SEQ ID NO: 1443009 - protein, 6 aa, Mycobacterium tuberculosis
EKPIPM

SEQ ID NO: 1443010 - protein, 13 aa, Mycobacterium tuberculosis
EKQARISTDIGAP

SEQ ID NO: 1443011 - protein, 5 aa, Mycobacterium tuberculosis
EKQEP

SEQ ID NO: 1443012 - protein, 7 aa, Mycobacterium tuberculosis
EKQRTRV

SEQ ID NO: 1443013 - protein, 16 aa, Mycobacterium tuberculosis
EKRAPNFQKPLGAERE

SEQ ID NO: 1443014 - protein, 7 aa, Mycobacterium tuberculosis
EKRWKDD

SEQ ID NO: 1443015 - protein, 7 aa, Mycobacterium tuberculosis
EKSLAEA

SEQ ID NO: 1443016 - protein, 7 aa, Mycobacterium tuberculosis
EKTGTMG

SEQ ID NO: 1443017 - protein, 18 aa, Mycobacterium tuberculosis
ELAEGNLGRTPPSAQLRR

SEQ ID NO: 1443018 - protein, 8 aa, Mycobacterium tuberculosis
ELAESGDD

SEQ ID NO: 1443019 - protein, 5 aa, Mycobacterium tuberculosis
ELAPS

SEQ ID NO: 1443020 - protein, 5 aa, Mycobacterium tuberculosis
ELAQP

SEQ ID NO: 1443021 - protein, 7 aa, Mycobacterium tuberculosis
ELDGKAG

SEQ ID NO: 1443022 - protein, 11 aa, Mycobacterium tuberculosis
ELDRPGRLGEQ

SEQ ID NO: 1443023 - protein, 6 aa, Mycobacterium tuberculosis
ELEGEG

SEQ ID NO: 1443024 - protein, 12 aa, Mycobacterium tuberculosis
ELGPSVRPVTKT

SEQ ID NO: 1443025 - protein, 16 aa, Mycobacterium tuberculosis
ELGQAANSFSSATAAL

SEQ ID NO: 1443026 - protein, 17 aa, Mycobacterium tuberculosis
ELGQAANSFSSATAALA

SEQ ID NO: 1443027 - protein, 20 aa, Mycobacterium tuberculosis
ELGSAAAAFGSVTSGLVGGI

SEQ ID NO: 1443028 - protein, 28 aa, Mycobacterium tuberculosis
ELGTAASSFSSVTTGLTGQAWQGPASAA

SEQ ID NO: 1443029 - protein, 9 aa, Mycobacterium tuberculosis
ELGTTTIKD

SEQ ID NO: 1443030 - protein, 6 aa, Mycobacterium tuberculosis
ELGVQD

SEQ ID NO: 1443031 - protein, 7 aa, Mycobacterium tuberculosis
ELKAADS

SEQ ID NO: 1443032 - protein, 7 aa, Mycobacterium tuberculosis
ELKSTGF

SEQ ID NO: 1443033 - protein, 8 aa, Mycobacterium tuberculosis
ELKSTGFA

SEQ ID NO: 1443034 - protein, 16 aa, Mycobacterium tuberculosis
ELNRPGMSGDSSSWKG

SEQ ID NO: 1443035 - protein, 9 aa, Mycobacterium tuberculosis
ELPAPQGQD

SEQ ID NO: 1443036 - protein, 7 aa, Mycobacterium tuberculosis
ELPDQLG

SEQ ID NO: 1443037 - protein, 15 aa, Mycobacterium tuberculosis
ELPEAPANRATVPQD

SEQ ID NO: 1443038 - protein, 9 aa, Mycobacterium tuberculosis
ELPEGVGDG

SEQ ID NO: 1443039 - protein, 14 aa, Mycobacterium tuberculosis
ELPGARDQLRGTRR

SEQ ID NO: 1443040 - protein, 4 aa, Mycobacterium tuberculosis
ELPR

SEQ ID NO: 1443041 - protein, 13 aa, Mycobacterium tuberculosis
ELPRRRSDRSRGV

SEQ ID NO: 1443042 - protein, 15 aa, Mycobacterium tuberculosis
ELPTAGGEQARSVRG

SEQ ID NO: 1443043 - protein, 6 aa, Mycobacterium tuberculosis
ELPTAP

SEQ ID NO: 1443044 - protein, 38 aa, Mycobacterium tuberculosis; identical to SEQ ID NO: 150802

SEQ ID NO: 1443045 - protein, 5 aa, Mycobacterium tuberculosis
ELQNG

SEQ ID NO: 1443046 - protein, 8 aa, Mycobacterium tuberculosis
ELRDAENN

SEQ ID NO: 1443047 - protein, 10 aa, Mycobacterium tuberculosis
ELSPSGQGPV

SEQ ID NO: 1443048 - protein, 8 aa, Mycobacterium tuberculosis
ELSQADEV

SEQ ID NO: 1443049 - protein, 10 aa, Mycobacterium tuberculosis
EMAGGGGAHL

SEQ ID NO: 1443050 - protein, 5 aa, Mycobacterium tuberculosis
EMDTP

SEQ ID NO: 1443051 - protein, 17 aa, Mycobacterium tuberculosis
EMSEESRVRQRYVDLIV

SEQ ID NO: 1443052 - protein, 7 aa, Mycobacterium tuberculosis
ENAGAAE

SEQ ID NO: 1443053 - protein, 10 aa, Mycobacterium tuberculosis
ENDSDESSLT

SEQ ID NO: 1443054 - protein, 12 aa, Mycobacterium tuberculosis
ENFDPTRRSSRV

SEQ ID NO: 1443055 - protein, 7 aa, Mycobacterium tuberculosis
ENGAEQF

SEQ ID NO: 1443056 - protein, 17 aa, Mycobacterium tuberculosis
ENGGAGGTGRVGGPVGG

SEQ ID NO: 1443057 - protein, 5 aa, Mycobacterium tuberculosis
ENGPD

SEQ ID NO: 1443058 - protein, 35 aa, Mycobacterium tuberculosis
ENHDDHHREEQQHHRDDAEFDDGSSDFHGLIVLSP

SEQ ID NO: 1443059 - protein, 16 aa, Mycobacterium tuberculosis
ENLPGRSALRARRFSR

SEQ ID NO: 1443060 - protein, 7 aa, Mycobacterium tuberculosis
ENPAEAD

SEQ ID NO: 1443061 - protein, 6 aa, Mycobacterium tuberculosis
ENPDKS

SEQ ID NO: 1443062 - protein, 6 aa, Mycobacterium tuberculosis
ENQHDE

SEQ ID NO: 1443063 - protein, 7 aa, Mycobacterium tuberculosis
ENQHDEP

SEQ ID NO: 1443064 - protein, 7 aa, Mycobacterium tuberculosis
ENRAAVE

SEQ ID NO: 1443065 - protein, 11 aa, Mycobacterium tuberculosis
ENRDDLPEQYR

SEQ ID NO: 1443066 - protein, 14 aa, Mycobacterium tuberculosis
ENRESAGAGFRGRT

SEQ ID NO: 1443067 - protein, 7 aa, Mycobacterium tuberculosis
ENRSQAA

SEQ ID NO: 1443068 - protein, 5 aa, Mycobacterium tuberculosis
ENSAG

SEQ ID NO: 1443069 - protein, 14 aa, Mycobacterium tuberculosis
ENSPAPARSTARKP

SEQ ID NO: 1443070 - protein, 4 aa, Mycobacterium tuberculosis
ENTR

SEQ ID NO: 1443071 - protein, 5 aa, Mycobacterium tuberculosis
ENVRP

SEQ ID NO: 1443072 - protein, 10 aa, Mycobacterium tuberculosis
EPAARAGPAV

SEQ ID NO: 1443073 - protein, 7 aa, Mycobacterium tuberculosis
EPAAREL

SEQ ID NO: 1443074 - protein, 24 aa, Mycobacterium tuberculosis
EPACSGDGGYRHPQRDRDNRRSHP

SEQ ID NO: 1443075 - protein, 15 aa, Mycobacterium tuberculosis
EPAGDRQDPRRGPCR

SEQ ID NO: 1443076 - protein, 9 aa, Mycobacterium tuberculosis
EPAGQPGRW

SEQ ID NO: 1443077 - protein, 5 aa, Mycobacterium tuberculosis
EPAHS

SEQ ID NO: 1443078 - protein, 23 aa, Mycobacterium tuberculosis
EPAKGDGQRGVHGGAGDRPGRHI

SEQ ID NO: 1443079 - protein, 13 aa, Mycobacterium tuberculosis
EPALETPESPVET

SEQ ID NO: 1443080 - protein, 22 aa, Mycobacterium tuberculosis
EPAPRRDTRQRGTRRDSGGPPR

SEQ ID NO: 1443081 - protein, 8 aa, Mycobacterium tuberculosis
EPAQGNLL

SEQ ID NO: 1443082 - protein, 22 aa, Mycobacterium tuberculosis
EPASVPLPSGPVVPSAPSVACV

SEQ ID NO: 1443083 - protein, 5 aa, Mycobacterium tuberculosis
EPCPT

SEQ ID NO: 1443084 - protein, 6 aa, Mycobacterium tuberculosis
EPDEIE

SEQ ID NO: 1443085 - protein, 8 aa, Mycobacterium tuberculosis
EPEEGDTI

SEQ ID NO: 1443086 - protein, 17 aa, Mycobacterium tuberculosis
EPEKRDSHHNSDRRRGA

SEQ ID NO: 1443087 - protein, 25 aa, Mycobacterium tuberculosis
EPEPPRCGPARPSNPAAPGSVGNSW

SEQ ID NO: 1443088 - protein, 6 aa, Mycobacterium tuberculosis
EPERDP

SEQ ID NO: 1443089 - protein, 7 aa, Mycobacterium tuberculosis
EPGERAY

SEQ ID NO: 1443090 - protein, 12 aa, Mycobacterium tuberculosis
EPGQARIGGRRR

SEQ ID NO: 1443091 - protein, 4 aa, Mycobacterium tuberculosis
EPGR

SEQ ID NO: 1443092 - protein, 19 aa, Mycobacterium tuberculosis
EPGTGSPQPTGTILAELPL

SEQ ID NO: 1443093 - protein, 22 aa, Mycobacterium tuberculosis
EPIPATSEATDISASGATITND

SEQ ID NO: 1443094 - protein, 13 aa, Mycobacterium tuberculosis
EPKAGVARSSVLV

SEQ ID NO: 1443095 - protein, 10 aa, Mycobacterium tuberculosis
EPKKVKPPRT

SEQ ID NO: 1443096 - protein, 9 aa, Mycobacterium tuberculosis
EPLPRAHGG

SEQ ID NO: 1443097 - protein, 18 aa, Mycobacterium tuberculosis
EPLPSRPGLGRSRPRPGL

SEQ ID NO: 1443098 - protein, 6 aa, Mycobacterium tuberculosis
EPLPVP

SEQ ID NO: 1443099 - protein, 7 aa, Mycobacterium tuberculosis
EPNLKPG

SEQ ID NO: 1443100 - protein, 18 aa, Mycobacterium tuberculosis
EPPLNEDKTIRGNVEEGM

SEQ ID NO: 1443101 - protein, 18 aa, Mycobacterium tuberculosis
EPPLNEDKTVRGNVEEGI

SEQ ID NO: 1443102 - protein, 5 aa, Mycobacterium tuberculosis
EPPPE

SEQ ID NO: 1443103 - protein, 20 aa, Mycobacterium tuberculosis
EPPQGVNRPGMSGDSSSWKG

SEQ ID NO: 1443104 - protein, 5 aa, Mycobacterium tuberculosis
EPPTH

SEQ ID NO: 1443105 - protein, 5 aa, Mycobacterium tuberculosis
EPPVA

SEQ ID NO: 1443106 - protein, 10 aa, Mycobacterium tuberculosis
EPPVNQSETE

SEQ ID NO: 1443107 - protein, 9 aa, Mycobacterium tuberculosis
EPPYRGGPV

SEQ ID NO: 1443108 - protein, 6 aa, Mycobacterium tuberculosis
EPQLPV

SEQ ID NO: 1443109 - protein, 6 aa, Mycobacterium tuberculosis
EPQPYP

SEQ ID NO: 1443110 - protein, 10 aa, Mycobacterium tuberculosis
EPQSAGACGS

SEQ ID NO: 1443111 - protein, 12 aa, Mycobacterium tuberculosis
EPRAPQKPSRIT

SEQ ID NO: 1443112 - protein, 8 aa, Mycobacterium tuberculosis
EPRAPYPH

SEQ ID NO: 1443113 - protein, 13 aa, Mycobacterium tuberculosis
EPRENPIDKACGE

SEQ ID NO: 1443114 - protein, 14 aa, Mycobacterium tuberculosis
EPRPGHSRAGAPSG

SEQ ID NO: 1443115 - protein, 6 aa, Mycobacterium tuberculosis
EPRPTQ

SEQ ID NO: 1443116 - protein, 8 aa, Mycobacterium tuberculosis
EPRQAGAR

SEQ ID NO: 1443117 - protein, 40 aa, Mycobacterium tuberculosis
EPRRTRAEQRPGRLTQRQRGGRPRHPSRRGELADSGPDAT

SEQ ID NO: 1443118 - protein, 11 aa, Mycobacterium tuberculosis
EPSAHAAAADV

SEQ ID NO: 1443119 - protein, 5 aa, Mycobacterium tuberculosis
EPSPG

SEQ ID NO: 1443120 - protein, 6 aa, Mycobacterium tuberculosis
EPSPGA

SEQ ID NO: 1443121 - protein, 5 aa, Mycobacterium tuberculosis
EPSTG

SEQ ID NO: 1443122 - protein, 4 aa, Mycobacterium tuberculosis
EPTE

SEQ ID NO: 1443123 - protein, 6 aa, Mycobacterium tuberculosis
EPTGPA

SEQ ID NO: 1443124 - protein, 8 aa, Mycobacterium tuberculosis
EPTGRNLN

SEQ ID NO: 1443125 - protein, 4 aa, Mycobacterium tuberculosis
EPTM

SEQ ID NO: 1443126 - protein, 15 aa, Mycobacterium tuberculosis
EPTNPDSAALGVPAP

SEQ ID NO: 1443127 - protein, 15 aa, Mycobacterium tuberculosis
EPTTGAVSDIEQATK

SEQ ID NO: 1443128 - protein, 21 aa, Mycobacterium tuberculosis
EPVDPGGDGSMSGEHRAGPHH

SEQ ID NO: 1443129 - protein, 12 aa, Mycobacterium tuberculosis
EPVNPPKPPPAI

SEQ ID NO: 1443130 - protein, 12 aa, Mycobacterium tuberculosis
EPVPERGDAARN

SEQ ID NO: 1443131 - protein, 23 aa, Mycobacterium tuberculosis
EPVPPGPPAPALPALPPSPPRPP

SEQ ID NO: 1443132 - protein, 5 aa, Mycobacterium tuberculosis
EPVRD

SEQ ID NO: 1443133 - protein, 17 aa, Mycobacterium tuberculosis
EPWEDPAGISASGDSEA

SEQ ID NO: 1443134 - protein, 12 aa, Mycobacterium tuberculosis
EPYAGSVTRAGE

SEQ ID NO: 1443135 - protein, 29 aa, Mycobacterium tuberculosis
EQADHPEHCDESPRAQCRTGGADAAQRDI

SEQ ID NO: 1443136 - protein, 7 aa, Mycobacterium tuberculosis
EQADRAA

SEQ ID NO: 1443137 - protein, 16 aa, Mycobacterium tuberculosis
EQAPEPDPDELPATGA

SEQ ID NO: 1443138 - protein, 10 aa, Mycobacterium tuberculosis
EQARIAEGAG

SEQ ID NO: 1443139 - protein, 10 aa, Mycobacterium tuberculosis
EQDKTTNPAS

SEQ ID NO: 1443140 - protein, 16 aa, Mycobacterium tuberculosis
EQDRPEGSRATVYTYV

SEQ ID NO: 1443141 - protein, 6 aa, Mycobacterium tuberculosis
EQDTAH

SEQ ID NO: 1443142 - protein, 10 aa, Mycobacterium tuberculosis
EQFGTDTPRR

SEQ ID NO: 1443143 - protein, 9 aa, Mycobacterium tuberculosis
EQGGTDPLT

SEQ ID NO: 1443144 - protein, 8 aa, Mycobacterium tuberculosis
EQLGPDYA

SEQ ID NO: 1443145 - protein, 27 aa, Mycobacterium tuberculosis
EQPALSSSKSNRFTSQRQTTGVGTTTV

SEQ ID NO: 1443146 - protein, 6 aa, Mycobacterium tuberculosis
EQPFGE

SEQ ID NO: 1443147 - protein, 21 aa, Mycobacterium tuberculosis
EQPHGCDRSPRSSARRVDWAA

SEQ ID NO: 1443148 - protein, 12 aa, Mycobacterium tuberculosis
EQPRAGRPRITD

SEQ ID NO: 1443149 - protein, 9 aa, Mycobacterium tuberculosis
EQPTTTTGE

SEQ ID NO: 1443150 - protein, 7 aa, Mycobacterium tuberculosis
EQQVGRR

SEQ ID NO: 1443151 - protein, 9 aa, Mycobacterium tuberculosis
EQSRHQSAH

SEQ ID NO: 1443152 - protein, 6 aa, Mycobacterium tuberculosis
EQTQAG

SEQ ID NO: 1443153 - protein, 5 aa, Mycobacterium tuberculosis
EQTRP

SEQ ID NO: 1443154 - protein, 4 aa, Mycobacterium tuberculosis
EQTV

SEQ ID NO: 1443155 - protein, 5 aa, Mycobacterium tuberculosis
EQTVG

SEQ ID NO: 1443156 - protein, 4 aa, Mycobacterium tuberculosis
EQVR

SEQ ID NO: 1443157 - protein, 19 aa, Mycobacterium tuberculosis
ERAASGHRRCPGRRNTRRH

SEQ ID NO: 1443158 - protein, 8 aa, Mycobacterium tuberculosis
ERAEQTAD

SEQ ID NO: 1443159 - protein, 11 aa, Mycobacterium tuberculosis
ERAGDHRGRGL

SEQ ID NO: 1443160 - protein, 16 aa, Mycobacterium tuberculosis
ERAGPGHGLGRRRRLP

SEQ ID NO: 1443161 - protein, 10 aa, Mycobacterium tuberculosis
ERAKATAAHN

SEQ ID NO: 1443162 - protein, 30 aa, Mycobacterium tuberculosis
ERAPSRQRAAARTCSPRPDSRPGRAARNAR

SEQ ID NO: 1443163 - protein, 10 aa, Mycobacterium tuberculosis
ERASSTAPAD

SEQ ID NO: 1443164 - protein, 6 aa, Mycobacterium tuberculosis
ERATDP

SEQ ID NO: 1443165 - protein, 24 aa, Mycobacterium tuberculosis
ERDCDERGNHRAGPVGRQLPRGGG

SEQ ID NO: 1443166 - protein, 5 aa, Mycobacterium tuberculosis
ERDDP

SEQ ID NO: 1443167 - protein, 7 aa, Mycobacterium tuberculosis
ERDEQGV

SEQ ID NO: 1443168 - protein, 17 aa, Mycobacterium tuberculosis
ERDRDEQRPVLSRRTDD

SEQ ID NO: 1443169 - protein, 4 aa, Mycobacterium tuberculosis
EREE

SEQ ID NO: 1443170 - protein, 11 aa, Mycobacterium tuberculosis
ERELPEPDDEF

SEQ ID NO: 1443171 - protein, 19 aa, Mycobacterium tuberculosis
ERGAPAGDPRGYPAPPGAP

SEQ ID NO: 1443172 - protein, 7 aa, Mycobacterium tuberculosis
ERGARDQ

SEQ ID NO: 1443173 - protein, 15 aa, Mycobacterium tuberculosis
ERGGGQRQSGGQAGV

SEQ ID NO: 1443174 - protein, 19 aa, Mycobacterium tuberculosis
ERGGYDAQGHGNSVPRSTS

SEQ ID NO: 1443175 - protein, 10 aa, Mycobacterium tuberculosis
ERGIDAPGPH

SEQ ID NO: 1443176 - protein, 15 aa, Mycobacterium tuberculosis
ERGLPTVSSSDAVQQ

SEQ ID NO: 1443177 - protein, 8 aa, Mycobacterium tuberculosis
ERGPSAGL

SEQ ID NO: 1443178 - protein, 5 aa, Mycobacterium tuberculosis
ERGRA

SEQ ID NO: 1443179 - protein, 4 aa, Mycobacterium tuberculosis
ERGY

SEQ ID NO: 1443180 - protein, 8 aa, Mycobacterium tuberculosis
ERHGRTPN

SEQ ID NO: 1443181 - protein, 11 aa, Mycobacterium tuberculosis
ERHHGNEADKH

SEQ ID NO: 1443182 - protein, 7 aa, Mycobacterium tuberculosis
ERKAFGR

SEQ ID NO: 1443183 - protein, 12 aa, Mycobacterium tuberculosis
ERLDGTNGLGGF

SEQ ID NO: 1443184 - protein, 13 aa, Mycobacterium tuberculosis
ERLEEGIERGRGK

SEQ ID NO: 1443185 - protein, 6 aa, Mycobacterium tuberculosis
ERLGGD

SEQ ID NO: 1443186 - protein, 4 aa, Mycobacterium tuberculosis
ERLT

SEQ ID NO: 1443187 - protein, 21 aa, Mycobacterium tuberculosis
ERPAPGSSMPAASAPASPTLV

SEQ ID NO: 1443188 - protein, 4 aa, Mycobacterium tuberculosis
ERPE

SEQ ID NO: 1443189 - protein, 17 aa, Mycobacterium tuberculosis
ERPGSHSEPRTTTSVPQ

SEQ ID NO: 1443190 - protein, 44 aa, Mycobacterium tuberculosis
ERPKAKQRQREGGDHGRQARYSGLGSMEPKPESERDAHKADTAI

SEQ ID NO: 1443191 - protein, 80 aa, Mycobacterium tuberculosis
ERPKAKQRQREGGDHGRQARYSGLGSMEPKPESERDAHKADTAITRKPSASPAATTSGSNESTDATRSEAGYRDGLNGWS

SEQ ID NO: 1443192 - protein, 20 aa, Mycobacterium tuberculosis
ERPPGLTQGEITDRDGVVTI

SEQ ID NO: 1443193 - protein, 6 aa, Mycobacterium tuberculosis
ERPPRP

SEQ ID NO: 1443194 - protein, 9 aa, Mycobacterium tuberculosis
ERQLGPKRP

SEQ ID NO: 1443195 - protein, 6 aa, Mycobacterium tuberculosis
ERQRWS

SEQ ID NO: 1443196 - protein, 10 aa, Mycobacterium tuberculosis
ERRDGGACSA

SEQ ID NO: 1443197 - protein, 4 aa, Mycobacterium tuberculosis
ERRE

SEQ ID NO: 1443198 - protein, 8 aa, Mycobacterium tuberculosis
ERRGHPDL

SEQ ID NO: 1443199 - protein, 6 aa, Mycobacterium tuberculosis
ERRGRC

SEQ ID NO: 1443200 - protein, 7 aa, Mycobacterium tuberculosis
ERRPAVG

SEQ ID NO: 1443201 - protein, 16 aa, Mycobacterium tuberculosis
ERRQKSRQTRASRDAL

SEQ ID NO: 1443202 - protein, 15 aa, Mycobacterium tuberculosis
ERSADFTARPAPDDV

SEQ ID NO: 1443203 - protein, 5 aa, Mycobacterium tuberculosis
ERSAV

SEQ ID NO: 1443204 - protein, 9 aa, Mycobacterium tuberculosis
ERSHARDDR

SEQ ID NO: 1443205 - protein, 4 aa, Mycobacterium tuberculosis
ERSK

SEQ ID NO: 1443206 - protein, 32 aa, Mycobacterium tuberculosis
ERSPDQADQGAGRIPPLSTSRVPTSRTTTATE

SEQ ID NO: 1443207 - protein, 9 aa, Mycobacterium tuberculosis
ERSPRPVGR

SEQ ID NO: 1443208 - protein, 12 aa, Mycobacterium tuberculosis
ERSTSSGRRAWN

SEQ ID NO: 1443209 - protein, 27 aa, Mycobacterium tuberculosis
ERTPPPAAPPAGSSASAARRGRRDRRC

SEQ ID NO: 1443210 - protein, 14 aa, Mycobacterium tuberculosis
ERVEPGRGRPGRPP

SEQ ID NO: 1443211 - protein, 4 aa, Mycobacterium tuberculosis
ESAA

SEQ ID NO: 1443212 - protein, 20 aa, Mycobacterium tuberculosis
ESAAENLAETASKVGGAPPW

SEQ ID NO: 1443213 - protein, 9 aa, Mycobacterium tuberculosis
ESALTGESL

SEQ ID NO: 1443214 - protein, 9 aa, Mycobacterium tuberculosis
ESARGPPIW

SEQ ID NO: 1443215 - protein, 5 aa, Mycobacterium tuberculosis
ESCGE

SEQ ID NO: 1443216 - protein, 29 aa, Mycobacterium tuberculosis
ESCGGSKPAPAKGTAKSPGKGPDKSLDKA

SEQ ID NO: 1443217 - protein, 4 aa, Mycobacterium tuberculosis
ESEA

SEQ ID NO: 1443218 - protein, 21 aa, Mycobacterium tuberculosis
ESEAAVERRSRRSSRCGDRRP

SEQ ID NO: 1443219 - protein, 6 aa, Mycobacterium tuberculosis
ESEASR

SEQ ID NO: 1443220 - protein, 14 aa, Mycobacterium tuberculosis
ESERLPRGADPNTH

SEQ ID NO: 1443221 - protein, 18 aa, Mycobacterium tuberculosis
ESFGSGAVGPITTGSAVP

SEQ ID NO: 1443222 - protein, 6 aa, Mycobacterium tuberculosis
ESGAAD

SEQ ID NO: 1443223 - protein, 8 aa, Mycobacterium tuberculosis
ESGAGNST

SEQ ID NO: 1443224 - protein, 9 aa, Mycobacterium tuberculosis
ESGDTPHVA

SEQ ID NO: 1443225 - protein, 11 aa, Mycobacterium tuberculosis
ESGEEVAGEET

SEQ ID NO: 1443226 - protein, 16 aa, Mycobacterium tuberculosis
ESGEHPDRAGGHRPVD

SEQ ID NO: 1443227 - protein, 30 aa, Mycobacterium tuberculosis
ESGGSPGTRTGNPEAGPDVRPANTLVSAAR

SEQ ID NO: 1443228 - protein, 7 aa, Mycobacterium tuberculosis
ESGGYAG

SEQ ID NO: 1443229 - protein, 6 aa, Mycobacterium tuberculosis
ESGSPT

SEQ ID NO: 1443230 - protein, 20 aa, Mycobacterium tuberculosis
ESHATTAEASPGELSAPYQR

SEQ ID NO: 1443231 - protein, 4 aa, Mycobacterium tuberculosis
ESHG

SEQ ID NO: 1443232 - protein, 22 aa, Mycobacterium tuberculosis
ESHGRLNTTPTPRTPPTPPDIS

SEQ ID NO: 1443233 - protein, 10 aa, Mycobacterium tuberculosis
ESIDDPAGVR

SEQ ID NO: 1443234 - protein, 25 aa, Mycobacterium tuberculosis
ESIGGSVSAALGKGSSAGSLPVPPD

SEQ ID NO: 1443235 - protein, 5 aa, Mycobacterium tuberculosis
ESIGN

SEQ ID NO: 1443236 - protein, 9 aa, Mycobacterium tuberculosis
ESIGRTEKI

SEQ ID NO: 1443237 - protein, 11 aa, Mycobacterium tuberculosis
ESISGTAPSRL

SEQ ID NO: 1443238 - protein, 51 aa, Mycobacterium tuberculosis
ESKVAAARSPIKADLTGGPGRGQPRHGRAGGQGARADVGSGGRRRGRRGPW

SEQ ID NO: 1443239 - protein, 12 aa, Mycobacterium tuberculosis
ESLAAEGDALTD

SEQ ID NO: 1443240 - protein, 14 aa, Mycobacterium tuberculosis
ESLAAEGEEHHGGA

SEQ ID NO: 1443241 - protein, 23 aa, Mycobacterium tuberculosis
ESLKGTDGEDGYVGRGGAGDRLG

SEQ ID NO: 1443242 - protein, 66 aa, Mycobacterium tuberculosis
ESLPRRRQPQRGRRATTGPGSGSVGSGRAAQPPSHAAHPDATARGSSQTAGHHRSPGGSPDRRLGR

SEQ ID NO: 1443243 - protein, 10 aa, Mycobacterium tuberculosis
ESLRSAGAAR

SEQ ID NO: 1443244 - protein, 7 aa, Mycobacterium tuberculosis
ESLSSGP

SEQ ID NO: 1443245 - protein, 9 aa, Mycobacterium tuberculosis
ESNNGTVVS

SEQ ID NO: 1443246 - protein, 9 aa, Mycobacterium tuberculosis
ESPRRSPRR

SEQ ID NO: 1443247 - protein, 20 aa, Mycobacterium tuberculosis
ESQARDQRVPAGGSEGGRPA

SEQ ID NO: 1443248 - protein, 4 aa, Mycobacterium tuberculosis
ESRD

SEQ ID NO: 1443249 - protein, 9 aa, Mycobacterium tuberculosis
ESRPGDEIS

SEQ ID NO: 1443250 - protein, 19 aa, Mycobacterium tuberculosis
ESRPPSPEDLADNAQQPCG

SEQ ID NO: 1443251 - protein, 13 aa, Mycobacterium tuberculosis
ESRSARWATVPRV

SEQ ID NO: 1443252 - protein, 8 aa, Mycobacterium tuberculosis
ESSRAPYG

SEQ ID NO: 1443253 - protein, 14 aa, Mycobacterium tuberculosis
ESSSSGRRRPPAMS

SEQ ID NO: 1443254 - protein, 10 aa, Mycobacterium tuberculosis
ESTAARVDYP

SEQ ID NO: 1443255 - protein, 7 aa, Mycobacterium tuberculosis
ESTGGTL

SEQ ID NO: 1443256 - protein, 10 aa, Mycobacterium tuberculosis
ETAAAGAPRL

SEQ ID NO: 1443257 - protein, 14 aa, Mycobacterium tuberculosis
ETAAGRRALRDRLA

SEQ ID NO: 1443258 - protein, 11 aa, Mycobacterium tuberculosis
ETAASVNQARY

SEQ ID NO: 1443259 - protein, 5 aa, Mycobacterium tuberculosis
ETAGM

SEQ ID NO: 1443260 - protein, 16 aa, Mycobacterium tuberculosis
ETARNPVRPGTPAPAV

SEQ ID NO: 1443261 - protein, 6 aa, Mycobacterium tuberculosis
ETDAET

SEQ ID NO: 1443262 - protein, 7 aa, Mycobacterium tuberculosis
ETDDPIV

SEQ ID NO: 1443263 - protein, 17 aa, Mycobacterium tuberculosis
ETDEAGNLISEWDDTPE

SEQ ID NO: 1443264 - protein, 6 aa, Mycobacterium tuberculosis
ETDGRW

SEQ ID NO: 1443265 - protein, 4 aa, Mycobacterium tuberculosis
ETDR

SEQ ID NO: 1443266 - protein, 10 aa, Mycobacterium tuberculosis
ETDTGTPEAQ

SEQ ID NO: 1443267 - protein, 15 aa, Mycobacterium tuberculosis
ETDVGSAGRGYDKRR

SEQ ID NO: 1443268 - protein, 6 aa, Mycobacterium tuberculosis
ETEKTI

SEQ ID NO: 1443269 - protein, 7 aa, Mycobacterium tuberculosis
ETGATVS

SEQ ID NO: 1443270 - protein, 20 aa, Mycobacterium tuberculosis
ETGPKHSDGGDSGKDPAHRY

SEQ ID NO: 1443271 - protein, 4 aa, Mycobacterium tuberculosis
ETGR

SEQ ID NO: 1443272 - protein, 5 aa, Mycobacterium tuberculosis
ETKGG

SEQ ID NO: 1443273 - protein, 6 aa, Mycobacterium tuberculosis
ETLPYT

SEQ ID NO: 1443274 - protein, 9 aa, Mycobacterium tuberculosis
ETLTGTHTT

SEQ ID NO: 1443275 - protein, 27 aa, Mycobacterium tuberculosis
ETMGTGGSGSGDSNCTSTSPSSCKRPC

SEQ ID NO: 1443276 - protein, 23 aa, Mycobacterium tuberculosis
ETMSGPDGARPDGRAGPRGRHRD

SEQ ID NO: 1443277 - protein, 12 aa, Mycobacterium tuberculosis
ETNRDGETTRHA

SEQ ID NO: 1443278 - protein, 5 aa, Mycobacterium tuberculosis
ETPKY

SEQ ID NO: 1443279 - protein, 16 aa, Mycobacterium tuberculosis
ETPSRPGTATLEPGHT

SEQ ID NO: 1443280 - protein, 8 aa, Mycobacterium tuberculosis
ETQAPSIA

SEQ ID NO: 1443281 - protein, 5 aa, Mycobacterium tuberculosis
ETQPQ

SEQ ID NO: 1443282 - protein, 8 aa, Mycobacterium tuberculosis
ETRDGPRF

SEQ ID NO: 1443283 - protein, 76 aa, Mycobacterium tuberculosis
ETRSPTVAGVEETRRRGGGRVAKARGRRDVDDRDLDGTEQDGAVPEHRDRGDLETVGQQGERVGAAGQVDHARGSL

SEQ ID NO: 1443284 - protein, 15 aa, Mycobacterium tuberculosis
ETSAPPTSSFGNNER

SEQ ID NO: 1443285 - protein, 20 aa, Mycobacterium tuberculosis
ETSAPRNRYSPDGSSSRLPT

SEQ ID NO: 1443286 - protein, 11 aa, Mycobacterium tuberculosis
ETSDTQRDTVK

SEQ ID NO: 1443287 - protein, 5 aa, Mycobacterium tuberculosis
ETTGF

SEQ ID NO: 1443288 - protein, 9 aa, Mycobacterium tuberculosis
ETYPSLDPQ

SEQ ID NO: 1443289 - protein, 4 aa, Mycobacterium tuberculosis
EVAA

SEQ ID NO: 1443290 - protein, 16 aa, Mycobacterium tuberculosis
EVAGGQQQRRVGRPNL

SEQ ID NO: 1443291 - protein, 24 aa, Mycobacterium tuberculosis
EVATQPALGTGEQAAQPLNGSTSR

SEQ ID NO: 1443292 - protein, 15 aa, Mycobacterium tuberculosis
EVATSDTDRAQRTPW

SEQ ID NO: 1443293 - protein, 6 aa, Mycobacterium tuberculosis
EVAVSP

SEQ ID NO: 1443294 - protein, 9 aa, Mycobacterium tuberculosis
EVEGDPECQ

SEQ ID NO: 1443295 - protein, 6 aa, Mycobacterium tuberculosis
EVERQH

SEQ ID NO: 1443296 - protein, 23 aa, Mycobacterium tuberculosis
EVGGAHQSQAQKPYHDATEPLGE

SEQ ID NO: 1443297 - protein, 10 aa, Mycobacterium tuberculosis
EVGGGDTRCD

SEQ ID NO: 1443298 - protein, 18 aa, Mycobacterium tuberculosis
EVGRQLGEKTVEATTAGH

SEQ ID NO: 1443299 - protein, 5 aa, Mycobacterium tuberculosis
EVNSS

SEQ ID NO: 1443300 - protein, 4 aa, Mycobacterium tuberculosis
EVPG

SEQ ID NO: 1443301 - protein, 11 aa, Mycobacterium tuberculosis
EVPRQTAGPAF

SEQ ID NO: 1443302 - protein, 9 aa, Mycobacterium tuberculosis
EVRDPGRQG

SEQ ID NO: 1443303 - protein, 15 aa, Mycobacterium tuberculosis
EVRPSKGLQVFSFTY

SEQ ID NO: 1443304 - protein, 21 aa, Mycobacterium tuberculosis
EVRSGASSASPRLMLARTWVP

SEQ ID NO: 1443305 - protein, 7 aa, Mycobacterium tuberculosis
EVSADGL

SEQ ID NO: 1443306 - protein, 7 aa, Mycobacterium tuberculosis
EVSDREG

SEQ ID NO: 1443307 - protein, 6 aa, Mycobacterium tuberculosis
EVSPPS

SEQ ID NO: 1443308 - protein, 12 aa, Mycobacterium tuberculosis
EVSSPDEGNCVG

SEQ ID NO: 1443309 - protein, 11 aa, Mycobacterium tuberculosis
EVSTDHAERER

SEQ ID NO: 1443310 - protein, 24 aa, Mycobacterium tuberculosis
EVTSERQGDATADGWSLHDGHDRL

SEQ ID NO: 1443311 - protein, 16 aa, Mycobacterium tuberculosis
EWRSPADTSPRPLPSG

SEQ ID NO: 1443312 - protein, 13 aa, Mycobacterium tuberculosis
EWSGRGLWANLGL

SEQ ID NO: 1443313 - protein, 8 aa, Mycobacterium tuberculosis
EWTPEGRL

SEQ ID NO: 1443314 - protein, 17 aa, Mycobacterium tuberculosis
EYAGAAQGKWGPGKPVD

SEQ ID NO: 1443315 - protein, 16 aa, Mycobacterium tuberculosis
EYDAHRDDDTLSQCPT

SEQ ID NO: 1443316 - protein, 13 aa, Mycobacterium tuberculosis
EYDPPAKGDPAAE

SEQ ID NO: 1443317 - protein, 14 aa, Mycobacterium tuberculosis
EYDRRGWGSGGADP

SEQ ID NO: 1443318 - protein, 15 aa, Mycobacterium tuberculosis
EYPTDQYSANDPKLN

SEQ ID NO: 1443319 - protein, 10 aa, Mycobacterium tuberculosis
EYQAAAQAAA

SEQ ID NO: 1443320 - protein, 14 aa, Mycobacterium tuberculosis
EYQARNSVTRSVSP

SEQ ID NO: 1443321 - protein, 16 aa, Mycobacterium tuberculosis
FADEDRRTLAAAPAPG

SEQ ID NO: 1443322 - protein, 6 aa, Mycobacterium tuberculosis
FADQPN

SEQ ID NO: 1443323 - protein, 46 aa, Mycobacterium tuberculosis
FAEDAADNADDGDDAHPEEAERGSGAEGSNRARRSRRGRRRRRIGA

SEQ ID NO: 1443324 - protein, 6 aa, Mycobacterium tuberculosis
FAEGAT

SEQ ID NO: 1443325 - protein, 7 aa, Mycobacterium tuberculosis
FAEPDGR

SEQ ID NO: 1443326 - protein, 4 aa, Mycobacterium tuberculosis
FAER

SEQ ID NO: 1443327 - protein, 13 aa, Mycobacterium tuberculosis
FAERGEQELKGVP

SEQ ID NO: 1443328 - protein, 4 aa, Mycobacterium tuberculosis
FAES

SEQ ID NO: 1443329 - protein, 20 aa, Mycobacterium tuberculosis
FAGDAEKTTASWGRSPEAIT

SEQ ID NO: 1443330 - protein, 7 aa, Mycobacterium tuberculosis
FAGGRSR

SEQ ID NO: 1443331 - protein, 5 aa, Mycobacterium tuberculosis
FAGQG

SEQ ID NO: 1443332 - protein, 13 aa, Mycobacterium tuberculosis
FANPTVRADHSDP

SEQ ID NO: 1443333 - protein, 7 aa, Mycobacterium tuberculosis
FANTGDT

SEQ ID NO: 1443334 - protein, 18 aa, Mycobacterium tuberculosis
FANTGTTTSDLPTPAQQH

SEQ ID NO: 1443335 - protein, 12 aa, Mycobacterium tuberculosis
FAPKNTPAKPMS

SEQ ID NO: 1443336 - protein, 15 aa, Mycobacterium tuberculosis
FARGGGRGTGDTGHA

SEQ ID NO: 1443337 - protein, 23 aa, Mycobacterium tuberculosis
FARPSPAPWPTRPAPSASRCTWS

SEQ ID NO: 1443338 - protein, 21 aa, Mycobacterium tuberculosis
FARSGPSATHRSLRRSDGHHL

SEQ ID NO: 1443339 - protein, 20 aa, Mycobacterium tuberculosis
FASGGTGGAAEPGGAGGRGG

SEQ ID NO: 1443340 - protein, 20 aa, Mycobacterium tuberculosis
FASGGTGGAGGTGGAGGPGR

SEQ ID NO: 1443341 - protein, 27 aa, Mycobacterium tuberculosis
FASGGTGGAGGTGGAGGRGGLLIGDGG

SEQ ID NO: 1443342 - protein, 38 aa, Mycobacterium tuberculosis
FASGGTGRSGRNRGRRWPRRAADRRRRRRRRGRSRWYR

SEQ ID NO: 1443343 - protein, 11 aa, Mycobacterium tuberculosis
FASTGLGCPGR

SEQ ID NO: 1443344 - protein, 21 aa, Mycobacterium tuberculosis
FDANRPSAWDRRGPAGLSLGR

SEQ ID NO: 1443345 - protein, 66 aa, Mycobacterium tuberculosis
FDERGQEVRDPADYEHANEPDERRADDREGADEDAGLGKSESPPQAPTTVTLPNGETVTAASPQLA

SEQ ID NO: 1443346 - protein, 11 aa, Mycobacterium tuberculosis
FDGGTGPRRGI

SEQ ID NO: 1443347 - protein, 4 aa, Mycobacterium tuberculosis
FDPD

SEQ ID NO: 1443348 - protein, 8 aa, Mycobacterium tuberculosis
FDPEDTSE

SEQ ID NO: 1443349 - protein, 4 aa, Mycobacterium tuberculosis
FDPL

SEQ ID NO: 1443350 - protein, 11 aa, Mycobacterium tuberculosis
FDRDPSGDWRR

SEQ ID NO: 1443351 - protein, 20 aa, Mycobacterium tuberculosis
FDSPDPEAEPDVVGGKAGDG

SEQ ID NO: 1443352 - protein, 13 aa, Mycobacterium tuberculosis
FDTRRGELAPQPV

SEQ ID NO: 1443353 - protein, 4 aa, Mycobacterium tuberculosis
FEAP

SEQ ID NO: 1443354 - protein, 9 aa, Mycobacterium tuberculosis
FEARTPDAL

SEQ ID NO: 1443355 - protein, 19 aa, Mycobacterium tuberculosis
FEGVDENGTPLLNWLRTRR

SEQ ID NO: 1443356 - protein, 26 aa, Mycobacterium tuberculosis
FEHQAEKAAAAGRTKEADEAKGERRT

SEQ ID NO: 1443357 - protein, 12 aa, Mycobacterium tuberculosis
FEPPPTGSRCGH

SEQ ID NO: 1443358 - protein, 4 aa, Mycobacterium tuberculosis
FERA

SEQ ID NO: 1443359 - protein, 24 aa, Mycobacterium tuberculosis
FESPGSRRRADRADRSATARTTGA

SEQ ID NO: 1443360 - protein, 29 aa, Mycobacterium tuberculosis
FGAEPGVAPMSDNSSYRGGQGQGRPDEYY

SEQ ID NO: 1443361 - protein, 13 aa, Mycobacterium tuberculosis
FGAGGAGGAGGFG

SEQ ID NO: 1443362 - protein, 5 aa, Mycobacterium tuberculosis
FGAGP

SEQ ID NO: 1443363 - protein, 13 aa, Mycobacterium tuberculosis
FGANTGGNGGDTT

SEQ ID NO: 1443364 - protein, 52 aa, Mycobacterium tuberculosis
FGAPGGDGGDGGNGGHGGDGNGSFADAGDGGPGGNGGTAAWVGPGETVAPPV

SEQ ID NO: 1443365 - protein, 5 aa, Mycobacterium tuberculosis
FGDDR

SEQ ID NO: 1443366 - protein, 35 aa, Mycobacterium tuberculosis
FGDGETGGTGGAGGAGSGTKAGGTGSDGGHGGNAT

SEQ ID NO: 1443367 - protein, 35 aa, Mycobacterium tuberculosis
FGDGGTGGTGGAGGAGSGTKAGGTGSDGGHGGNAT

SEQ ID NO: 1443368 - protein, 11 aa, Mycobacterium tuberculosis
FGEDPDADAVD

SEQ ID NO: 1443369 - protein, 10 aa, Mycobacterium tuberculosis
FGESGTDPDF

SEQ ID NO: 1443370 - protein, 20 aa, Mycobacterium tuberculosis
FGGLGGGSNGTGGAGGTGAT

SEQ ID NO: 1443371 - protein, 14 aa, Mycobacterium tuberculosis
FGGPTVTNDGVTAA

SEQ ID NO: 1443372 - protein, 11 aa, Mycobacterium tuberculosis
FGGTNARCRGS

SEQ ID NO: 1443373 - protein, 25 aa, Mycobacterium tuberculosis
FGNGGDGGAGGFGADTGGNSSSVPN

SEQ ID NO: 1443374 - protein, 52 aa, Mycobacterium tuberculosis
FGNGGTGGVGGKGGTSSDLASATSGAAGPAGPAASAGCSTATAGTGGPVASA

SEQ ID NO: 1443375 - protein, 53 aa, Mycobacterium tuberculosis
FGNGGTGGVGGKGGTSSDLASATSGAGGAGGAGASAAASTATAGTGGAGWHRR

SEQ ID NO: 1443376 - protein, 51 aa, Mycobacterium tuberculosis
FGNGGTGGVGGKGGTSSDLASATSGAGGAGGAGASAGCSTATAGTGGPVAS

SEQ ID NO: 1443377 - protein, 9 aa, Mycobacterium tuberculosis
FGNTGSGNI

SEQ ID NO: 1443378 - protein, 14 aa, Mycobacterium tuberculosis
FGNTGTNNLGIGLT

SEQ ID NO: 1443379 - protein, 16 aa, Mycobacterium tuberculosis
FGNTGTNNVGVGLTGT

SEQ ID NO: 1443380 - protein, 6 aa, Mycobacterium tuberculosis
FGPEDY

SEQ ID NO: 1443381 - protein, 36 aa, Mycobacterium tuberculosis
FGPGGAGGTGGFGASSADQMAGGIGGTDRGSRCLPP

SEQ ID NO: 1443382 - protein, 8 aa, Mycobacterium tuberculosis
FGPSARTR

SEQ ID NO: 1443383 - protein, 8 aa, Mycobacterium tuberculosis
FGQSAGRF

SEQ ID NO: 1443384 - protein, 55 aa, Mycobacterium tuberculosis
FGQSGSPGSGAAGGLGGAGGNGGAGGGGGTGFNPGAPGDPGTQGATGANGQHCLN

SEQ ID NO: 1443385 - protein, 7 aa, Mycobacterium tuberculosis
FGRRGRP

SEQ ID NO: 1443386 - protein, 13 aa, Mycobacterium tuberculosis
FGRSTPRCASGGV

SEQ ID NO: 1443387 - protein, 12 aa, Mycobacterium tuberculosis
FGSADYRGGDHG

SEQ ID NO: 1443388 - protein, 26 aa, Mycobacterium tuberculosis
FGSPELQQGLGGVGGLRRSDPHRRPR

SEQ ID NO: 1443389 - protein, 14 aa, Mycobacterium tuberculosis
FGTAGGVGGAGGNA

SEQ ID NO: 1443390 - protein, 4 aa, Mycobacterium tuberculosis
FGTP

SEQ ID NO: 1443391 - protein, 8 aa, Mycobacterium tuberculosis
FGTTTSRT

SEQ ID NO: 1443392 - protein, 8 aa, Mycobacterium tuberculosis
FHPPHTPD

SEQ ID NO: 1443393 - protein, 8 aa, Mycobacterium tuberculosis
FKAKPGQR

SEQ ID NO: 1443394 - protein, 12 aa, Mycobacterium tuberculosis
FKDGDGGDRRRW

SEQ ID NO: 1443395 - protein, 21 aa, Mycobacterium tuberculosis
FKPPKAALSSSELHRNDSRIL

SEQ ID NO: 1443396 - protein, 10 aa, Mycobacterium tuberculosis
FNAPASASPL

SEQ ID NO: 1443397 - protein, 24 aa, Mycobacterium tuberculosis
FNDGPKVVRPTSTADEAVPSGAGR

SEQ ID NO: 1443398 - protein, 197 aa, Mycobacterium tuberculosis
FNGVNGAAGTNASDSGAVGGKGNSGGNGGQGGAGGDGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGNGGAGGKGGAGT

SEQ ID NO: 1443399 - protein, 15 aa, Mycobacterium tuberculosis
FNKGQLDGPGPSAGP

SEQ ID NO: 1443400 - protein, 8 aa, Mycobacterium tuberculosis
FNPECASA

SEQ ID NO: 1443401 - protein, 9 aa, Mycobacterium tuberculosis
FNPPPNHHP

SEQ ID NO: 1443402 - protein, 17 aa, Mycobacterium tuberculosis
FNSGSGNIGFGNSAPAR

SEQ ID NO: 1443403 - protein, 15 aa, Mycobacterium tuberculosis
FNTGSGNVALFNSGT

SEQ ID NO: 1443404 - protein, 30 aa, Mycobacterium tuberculosis
FNTGVANAGSYNTGSFNAGDTNTGGVQPGH

SEQ ID NO: 1443405 - protein, 9 aa, Mycobacterium tuberculosis
FPDRGGDRA

SEQ ID NO: 1443406 - protein, 19 aa, Mycobacterium tuberculosis
FPEPVKPPSPGGADRRSSD

SEQ ID NO: 1443407 - protein, 5 aa, Mycobacterium tuberculosis
FPGET

SEQ ID NO: 1443408 - protein, 7 aa, Mycobacterium tuberculosis
FPGQQGD

SEQ ID NO: 1443409 - protein, 10 aa, Mycobacterium tuberculosis
FPGQRGITRT

SEQ ID NO: 1443410 - protein, 9 aa, Mycobacterium tuberculosis
FPGRGGHQV

SEQ ID NO: 1443411 - protein, 25 aa, Mycobacterium tuberculosis
FPHPTLGPDTEPQDRMATTSRVRPP

SEQ ID NO: 1443412 - protein, 20 aa, Mycobacterium tuberculosis
FPPAPPTPPVPPLSPPLPPL

SEQ ID NO: 1443413 - protein, 9 aa, Mycobacterium tuberculosis
FPPEPVAPD

SEQ ID NO: 1443414 - protein, 5 aa, Mycobacterium tuberculosis
FPPGS

SEQ ID NO: 1443415 - protein, 17 aa, Mycobacterium tuberculosis
FPPRPGQQIGGAQEHRG

SEQ ID NO: 1443416 - protein, 9 aa, Mycobacterium tuberculosis
FPPTGNGRA

SEQ ID NO: 1443417 - protein, 22 aa, Mycobacterium tuberculosis
FPPTPPVPGDTTAGDPASAAGA

SEQ ID NO: 1443418 - protein, 8 aa, Mycobacterium tuberculosis
FPQPDRFD

SEQ ID NO: 1443419 - protein, 4 aa, Mycobacterium tuberculosis
FPRA

SEQ ID NO: 1443420 - protein, 15 aa, Mycobacterium tuberculosis
FPRARPGAAHRVPVR

SEQ ID NO: 1443421 - protein, 6 aa, Mycobacterium tuberculosis
FPRDGY

SEQ ID NO: 1443422 - protein, 11 aa, Mycobacterium tuberculosis
FPRKAGARTRF

SEQ ID NO: 1443423 - protein, 8 aa, Mycobacterium tuberculosis
FPRPDDPL

SEQ ID NO: 1443424 - protein, 61 aa, Mycobacterium tuberculosis
FPRPRTYYTPTATPCYADSKPPNDSYPDPSTTRSSRSPWPSAPSNGAAVRPATPWKPPSKG

SEQ ID NO: 1443425 - protein, 6 aa, Mycobacterium tuberculosis
FPRPST

SEQ ID NO: 1443426 - protein, 10 aa, Mycobacterium tuberculosis
FPSAGGQPLG

SEQ ID NO: 1443427 - protein, 4 aa, Mycobacterium tuberculosis
FPSQ

SEQ ID NO: 1443428 - protein, 33 aa, Mycobacterium tuberculosis
FPTEPGAAGLDGEPGRSVRSGRASPPWYSAGSP

SEQ ID NO: 1443429 - protein, 28 aa, Mycobacterium tuberculosis
FPYSGPRRGAGRTALARGSSAGAPTLRP

SEQ ID NO: 1443430 - protein, 17 aa, Mycobacterium tuberculosis
FQENHSRADRCGDQLPQ

SEQ ID NO: 1443431 - protein, 10 aa, Mycobacterium tuberculosis
FQSEQGGGVR

SEQ ID NO: 1443432 - protein, 17 aa, Mycobacterium tuberculosis
FRERSSTCRTDRRAGRG

SEQ ID NO: 1443433 - protein, 26 aa, Mycobacterium tuberculosis
FRPNNSVPGDPPQPLGAPNYSQIRDD

SEQ ID NO: 1443434 - protein, 21 aa, Mycobacterium tuberculosis
FRPPSRRRMGSARAEMTKDAG

SEQ ID NO: 1443435 - protein, 9 aa, Mycobacterium tuberculosis
FRPTEKDEQ

SEQ ID NO: 1443436 - protein, 13 aa, Mycobacterium tuberculosis
FRRDRPTMVRWRR

SEQ ID NO: 1443437 - protein, 14 aa, Mycobacterium tuberculosis
FSADADGYTRSEGA

SEQ ID NO: 1443438 - protein, 8 aa, Mycobacterium tuberculosis
FSGDGSLD

SEQ ID NO: 1443439 - protein, 8 aa, Mycobacterium tuberculosis
FSGGARSL

SEQ ID NO: 1443440 - protein, 23 aa, Mycobacterium tuberculosis
FSGPPGSGGPEAIAGGGRYCFRF

SEQ ID NO: 1443441 - protein, 6 aa, Mycobacterium tuberculosis
FSGPQI

SEQ ID NO: 1443442 - protein, 14 aa, Mycobacterium tuberculosis
FSPDGGADNPGEAD

SEQ ID NO: 1443443 - protein, 6 aa, Mycobacterium tuberculosis
FSPGDT

SEQ ID NO: 1443444 - protein, 8 aa, Mycobacterium tuberculosis
FSPTGSAS

SEQ ID NO: 1443445 - protein, 10 aa, Mycobacterium tuberculosis
FSRSGRAMEA

SEQ ID NO: 1443446 - protein, 11 aa, Mycobacterium tuberculosis
FSSRPSSTAST

SEQ ID NO: 1443447 - protein, 19 aa, Mycobacterium tuberculosis
FSSYTPAPATGGRSGLVIG

SEQ ID NO: 1443448 - protein, 20 aa, Mycobacterium tuberculosis
FSTDRDGPRWTSEAGRPDTG

SEQ ID NO: 1443449 - protein, 30 aa, Mycobacterium tuberculosis
FSTGIANTGDYNTGSFNAGDTNTGGFNPGG

SEQ ID NO: 1443450 - protein, 12 aa, Mycobacterium tuberculosis
FSTSNDDAAKFD

SEQ ID NO: 1443451 - protein, 8 aa, Mycobacterium tuberculosis
FTAGEGNQ

SEQ ID NO: 1443452 - protein, 8 aa, Mycobacterium tuberculosis
FTGEGARL

SEQ ID NO: 1443453 - protein, 10 aa, Mycobacterium tuberculosis
FTNPGAQPRC

SEQ ID NO: 1443454 - protein, 12 aa, Mycobacterium tuberculosis
FTNSPLRDGEHA

SEQ ID NO: 1443455 - protein, 15 aa, Mycobacterium tuberculosis
FTNTGFGNAGSGNFG

SEQ ID NO: 1443456 - protein, 17 aa, Mycobacterium tuberculosis
FTPGADPGLPWIQAICT

SEQ ID NO: 1443457 - protein, 5 aa, Mycobacterium tuberculosis
FTREP

SEQ ID NO: 1443458 - protein, 6 aa, Mycobacterium tuberculosis
FTRGEP

SEQ ID NO: 1443459 - protein, 21 aa, Mycobacterium tuberculosis
FTSTHPGKRCANPDFTSPNFA

SEQ ID NO: 1443460 - protein, 7 aa, Mycobacterium tuberculosis
GAAAAEP

SEQ ID NO: 1443461 - protein, 40 aa, Mycobacterium tuberculosis
GAAAASAPRSPLPPAVGPAGHRRGGPAGAAPSASADGVNT

SEQ ID NO: 1443462 - protein, 53 aa, Mycobacterium tuberculosis
GAAADRATQIRTGGRGVDRPAGAGTCGGAGGSGDRPGPRRQPGGHAVAGARRR

SEQ ID NO: 1443463 - protein, 41 aa, Mycobacterium tuberculosis
GAAAGNGLAAGNGVSSSGGGGAGGTGGAGGDGGAGGAGGNA

SEQ ID NO: 1443464 - protein, 16 aa, Mycobacterium tuberculosis
GAAAGRRHRAPGPAHR

SEQ ID NO: 1443465 - protein, 21 aa, Mycobacterium tuberculosis
GAAALGNAQGYKYSHDDPDGV

SEQ ID NO: 1443466 - protein, 15 aa, Mycobacterium tuberculosis
GAAAPWTRRSPTHNA

SEQ ID NO: 1443467 - protein, 24 aa, Mycobacterium tuberculosis
GAAARRVGGTDRGSSDVAAGGRRP

SEQ ID NO: 1443468 - protein, 8 aa, Mycobacterium tuberculosis
GAAARSAF

SEQ ID NO: 1443469 - protein, 27 aa, Mycobacterium tuberculosis
GAAARSSAYGDPTVGNPTHRDRADRSC

SEQ ID NO: 1443470 - protein, 14 aa, Mycobacterium tuberculosis
GAAASGDAVTAPMQ

SEQ ID NO: 1443471 - protein, 27 aa, Mycobacterium tuberculosis
GAAATTRAARRPRGGAGADAGCAAQVR

SEQ ID NO: 1443472 - protein, 5 aa, Mycobacterium tuberculosis
GAAGA

SEQ ID NO: 1443473 - protein, 10 aa, Mycobacterium tuberculosis
GAAGAASRRR

SEQ ID NO: 1443474 - protein, 30 aa, Mycobacterium tuberculosis; identical to SEQ ID NO: 192504

SEQ ID NO: 1443475 - protein, 15 aa, Mycobacterium tuberculosis
GAAGGAGGIGGNGGL

SEQ ID NO: 1443476 - protein, 11 aa, Mycobacterium tuberculosis
GAAGGHGGDAQ

SEQ ID NO: 1443477 - protein, 7 aa, Mycobacterium tuberculosis
GAAGRQA

SEQ ID NO: 1443478 - protein, 9 aa, Mycobacterium tuberculosis
GAAGTGDPV

SEQ ID NO: 1443479 - protein, 15 aa, Mycobacterium tuberculosis
GAAGVAGGNGGPTPL

SEQ ID NO: 1443480 - protein, 7 aa, Mycobacterium tuberculosis
GAAKALA

SEQ ID NO: 1443481 - protein, 18 aa, Mycobacterium tuberculosis
GAAKGYAAAELAQRFAVA

SEQ ID NO: 1443482 - protein, 40 aa, Mycobacterium tuberculosis
GAALGSGATVDGGGGGVGARELGTTDPGGIGARPGTIGVG

SEQ ID NO: 1443483 - protein, 12 aa, Mycobacterium tuberculosis
GAANAAAGRAPR

SEQ ID NO: 1443484 - protein, 15 aa, Mycobacterium tuberculosis
GAANEAAGPGPGSIR

SEQ ID NO: 1443485 - protein, 32 aa, Mycobacterium tuberculosis
GAANEGGRTPGPGIPSAWSSAQRRPQAPRSQR

SEQ ID NO: 1443486 - protein, 10 aa, Mycobacterium tuberculosis
GAAPEDGGPE

SEQ ID NO: 1443487 - protein, 27 aa, Mycobacterium tuberculosis
GAAPRRGRRSGRRRGERVDHTDGHPGF

SEQ ID NO: 1443488 - protein, 8 aa, Mycobacterium tuberculosis
GAAQAVAA

SEQ ID NO: 1443489 - protein, 15 aa, Mycobacterium tuberculosis
GAAQLGRPQTTGPGR

SEQ ID NO: 1443490 - protein, 10 aa, Mycobacterium tuberculosis
GAAQPTQDRH

SEQ ID NO: 1443491 - protein, 13 aa, Mycobacterium tuberculosis
GAARDGALQHVEG

SEQ ID NO: 1443492 - protein, 12 aa, Mycobacterium tuberculosis
GAARGGNRRGCS

SEQ ID NO: 1443493 - protein, 10 aa, Mycobacterium tuberculosis
GAASADGPVQ

SEQ ID NO: 1443494 - protein, 17 aa, Mycobacterium tuberculosis
GAASAVAAAASGAAGAA

SEQ ID NO: 1443495 - protein, 17 aa, Mycobacterium tuberculosis
GAASRGAGHTSGFPGRR

SEQ ID NO: 1443496 - protein, 12 aa, Mycobacterium tuberculosis
GAAVSAGPAGTH

SEQ ID NO: 1443497 - protein, 13 aa, Mycobacterium tuberculosis
GACANGGAGGNGG

SEQ ID NO: 1443498 - protein, 14 aa, Mycobacterium tuberculosis
GACAPGPGGNPLTR

SEQ ID NO: 1443499 - protein, 29 aa, Mycobacterium tuberculosis
GACSRSVSTPMNRSSRTSPATRCRSARWG

SEQ ID NO: 1443500 - protein, 4 aa, Mycobacterium tuberculosis
GADA

SEQ ID NO: 1443501 - protein, 17 aa, Mycobacterium tuberculosis
GADAPRGAAGHRTVSHW

SEQ ID NO: 1443502 - protein, 9 aa, Mycobacterium tuberculosis
GADASSSEI

SEQ ID NO: 1443503 - protein, 9 aa, Mycobacterium tuberculosis
GADDGRSAA

SEQ ID NO: 1443504 - protein, 7 aa, Mycobacterium tuberculosis
GADDRHR

SEQ ID NO: 1443505 - protein, 7 aa, Mycobacterium tuberculosis
GADELST

SEQ ID NO: 1443506 - protein, 22 aa, Mycobacterium tuberculosis
GADEVSCRDRDADWQHGREYQI

SEQ ID NO: 1443507 - protein, 7 aa, Mycobacterium tuberculosis
GADEVSS

SEQ ID NO: 1443508 - protein, 4 aa, Mycobacterium tuberculosis
GADG

SEQ ID NO: 1443509 - protein, 21 aa, Mycobacterium tuberculosis
GADGAPGTGQAGGAGGILYGN

SEQ ID NO: 1443510 - protein, 43 aa, Mycobacterium tuberculosis
GADGAPGTGQAGRGREGSCTANGGNGGVPAPPARPGGEEGDAS

SEQ ID NO: 1443511 - protein, 17 aa, Mycobacterium tuberculosis
GADGAPGTGRPAGRRYP

SEQ ID NO: 1443512 - protein, 5 aa, Mycobacterium tuberculosis
GADGL

SEQ ID NO: 1443513 - protein, 17 aa, Mycobacterium tuberculosis
GADGRIGGEWRRSSART

SEQ ID NO: 1443514 - protein, 7 aa, Mycobacterium tuberculosis
GADKSSI

SEQ ID NO: 1443515 - protein, 29 aa, Mycobacterium tuberculosis
GADLDQQPRDRGGRQASPGQSAAENDGNL

SEQ ID NO: 1443516 - protein, 7 aa, Mycobacterium tuberculosis
GADPAHV

SEQ ID NO: 1443517 - protein, 11 aa, Mycobacterium tuberculosis
GADRGEGRRLN

SEQ ID NO: 1443518 - protein, 10 aa, Mycobacterium tuberculosis
GADRGGPHGR

SEQ ID NO: 1443519 - protein, 15 aa, Mycobacterium tuberculosis
GADRIRRQKVSDGKD

SEQ ID NO: 1443520 - protein, 10 aa, Mycobacterium tuberculosis
GADTRRGRAA

SEQ ID NO: 1443521 - protein, 5 aa, Mycobacterium tuberculosis
GADTY

SEQ ID NO: 1443522 - protein, 13 aa, Mycobacterium tuberculosis
GAEAANVAAAATC

SEQ ID NO: 1443523 - protein, 4 aa, Mycobacterium tuberculosis
GAEL

SEQ ID NO: 1443524 - protein, 6 aa, Mycobacterium tuberculosis
GAEPAT

SEQ ID NO: 1443525 - protein, 8 aa, Mycobacterium tuberculosis
GAERGRAE

SEQ ID NO: 1443526 - protein, 7 aa, Mycobacterium tuberculosis
GAERLPN

SEQ ID NO: 1443527 - protein, 7 aa, Mycobacterium tuberculosis
GAEVSDT

SEQ ID NO: 1443528 - protein, 40 aa, Mycobacterium tuberculosis
GAFAGGGGGRGGDGGNAGNAGAGGPGGTGSTAGKAGPAGS

SEQ ID NO: 1443529 - protein, 17 aa, Mycobacterium tuberculosis
GAFGGGAGGHGGSGGGG

SEQ ID NO: 1443530 - protein, 8 aa, Mycobacterium tuberculosis
GAGAAGDV

SEQ ID NO: 1443531 - protein, 13 aa, Mycobacterium tuberculosis
GAGAAGGHGGDAQ

SEQ ID NO: 1443532 - protein, 13 aa, Mycobacterium tuberculosis
GAGAAGGNGGAGG

SEQ ID NO: 1443533 - protein, 11 aa, Mycobacterium tuberculosis
GAGAASVGCDQ

SEQ ID NO: 1443534 - protein, 10 aa, Mycobacterium tuberculosis
GAGAETDAQN

SEQ ID NO: 1443535 - protein, 11 aa, Mycobacterium tuberculosis
GAGAGADVAAG

SEQ ID NO: 1443536 - protein, 9 aa, Mycobacterium tuberculosis
GAGAGEVDR

SEQ ID NO: 1443537 - protein, 24 aa, Mycobacterium tuberculosis
GAGAGIPRPARSAVGRAGADRHPA

SEQ ID NO: 1443538 - protein, 9 aa, Mycobacterium tuberculosis
GAGAGMPGG

SEQ ID NO: 1443539 - protein, 35 aa, Mycobacterium tuberculosis
GAGAGRRRGSGGRGVAAGTVAGAGPPTHAGGRRPG

SEQ ID NO: 1443540 - protein, 22 aa, Mycobacterium tuberculosis
GAGAQGGAGTNGATGGAGGDGV

SEQ ID NO: 1443541 - protein, 22 aa, Mycobacterium tuberculosis
GAGASRGDGTRAGWPDRDRPRR

SEQ ID NO: 1443542 - protein, 13 aa, Mycobacterium tuberculosis
GAGCAGRAGRAAG

SEQ ID NO: 1443543 - protein, 16 aa, Mycobacterium tuberculosis
GAGDAHSRRPATALPG

SEQ ID NO: 1443544 - protein, 11 aa, Mycobacterium tuberculosis
GAGDLPEGIEG

SEQ ID NO: 1443545 - protein, 5 aa, Mycobacterium tuberculosis
GAGDT

SEQ ID NO: 1443546 - protein, 16 aa, Mycobacterium tuberculosis
GAGEKRRRHRAQRRRL

SEQ ID NO: 1443547 - protein, 7 aa, Mycobacterium tuberculosis
GAGGAAG

SEQ ID NO: 1443548 - protein, 24 aa, Mycobacterium tuberculosis
GAGGADGTGTNVTGGAGGAGGNGG

SEQ ID NO: 1443549 - protein, 20 aa, Mycobacterium tuberculosis
GAGGAGGAGAPGGTGGTGGW

SEQ ID NO: 1443550 - protein, 46 aa, Mycobacterium tuberculosis
  misc_feature (28)..(29): Xaa can be any naturally occurring amino acid
GAGGAGGAGAPGGTGGTGGWLAGGGGVXXMGGAGGGAGGAGGNAGL

SEQ ID NO: 1443551 - protein, 42 aa, Mycobacterium tuberculosis
GAGGAGGAGGAGGSGGEAGAGGLTNGPGSLGVSGTEGMAGAP

SEQ ID NO: 1443552 - protein, 16 aa, Mycobacterium tuberculosis
GAGGAGGAGGAGGTGG

SEQ ID NO: 1443553 - protein, 51 aa, Mycobacterium tuberculosis
GAGGAGGAGGNAGMLSGSGGSGGTGGASGAAKGGVGRQRRYGRGVRQRRRR

SEQ ID NO: 1443554 - protein, 25 aa, Mycobacterium tuberculosis
GAGGAGGAGSPAGAPGNGGTGGTGG

SEQ ID NO: 1443555 - protein, 52 aa, Mycobacterium tuberculosis
GAGGAGGESDNGDGGNGGVGGKAGLVGEGGNGGDGGATIAGKGGSGGNGGNA

SEQ ID NO: 1443556 - protein, 40 aa, Mycobacterium tuberculosis
GAGGAGGKGGSGLSGNANGGAGGDSGRGGTGGAGGEGGAA

SEQ ID NO: 1443557 - protein, 14 aa, Mycobacterium tuberculosis
GAGGAGGNGGDTTV

SEQ ID NO: 1443558 - protein, 19 aa, Mycobacterium tuberculosis
GAGGAGGNGGGDGGPGGAA

SEQ ID NO: 1443559 - protein, 26 aa, Mycobacterium tuberculosis
GAGGAGGVGGAGGIGGTDGGGGKGGA

SEQ ID NO: 1443560 - protein, 24 aa, Mycobacterium tuberculosis
GAGGAGSGTKAGGTGSDGGHGGNA

SEQ ID NO: 1443561 - protein, 128 aa, Mycobacterium tuberculosis
GAGGARSAGAGGARSAGAGGARSAGGAGSAGAAGRGSPSGAGRSFTASSTGGATSAGAGGARSAGGAGSAGAAGRGSPSGAGRSLAASSTGGAGSAGGGASGAGSPLTAAASNGASIAAEAGSTSRGV

SEQ ID NO: 1443562 - protein, 27 aa, Mycobacterium tuberculosis
GAGGDGGAGGSGLTTGGAAGNGGNAGT

SEQ ID NO: 1443563 - protein, 33 aa, Mycobacterium tuberculosis
GAGGDGGAGGSGLTTGGAAGNGGNAGTLSLGAA

SEQ ID NO: 1443564 - protein, 138 aa, Mycobacterium tuberculosis
GAGGDGGVGGVGAPGTNGMNPPPNQTSQAANGSPGANNGAGSGGAGLPGNPGAVPGRVGGAGGLGGSGSDTSEGPVTGGNGGNGGDGGPGAPGGNGAPGGIGVNTGTGWAYGGNGGNGGDGGAGARGGDGGNGGNGLA

SEQ ID NO: 1443565 - protein, 30 aa, Mycobacterium tuberculosis
GAGGEGGSGGSGNLTGGAGGAGGNAGNARH

SEQ ID NO: 1443566 - protein, 57 aa, Mycobacterium tuberculosis; identical to SEQ ID NO: 229721

SEQ ID NO: 1443567 - protein, 8 aa, Mycobacterium tuberculosis
GAGGGCGS

SEQ ID NO: 1443568 - protein, 9 aa, Mycobacterium tuberculosis
GAGGGGGIG

SEQ ID NO: 1443569 - protein, 20 aa, Mycobacterium tuberculosis
GAGGGPVGAPARRPAGQTAA

SEQ ID NO: 1443570 - protein, 27 aa, Mycobacterium tuberculosis
GAGGHGGAGGLGAVTGGVGGAGGAGGL

SEQ ID NO: 1443571 - protein, 25 aa, Mycobacterium tuberculosis
GAGGHGGAGGPGPIGGVGDTAVSGV

SEQ ID NO: 1443572 - protein, 22 aa, Mycobacterium tuberculosis
GAGGHGGAGGPGPIGGVGGHGG

SEQ ID NO: 1443573 - protein, 38 aa, Mycobacterium tuberculosis; identical to SEQ ID NO: 229723

SEQ ID NO: 1443574 - protein, 36 aa, Mycobacterium tuberculosis
GAGGHGGTGGAGGAGVNGGGAGGAGGAGGNGGAGGQ

SEQ ID NO: 1443575 - protein, 26 aa, Mycobacterium tuberculosis
GAGGNGGGASNSASIGGDGGSGGAGG

SEQ ID NO: 1443576 - protein, 9 aa, Mycobacterium tuberculosis
GAGGNGGTA

SEQ ID NO: 1443577 - protein, 95 aa, Mycobacterium tuberculosis
GAGGNGGTAGQGGDGGTALGAGGIGGDGGTGGAGGTGGTAGTGGGSSMIGGKGGTGGNGGVGGTGGASALTIGNGSSAGAGGAGGAGGTGGTGGY

SEQ ID NO: 1443578 - protein, 6 aa, Mycobacterium tuberculosis
GAGGQL

SEQ ID NO: 1443579 - protein, 6 aa, Mycobacterium tuberculosis
GAGGRR

SEQ ID NO: 1443580 - protein, 6 aa, Mycobacterium tuberculosis
GAGGRW

SEQ ID NO: 1443581 - protein, 28 aa, Mycobacterium tuberculosis
GAGGSGGAAGSGASRTPRPQQPRDHRHP

SEQ ID NO: 1443582 - protein, 29 aa, Mycobacterium tuberculosis
GAGGSRRGGGAAGTADGCGQRRRRRIGGR

SEQ ID NO: 1443583 - protein, 10 aa, Mycobacterium tuberculosis
GAGGTAVASE

SEQ ID NO: 1443584 - protein, 12 aa, Mycobacterium tuberculosis
GAGGTGGAGGFG

SEQ ID NO: 1443585 - protein, 31 aa, Mycobacterium tuberculosis
GAGGTGGAGGTGGGEPSAGASGGNGGNGGNG

SEQ ID NO: 1443586 - protein, 13 aa, Mycobacterium tuberculosis
GAGGTGGAGGTIG

SEQ ID NO: 1443587 - protein, 20 aa, Mycobacterium tuberculosis
GAGGTGGAGGTIGAGVAGMG

SEQ ID NO: 1443588 - protein, 29 aa, Mycobacterium tuberculosis
GAGGTGGAGSHSTAAGVSGGAGGAGGDAG

SEQ ID NO: 1443589 - protein, 31 aa, Mycobacterium tuberculosis
GAGGTGGLGGAGAGGGADGDDGDDGQPGNNG

SEQ ID NO: 1443590 - protein, 29 aa, Mycobacterium tuberculosis
GAGGTGGSGGGGATTGGDGGAGGNAGTLS

SEQ ID NO: 1443591 - protein, 51 aa, Mycobacterium tuberculosis
GAGGTGGSSGIGSSGGTGGDGGTAGVFGNGGDGGAAGFGTGAGGTGGTGGN

SEQ ID NO: 1443592 - protein, 50 aa, Mycobacterium tuberculosis
GAGGTGGSSGIGSSGGTGGDGGTAGVFGNGGDGGAGGFGAGTGGNGGVGG

SEQ ID NO: 1443593 - protein, 51 aa, Mycobacterium tuberculosis
GAGGTGGSSGIGSSGGTGGDGGTAGVFGNGGDGGAGGFGTGAGGTGGTGGN

SEQ ID NO: 1443594 - protein, 19 aa, Mycobacterium tuberculosis
GAGGVGGAGGGTGGAGGPG

SEQ ID NO: 1443595 - protein, 50 aa, Mycobacterium tuberculosis
GAGGVGGGGGAGGDGGRGGVATPGGQGGDAGDGGAGGAGGNGGGASGAGG

SEQ ID NO: 1443596 - protein, 30 aa, Mycobacterium tuberculosis
GAGGVGGNGAKAAAAGGDGGQGGDGGNAGL

SEQ ID NO: 1443597 - protein, 36 aa, Mycobacterium tuberculosis
GAGGVGGSAGLIGTGGNGGNGGTGANAGSPGTGGAG

SEQ ID NO: 1443598 - protein, 30 aa, Mycobacterium tuberculosis
GAGGVGGSSEDVGGTGGAGGDWPRSIPWPG

SEQ ID NO: 1443599 - protein, 9 aa, Mycobacterium tuberculosis
GAGGVGKTR

SEQ ID NO: 1443600 - protein, 4 aa, Mycobacterium tuberculosis
GAGI

SEQ ID NO: 1443601 - protein, 5 aa, Mycobacterium tuberculosis
GAGKD

SEQ ID NO: 1443602 - protein, 4 aa, Mycobacterium tuberculosis
GAGL

SEQ ID NO: 1443603 - protein, 13 aa, Mycobacterium tuberculosis
GAGPAAPASSAGV

SEQ ID NO: 1443604 - protein, 13 aa, Mycobacterium tuberculosis
GAGPGFLASSPRF

SEQ ID NO: 1443605 - protein, 17 aa, Mycobacterium tuberculosis
GAGPLDTPRSASTPGYR

SEQ ID NO: 1443606 - protein, 8 aa, Mycobacterium tuberculosis
GAGPRSPL

SEQ ID NO: 1443607 - protein, 17 aa, Mycobacterium tuberculosis
GAGQPASDPESTAQPGL

SEQ ID NO: 1443608 - protein, 8 aa, Mycobacterium tuberculosis
GAGQRIPR

SEQ ID NO: 1443609 - protein, 22 aa, Mycobacterium tuberculosis
GAGQRPRSCASTRPPGQPGGQG

SEQ ID NO: 1443610 - protein, 12 aa, Mycobacterium tuberculosis
GAGRERSGLAAR

SEQ ID NO: 1443611 - protein, 50 aa, Mycobacterium tuberculosis
GAGRGGSPSSAAAGPVRRPAGRRGSGMRGAPRTRPRTPRSGRALPRGDPA

SEQ ID NO: 1443612 - protein, 19 aa, Mycobacterium tuberculosis
GAGRPSPDLLGDADTDRLN

SEQ ID NO: 1443613 - protein, 15 aa, Mycobacterium tuberculosis
GAGSRTGGSIPTIVG

SEQ ID NO: 1443614 - protein, 17 aa, Mycobacterium tuberculosis
GAGSSPLLAAGRGVGWA

SEQ ID NO: 1443615 - protein, 4 aa, Mycobacterium tuberculosis
GAGT

SEQ ID NO: 1443616 - protein, 21 aa, Mycobacterium tuberculosis
GAGTAIGSNAGDGGAGGDSSA

SEQ ID NO: 1443617 - protein, 9 aa, Mycobacterium tuberculosis
GAGTDNTVT

SEQ ID NO: 1443618 - protein, 6 aa, Mycobacterium tuberculosis
GAGTRR

SEQ ID NO: 1443619 - protein, 12 aa, Mycobacterium tuberculosis
GAGVEQPDIPGA

SEQ ID NO: 1443620 - protein, 5 aa, Mycobacterium tuberculosis
GAGVT

SEQ ID NO: 1443621 - protein, 14 aa, Mycobacterium tuberculosis
GAGYTGGKRVGSAG

SEQ ID NO: 1443622 - protein, 10 aa, Mycobacterium tuberculosis
GAHGAGAAAA

SEQ ID NO: 1443623 - protein, 14 aa, Mycobacterium tuberculosis
GAHHGSAAEGQGFH

SEQ ID NO: 1443624 - protein, 11 aa, Mycobacterium tuberculosis
GAHPGSQSVGS

SEQ ID NO: 1443625 - protein, 6 aa, Mycobacterium tuberculosis
GAHPST

SEQ ID NO: 1443626 - protein, 5 aa, Mycobacterium tuberculosis
GAHRR

SEQ ID NO: 1443627 - protein, 10 aa, Mycobacterium tuberculosis
GAHTATGCSP

SEQ ID NO: 1443628 - protein, 11 aa, Mycobacterium tuberculosis
GAKAQARSGEF

SEQ ID NO: 1443629 - protein, 10 aa, Mycobacterium tuberculosis
GAKPPPRGGL

SEQ ID NO: 1443630 - protein, 7 aa, Mycobacterium tuberculosis
GAKRGVE

SEQ ID NO: 1443631 - protein, 12 aa, Mycobacterium tuberculosis
GAKRLGDDRRPL

SEQ ID NO: 1443632 - protein, 18 aa, Mycobacterium tuberculosis
GAKRPAAGHLPPARGRRS

SEQ ID NO: 1443633 - protein, 8 aa, Mycobacterium tuberculosis
GALGARRR

SEQ ID NO: 1443634 - protein, 35 aa, Mycobacterium tuberculosis
GALGGNGGAGGAGGSPGGSSGIQGNMGPPGTQGAD

SEQ ID NO: 1443635 - protein, 14 aa, Mycobacterium tuberculosis
GALPKTTSGKISRA

SEQ ID NO: 1443636 - protein, 6 aa, Mycobacterium tuberculosis
GALPNL

SEQ ID NO: 1443637 - protein, 18 aa, Mycobacterium tuberculosis
GALQPDPQRPNEGSTHAD

SEQ ID NO: 1443638 - protein, 13 aa, Mycobacterium tuberculosis
GALTSGKPALSDP

SEQ ID NO: 1443639 - protein, 16 aa, Mycobacterium tuberculosis
GANGAPGTGANGGPGG

SEQ ID NO: 1443640 - protein, 16 aa, Mycobacterium tuberculosis
GANGAPGTGATAATAE

SEQ ID NO: 1443641 - protein, 6 aa, Mycobacterium tuberculosis
GANRYA

SEQ ID NO: 1443642 - protein, 12 aa, Mycobacterium tuberculosis
GANTDPYQRAEG

SEQ ID NO: 1443643 - protein, 17 aa, Mycobacterium tuberculosis
GAPAALADSVRNGDTQV

SEQ ID NO: 1443644 - protein, 23 aa, Mycobacterium tuberculosis
GAPAAPGSPAGAPGNGGTGGTGG

SEQ ID NO: 1443645 - protein, 22 aa, Mycobacterium tuberculosis
GAPADAGSFEASSPSPRRRTDR

SEQ ID NO: 1443646 - protein, 15 aa, Mycobacterium tuberculosis
GAPAGRCDGCRYRAG

SEQ ID NO: 1443647 - protein, 25 aa, Mycobacterium tuberculosis
GAPAKSVTPDPVSGTPRASGPAGMT

SEQ ID NO: 1443648 - protein, 43 aa, Mycobacterium tuberculosis
GAPAPSRTRRDNRREPARSSPIAGRWPGRSGTRPRAEAAFEEI

SEQ ID NO: 1443649 - protein, 17 aa, Mycobacterium tuberculosis
GAPARRRRRRRGDSDAI

SEQ ID NO: 1443650 - protein, 17 aa, Mycobacterium tuberculosis
GAPCPKPQAAAQSPDGL

SEQ ID NO: 1443651 - protein, 6 aa, Mycobacterium tuberculosis
GAPIAE

SEQ ID NO: 1443652 - protein, 9 aa, Mycobacterium tuberculosis
GAPINSATA

SEQ ID NO: 1443653 - protein, 14 aa, Mycobacterium tuberculosis
GAPIPPFPPAPPLP

SEQ ID NO: 1443654 - protein, 14 aa, Mycobacterium tuberculosis
GAPKTGWLARWICS

SEQ ID NO: 1443655 - protein, 14 aa, Mycobacterium tuberculosis
GAPPSAVGGGRWRP

SEQ ID NO: 1443656 - protein, 20 aa, Mycobacterium tuberculosis
GAPPVPPDPPLPPAPPAHHS

SEQ ID NO: 1443657 - protein, 13 aa, Mycobacterium tuberculosis
GAPPYRADSAGTL

SEQ ID NO: 1443658 - protein, 7 aa, Mycobacterium tuberculosis
GAPQTSC

SEQ ID NO: 1443659 - protein, 5 aa, Mycobacterium tuberculosis
GAPRT

SEQ ID NO: 1443660 - protein, 17 aa, Mycobacterium tuberculosis
GAPSGRLRAACGRRRAA

SEQ ID NO: 1443661 - protein, 4 aa, Mycobacterium tuberculosis
GAPT

SEQ ID NO: 1443662 - protein, 11 aa, Mycobacterium tuberculosis
GAQAEAAAAAY

SEQ ID NO: 1443663 - protein, 6 aa, Mycobacterium tuberculosis
GAQCPR

SEQ ID NO: 1443664 - protein, 12 aa, Mycobacterium tuberculosis
GAQDPDRERRGL

SEQ ID NO: 1443665 - protein, 4 aa, Mycobacterium tuberculosis
GAQG

SEQ ID NO: 1443666 - protein, 13 aa, Mycobacterium tuberculosis
GAQHQGDVRRGHR

SEQ ID NO: 1443667 - protein, 4 aa, Mycobacterium tuberculosis
GAQL

SEQ ID NO: 1443668 - protein, 24 aa, Mycobacterium tuberculosis
GAQPGDRDRRDRRRRTRQRHRSLR

SEQ ID NO: 1443669 - protein, 4 aa, Mycobacterium tuberculosis
GAQQ

SEQ ID NO: 1443670 - protein, 5 aa, Mycobacterium tuberculosis
GAQVF

SEQ ID NO: 1443671 - protein, 14 aa, Mycobacterium tuberculosis
GARANLDAEGGASF

SEQ ID NO: 1443672 - protein, 47 aa, Mycobacterium tuberculosis
GARARHGPGQRQRRGDRAGASGGLHRQPADHHRPARARAHRPEPRAD

SEQ ID NO: 1443673 - protein, 28 aa, Mycobacterium tuberculosis
GARGARDRGPSRSRSGCRTGSPGAPARA

SEQ ID NO: 1443674 - protein, 7 aa, Mycobacterium tuberculosis
GARGVGG

SEQ ID NO: 1443675 - protein, 18 aa, Mycobacterium tuberculosis
GARIGGHRPASVDPGQPG

SEQ ID NO: 1443676 - protein, 8 aa, Mycobacterium tuberculosis
GARKGSLG

SEQ ID NO: 1443677 - protein, 8 aa, Mycobacterium tuberculosis
GARKVEKA

SEQ ID NO: 1443678 - protein, 6 aa, Mycobacterium tuberculosis
GARPHH

SEQ ID NO: 1443679 - protein, 5 aa, Mycobacterium tuberculosis
GARPS

SEQ ID NO: 1443680 - protein, 22 aa, Mycobacterium tuberculosis
GARQEKRELSKPCDPGRRGHRR

SEQ ID NO: 1443681 - protein, 24 aa, Mycobacterium tuberculosis
GARRGGAVSGIGGHNAAMAVLFWG

SEQ ID NO: 1443682 - protein, 9 aa, Mycobacterium tuberculosis
GARRGGVGA

SEQ ID NO: 1443683 - protein, 8 aa, Mycobacterium tuberculosis
GARRRGAR

SEQ ID NO: 1443684 - protein, 11 aa, Mycobacterium tuberculosis
GARRRQPGARR

SEQ ID NO: 1443685 - protein, 6 aa, Mycobacterium tuberculosis
GARRRW

SEQ ID NO: 1443686 - protein, 9 aa, Mycobacterium tuberculosis
GARSPLGRK

SEQ ID NO: 1443687 - protein, 9 aa, Mycobacterium tuberculosis
GARTAAHRQ

SEQ ID NO: 1443688 - protein, 12 aa, Mycobacterium tuberculosis
GARWNGARGNSG

SEQ ID NO: 1443689 - protein, 11 aa, Mycobacterium tuberculosis
GASAAATPLTP

SEQ ID NO: 1443690 - protein, 45 aa, Mycobacterium tuberculosis
GASAATSALPPFTPPVQGTGPAGPAAAAAATQAAGAGAVADAQAT

SEQ ID NO: 1443691 - protein, 17 aa, Mycobacterium tuberculosis
GASADQSRGVADGKPAD

SEQ ID NO: 1443692 - protein, 9 aa, Mycobacterium tuberculosis
GASARERNI

SEQ ID NO: 1443693 - protein, 37 aa, Mycobacterium tuberculosis
GASATGAATGGDGGAGGKSGAFGLGGDGGAGGATGLS

SEQ ID NO: 1443694 - protein, 35 aa, Mycobacterium tuberculosis
GASDLRSSSGCVTGTGAAHPGGEPGGAHPGSADDV

SEQ ID NO: 1443695 - protein, 99 aa, Mycobacterium tuberculosis
GASEEAGNLAGPGDGERRNGASEEAGNLAGPGDGERRNGASEEAGNLAGPGDGERRNGASEEAGNLAGPGDGERRNGASEEAGSHAQRDPINLHSACGP

SEQ ID NO: 1443696 - protein, 9 aa, Mycobacterium tuberculosis
GASEGAGLG

SEQ ID NO: 1443697 - protein, 19 aa, Mycobacterium tuberculosis
GASEPDAKAPEEPPAEVPE

SEQ ID NO: 1443698 - protein, 4 aa, Mycobacterium tuberculosis
GASG

SEQ ID NO: 1443699 - protein, 31 aa, Mycobacterium tuberculosis
GASGGAGGSGGSALNVGGTGGVGGNGGSGGS

SEQ ID NO: 1443700 - protein, 25 aa, Mycobacterium tuberculosis
GASGGAGGSGGSSLTARRRGRRHRR

SEQ ID NO: 1443701 - protein, 5 aa, Mycobacterium tuberculosis
GASGI

SEQ ID NO: 1443702 - protein, 18 aa, Mycobacterium tuberculosis
GASGQLGAALSGAAEEQI

SEQ ID NO: 1443703 - protein, 12 aa, Mycobacterium tuberculosis
GASGSGGFRRSA

SEQ ID NO: 1443704 - protein, 9 aa, Mycobacterium tuberculosis
GASKTGTPS

SEQ ID NO: 1443705 - protein, 18 aa, Mycobacterium tuberculosis
GASNGAWGKGASETFNGG

SEQ ID NO: 1443706 - protein, 23 aa, Mycobacterium tuberculosis
GASPRSYSTSRGGSRTPRWCGWE

SEQ ID NO: 1443707 - protein, 14 aa, Mycobacterium tuberculosis
GASRAVSASLARAN

SEQ ID NO: 1443708 - protein, 5 aa, Mycobacterium tuberculosis
GASRR

SEQ ID NO: 1443709 - protein, 5 aa, Mycobacterium tuberculosis
GASTW

SEQ ID NO: 1443710 - protein, 17 aa, Mycobacterium tuberculosis
GASVDQPGATAVGLGGR

SEQ ID NO: 1443711 - protein, 14 aa, Mycobacterium tuberculosis
GATAGAGPAAWDGS

SEQ ID NO: 1443712 - protein, 6 aa, Mycobacterium tuberculosis
GATAVR

SEQ ID NO: 1443713 - protein, 6 aa, Mycobacterium tuberculosis
GATAVT

SEQ ID NO: 1443714 - protein, 7 aa, Mycobacterium tuberculosis
GATEDAY

SEQ ID NO: 1443715 - protein, 44 aa, Mycobacterium tuberculosis
GATFSDAAARDASTEPAPRGPTSSTSGGVKAGPGEAVDVNPENH

SEQ ID NO: 1443716 - protein, 6 aa, Mycobacterium tuberculosis
GATGPG

SEQ ID NO: 1443717 - protein, 11 aa, Mycobacterium tuberculosis
GATGPGSPLGG

SEQ ID NO: 1443718 - protein, 25 aa, Mycobacterium tuberculosis
GATNRVKPAKPQRGARRTPSQVTGP

SEQ ID NO: 1443719 - protein, 9 aa, Mycobacterium tuberculosis
GATPDTDYA

SEQ ID NO: 1443720 - protein, 7 aa, Mycobacterium tuberculosis
GATPEVV

SEQ ID NO: 1443721 - protein, 11 aa, Mycobacterium tuberculosis
GATPIPSPAAE

SEQ ID NO: 1443722 - protein, 8 aa, Mycobacterium tuberculosis
GATTPGPV

SEQ ID NO: 1443723 - protein, 17 aa, Mycobacterium tuberculosis
GAVADHPAQAGPAQAAV

SEQ ID NO: 1443724 - protein, 90 aa, Mycobacterium tuberculosis
GAVDPPPGHPGQGRASGRRQRGRRSSRRRVPGRGGQRDTADPPGGVRRGPGPHRGGGGGRLPAAGRGHGGPSDRAGARERATVSGSGTVR

SEQ ID NO: 1443725 - protein, 7 aa, Mycobacterium tuberculosis
GAVEPRP

SEQ ID NO: 1443726 - protein, 10 aa, Mycobacterium tuberculosis
GAVGQTHPQP

SEQ ID NO: 1443727 - protein, 14 aa, Mycobacterium tuberculosis
GAVGTASSPDGQDG

SEQ ID NO: 1443728 - protein, 14 aa, Mycobacterium tuberculosis
GAVPAVPAAPPPPV

SEQ ID NO: 1443729 - protein, 15 aa, Mycobacterium tuberculosis
GAVRGRGGQRRCRRH

SEQ ID NO: 1443730 - protein, 40 aa, Mycobacterium tuberculosis
GAVRRDREGAPGRVRRAAAGPRRGPAHRRARPARSTSATP

SEQ ID NO: 1443731 - protein, 4 aa, Mycobacterium tuberculosis
GAVT

SEQ ID NO: 1443732 - protein, 13 aa, Mycobacterium tuberculosis
GAWPTDGPAADRH

SEQ ID NO: 1443733 - protein, 18 aa, Mycobacterium tuberculosis
GAWPTDGPPQTGTLGSGQ

SEQ ID NO: 1443734 - protein, 30 aa, Mycobacterium tuberculosis
GAYASAEAANAGPNMAARGQRPPPRRCWGA

SEQ ID NO: 1443735 - protein, 23 aa, Mycobacterium tuberculosis
GAYASARPIRNRPTWRPAAPRTR

SEQ ID NO: 1443736 - protein, 10 aa, Mycobacterium tuberculosis
GAYGGAGGAG

SEQ ID NO: 1443737 - protein, 32 aa, Mycobacterium tuberculosis
GCGAPSGRPGTCSTMSTPTSSSVSVGTSRYRL

SEQ ID NO: 1443738 - protein, 7 aa, Mycobacterium tuberculosis
GCGDPAA

SEQ ID NO: 1443739 - protein, 5 aa, Mycobacterium tuberculosis
GCGGA

SEQ ID NO: 1443740 - protein, 12 aa, Mycobacterium tuberculosis
GCGPPPPTGPTT

SEQ ID NO: 1443741 - protein, 15 aa, Mycobacterium tuberculosis
GCGRPSSFLIVMILP

SEQ ID NO: 1443742 - protein, 40 aa, Mycobacterium tuberculosis
GCGSRRGGRRRAAARRARAKPGAATGLPAGRRARRQRAGP

SEQ ID NO: 1443743 - protein, 4 aa, Mycobacterium tuberculosis
GCGT

SEQ ID NO: 1443744 - protein, 7 aa, Mycobacterium tuberculosis
GCHRDPV

SEQ ID NO: 1443745 - protein, 23 aa, Mycobacterium tuberculosis
GCKSRSRRRRRRCPPPHQLGRRV

SEQ ID NO: 1443746 - protein, 12 aa, Mycobacterium tuberculosis
GCKTSSARHSCN

SEQ ID NO: 1443747 - protein, 5 aa, Mycobacterium tuberculosis
GCPAT

SEQ ID NO: 1443748 - protein, 18 aa, Mycobacterium tuberculosis
GCPEGGASPTTICSPSPS

SEQ ID NO: 1443749 - protein, 5 aa, Mycobacterium tuberculosis
GCPGE

SEQ ID NO: 1443750 - protein, 19 aa, Mycobacterium tuberculosis
GCQRRPHRRRGGTVRQRRQ

SEQ ID NO: 1443751 - protein, 22 aa, Mycobacterium tuberculosis
GCRGGGSAGQRGAAQCAGRGVR

SEQ ID NO: 1443752 - protein, 5 aa, Mycobacterium tuberculosis
GCRPV

SEQ ID NO: 1443753 - protein, 20 aa, Mycobacterium tuberculosis
GCSSSRPRRAPHQCEWRDGG

SEQ ID NO: 1443754 - protein, 8 aa, Mycobacterium tuberculosis
GCTEPPPI

SEQ ID NO: 1443755 - protein, 20 aa, Mycobacterium tuberculosis
GCTGPAAQVGDQSRSPQRDY

SEQ ID NO: 1443756 - protein, 6 aa, Mycobacterium tuberculosis
GDAARN

SEQ ID NO: 1443757 - protein, 12 aa, Mycobacterium tuberculosis
GDAETAPLPNPE

SEQ ID NO: 1443758 - protein, 17 aa, Mycobacterium tuberculosis
GDAGDSGEGGFGGPGLA

SEQ ID NO: 1443759 - protein, 9 aa, Mycobacterium tuberculosis
GDAGMRSPT

SEQ ID NO: 1443760 - protein, 5 aa, Mycobacterium tuberculosis
GDAGV

SEQ ID NO: 1443761 - protein, 12 aa, Mycobacterium tuberculosis
GDAIAPTWSARI

SEQ ID NO: 1443762 - protein, 38 aa, Mycobacterium tuberculosis
GDAPHPRPIPGPPVGPEGLTPTQLASDANEERLREERA

SEQ ID NO: 1443763 - protein, 11 aa, Mycobacterium tuberculosis
GDAPPSGPGSR

SEQ ID NO: 1443764 - protein, 4 aa, Mycobacterium tuberculosis
GDAQ

SEQ ID NO: 1443765 - protein, 6 aa, Mycobacterium tuberculosis
GDATKA

SEQ ID NO: 1443766 - protein, 15 aa, Mycobacterium tuberculosis
GDATQADRLHRARSI

SEQ ID NO: 1443767 - protein, 11 aa, Mycobacterium tuberculosis
GDDEDHEDLEA

SEQ ID NO: 1443768 - protein, 7 aa, Mycobacterium tuberculosis
GDDGTRI

SEQ ID NO: 1443769 - protein, 4 aa, Mycobacterium tuberculosis
GDDI

SEQ ID NO: 1443770 - protein, 5 aa, Mycobacterium tuberculosis
GDDPK

SEQ ID NO: 1443771 - protein, 7 aa, Mycobacterium tuberculosis
GDDPSRI

SEQ ID NO: 1443772 - protein, 8 aa, Mycobacterium tuberculosis
GDDSTSTL

SEQ ID NO: 1443773 - protein, 10 aa, Mycobacterium tuberculosis
GDEPALTASD

SEQ ID NO: 1443774 - protein, 10 aa, Mycobacterium tuberculosis
GDEPTPPLSK

SEQ ID NO: 1443775 - protein, 10 aa, Mycobacterium tuberculosis
GDEQARIRTT

SEQ ID NO: 1443776 - protein, 13 aa, Mycobacterium tuberculosis
GDEQAVGAPLTTT

SEQ ID NO: 1443777 - protein, 9 aa, Mycobacterium tuberculosis
GDFGSGTTT

SEQ ID NO: 1443778 - protein, 6 aa, Mycobacterium tuberculosis
GDFPES

SEQ ID NO: 1443779 - protein, 5 aa, Mycobacterium tuberculosis
GDFPQ

SEQ ID NO: 1443780 - protein, 4 aa, Mycobacterium tuberculosis
GDFS

SEQ ID NO: 1443781 - protein, 10 aa, Mycobacterium tuberculosis
GDGAAGAGYA

SEQ ID NO: 1443782 - protein, 17 aa, Mycobacterium tuberculosis
GDGANGIDGTGQAGGNG

SEQ ID NO: 1443783 - protein, 4 aa, Mycobacterium tuberculosis
GDGG

SEQ ID NO: 1443784 - protein, 18 aa, Mycobacterium tuberculosis
GDGGAGGAGGAGAAGGFG

SEQ ID NO: 1443785 - protein, 49 aa, Mycobacterium tuberculosis
GDGGAGGASDTGAGGNGGAGGKAGLYGNGGDGGAGGDGATSGKGGAGGN

SEQ ID NO: 1443786 - protein, 55 aa, Mycobacterium tuberculosis
GDGGAGGHGGQGGPALVSGATGGAGGTGGNGRRPVGHGEAGGAADNLGLKASREI

SEQ ID NO: 1443787 - protein, 35 aa, Mycobacterium tuberculosis
GDGGAGGHGGQGGTGVSSGGNGGAGGTGGDGRGLS

SEQ ID NO: 1443788 - protein, 195 aa, Mycobacterium tuberculosis
GDGGDGGEGGGAGFGSGVAGAAGAGGNGGKGGDGGTGGTGGTNFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 1443789 - protein, 45 aa, Mycobacterium tuberculosis
GDGGDGGPGDSGGPGGSGGTGGTLAGQNGSPGGTTPPQASWIHTP

SEQ ID NO: 1443790 - protein, 10 aa, Mycobacterium tuberculosis
GDGGGAGGNG

SEQ ID NO: 1443791 - protein, 209 aa, Mycobacterium tuberculosis
GDGGQGGIGGAGGNAGFGAGVPGDGGIGGTGGAGGAGGAGADGDPSIDGGQGGAGGHGGQGGKGGLNSTGLASAASGDGGNGGAGGAGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 1443792 - protein, 31 aa, Mycobacterium tuberculosis
GDGGRGGNGGEGGDGPPGVKGDGGNGGNGGH

SEQ ID NO: 1443793 - protein, 32 aa, Mycobacterium tuberculosis
GDGGRGGNGGEGGDGPPGVKGDGGNGGNGGNA

SEQ ID NO: 1443794 - protein, 9 aa, Mycobacterium tuberculosis
GDGGVGDHH

SEQ ID NO: 1443795 - protein, 21 aa, Mycobacterium tuberculosis
GDGKPDASRCASNYGGAAGQI

SEQ ID NO: 1443796 - protein, 7 aa, Mycobacterium tuberculosis
GDGLRDD

SEQ ID NO: 1443797 - protein, 89 aa, Mycobacterium tuberculosis
GDGNGGHGGNGGNPGAGGQGGSGGAGSTPGAKGAHGFTPTSGGDGGDGGNGGNSQVVGGNGGDGGNGGNGGSAGHGRQTAAAAATARLV

SEQ ID NO: 1443798 - protein, 24 aa, Mycobacterium tuberculosis
GDGNLGSGNVGSTTSVAELWVRST

SEQ ID NO: 1443799 - protein, 5 aa, Mycobacterium tuberculosis
GDGPT

SEQ ID NO: 1443800 - protein, 8 aa, Mycobacterium tuberculosis
GDGRRRTT

SEQ ID NO: 1443801 - protein, 18 aa, Mycobacterium tuberculosis
GDGTDAAPGSGGAGGAGG

SEQ ID NO: 1443802 - protein, 11 aa, Mycobacterium tuberculosis
GDGVDADQAAG

SEQ ID NO: 1443803 - protein, 11 aa, Mycobacterium tuberculosis
GDGVNDAPALR

SEQ ID NO: 1443804 - protein, 7 aa, Mycobacterium tuberculosis
GDHATGG

SEQ ID NO: 1443805 - protein, 6 aa, Mycobacterium tuberculosis
GDHDEY

SEQ ID NO: 1443806 - protein, 157 aa, Mycobacterium tuberculosis
GDHGGPATNPGSGSRGGAGGSGGNGGAGGNATGSGGKGGAGGNGGDGSFGATSGPASIGVTGAPGGNGGKGGAGGSNPNGSGGDGGKGGNGGAGGNGGSIGANSGIVGGSGGAGGAGGAGGNGSLSSGEGGKGGDGGHGGDGVGGNSSVTQGGSGFF

SEQ ID NO: 1443807 - protein, 6 aa, Mycobacterium tuberculosis
GDHPLG

SEQ ID NO: 1443808 - protein, 15 aa, Mycobacterium tuberculosis
GDHQPGGRADGGEVA

SEQ ID NO: 1443809 - protein, 11 aa, Mycobacterium tuberculosis
GDIAPRRDSEH

SEQ ID NO: 1443810 - protein, 6 aa, Mycobacterium tuberculosis
GDIAPT

SEQ ID NO: 1443811 - protein, 5 aa, Mycobacterium tuberculosis
GDIDA

SEQ ID NO: 1443812 - protein, 5 aa, Mycobacterium tuberculosis
GDIDP

SEQ ID NO: 1443813 - protein, 14 aa, Mycobacterium tuberculosis
GDIGGAGGGVSGHR

SEQ ID NO: 1443814 - protein, 20 aa, Mycobacterium tuberculosis
GDINTGGGQLRRRQHRRLHL

SEQ ID NO: 1443815 - protein, 8 aa, Mycobacterium tuberculosis
GDLAGAGR

SEQ ID NO: 1443816 - protein, 4 aa, Mycobacterium tuberculosis
GDLD

SEQ ID NO: 1443817 - protein, 37 aa, Mycobacterium tuberculosis
GDLNTGSLNPGSYNTGSVNTGSVNTGGFNAGNYNTGY

SEQ ID NO: 1443818 - protein, 4 aa, Mycobacterium tuberculosis
GDLR

SEQ ID NO: 1443819 - protein, 7 aa, Mycobacterium tuberculosis
GDMGGQQ

SEQ ID NO: 1443820 - protein, 379 aa, Mycobacterium tuberculosis
GDNGGDPGAGGAGGTGGAGSTIGAHGAAGASPTSGGNGGAGGNGAHFSSGGKAGGNGGAGGAGGLVGNGGAGGAGGNGAPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGVGGNGGNGGSRGIGGAGGIGGAGSTAGADGARGATPTSGGNGGTGGNGANATVAGGAGGAGGKGGNGGLVGNGGAGGKGGDGMAGVAGSSPTTAGESGTSGQNGGAGGAGGAGGRGGDFGGDGGTGGAGGNGANGANATTPGAKGGDGGHGGPGAQGGNGGQGGPGGLA

SEQ ID NO: 1443821 - protein, 10 aa, Mycobacterium tuberculosis
GDNPASPLTN

SEQ ID NO: 1443822 - protein, 9 aa, Mycobacterium tuberculosis
GDNRGPLGY

SEQ ID NO: 1443823 - protein, 5 aa, Mycobacterium tuberculosis
GDNTN

SEQ ID NO: 1443824 - protein, 8 aa, Mycobacterium tuberculosis
GDPADRRR

SEQ ID NO: 1443825 - protein, 7 aa, Mycobacterium tuberculosis
GDPANAR

SEQ ID NO: 1443826 - protein, 12 aa, Mycobacterium tuberculosis
GDPDAAARACGG

SEQ ID NO: 1443827 - protein, 9 aa, Mycobacterium tuberculosis
GDPDAPPTM

SEQ ID NO: 1443828 - protein, 5 aa, Mycobacterium tuberculosis
GDPEA

SEQ ID NO: 1443829 - protein, 7 aa, Mycobacterium tuberculosis
GDPGDLS

SEQ ID NO: 1443830 - protein, 7 aa, Mycobacterium tuberculosis
GDPGGGA

SEQ ID NO: 1443831 - protein, 10 aa, Mycobacterium tuberculosis
GDPGGSSSIP

SEQ ID NO: 1443832 - protein, 16 aa, Mycobacterium tuberculosis
GDPGVASDALATTGLG

SEQ ID NO: 1443833 - protein, 13 aa, Mycobacterium tuberculosis
GDPKGDGTGGPGY

SEQ ID NO: 1443834 - protein, 10 aa, Mycobacterium tuberculosis
GDPNGAAAGD

SEQ ID NO: 1443835 - protein, 11 aa, Mycobacterium tuberculosis
GDPNGAAAGDL

SEQ ID NO: 1443836 - protein, 14 aa, Mycobacterium tuberculosis
GDPPARHLERFQAR

SEQ ID NO: 1443837 - protein, 10 aa, Mycobacterium tuberculosis
GDPPRRPSTW

SEQ ID NO: 1443838 - protein, 9 aa, Mycobacterium tuberculosis
GDPSGSTAI

SEQ ID NO: 1443839 - protein, 7 aa, Mycobacterium tuberculosis
GDPSYRT

SEQ ID NO: 1443840 - protein, 5 aa, Mycobacterium tuberculosis
GDPTK

SEQ ID NO: 1443841 - protein, 6 aa, Mycobacterium tuberculosis
GDPTPF

SEQ ID NO: 1443842 - protein, 6 aa, Mycobacterium tuberculosis
GDPVGQ

SEQ ID NO: 1443843 - protein, 6 aa, Mycobacterium tuberculosis
GDPVRD

SEQ ID NO: 1443844 - protein, 8 aa, Mycobacterium tuberculosis
GDPVSSHR

SEQ ID NO: 1443845 - protein, 27 aa, Mycobacterium tuberculosis
GDQETARRGRAGRTQGAGPRARRRRPL

SEQ ID NO: 1443846 - protein, 12 aa, Mycobacterium tuberculosis
GDQGASGRRTSA

SEQ ID NO: 1443847 - protein, 14 aa, Mycobacterium tuberculosis
GDQSAGSARPYRGP

SEQ ID NO: 1443848 - protein, 10 aa, Mycobacterium tuberculosis
GDQTDVPESG

SEQ ID NO: 1443849 - protein, 10 aa, Mycobacterium tuberculosis
GDQTDVPQSG

SEQ ID NO: 1443850 - protein, 5 aa, Mycobacterium tuberculosis
GDQVR

SEQ ID NO: 1443851 - protein, 6 aa, Mycobacterium tuberculosis
GDRAQA

SEQ ID NO: 1443852 - protein, 11 aa, Mycobacterium tuberculosis
GDRGGPGRRDR

SEQ ID NO: 1443853 - protein, 5 aa, Mycobacterium tuberculosis
GDRGH

SEQ ID NO: 1443854 - protein, 10 aa, Mycobacterium tuberculosis
GDRGLDSGND

SEQ ID NO: 1443855 - protein, 61 aa, Mycobacterium tuberculosis
GDRKRGEAAAATRRQTNPAGDRKRGEAGHSESTGIHPDPRHRSTTEAMPKTTDTAATPDGT

SEQ ID NO: 1443856 - protein, 21 aa, Mycobacterium tuberculosis
GDRQCQCSTSAAGPGSDADHR

SEQ ID NO: 1443857 - protein, 4 aa, Mycobacterium tuberculosis
GDRR

SEQ ID NO: 1443858 - protein, 9 aa, Mycobacterium tuberculosis
GDRRSQPAA

SEQ ID NO: 1443859 - protein, 8 aa, Mycobacterium tuberculosis
GDSDEEFS

SEQ ID NO: 1443860 - protein, 35 aa, Mycobacterium tuberculosis
GDSDQRPADTRSHAQAPQMTTSPTMSRRSRPIRRT

SEQ ID NO: 1443861 - protein, 8 aa, Mycobacterium tuberculosis
GDSTLGRF

SEQ ID NO: 1443862 - protein, 5 aa, Mycobacterium tuberculosis
GDSYA

SEQ ID NO: 1443863 - protein, 6 aa, Mycobacterium tuberculosis
GDTGVQ

SEQ ID NO: 1443864 - protein, 9 aa, Mycobacterium tuberculosis
GDTNTGFGN

SEQ ID NO: 1443865 - protein, 6 aa, Mycobacterium tuberculosis
GDTPAR

SEQ ID NO: 1443866 - protein, 14 aa, Mycobacterium tuberculosis
GDTPIKGAGRHRGH

SEQ ID NO: 1443867 - protein, 8 aa, Mycobacterium tuberculosis
GDTRNRGR

SEQ ID NO: 1443868 - protein, 6 aa, Mycobacterium tuberculosis
GDVDDQ

SEQ ID NO: 1443869 - protein, 30 aa, Mycobacterium tuberculosis
GDVGQSQTIAPPAPAPSAAPSTPPAAGAPI

SEQ ID NO: 1443870 - protein, 13 aa, Mycobacterium tuberculosis
GDVNTGAFDTGDF

SEQ ID NO: 1443871 - protein, 15 aa, Mycobacterium tuberculosis
GDVPRTGEQADALSG

SEQ ID NO: 1443872 - protein, 8 aa, Mycobacterium tuberculosis
GDVSGRRV

SEQ ID NO: 1443873 - protein, 14 aa, Mycobacterium tuberculosis
GDYDEFGAHIGGQR

SEQ ID NO: 1443874 - protein, 10 aa, Mycobacterium tuberculosis
GDYDSATNIS

SEQ ID NO: 1443875 - protein, 24 aa, Mycobacterium tuberculosis
GEAAPQSPAGTSRRAELSKRPTKK

SEQ ID NO: 1443876 - protein, 4 aa, Mycobacterium tuberculosis
GEAD

SEQ ID NO: 1443877 - protein, 13 aa, Mycobacterium tuberculosis
GEAEVAGADVAQP

SEQ ID NO: 1443878 - protein, 9 aa, Mycobacterium tuberculosis
GEAGADYNV

SEQ ID NO: 1443879 - protein, 30 aa, Mycobacterium tuberculosis
GEALPAGGTTATLRPATETSGGAIAEQPYG

SEQ ID NO: 1443880 - protein, 29 aa, Mycobacterium tuberculosis
GEALPAGGTTATPRPATETSGGAIAEQPY

SEQ ID NO: 1443881 - protein, 11 aa, Mycobacterium tuberculosis
GEDARADQQEH

SEQ ID NO: 1443882 - protein, 9 aa, Mycobacterium tuberculosis
GEGAGPPVR

SEQ ID NO: 1443883 - protein, 14 aa, Mycobacterium tuberculosis
GEGAQSGQRGFDTE

SEQ ID NO: 1443884 - protein, 13 aa, Mycobacterium tuberculosis
GEGDTTPLRGAGK

SEQ ID NO: 1443885 - protein, 7 aa, Mycobacterium tuberculosis
GEGHARS

SEQ ID NO: 1443886 - protein, 15 aa, Mycobacterium tuberculosis
GEGRDVQRTGPGDQE

SEQ ID NO: 1443887 - protein, 7 aa, Mycobacterium tuberculosis
GEGRGAA

SEQ ID NO: 1443888 - protein, 9 aa, Mycobacterium tuberculosis
GEGVGPAAA

SEQ ID NO: 1443889 - protein, 14 aa, Mycobacterium tuberculosis
GEHPQSPPSRWASN

SEQ ID NO: 1443890 - protein, 4 aa, Mycobacterium tuberculosis
GEIA

SEQ ID NO: 1443891 - protein, 10 aa, Mycobacterium tuberculosis
GEKCQARSAK

SEQ ID NO: 1443892 - protein, 9 aa, Mycobacterium tuberculosis
GELAGPDFG

SEQ ID NO: 1443893 - protein, 10 aa, Mycobacterium tuberculosis
GELDTNDPVG

SEQ ID NO: 1443894 - protein, 10 aa, Mycobacterium tuberculosis
GELSGRGRAV

SEQ ID NO: 1443895 - protein, 8 aa, Mycobacterium tuberculosis
GENPKTAR

SEQ ID NO: 1443896 - protein, 11 aa, Mycobacterium tuberculosis
GEPDNQDPAGL

SEQ ID NO: 1443897 - protein, 14 aa, Mycobacterium tuberculosis
GEPEPAGRPADPPF

SEQ ID NO: 1443898 - protein, 64 aa, Mycobacterium tuberculosis
GEPGLGSGAGGGDVGGGGAGGTTPTGYLGPPPVPTSSPPTTPAGAPTKSATMPPPGGASPASAH

SEQ ID NO: 1443899 - protein, 4 aa, Mycobacterium tuberculosis
GEPL

SEQ ID NO: 1443900 - protein, 12 aa, Mycobacterium tuberculosis
GEPPFTGDSPVS

SEQ ID NO: 1443901 - protein, 24 aa, Mycobacterium tuberculosis
GEPSADAGPVRRQGTHPHDGADQQ

SEQ ID NO: 1443902 - protein, 5 aa, Mycobacterium tuberculosis
GEPVV

SEQ ID NO: 1443903 - protein, 12 aa, Mycobacterium tuberculosis
GEPWPQPVPEPA

SEQ ID NO: 1443904 - protein, 9 aa, Mycobacterium tuberculosis
GEPYSTTNP

SEQ ID NO: 1443905 - protein, 16 aa, Mycobacterium tuberculosis
GEQAADAELTERSTVA

SEQ ID NO: 1443906 - protein, 16 aa, Mycobacterium tuberculosis
GEQLGPSADPGDGPAH

SEQ ID NO: 1443907 - protein, 8 aa, Mycobacterium tuberculosis
GEQRRDGR

SEQ ID NO: 1443908 - protein, 8 aa, Mycobacterium tuberculosis
GEQTQRQP

SEQ ID NO: 1443909 - protein, 15 aa, Mycobacterium tuberculosis
GERGALPARDGSGAA

SEQ ID NO: 1443910 - protein, 11 aa, Mycobacterium tuberculosis
GERIDADTGLT

SEQ ID NO: 1443911 - protein, 7 aa, Mycobacterium tuberculosis
GERTRVT

SEQ ID NO: 1443912 - protein, 15 aa, Mycobacterium tuberculosis
GERVGAGARRPGRRD

SEQ ID NO: 1443913 - protein, 4 aa, Mycobacterium tuberculosis
GESF

SEQ ID NO: 1443914 - protein, 6 aa, Mycobacterium tuberculosis
GESMSG

SEQ ID NO: 1443915 - protein, 24 aa, Mycobacterium tuberculosis
GESPGEGLPPITTPPWDTKAPKDN

SEQ ID NO: 1443916 - protein, 8 aa, Mycobacterium tuberculosis
GESQHGGD

SEQ ID NO: 1443917 - protein, 49 aa, Mycobacterium tuberculosis
GESRPSQAVNSSLGTQPVCGDGGDGGNVGTGGTGWRGGDGGSGGAGGAS

SEQ ID NO: 1443918 - protein, 8 aa, Mycobacterium tuberculosis
GESRRDRR

SEQ ID NO: 1443919 - protein, 10 aa, Mycobacterium tuberculosis
GESTADREAA

SEQ ID NO: 1443920 - protein, 31 aa, Mycobacterium tuberculosis
GESTSAHPDNCQQTPHKGKPSSICSAAITRS

SEQ ID NO: 1443921 - protein, 11 aa, Mycobacterium tuberculosis
GESVGTRRPVK

SEQ ID NO: 1443922 - protein, 14 aa, Mycobacterium tuberculosis
GETCNGDSARRSGN

SEQ ID NO: 1443923 - protein, 6 aa, Mycobacterium tuberculosis
GETDAV

SEQ ID NO: 1443924 - protein, 18 aa, Mycobacterium tuberculosis
GETGSTGGSLADITGSVR

SEQ ID NO: 1443925 - protein, 7 aa, Mycobacterium tuberculosis
GETMRPQ

SEQ ID NO: 1443926 - protein, 15 aa, Mycobacterium tuberculosis
GETSDIAPAAPVPPA

SEQ ID NO: 1443927 - protein, 5 aa, Mycobacterium tuberculosis
GETYN

SEQ ID NO: 1443928 - protein, 24 aa, Mycobacterium tuberculosis
GEVRKSGAEPGDQIGHTNGAGGMT

SEQ ID NO: 1443929 - protein, 12 aa, Mycobacterium tuberculosis
GEVSSPDEGNCV

SEQ ID NO: 1443930 - protein, 7 aa, Mycobacterium tuberculosis
GFANTGT

SEQ ID NO: 1443931 - protein, 30 aa, Mycobacterium tuberculosis
GFAQGGRGGFGGNGNTGASGGMGGAGCASG

SEQ ID NO: 1443932 - protein, 36 aa, Mycobacterium tuberculosis
GFAQGGRGGFGGNGNTGASGGMGGAGGAGGLAGPAG

SEQ ID NO: 1443933 - protein, 9 aa, Mycobacterium tuberculosis
GFDAAAPSA

SEQ ID NO: 1443934 - protein, 27 aa, Mycobacterium tuberculosis
GFDNAQRTALDRRGAAGLSVRRGAGPA

SEQ ID NO: 1443935 - protein, 7 aa, Mycobacterium tuberculosis
GFDTPTP

SEQ ID NO: 1443936 - protein, 69 aa, Mycobacterium tuberculosis
GFGGGTGGNGGNGHAGGAGGSGGTAGLLGSGGSGGTGGDGGNGGLGAGSGAKGNGGNGGDGGKGGDAQL

SEQ ID NO: 1443937 - protein, 29 aa, Mycobacterium tuberculosis
GFGGLGGGSNGTDGAGGAGGSSQCSSSWF

SEQ ID NO: 1443938 - protein, 24 aa, Mycobacterium tuberculosis
GFGGLGGGSNGTGGAGGAGGTGAT

SEQ ID NO: 1443939 - protein, 46 aa, Mycobacterium tuberculosis
  misc_feature (22)..(22): Xaa can be any naturally occurring amino acid
GFGGPEPRGGDVDVGWLGALPXLPGESSGHPPGRLGNASVAIPLTS

SEQ ID NO: 1443940 - protein, 30 aa, Mycobacterium tuberculosis
GFGGQGRHRAGKGGTGRQPAVAAATAGGGI

SEQ ID NO: 1443941 - protein, 15 aa, Mycobacterium tuberculosis
GFGGSLVPGKAGGAG

SEQ ID NO: 1443942 - protein, 40 aa, Mycobacterium tuberculosis
GFGNTGDANTGGGNTGNGNIGGGNTGNNNFGGGNTGNNNF

SEQ ID NO: 1443943 - protein, 7 aa, Mycobacterium tuberculosis
GFGNTTA

SEQ ID NO: 1443944 - protein, 15 aa, Mycobacterium tuberculosis
GFGQRGDRQPVPGRD

SEQ ID NO: 1443945 - protein, 34 aa, Mycobacterium tuberculosis
GFGSDDATDGARRGQRSHRRAGPLHRPADRRQSW

SEQ ID NO: 1443946 - protein, 6 aa, Mycobacterium tuberculosis
GFGSTE

SEQ ID NO: 1443947 - protein, 15 aa, Mycobacterium tuberculosis
GFGTGAGGTGGTGGN

SEQ ID NO: 1443948 - protein, 21 aa, Mycobacterium tuberculosis
GFPAFTSTRNQSRSSTYPVST

SEQ ID NO: 1443949 - protein, 5 aa, Mycobacterium tuberculosis
GFPNR

SEQ ID NO: 1443950 - protein, 7 aa, Mycobacterium tuberculosis
GFPRRSK

SEQ ID NO: 1443951 - protein, 14 aa, Mycobacterium tuberculosis
GFPSAPKARSPPRT

SEQ ID NO: 1443952 - protein, 12 aa, Mycobacterium tuberculosis
GFRGGAVDSRES

SEQ ID NO: 1443953 - protein, 5 aa, Mycobacterium tuberculosis
GFSNG

SEQ ID NO: 1443954 - protein, 5 aa, Mycobacterium tuberculosis
GFTDT

SEQ ID NO: 1443955 - protein, 18 aa, Mycobacterium tuberculosis
GFTSGGVPLTRTKTRPYL

SEQ ID NO: 1443956 - protein, 11 aa, Mycobacterium tuberculosis
GFYRGGDADGG

SEQ ID NO: 1443957 - protein, 5 aa, Mycobacterium tuberculosis
GGAAG

SEQ ID NO: 1443958 - protein, 33 aa, Mycobacterium tuberculosis
GGAAGAGGNGGNNTSAGTGGVGASGGTGGNAGL

SEQ ID NO: 1443959 - protein, 9 aa, Mycobacterium tuberculosis
GGAAGNASL

SEQ ID NO: 1443960 - protein, 22 aa, Mycobacterium tuberculosis
GGAASAPIAAGTARDDRIPADA

SEQ ID NO: 1443961 - protein, 9 aa, Mycobacterium tuberculosis
GGAASHAAA

SEQ ID NO: 1443962 - protein, 26 aa, Mycobacterium tuberculosis
GGADSHGGHRAGRRGSQAGRRLGRRR

SEQ ID NO: 1443963 - protein, 8 aa, Mycobacterium tuberculosis
GGAEPAST

SEQ ID NO: 1443964 - protein, 7 aa, Mycobacterium tuberculosis
GGAESLN

SEQ ID NO: 1443965 - protein, 22 aa, Mycobacterium tuberculosis
GGAGAGAGGAGGAGGTGGTGGY

SEQ ID NO: 1443966 - protein, 14 aa, Mycobacterium tuberculosis
GGAGDRGGAGGTGF

SEQ ID NO: 1443967 - protein, 5 aa, Mycobacterium tuberculosis
GGAGG

SEQ ID NO: 1443968 - protein, 6 aa, Mycobacterium tuberculosis
GGAGGA

SEQ ID NO: 1443969 - protein, 22 aa, Mycobacterium tuberculosis
GGAGGAGEDGTTPGGNGGAGGV

SEQ ID NO: 1443970 - protein, 8 aa, Mycobacterium tuberculosis
GGAGGAGG

SEQ ID NO: 1443971 - protein, 22 aa, Mycobacterium tuberculosis
GGAGGAGGAATSLVGGIGGTGG

SEQ ID NO: 1443972 - protein, 12 aa, Mycobacterium tuberculosis
GGAGGAGGAGAP

SEQ ID NO: 1443973 - protein, 44 aa, Mycobacterium tuberculosis
GGAGGAGGAGGTGGEGGTGGDGKTTDGNPGMGGSPGSAGQPGQP

SEQ ID NO: 1443974 - protein, 12 aa, Mycobacterium tuberculosis
GGAGGAGGDSSF

SEQ ID NO: 1443975 - protein, 23 aa, Mycobacterium tuberculosis
GGAGGAGGDSSFANGAARRRGRC

SEQ ID NO: 1443976 - protein, 23 aa, Mycobacterium tuberculosis
GGAGGAGGFGQSGAAGGAGGAGG

SEQ ID NO: 1443977 - protein, 53 aa, Mycobacterium tuberculosis; identical to SEQ ID NO: 192559

SEQ ID NO: 1443978 - protein, 53 aa, Mycobacterium tuberculosis
GGAGGAGGGSFAGAGGTGGAGGAPGLVGNAGNGGNGGASANGAGAAGGAGGSG

SEQ ID NO: 1443979 - protein, 26 aa, Mycobacterium tuberculosis
GGAGGAGGLGKAGFAGGAGGTGGTGG

SEQ ID NO: 1443980 - protein, 21 aa, Mycobacterium tuberculosis
GGAGGAGGNGIAGVTGTSAST

SEQ ID NO: 1443981 - protein, 37 aa, Mycobacterium tuberculosis
GGAGGAGGNGIAGVTGTSASTPGGSGTAGGAGGIGGN

SEQ ID NO: 1443982 - protein, 44 aa, Mycobacterium tuberculosis
GGAGGAGGNGIAGVTGTSASTPGGSGTAGGAGGIGGNGGAGGAG

SEQ ID NO: 1443983 - protein, 52 aa, Mycobacterium tuberculosis
GGAGGAGGNGIAGVTGTSASTPGGSGTAGGAGGIGGNGGAGGAGGVLMGNGG

SEQ ID NO: 1443984 - protein, 15 aa, Mycobacterium tuberculosis
GGAGGAGGSGGGSGG

SEQ ID NO: 1443985 - protein, 15 aa, Mycobacterium tuberculosis
GGAGGAGGTGGTGGY

SEQ ID NO: 1443986 - protein, 20 aa, Mycobacterium tuberculosis
GGAGGFGGFGGDGGDGGIGG

SEQ ID NO: 1443987 - protein, 7 aa, Mycobacterium tuberculosis
GGAGGFS

SEQ ID NO: 1443988 - protein, 49 aa, Mycobacterium tuberculosis
GGAGGGGGAGGDGGRGGVATPGGQGGDAGDGGAGGAGGNGGGGASGAGG

SEQ ID NO: 1443989 - protein, 22 aa, Mycobacterium tuberculosis
GGAGGGGGKGGNGAGGGLGGGS

SEQ ID NO: 1443990 - protein, 14 aa, Mycobacterium tuberculosis
GGAGGGGGKRRQRC

SEQ ID NO: 1443991 - protein, 27 aa, Mycobacterium tuberculosis
GGAGGGGGNAPDGGFGGNGGKGGPGRH

SEQ ID NO: 1443992 - protein, 13 aa, Mycobacterium tuberculosis
GGAGGHGPLRRRR

SEQ ID NO: 1443993 - protein, 41 aa, Mycobacterium tuberculosis
GGAGGKGGSGLVGGDGGNGGAGGAGGNGGKGGAGGAGGGAG

SEQ ID NO: 1443994 - protein, 6 aa, Mycobacterium tuberculosis
GGAGGN

SEQ ID NO: 1443995 - protein, 9 aa, Mycobacterium tuberculosis
GGAGGNASL

SEQ ID NO: 1443996 - protein, 20 aa, Mycobacterium tuberculosis
GGAGGNGGAATTGPAGPAAL

SEQ ID NO: 1443997 - protein, 28 aa, Mycobacterium tuberculosis
GGAGGNGGVGVAGDPGGVGGAGGAGINH

SEQ ID NO: 1443998 - protein, 76 aa, Mycobacterium tuberculosis
GGAGGQLYGNGGDGGPGGQGGQAFGANNIGGTGGAGGNGGPAILSGNGGNGGAGGAGGGAGGVGGAGGAPGTGGTL

SEQ ID NO: 1443999 - protein, 51 aa, Mycobacterium tuberculosis
GGAGGSGAAGVNGGAGGNGGAGGLIGNGGAGGAGGRASTGTGSAGGAGGAA

SEQ ID NO: 1444000 - protein, 20 aa, Mycobacterium tuberculosis
GGAGGSGAPGGIGAGGNGGN

SEQ ID NO: 1444001 - protein, 21 aa, Mycobacterium tuberculosis
GGAGGSGAPGQAGEWDSDDRL

SEQ ID NO: 1444002 - protein, 52 aa, Mycobacterium tuberculosis; identical to SEQ ID NO: 229830

SEQ ID NO: 1444003 - protein, 43 aa, Mycobacterium tuberculosis
GGAGGTGAAGGPCTPDGTAGPGGSGGNRRAAVRSPRPVRPGRV

SEQ ID NO: 1444004 - protein, 103 aa, Mycobacterium tuberculosis; identical to SEQ ID NO: 194128

SEQ ID NO: 1444005 - protein, 27 aa, Mycobacterium tuberculosis
GGAGGTGGAVTGVSTTGGPGGHGGDAG

SEQ ID NO: 1444006 - protein, 57 aa, Mycobacterium tuberculosis
GGAGGTGGLSVNGGTGGTGGTGGGGGLFSNGGAGGAGGFGVSGSAGGNGGTGGDGGI

SEQ ID NO: 1444007 - protein, 17 aa, Mycobacterium tuberculosis
GGAGGTGGNGGSGFNSL

SEQ ID NO: 1444008 - protein, 7 aa, Mycobacterium tuberculosis
GGAGGTR

SEQ ID NO: 1444009 - protein, 26 aa, Mycobacterium tuberculosis
GGAGGVGGARGSPNTPLGGAGGERSP

SEQ ID NO: 1444010 - protein, 22 aa, Mycobacterium tuberculosis
GGAGGVGGLAADAGDGGAGGDG

SEQ ID NO: 1444011 - protein, 35 aa, Mycobacterium tuberculosis
GGAGGVGGVGAAGANGATPGQDGAAGVAGSDDGAR

SEQ ID NO: 1444012 - protein, 18 aa, Mycobacterium tuberculosis
GGAGQRRRRDVEPDRKTP

SEQ ID NO: 1444013 - protein, 15 aa, Mycobacterium tuberculosis
GGAGTGEKPDPEGLG

SEQ ID NO: 1444014 - protein, 19 aa, Mycobacterium tuberculosis
GGAGWQRRGQRKRRKQHHS

SEQ ID NO: 1444015 - protein, 46 aa, Mycobacterium tuberculosis; identical to SEQ ID NO: 229834

SEQ ID NO: 1444016 - protein, 14 aa, Mycobacterium tuberculosis
GGAHPPTCRPGHAG

SEQ ID NO: 1444017 - protein, 7 aa, Mycobacterium tuberculosis
GGANYPR

SEQ ID NO: 1444018 - protein, 8 aa, Mycobacterium tuberculosis
GGANYPRE

SEQ ID NO: 1444019 - protein, 10 aa, Mycobacterium tuberculosis
GGAPNPYTYP

SEQ ID NO: 1444020 - protein, 154 aa, Mycobacterium tuberculosis
GGAPPPPPPPPPPPPPPPPPPPPPPPPSPPQKPTQNHPPPPTPPPPPAPPPPPPPPPPPPPPPPPPPPPTPPPPPPPPPTPPPPPPPPPAPASPPPPPPPPPPPPPPPPPPPPPPPPPPPPPPPPPPPPPPLPPPPPPPPSPPPPPPLPSPPPP

SEQ ID NO: 1444021 - protein, 15 aa, Mycobacterium tuberculosis
GGARCPTSCPPTTSH

SEQ ID NO: 1444022 - protein, 11 aa, Mycobacterium tuberculosis
GGARPDRPGFR

SEQ ID NO: 1444023 - protein, 18 aa, Mycobacterium tuberculosis
GGARPGLSSAQRAGGDVS

SEQ ID NO: 1444024 - protein, 9 aa, Mycobacterium tuberculosis
GGARPTGPV

SEQ ID NO: 1444025 - protein, 6 aa, Mycobacterium tuberculosis
GGASAP

SEQ ID NO: 1444026 - protein, 44 aa, Mycobacterium tuberculosis
GGASGAAKGGVGGNGGTAGVFGNGGDGGAGGFGAGTGGNGGVGG

SEQ ID NO: 1444027 - protein, 18 aa, Mycobacterium tuberculosis
GGASLTASLGEASSVGGL

SEQ ID NO: 1444028 - protein, 11 aa, Mycobacterium tuberculosis
GGASPDRPDFS

SEQ ID NO: 1444029 - protein, 21 aa, Mycobacterium tuberculosis
GGASTDVAGGAGGAGGAGGNA

SEQ ID NO: 1444030 - protein, 6 aa, Mycobacterium tuberculosis
GGATAR

SEQ ID NO: 1444031 - protein, 7 aa, Mycobacterium tuberculosis
GGATETA

SEQ ID NO: 1444032 - protein, 15 aa, Mycobacterium tuberculosis
GGATWGSRRRWCMRC

SEQ ID NO: 1444033 - protein, 50 aa, Mycobacterium tuberculosis
GGAVGIGGAGGKAQAAGYTDGATGTGGDGGNGGDGGKAGDGGAGENGLNS

SEQ ID NO: 1444034 - protein, 15 aa, Mycobacterium tuberculosis
GGAWGDGGFRRRGSA

SEQ ID NO: 1444035 - protein, 8 aa, Mycobacterium tuberculosis
GGAYGIDG

SEQ ID NO: 1444036 - protein, 13 aa, Mycobacterium tuberculosis
GGCHRPARTPCPS

SEQ ID NO: 1444037 - protein, 13 aa, Mycobacterium tuberculosis
GGCVSTSSVITCG

SEQ ID NO: 1444038 - protein, 11 aa, Mycobacterium tuberculosis
GGDDDSEMSDG

SEQ ID NO: 1444039 - protein, 16 aa, Mycobacterium tuberculosis
GGDDPEYTAPTRGAAA

SEQ ID NO: 1444040 - protein, 32 aa, Mycobacterium tuberculosis
GGDETEVLSSPSSSSTWSRQTATPPARSSLPA

SEQ ID NO: 1444041 - protein, 72 aa, Mycobacterium tuberculosis
GGDGGAGGIGGTGGNFSGRGAYGGEGGSGGAGGNAGGAGTGGTAGSGGAGGFGGNGADGGNGGNGGNGGFGG

SEQ ID NO: 1444042 - protein, 46 aa, Mycobacterium tuberculosis
GGDGGAGGQGGDGAAGDAAASAGGTGGKGGQGGTGGMGGAGGDGTT

SEQ ID NO: 1444043 - protein, 56 aa, Mycobacterium tuberculosis
GGDGGNGGNGGNGGTGVGSPGGLGGAGGTGGLGGAGAGGGADGDDGDDGQPGNNGQ

SEQ ID NO: 1444044 - protein, 20 aa, Mycobacterium tuberculosis
GGDGGPAAPAARSASPAPAP

SEQ ID NO: 1444045 - protein, 15 aa, Mycobacterium tuberculosis
GGDGGPGGQGGQAFG

SEQ ID NO: 1444046 - protein, 7 aa, Mycobacterium tuberculosis
GGDPLRR

SEQ ID NO: 1444047 - protein, 7 aa, Mycobacterium tuberculosis
GGDPSRI

SEQ ID NO: 1444048 - protein, 14 aa, Mycobacterium tuberculosis
GGDPTGTGRGGPGY

SEQ ID NO: 1444049 - protein, 48 aa, Mycobacterium tuberculosis
GGDQMARKATSPGKPAPTSGQYRPVGGGNEVTVPKGHRPPPSPKPGQK

SEQ ID NO: 1444050 - protein, 6 aa, Mycobacterium tuberculosis
GGDTPT

SEQ ID NO: 1444051 - protein, 12 aa, Mycobacterium tuberculosis
GGEAGPVPDDGF

SEQ ID NO: 1444052 - protein, 6 aa, Mycobacterium tuberculosis
GGECGA

SEQ ID NO: 1444053 - protein, 17 aa, Mycobacterium tuberculosis
GGEVIGGDRREVGSPGA

SEQ ID NO: 1444054 - protein, 14 aa, Mycobacterium tuberculosis
GGEVTPDSARHMVC

SEQ ID NO: 1444055 - protein, 23 aa, Mycobacterium tuberculosis
GGFDGGRGVGVGGVGQGAQPGGV

SEQ ID NO: 1444056 - protein, 12 aa, Mycobacterium tuberculosis
GGFGGAGGGGAV

SEQ ID NO: 1444057 - protein, 17 aa, Mycobacterium tuberculosis
GGFGGFGGDGGDGGIGG

SEQ ID NO: 1444058 - protein, 32 aa, Mycobacterium tuberculosis
GGFGRTTGGIGGTGGNAGLLNGSGGAGGADER

SEQ ID NO: 1444059 - protein, 7 aa, Mycobacterium tuberculosis
GGFSGGT

SEQ ID NO: 1444060 - protein, 4 aa, Mycobacterium tuberculosis
GGGA

SEQ ID NO: 1444061 - protein, 9 aa, Mycobacterium tuberculosis
GGGAAGSVG

SEQ ID NO: 1444062 - protein, 7 aa, Mycobacterium tuberculosis
GGGDCPG

SEQ ID NO: 1444063 - protein, 9 aa, Mycobacterium tuberculosis
GGGDQGEIA

SEQ ID NO: 1444064 - protein, 7 aa, Mycobacterium tuberculosis
GGGETAA

SEQ ID NO: 1444065 - protein, 9 aa, Mycobacterium tuberculosis
GGGGAGATV

SEQ ID NO: 1444066 - protein, 51 aa, Mycobacterium tuberculosis
GGGGAGGAGGTGSTAGSGGSGGTNPPTGLQAAGGNGGSGHAGGHGGNGGGA

SEQ ID NO: 1444067 - protein, 112 aa, Mycobacterium tuberculosis
GGGGAGGAGGTGSTAGSGGSGGTNPPTGLQAAGGNGGSGHAGGHGGNGGGAGLLGGGGTGGNGGGGGQGGLGAAAGGVDGNGGNGGNGGKGGDAQLVGDGGNGGNGGKGGAG

SEQ ID NO: 1444068 - protein, 8 aa, Mycobacterium tuberculosis
GGGGEVEP

SEQ ID NO: 1444069 - protein, 27 aa, Mycobacterium tuberculosis
GGGGGGGGGGGGGADTNRSDRSSDVGG

SEQ ID NO: 1444070 - protein, 138 aa, Mycobacterium tuberculosis
GGGGGGGGGGRGGGGGGGGGGGGGGGGGGGGGGGGGGGGGGGGGGGGGGGGGGGGGRGGGGGGGGGGGGGGGGGGGGGGGGGGGGGGGGGGGGGGGGGGGGGGGGGGGGGGGGGGGGGGGGGGGWGGGGGGGAGGGGG

SEQ ID NO: 1444071 - protein, 12 aa, Mycobacterium tuberculosis
GGGGGVGGTGGT

SEQ ID NO: 1444072 - protein, 19 aa, Mycobacterium tuberculosis
GGGGKGGNGAGGGLGGGSF

SEQ ID NO: 1444073 - protein, 51 aa, Mycobacterium tuberculosis
GGGGNGGTGWNGGKGDTGSGGGAGDGGKAPAGGTGGAGGDGGAGGKGGSGG

SEQ ID NO: 1444074 - protein, 19 aa, Mycobacterium tuberculosis
GGGGQGFDTGGAGGPGGDA

SEQ ID NO: 1444075 - protein, 13 aa, Mycobacterium tuberculosis
GGGGTDVEPYSSQ

SEQ ID NO: 1444076 - protein, 9 aa, Mycobacterium tuberculosis
GGGHRGGHW

SEQ ID NO: 1444077 - protein, 19 aa, Mycobacterium tuberculosis
GGGNAAGPSKGIDSGAGTV

SEQ ID NO: 1444078 - protein, 23 aa, Mycobacterium tuberculosis
GGGPAAVDAAPAGATSGVDQDRG

SEQ ID NO: 1444079 - protein, 55 aa, Mycobacterium tuberculosis
GGGPGIGFGSGQSAHAKAAASDSAAAESAAQASARAQARSARRGRSAAKARGHRD

SEQ ID NO: 1444080 - protein, 10 aa, Mycobacterium tuberculosis
GGGPPQPPTG

SEQ ID NO: 1444081 - protein, 35 aa, Mycobacterium tuberculosis
GGGPRNRSSARDSRPTPRPRRPIPLQPSRRPRPRR

SEQ ID NO: 1444082 - protein, 7 aa, Mycobacterium tuberculosis
GGGQGNH

SEQ ID NO: 1444083 - protein, 28 aa, Mycobacterium tuberculosis
GGGRAKSLANPAAVDGCAGSSVRADHQG

SEQ ID NO: 1444084 - protein, 8 aa, Mycobacterium tuberculosis
GGGRGGDG

SEQ ID NO: 1444085 - protein, 84 aa, Mycobacterium tuberculosis
GGGRTATKKKKKKKKKKKKKKKKKKKKKKKKKKKKKKKKKKKKKKKKKKKKGGGGGEGGGGGGGGGGGGGGGRGGGGGGKKKKK

SEQ ID NO: 1444086 - protein, 24 aa, Mycobacterium tuberculosis
GGGTTTDPTPDQGAPIDGGGVPCV

SEQ ID NO: 1444087 - protein, 9 aa, Mycobacterium tuberculosis
GGGVADPGV

SEQ ID NO: 1444088 - protein, 47 aa, Mycobacterium tuberculosis
GGGVASAFGGGNAFGGRGGDGGDGGDGGTGGAGGARGAGGAGGAGGW

SEQ ID NO: 1444089 - protein, 7 aa, Mycobacterium tuberculosis
GGGYGAG

SEQ ID NO: 1444090 - protein, 9 aa, Mycobacterium tuberculosis
GGHDVPETK

SEQ ID NO: 1444091 - protein, 4 aa, Mycobacterium tuberculosis
GGHG

SEQ ID NO: 1444092 - protein, 19 aa, Mycobacterium tuberculosis
GGHGENLDTGGDGGAGGSA

SEQ ID NO: 1444093 - protein, 22 aa, Mycobacterium tuberculosis
GGHGGAGGNGGNATAPGGASAG

SEQ ID NO: 1444094 - protein, 21 aa, Mycobacterium tuberculosis
GGHGGDGGTGGTGGAVSLARA

SEQ ID NO: 1444095 - protein, 22 aa, Mycobacterium tuberculosis
GGHGGDGGTGGTGGAVSLARAG

SEQ ID NO: 1444096 - protein, 8 aa, Mycobacterium tuberculosis
GGHPACGS

SEQ ID NO: 1444097 - protein, 27 aa, Mycobacterium tuberculosis
GGIGGAGGTGGRSGRHRWQPRVAARRW

SEQ ID NO: 1444098 - protein, 21 aa, Mycobacterium tuberculosis
GGIGGDGAGGGGNATSTSSIP

SEQ ID NO: 1444099 - protein, 20 aa, Mycobacterium tuberculosis
GGIGGDGAGGGNATSTSSIP

SEQ ID NO: 1444100 - protein, 53 aa, Mycobacterium tuberculosis; identical to SEQ ID NO: 232723

SEQ ID NO: 1444101 - protein, 21 aa, Mycobacterium tuberculosis
GGKEAEERAASSVKEKNDWTY

SEQ ID NO: 1444102 - protein, 8 aa, Mycobacterium tuberculosis
GGKERGTV

SEQ ID NO: 1444103 - protein, 8 aa, Mycobacterium tuberculosis
GGKFDSDA

SEQ ID NO: 1444104 - protein, 106 aa, Mycobacterium tuberculosis
GGKGGAGGTVGTDGGAGGAGGAGGIGETDGSAGGVATGGEGGDGATGGVDGGVGGAGGKGGQGHNTGVGDAFGGDGGIGGDGNGALGAAGGNGGTGGAGGNGGRGG

SEQ ID NO: 1444105 - protein, 25 aa, Mycobacterium tuberculosis
GGKGGDAQLVGDGGNGGNGGKGGAG

SEQ ID NO: 1444106 - protein, 19 aa, Mycobacterium tuberculosis
GGKGLPFEAGANGGAGGAG

SEQ ID NO: 1444107 - protein, 5 aa, Mycobacterium tuberculosis
GGKNV

SEQ ID NO: 1444108 - protein, 15 aa, Mycobacterium tuberculosis
GGKQPLAAAKAAATS

SEQ ID NO: 1444109 - protein, 19 aa, Mycobacterium tuberculosis
GGKTAGSLAGGGESPRGVR

SEQ ID NO: 1444110 - protein, 14 aa, Mycobacterium tuberculosis
GGLGGAAGLGNAGG

SEQ ID NO: 1444111 - protein, 31 aa, Mycobacterium tuberculosis
GGLGGNGGAGGQLYGNGGDGGPGGQGGQAFG

SEQ ID NO: 1444112 - protein, 4 aa, Mycobacterium tuberculosis
GGLP

SEQ ID NO: 1444113 - protein, 6 aa, Mycobacterium tuberculosis
GGLTQA

SEQ ID NO: 1444114 - protein, 7 aa, Mycobacterium tuberculosis
GGLTTAD

SEQ ID NO: 1444115 - protein, 4 aa, Mycobacterium tuberculosis
GGMD

SEQ ID NO: 1444116 - protein, 7 aa, Mycobacterium tuberculosis
GGMGGAG

SEQ ID NO: 1444117 - protein, 4 aa, Mycobacterium tuberculosis
GGMP

SEQ ID NO: 1444118 - protein, 118 aa, Mycobacterium tuberculosis
GGNAIGGNGGPGDAGDAMTSGGAGGSGGNAVSTVNGDAVGGEGGKGGEGAYGGAGGAGGSAASIGNAAIGGNGGAGGNAQAPGGVGGAGGEGGDAQVGTNSPSNAEAGNGGSGGNGFD

SEQ ID NO: 1444119 - protein, 18 aa, Mycobacterium tuberculosis
GGNDTGRSGDGRPRNPRR

SEQ ID NO: 1444120 - protein, 23 aa, Mycobacterium tuberculosis
GGNGFTQTTAGVAGGNGGSAGFD

SEQ ID NO: 1444121 - protein, 38 aa, Mycobacterium tuberculosis
GGNGFTQTTAGVAGGNGGSAGLIGNGGAGAAGGLGGNG

SEQ ID NO: 1444122 - protein, 44 aa, Mycobacterium tuberculosis
GGNGFTQTTAGVAGGNGGSAGLIGNGGAGGGGGAGAAGGLGGNG

SEQ ID NO: 1444123 - protein, 50 aa, Mycobacterium tuberculosis
GGNGFTQTTAGVAGGNGGSAGLIGNGGAGGGGGAGAAGGLGGNGGRLYGT

SEQ ID NO: 1444124 - protein, 32 aa, Mycobacterium tuberculosis
GGNGGAGGDAGHGGTGGDGGDGGHAGTGGRGG

SEQ ID NO: 1444125 - protein, 20 aa, Mycobacterium tuberculosis
GGNGGNGVNGGTGGSGGNPF

SEQ ID NO: 1444126 - protein, 43 aa, Mycobacterium tuberculosis
GGNGGNSGAKAGGAGGKGQAGQPNSGTEPGFGGDGGLGGAGAT

SEQ ID NO: 1444127 - protein, 43 aa, Mycobacterium tuberculosis
GGNGGPGGSGGAADIGGNGGAGNGGGTDGNGGKWRVRRRRRQR

SEQ ID NO: 1444128 - protein, 19 aa, Mycobacterium tuberculosis
GGNGGSGASVHAVGVGGAA

SEQ ID NO: 1444129 - protein, 58 aa, Mycobacterium tuberculosis
GGNGGSGGQPVETGGNCPHRQRGGPVGSPGGPRERKRSAGSAGGSGGDGGKGGNGGSV

SEQ ID NO: 1444130 - protein, 48 aa, Mycobacterium tuberculosis
GGNGRGSGGVRAKPAEPGGSAGFDRASAGTGGGRRGRRGRRRRPANGG

SEQ ID NO: 1444131 - protein, 20 aa, Mycobacterium tuberculosis
GGNGRRRRRRRRGRSGWDRR

SEQ ID NO: 1444132 - protein, 17 aa, Mycobacterium tuberculosis
GGNGTGAKGGDGGAGGG

SEQ ID NO: 1444133 - protein, 7 aa, Mycobacterium tuberculosis
GGNNAGA

SEQ ID NO: 1444134 - protein, 9 aa, Mycobacterium tuberculosis
GGNNVGGAN

SEQ ID NO: 1444135 - protein, 6 aa, Mycobacterium tuberculosis
GGNPHY

SEQ ID NO: 1444136 - protein, 4 aa, Mycobacterium tuberculosis
GGNR

SEQ ID NO: 1444137 - protein, 14 aa, Mycobacterium tuberculosis
GGNTCSATGSSRIY

SEQ ID NO: 1444138 - protein, 6 aa, Mycobacterium tuberculosis
GGNYRG

SEQ ID NO: 1444139 - protein, 15 aa, Mycobacterium tuberculosis
GGPADHGGLRGGHHR

SEQ ID NO: 1444140 - protein, 19 aa, Mycobacterium tuberculosis
GGPAPPAHPGRRGRRRHHG

SEQ ID NO: 1444141 - protein, 5 aa, Mycobacterium tuberculosis
GGPDI

SEQ ID NO: 1444142 - protein, 8 aa, Mycobacterium tuberculosis
GGPDPGTW

SEQ ID NO: 1444143 - protein, 9 aa, Mycobacterium tuberculosis
GGPGKTFEE

SEQ ID NO: 1444144 - protein, 27 aa, Mycobacterium tuberculosis
GGPGRGSRRSRRSRGPRGHSGTRRPAG

SEQ ID NO: 1444145 - protein, 7 aa, Mycobacterium tuberculosis
GGPGRSA

SEQ ID NO: 1444146 - protein, 26 aa, Mycobacterium tuberculosis
GGPGVADHAGGGGDGRPGAQHGRTRI

SEQ ID NO: 1444147 - protein, 4 aa, Mycobacterium tuberculosis
GGPL

SEQ ID NO: 1444148 - protein, 17 aa, Mycobacterium tuberculosis
GGPLGGARSRRRRRQRD

SEQ ID NO: 1444149 - protein, 38 aa, Mycobacterium tuberculosis
GGPNQAGGAGGNAGLIGNGGAGGAGGVGAVGGKGGTGG

SEQ ID NO: 1444150 - protein, 13 aa, Mycobacterium tuberculosis
GGPPAGVLPPRQQ

SEQ ID NO: 1444151 - protein, 8 aa, Mycobacterium tuberculosis
GGPQAVAD

SEQ ID NO: 1444152 - protein, 7 aa, Mycobacterium tuberculosis
GGPQHQP

SEQ ID NO: 1444153 - protein, 5 aa, Mycobacterium tuberculosis
GGPRV

SEQ ID NO: 1444154 - protein, 6 aa, Mycobacterium tuberculosis
GGPSSD

SEQ ID NO: 1444155 - protein, 20 aa, Mycobacterium tuberculosis
GGPSTGTDEAWTKQEAGTDR

SEQ ID NO: 1444156 - protein, 14 aa, Mycobacterium tuberculosis
GGQDLQKNDRRHAG

SEQ ID NO: 1444157 - protein, 7 aa, Mycobacterium tuberculosis
GGQELGD

SEQ ID NO: 1444158 - protein, 11 aa, Mycobacterium tuberculosis
GGQGGNGGAGG

SEQ ID NO: 1444159 - protein, 14 aa, Mycobacterium tuberculosis
GGQPDPSKGRCAFA

SEQ ID NO: 1444160 - protein, 7 aa, Mycobacterium tuberculosis
GGQPLTH

SEQ ID NO: 1444161 - protein, 4 aa, Mycobacterium tuberculosis
GGQQ

SEQ ID NO: 1444162 - protein, 15 aa, Mycobacterium tuberculosis
GGQRGATAAPAAQAV

SEQ ID NO: 1444163 - protein, 27 aa, Mycobacterium tuberculosis
GGQRRGPGGAGTKRQARAAPGGPGGNP

SEQ ID NO: 1444164 - protein, 21 aa, Mycobacterium tuberculosis
GGQSHSRTVNGSPRPSRAPVS

SEQ ID NO: 1444165 - protein, 8 aa, Mycobacterium tuberculosis
GGQTRRSW

SEQ ID NO: 1444166 - protein, 6 aa, Mycobacterium tuberculosis
GGQVPR

SEQ ID NO: 1444167 - protein, 21 aa, Mycobacterium tuberculosis
GGRAAQFGRRRSGSSGSLCGG

SEQ ID NO: 1444168 - protein, 26 aa, Mycobacterium tuberculosis
GGRASRCAGGRAVPRRPGTPDPPPAV

SEQ ID NO: 1444169 - protein, 6 aa, Mycobacterium tuberculosis
GGRCGP

SEQ ID NO: 1444170 - protein, 6 aa, Mycobacterium tuberculosis
GGRCTP

SEQ ID NO: 1444171 - protein, 5 aa, Mycobacterium tuberculosis
GGRDA

SEQ ID NO: 1444172 - protein, 7 aa, Mycobacterium tuberculosis
GGRDCGD

SEQ ID NO: 1444173 - protein, 151 aa, Mycobacterium tuberculosis
GGRGAAPPPPPPPPPPPPPPPPPPPPPPPPPPPPPPPPPPPPPPPPPPPPPPPPPPPPPPPPPPPPPPPPPPPPPPPPPPPPPPPPPPPPPKKKKRKNKKKKKKKKRGEGGGGGGGGRGGGEKKKKKKKKKRKKKKKKKKKKKKNKKKKKK

SEQ ID NO: 1444174 - protein, 49 aa, Mycobacterium tuberculosis
GGRGAGGLTSGGVGSSGESGGSGNGRGDPGSGGSGGEGGEGGPSISVNV

SEQ ID NO: 1444175 - protein, 18 aa, Mycobacterium tuberculosis
GGRGGNGAAQGSVPPVSG

SEQ ID NO: 1444176 - protein, 21 aa, Mycobacterium tuberculosis
GGRGIGDDRAEAGVAPPVCGS

SEQ ID NO: 1444177 - protein, 9 aa, Mycobacterium tuberculosis
GGRGQRRDC

SEQ ID NO: 1444178 - protein, 5 aa, Mycobacterium tuberculosis
GGRHT

SEQ ID NO: 1444179 - protein, 16 aa, Mycobacterium tuberculosis
GGRLGESAPASGHATG

SEQ ID NO: 1444180 - protein, 14 aa, Mycobacterium tuberculosis
GGRPGDKKKRRRRC

SEQ ID NO: 1444181 - protein, 6 aa, Mycobacterium tuberculosis
GGRPIG

SEQ ID NO: 1444182 - protein, 6 aa, Mycobacterium tuberculosis
GGRPRC

SEQ ID NO: 1444183 - protein, 8 aa, Mycobacterium tuberculosis
GGRPRRRP

SEQ ID NO: 1444184 - protein, 10 aa, Mycobacterium tuberculosis
GGRPTEQGHR

SEQ ID NO: 1444185 - protein, 16 aa, Mycobacterium tuberculosis
GGRRASGGTGGGPGVN

SEQ ID NO: 1444186 - protein, 17 aa, Mycobacterium tuberculosis
GGRRRADRRGAGQLDRY

SEQ ID NO: 1444187 - protein, 16 aa, Mycobacterium tuberculosis
GGRRRCRGDRAGAFVW

SEQ ID NO: 1444188 - protein, 12 aa, Mycobacterium tuberculosis
GGRRVGDGHRRR

SEQ ID NO: 1444189 - protein, 13 aa, Mycobacterium tuberculosis
GGRRWASAEARRH

SEQ ID NO: 1444190 - protein, 17 aa, Mycobacterium tuberculosis
GGRTARNGTTRMTAVKP

SEQ ID NO: 1444191 - protein, 7 aa, Mycobacterium tuberculosis
GGRTGGN

SEQ ID NO: 1444192 - protein, 24 aa, Mycobacterium tuberculosis
GGRTRSRIANAPGGHRALIGQRRQ

SEQ ID NO: 1444193 - protein, 9 aa, Mycobacterium tuberculosis
GGRTVGAGR

SEQ ID NO: 1444194 - protein, 5 aa, Mycobacterium tuberculosis
GGSAA

SEQ ID NO: 1444195 - protein, 20 aa, Mycobacterium tuberculosis
GGSAGTGGAGGKGRRQPPTV

SEQ ID NO: 1444196 - protein, 5 aa, Mycobacterium tuberculosis
GGSCG

SEQ ID NO: 1444197 - protein, 6 aa, Mycobacterium tuberculosis
GGSDPA

SEQ ID NO: 1444198 - protein, 19 aa, Mycobacterium tuberculosis
GGSDRRATSSNLGPSRVGR

SEQ ID NO: 1444199 - protein, 6 aa, Mycobacterium tuberculosis
GGSELD

SEQ ID NO: 1444200 - protein, 32 aa, Mycobacterium tuberculosis
GGSGGAGGHGDTTSGKNGSSGTAGFDGNPGQP

SEQ ID NO: 1444201 - protein, 17 aa, Mycobacterium tuberculosis
GGSGGAGTNGGVGGSGG

SEQ ID NO: 1444202 - protein, 24 aa, Mycobacterium tuberculosis
GGSGGGDPATGSYPQEMLVDWVRV

SEQ ID NO: 1444203 - protein, 4 aa, Mycobacterium tuberculosis
GGSN

SEQ ID NO: 1444204 - protein, 10 aa, Mycobacterium tuberculosis
GGSPPRCGTG

SEQ ID NO: 1444205 - protein, 9 aa, Mycobacterium tuberculosis
GGSRKGGRA

SEQ ID NO: 1444206 - protein, 7 aa, Mycobacterium tuberculosis
GGSRRRR

SEQ ID NO: 1444207 - protein, 7 aa, Mycobacterium tuberculosis
GGSSLTA

SEQ ID NO: 1444208 - protein, 9 aa, Mycobacterium tuberculosis
GGSSVPAAW

SEQ ID NO: 1444209 - protein, 4 aa, Mycobacterium tuberculosis
GGST

SEQ ID NO: 1444210 - protein, 6 aa, Mycobacterium tuberculosis
GGSTIP

SEQ ID NO: 1444211 - protein, 15 aa, Mycobacterium tuberculosis
GGSTNTVSKKLQAPA

SEQ ID NO: 1444212 - protein, 7 aa, Mycobacterium tuberculosis
GGTARLR

SEQ ID NO: 1444213 - protein, 4 aa, Mycobacterium tuberculosis
GGTC

SEQ ID NO: 1444214 - protein, 4 aa, Mycobacterium tuberculosis
GGTF

SEQ ID NO: 1444215 - protein, 5 aa, Mycobacterium tuberculosis
GGTFE

SEQ ID NO: 1444216 - protein, 17 aa, Mycobacterium tuberculosis
GGTGAPAGTAGAGGLGG

SEQ ID NO: 1444217 - protein, 16 aa, Mycobacterium tuberculosis
GGTGATLGKAGIGGTG

SEQ ID NO: 1444218 - protein, 116 aa, Mycobacterium tuberculosis
GGTGGAARNSSGGTGNSFGGAGGAGGDGANGGDGGAGGEALTEGGATAVSGAGGKGGNAEASGGAGGNGGKGGFAQATTSVTGGNGGNGGNGHDSNAPGGAGGSGGVGGDGGRGGL

SEQ ID NO: 1444219 - protein, 20 aa, Mycobacterium tuberculosis
GGTGGAGGAGAVGGVGGKGG

SEQ ID NO: 1444220 - protein, 53 aa, Mycobacterium tuberculosis
GGTGGAGGNGGPAILSGNGGNGGAGGAGGAGGAGGGAGGVGGAGGAPGTGGTL

SEQ ID NO: 1444221 - protein, 15 aa, Mycobacterium tuberculosis
GGTGGATGALPRHGR

SEQ ID NO: 1444222 - protein, 15 aa, Mycobacterium tuberculosis
GGTGGIGGGPGGNGG

SEQ ID NO: 1444223 - protein, 15 aa, Mycobacterium tuberculosis
GGTGGNGAAAGAGGE

SEQ ID NO: 1444224 - protein, 41 aa, Mycobacterium tuberculosis
GGTGGNGGGGEQGGEGAPPAVSTATAATAATAARAATPSWS

SEQ ID NO: 1444225 - protein, 24 aa, Mycobacterium tuberculosis
GGTGGSGGAGLGGDGGAGGAGGNA

SEQ ID NO: 1444226 - protein, 67 aa, Mycobacterium tuberculosis
GGTGGTGGGGAAGFAGGVGGAGGEGLTDGAGTAEGGTGGLGGLGGVGGTGGMGGSGGVGGNGGAAGS

SEQ ID NO: 1444227 - protein, 23 aa, Mycobacterium tuberculosis
GGTGGTGGTGGTGGAGGSGGRGG

SEQ ID NO: 1444228 - protein, 10 aa, Mycobacterium tuberculosis
GGTGQPGARA

SEQ ID NO: 1444229 - protein, 8 aa, Mycobacterium tuberculosis
GGTGRSRL

SEQ ID NO: 1444230 - protein, 62 aa, Mycobacterium tuberculosis
GGTGSRTRKPRSAGDRRTGKRAAAAGAVGQTETGSRRTAGCGARGADGGVATGAGTDREPGL

SEQ ID NO: 1444231 - protein, 14 aa, Mycobacterium tuberculosis
GGTGVGTSQSAAWG

SEQ ID NO: 1444232 - protein, 15 aa, Mycobacterium tuberculosis
GGTGVSRHRRQRHRV

SEQ ID NO: 1444233 - protein, 6 aa, Mycobacterium tuberculosis
GGTKGC

SEQ ID NO: 1444234 - protein, 18 aa, Mycobacterium tuberculosis
GGTRTGRRRRRGGRVDRQ

SEQ ID NO: 1444235 - protein, 37 aa, Mycobacterium tuberculosis
GGVCGSGGASALLTGNGSSAGAGGAGGAGGTGGTGGY

SEQ ID NO: 1444236 - protein, 8 aa, Mycobacterium tuberculosis
GGVDNAER

SEQ ID NO: 1444237 - protein, 4 aa, Mycobacterium tuberculosis
GGVG

SEQ ID NO: 1444238 - protein, 5 aa, Mycobacterium tuberculosis
GGVGA

SEQ ID NO: 1444239 - protein, 10 aa, Mycobacterium tuberculosis
GGVGGAGGNA

SEQ ID NO: 1444240 - protein, 30 aa, Mycobacterium tuberculosis
GGVGGAGGQSLLGGATGGAGGNAGLFGVGG

SEQ ID NO: 1444241 - protein, 24 aa, Mycobacterium tuberculosis
GGVGGAGGYGASGDGGNAGNGGLG

SEQ ID NO: 1444242 - protein, 101 aa, Mycobacterium tuberculosis
GGVGGAVGTGGDGATGTPAGNGGDGGNGGNAGAGGNGGSGDFGGNTTSGASGSGGNGGNAGTAGSGGAGGTGGTGLSGGNGGNGGNGGNGGDGGNGAHGTV

SEQ ID NO: 1444243 - protein, 6 aa, Mycobacterium tuberculosis
GGVGGD

SEQ ID NO: 1444244 - protein, 24 aa, Mycobacterium tuberculosis
GGVGGFSNGGATGGAGGAGGAGGL

SEQ ID NO: 1444245 - protein, 21 aa, Mycobacterium tuberculosis
GGVGGFSNGGATGGAGGAGGL

SEQ ID NO: 1444246 - protein, 13 aa, Mycobacterium tuberculosis
GGVGGLPAGVAPA

SEQ ID NO: 1444247 - protein, 24 aa, Mycobacterium tuberculosis
GGVGGVGGKGGFGGAGGAGGNGGL

SEQ ID NO: 1444248 - protein, 20 aa, Mycobacterium tuberculosis
GGVGKTTITATLGAHLCRPA

SEQ ID NO: 1444249 - protein, 7 aa, Mycobacterium tuberculosis
GGVNGAA

SEQ ID NO: 1444250 - protein, 18 aa, Mycobacterium tuberculosis
GGVNPGKHQRKRKPAPVW

SEQ ID NO: 1444251 - protein, 5 aa, Mycobacterium tuberculosis
GGVPE

SEQ ID NO: 1444252 - protein, 7 aa, Mycobacterium tuberculosis
GGVPSAY

SEQ ID NO: 1444253 - protein, 7 aa, Mycobacterium tuberculosis
GGVTNSG

SEQ ID NO: 1444254 - protein, 18 aa, Mycobacterium tuberculosis
GGVTSSSFATPLTKPTPM

SEQ ID NO: 1444255 - protein, 30 aa, Mycobacterium tuberculosis; identical to SEQ ID NO: 155247

SEQ ID NO: 1444256 - protein, 6 aa, Mycobacterium tuberculosis
GGYDTP

SEQ ID NO: 1444257 - protein, 12 aa, Mycobacterium tuberculosis
GHADGPDDAVDR

SEQ ID NO: 1444258 - protein, 15 aa, Mycobacterium tuberculosis
GHAEFEDRAATDPLE

SEQ ID NO: 1444259 - protein, 5 aa, Mycobacterium tuberculosis
GHAGA

SEQ ID NO: 1444260 - protein, 8 aa, Mycobacterium tuberculosis
GHAGAVQT

SEQ ID NO: 1444261 - protein, 5 aa, Mycobacterium tuberculosis
GHAGL

SEQ ID NO: 1444262 - protein, 15 aa, Mycobacterium tuberculosis
GHAGRSGLCGAADVC

SEQ ID NO: 1444263 - protein, 4 aa, Mycobacterium tuberculosis
GHDR

SEQ ID NO: 1444264 - protein, 6 aa, Mycobacterium tuberculosis
GHDRIN

SEQ ID NO: 1444265 - protein, 25 aa, Mycobacterium tuberculosis
GHDSNAPGGAGGSGGVGGDGGRGGL

SEQ ID NO: 1444266 - protein, 10 aa, Mycobacterium tuberculosis
GHEETEGTLG

SEQ ID NO: 1444267 - protein, 16 aa, Mycobacterium tuberculosis
GHGAPSRGLRGRPADR

SEQ ID NO: 1444268 - protein, 44 aa, Mycobacterium tuberculosis
GHGGAGGHGAEGVAGAAGEDLSPHGTSGGVGGDAGDGGAGGRGG

SEQ ID NO: 1444269 - protein, 15 aa, Mycobacterium tuberculosis
GHGGDGGTGGTGGAV

SEQ ID NO: 1444270 - protein, 20 aa, Mycobacterium tuberculosis
GHGGTGGAGGHSAQGPDDKA

SEQ ID NO: 1444271 - protein, 52 aa, Mycobacterium tuberculosis
GHGGTGGAGGHSAQGPDGNGGIGGAGGAGGNGGQLYGTGGTGGTGGKGGDGF

SEQ ID NO: 1444272 - protein, 36 aa, Mycobacterium tuberculosis
GHGGVGGPGIAGAAGTAGLPGGNGANGGSGGISGAG

SEQ ID NO: 1444273 - protein, 4 aa, Mycobacterium tuberculosis
GHGH

SEQ ID NO: 1444274 - protein, 15 aa, Mycobacterium tuberculosis
GHGKGRRRRRAGRRW

SEQ ID NO: 1444275 - protein, 38 aa, Mycobacterium tuberculosis
GHGLGSKHGQNQGGCGHRGQREVEHPQQQVGGDQGWPR

SEQ ID NO: 1444276 - protein, 11 aa, Mycobacterium tuberculosis
GHGNSTTIGAE

SEQ ID NO: 1444277 - protein, 12 aa, Mycobacterium tuberculosis
GHGRRPAGHRTG

SEQ ID NO: 1444278 - protein, 10 aa, Mycobacterium tuberculosis
GHGRRSTGTV

SEQ ID NO: 1444279 - protein, 8 aa, Mycobacterium tuberculosis
GHGRSGVP

SEQ ID NO: 1444280 - protein, 23 aa, Mycobacterium tuberculosis
GHGRSSGDLGDPGGVGEHRDGAA

SEQ ID NO: 1444281 - protein, 6 aa, Mycobacterium tuberculosis
GHHGGS

SEQ ID NO: 1444282 - protein, 5 aa, Mycobacterium tuberculosis
GHHPG

SEQ ID NO: 1444283 - protein, 11 aa, Mycobacterium tuberculosis
GHHPRREQGAD

SEQ ID NO: 1444284 - protein, 12 aa, Mycobacterium tuberculosis
GHITGGTGSAIT

SEQ ID NO: 1444285 - protein, 14 aa, Mycobacterium tuberculosis
GHLASATARGPKSA

SEQ ID NO: 1444286 - protein, 37 aa, Mycobacterium tuberculosis; identical to SEQ ID NO: 229912

SEQ ID NO: 1444287 - protein, 16 aa, Mycobacterium tuberculosis
GHPARSYRGGSGEPVR

SEQ ID NO: 1444288 - protein, 12 aa, Mycobacterium tuberculosis
GHPDPSSGTIDA

SEQ ID NO: 1444289 - protein, 7 aa, Mycobacterium tuberculosis
GHPEDRC

SEQ ID NO: 1444290 - protein, 7 aa, Mycobacterium tuberculosis
GHPGADA

SEQ ID NO: 1444291 - protein, 15 aa, Mycobacterium tuberculosis
GHPGEDAVESEPPRV

SEQ ID NO: 1444292 - protein, 14 aa, Mycobacterium tuberculosis
GHPLGATGVGAVRG

SEQ ID NO: 1444293 - protein, 15 aa, Mycobacterium tuberculosis
GHPTRGDAGGHPGQP

SEQ ID NO: 1444294 - protein, 18 aa, Mycobacterium tuberculosis
GHPVNPVSPAVERTSGRR

SEQ ID NO: 1444295 - protein, 4 aa, Mycobacterium tuberculosis
GHRG

SEQ ID NO: 1444296 - protein, 42 aa, Mycobacterium tuberculosis
GHRGGAAHAVGSRGAARSAQQFGSQVPARDRRTRGRPGHQHG

SEQ ID NO: 1444297 - protein, 41 aa, Mycobacterium tuberculosis
GHRGGAAHAVGSRGAARSAQQFGSQVPARDRRTRRRPGHQH

SEQ ID NO: 1444298 - protein, 11 aa, Mycobacterium tuberculosis
GHRPASPGSRR

SEQ ID NO: 1444299 - protein, 12 aa, Mycobacterium tuberculosis
GHRPKRGRRGPQ

SEQ ID NO: 1444300 - protein, 28 aa, Mycobacterium tuberculosis
GHRSPNTTPPALPSIPGQHGWRGSSNRR

SEQ ID NO: 1444301 - protein, 13 aa, Mycobacterium tuberculosis
GHSGAIGGVGEQV

SEQ ID NO: 1444302 - protein, 19 aa, Mycobacterium tuberculosis
GHSGALPAFGGRPVAAGSS

SEQ ID NO: 1444303 - protein, 5 aa, Mycobacterium tuberculosis
GHTGR

SEQ ID NO: 1444304 - protein, 14 aa, Mycobacterium tuberculosis
GHTNTGIANSGNVE

SEQ ID NO: 1444305 - protein, 6 aa, Mycobacterium tuberculosis
GHTPTV

SEQ ID NO: 1444306 - protein, 16 aa, Mycobacterium tuberculosis
GHVATEEDRVDTRKVT

SEQ ID NO: 1444307 - protein, 14 aa, Mycobacterium tuberculosis
GHVDDATAKGAKVI

SEQ ID NO: 1444308 - protein, 13 aa, Mycobacterium tuberculosis
GHYQGRISTPDLS

SEQ ID NO: 1444309 - protein, 35 aa, Mycobacterium tuberculosis
GIANSGTLNTGVANTGDHSSGGFNQGSDQSGFFGQ

SEQ ID NO: 1444310 - protein, 9 aa, Mycobacterium tuberculosis
GIAPGKEGI

SEQ ID NO: 1444311 - protein, 17 aa, Mycobacterium tuberculosis
GIATGAGGIGGAGGAGG

SEQ ID NO: 1444312 - protein, 17 aa, Mycobacterium tuberculosis
GIDPTGLRGSAHWGIRP

SEQ ID NO: 1444313 - protein, 9 aa, Mycobacterium tuberculosis
GIGGAGGRS

SEQ ID NO: 1444314 - protein, 10 aa, Mycobacterium tuberculosis
GIGGAGGRSG

SEQ ID NO: 1444315 - protein, 31 aa, Mycobacterium tuberculosis
GIGGTGGTGLGAPDPGGTGGKGGVGGIGGAG

SEQ ID NO: 1444316 - protein, 4 aa, Mycobacterium tuberculosis
GIGP

SEQ ID NO: 1444317 - protein, 15 aa, Mycobacterium tuberculosis
GIGPARLDKLRNLVR

SEQ ID NO: 1444318 - protein, 13 aa, Mycobacterium tuberculosis
GIGPDRGHQGAPQ

SEQ ID NO: 1444319 - protein, 7 aa, Mycobacterium tuberculosis
GIGTGKT

SEQ ID NO: 1444320 - protein, 6 aa, Mycobacterium tuberculosis
GINPHD

SEQ ID NO: 1444321 - protein, 7 aa, Mycobacterium tuberculosis
GIPARSD

SEQ ID NO: 1444322 - protein, 17 aa, Mycobacterium tuberculosis
GIPGQRNERHRRRRDLD

SEQ ID NO: 1444323 - protein, 13 aa, Mycobacterium tuberculosis
GIPGSAGATPVQN

SEQ ID NO: 1444324 - protein, 6 aa, Mycobacterium tuberculosis
GIPPGT

SEQ ID NO: 1444325 - protein, 6 aa, Mycobacterium tuberculosis
GIPRRA

SEQ ID NO: 1444326 - protein, 12 aa, Mycobacterium tuberculosis
GIPVDDPDGLPA

SEQ ID NO: 1444327 - protein, 28 aa, Mycobacterium tuberculosis
GIQGVGGSGGKGGAGGLAGDGGNGANGN

SEQ ID NO: 1444328 - protein, 5 aa, Mycobacterium tuberculosis
GIRTD

SEQ ID NO: 1444329 - protein, 11 aa, Mycobacterium tuberculosis
GITADSDPDAE

SEQ ID NO: 1444330 - protein, 15 aa, Mycobacterium tuberculosis
GITDQNGDEPPRTSD

SEQ ID NO: 1444331 - protein, 6 aa, Mycobacterium tuberculosis
GITEPD

SEQ ID NO: 1444332 - protein, 12 aa, Mycobacterium tuberculosis
GITGSDGASHNG

SEQ ID NO: 1444333 - protein, 7 aa, Mycobacterium tuberculosis
GKANRAA

SEQ ID NO: 1444334 - protein, 10 aa, Mycobacterium tuberculosis
GKANVEGVDP

SEQ ID NO: 1444335 - protein, 9 aa, Mycobacterium tuberculosis
GKAPLGGGL

SEQ ID NO: 1444336 - protein, 8 aa, Mycobacterium tuberculosis
GKAPYGAP

SEQ ID NO: 1444337 - protein, 15 aa, Mycobacterium tuberculosis
GKAQAGMASSRSQLG

SEQ ID NO: 1444338 - protein, 9 aa, Mycobacterium tuberculosis
GKDGQNARL

SEQ ID NO: 1444339 - protein, 16 aa, Mycobacterium tuberculosis
GKDVQNPAAHSELAAP

SEQ ID NO: 1444340 - protein, 9 aa, Mycobacterium tuberculosis
GKEEESAQT

SEQ ID NO: 1444341 - protein, 12 aa, Mycobacterium tuberculosis
GKELDRSAAEEP

SEQ ID NO: 1444342 - protein, 5 aa, Mycobacterium tuberculosis
GKFET

SEQ ID NO: 1444343 - protein, 41 aa, Mycobacterium tuberculosis
GKGGAGANGGSSNGNARGGNAGNGGHGGAGGSGDTGRRRRR

SEQ ID NO: 1444344 - protein, 21 aa, Mycobacterium tuberculosis
GKGGDGGKRGHRRHRRGVGRR

SEQ ID NO: 1444345 - protein, 23 aa, Mycobacterium tuberculosis
GKGGSADESSSGCTGGSGGNGGA

SEQ ID NO: 1444346 - protein, 10 aa, Mycobacterium tuberculosis
GKGGTGKSTI

SEQ ID NO: 1444347 - protein, 6 aa, Mycobacterium tuberculosis
GKIAGN

SEQ ID NO: 1444348 - protein, 23 aa, Mycobacterium tuberculosis
GKKGDGGAGGFGAGTGGYGGVGG

SEQ ID NO: 1444349 - protein, 11 aa, Mycobacterium tuberculosis
GKLNNKPDAAA

SEQ ID NO: 1444350 - protein, 4 aa, Mycobacterium tuberculosis
GKNA

SEQ ID NO: 1444351 - protein, 9 aa, Mycobacterium tuberculosis
GKNKDRDQG

SEQ ID NO: 1444352 - protein, 17 aa, Mycobacterium tuberculosis
GKPARVAPGRLRPRSPR

SEQ ID NO: 1444353 - protein, 8 aa, Mycobacterium tuberculosis
GKPISPAQ

SEQ ID NO: 1444354 - protein, 10 aa, Mycobacterium tuberculosis
GKPQLGRSGW

SEQ ID NO: 1444355 - protein, 15 aa, Mycobacterium tuberculosis
GKPTDQLPGPGPPAH

SEQ ID NO: 1444356 - protein, 6 aa, Mycobacterium tuberculosis
GKPYPA

SEQ ID NO: 1444357 - protein, 7 aa, Mycobacterium tuberculosis
GKQALSA

SEQ ID NO: 1444358 - protein, 18 aa, Mycobacterium tuberculosis
GKQARDKRQDMARRDAQR

SEQ ID NO: 1444359 - protein, 11 aa, Mycobacterium tuberculosis
GKQYSSGGGAV

SEQ ID NO: 1444360 - protein, 7 aa, Mycobacterium tuberculosis
GKRAPMG

SEQ ID NO: 1444361 - protein, 26 aa, Mycobacterium tuberculosis
GKRIQAAGGAVRTRVGDRSRAAGRRA

SEQ ID NO: 1444362 - protein, 25 aa, Mycobacterium tuberculosis
GKRKAGHAPVQPADEHVRPEDTVVA

SEQ ID NO: 1444363 - protein, 7 aa, Mycobacterium tuberculosis
GKRPTPL

SEQ ID NO: 1444364 - protein, 23 aa, Mycobacterium tuberculosis
GKSPGNTPAAPVRPTSTTYPGHS

SEQ ID NO: 1444365 - protein, 7 aa, Mycobacterium tuberculosis
GKSSNVG

SEQ ID NO: 1444366 - protein, 4 aa, Mycobacterium tuberculosis
GKST

SEQ ID NO: 1444367 - protein, 23 aa, Mycobacterium tuberculosis
GKSTGRVRHGTGRPKAHCYWACG

SEQ ID NO: 1444368 - protein, 5 aa, Mycobacterium tuberculosis
GKSYL

SEQ ID NO: 1444369 - protein, 9 aa, Mycobacterium tuberculosis
GKTAEAAAH

SEQ ID NO: 1444370 - protein, 7 aa, Mycobacterium tuberculosis
GKTCEGV

SEQ ID NO: 1444371 - protein, 17 aa, Mycobacterium tuberculosis
GKTTKTPAGDAVNDYRA

SEQ ID NO: 1444372 - protein, 11 aa, Mycobacterium tuberculosis
GLAAGNAATMP

SEQ ID NO: 1444373 - protein, 5 aa, Mycobacterium tuberculosis
GLADG

SEQ ID NO: 1444374 - protein, 9 aa, Mycobacterium tuberculosis
GLAESAAQL

SEQ ID NO: 1444375 - protein, 9 aa, Mycobacterium tuberculosis
GLAETAQEI

SEQ ID NO: 1444376 - protein, 4 aa, Mycobacterium tuberculosis
GLAG

SEQ ID NO: 1444377 - protein, 23 aa, Mycobacterium tuberculosis
GLAGGVRAAAGQGPRAGDKPRCD

SEQ ID NO: 1444378 - protein, 7 aa, Mycobacterium tuberculosis
GLAKPAG

SEQ ID NO: 1444379 - protein, 9 aa, Mycobacterium tuberculosis
GLASDNPTT

SEQ ID NO: 1444380 - protein, 11 aa, Mycobacterium tuberculosis
GLDRPAATHRP

SEQ ID NO: 1444381 - protein, 11 aa, Mycobacterium tuberculosis
GLEKDPAIHDN

SEQ ID NO: 1444382 - protein, 6 aa, Mycobacterium tuberculosis
GLEPAS

SEQ ID NO: 1444383 - protein, 9 aa, Mycobacterium tuberculosis
GLESSTISC

SEQ ID NO: 1444384 - protein, 10 aa, Mycobacterium tuberculosis
GLGAGRRRDR

SEQ ID NO: 1444385 - protein, 5 aa, Mycobacterium tuberculosis
GLGAP

SEQ ID NO: 1444386 - protein, 7 aa, Mycobacterium tuberculosis
GLGDVNG

SEQ ID NO: 1444387 - protein, 26 aa, Mycobacterium tuberculosis
GLGGAASSQLLPAGGARGLAGRPRRA

SEQ ID NO: 1444388 - protein, 9 aa, Mycobacterium tuberculosis
GLGGAGGAG

SEQ ID NO: 1444389 - protein, 29 aa, Mycobacterium tuberculosis
GLGGAGPDRAGGAVGGVGGVGGRAGSAGI

SEQ ID NO: 1444390 - protein, 21 aa, Mycobacterium tuberculosis
GLGGGSNGTGGAGGAGGTGAT

SEQ ID NO: 1444391 - protein, 7 aa, Mycobacterium tuberculosis
GLGGHPR

SEQ ID NO: 1444392 - protein, 8 aa, Mycobacterium tuberculosis
GLGGHPRL

SEQ ID NO: 1444393 - protein, 10 aa, Mycobacterium tuberculosis
GLGGPGREHE

SEQ ID NO: 1444394 - protein, 16 aa, Mycobacterium tuberculosis
GLGGRRGRRRQGAGLS

SEQ ID NO: 1444395 - protein, 5 aa, Mycobacterium tuberculosis
GLGHP

SEQ ID NO: 1444396 - protein, 8 aa, Mycobacterium tuberculosis
GLGMTDAD

SEQ ID NO: 1444397 - protein, 8 aa, Mycobacterium tuberculosis
GLGPEARY

SEQ ID NO: 1444398 - protein, 19 aa, Mycobacterium tuberculosis
GLGPGQAGHQQRGADPVQT

SEQ ID NO: 1444399 - protein, 5 aa, Mycobacterium tuberculosis
GLGPV

SEQ ID NO: 1444400 - protein, 4 aa, Mycobacterium tuberculosis
GLGR

SEQ ID NO: 1444401 - protein, 45 aa, Mycobacterium tuberculosis
GLGRGQPGSHPGGAGAAADQPDQRRGKRARADAGRAAGGADGRQG

SEQ ID NO: 1444402 - protein, 12 aa, Mycobacterium tuberculosis
GLGSGGAKGCPK

SEQ ID NO: 1444403 - protein, 22 aa, Mycobacterium tuberculosis
GLGTAEGRGRRAAPRKRSAGAG

SEQ ID NO: 1444404 - protein, 22 aa, Mycobacterium tuberculosis
GLKAPTADDEALPLSDEPPPRA

SEQ ID NO: 1444405 - protein, 4 aa, Mycobacterium tuberculosis
GLLP

SEQ ID NO: 1444406 - protein, 20 aa, Mycobacterium tuberculosis
GLNGSGGDGGDGGNGAPGGV

SEQ ID NO: 1444407 - protein, 29 aa, Mycobacterium tuberculosis
GLNKDELGSTHHASTRRQFGAPGSVVKPS

SEQ ID NO: 1444408 - protein, 11 aa, Mycobacterium tuberculosis
GLNPGPRSTDP

SEQ ID NO: 1444409 - protein, 18 aa, Mycobacterium tuberculosis
GLNSGNNNIGFGNSGNNN

SEQ ID NO: 1444410 - protein, 8 aa, Mycobacterium tuberculosis
GLNSGRGN

SEQ ID NO: 1444411 - protein, 11 aa, Mycobacterium tuberculosis
GLPAGRSGCSA

SEQ ID NO: 1444412 - protein, 8 aa, Mycobacterium tuberculosis
GLPAGTLD

SEQ ID NO: 1444413 - protein, 10 aa, Mycobacterium tuberculosis
GLPASKSDLP

SEQ ID NO: 1444414 - protein, 8 aa, Mycobacterium tuberculosis
GLPGGLPD

SEQ ID NO: 1444415 - protein, 9 aa, Mycobacterium tuberculosis
GLPGRGAAT

SEQ ID NO: 1444416 - protein, 6 aa, Mycobacterium tuberculosis
GLPPGM

SEQ ID NO: 1444417 - protein, 7 aa, Mycobacterium tuberculosis
GLPPIAP

SEQ ID NO: 1444418 - protein, 13 aa, Mycobacterium tuberculosis
GLPPPTTSSGIDA

SEQ ID NO: 1444419 - protein, 14 aa, Mycobacterium tuberculosis
GLPQDDPELKTYDS

SEQ ID NO: 1444420 - protein, 4 aa, Mycobacterium tuberculosis
GLPR

SEQ ID NO: 1444421 - protein, 18 aa, Mycobacterium tuberculosis
GLPSGEAVPPPYLSILFH

SEQ ID NO: 1444422 - protein, 29 aa, Mycobacterium tuberculosis
GLPSGGGGRGRGVRARPGGGGPRPPIPAP

SEQ ID NO: 1444423 - protein, 9 aa, Mycobacterium tuberculosis
GLPSGRRRY

SEQ ID NO: 1444424 - protein, 7 aa, Mycobacterium tuberculosis
GLQAERT

SEQ ID NO: 1444425 - protein, 6 aa, Mycobacterium tuberculosis
GLQEKP

SEQ ID NO: 1444426 - protein, 7 aa, Mycobacterium tuberculosis
GLQPGGQ

SEQ ID NO: 1444427 - protein, 8 aa, Mycobacterium tuberculosis
GLQPSQQR

SEQ ID NO: 1444428 - protein, 11 aa, Mycobacterium tuberculosis
GLQTQTADTAQ

SEQ ID NO: 1444429 - protein, 29 aa, Mycobacterium tuberculosis
GLRARSSTAGSGGSGGPGGNGGTGDTAGT

SEQ ID NO: 1444430 - protein, 13 aa, Mycobacterium tuberculosis
GLRDRRTDPGRSW

SEQ ID NO: 1444431 - protein, 5 aa, Mycobacterium tuberculosis
GLRPD

SEQ ID NO: 1444432 - protein, 32 aa, Mycobacterium tuberculosis
GLRPDTPVASGQLSSTSIRSRRSGISKAQRET

SEQ ID NO: 1444433 - protein, 9 aa, Mycobacterium tuberculosis
GLRSPDTAR

SEQ ID NO: 1444434 - protein, 13 aa, Mycobacterium tuberculosis
GLRTRSGPAAAGH

SEQ ID NO: 1444435 - protein, 9 aa, Mycobacterium tuberculosis
GLSDDERAQ

SEQ ID NO: 1444436 - protein, 10 aa, Mycobacterium tuberculosis
GLSNATPREV

SEQ ID NO: 1444437 - protein, 4 aa, Mycobacterium tuberculosis
GLSP

SEQ ID NO: 1444438 - protein, 19 aa, Mycobacterium tuberculosis
GLSPERRCGSGGRFVSAKV

SEQ ID NO: 1444439 - protein, 14 aa, Mycobacterium tuberculosis
GLSSAKSKPEGDFG

SEQ ID NO: 1444440 - protein, 16 aa, Mycobacterium tuberculosis
GLSTMRPKSSTRQRTC

SEQ ID NO: 1444441 - protein, 11 aa, Mycobacterium tuberculosis
GLTELSEEAGM

SEQ ID NO: 1444442 - protein, 4 aa, Mycobacterium tuberculosis
GLTG

SEQ ID NO: 1444443 - protein, 5 aa, Mycobacterium tuberculosis
GLTNG

SEQ ID NO: 1444444 - protein, 5 aa, Mycobacterium tuberculosis
GLTRN

SEQ ID NO: 1444445 - protein, 6 aa, Mycobacterium tuberculosis
GLTSPE

SEQ ID NO: 1444446 - protein, 29 aa, Mycobacterium tuberculosis
GLVGEGGNGGDGGATIAGKGGSGGNGGNA

SEQ ID NO: 1444447 - protein, 7 aa, Mycobacterium tuberculosis
GLYPPGS

SEQ ID NO: 1444448 - protein, 10 aa, Mycobacterium tuberculosis
GMAGDDPAGA

SEQ ID NO: 1444449 - protein, 9 aa, Mycobacterium tuberculosis
GMAGGSADA

SEQ ID NO: 1444450 - protein, 25 aa, Mycobacterium tuberculosis
GMAPPGSGTWPPRSCPKPPRSWTST

SEQ ID NO: 1444451 - protein, 48 aa, Mycobacterium tuberculosis; identical to SEQ ID NO: 194178

SEQ ID NO: 1444452 - protein, 6 aa, Mycobacterium tuberculosis
GMEDDA

SEQ ID NO: 1444453 - protein, 13 aa, Mycobacterium tuberculosis
GMGGAGGAGGAGG

SEQ ID NO: 1444454 - protein, 14 aa, Mycobacterium tuberculosis
GMGGNGGATSVGGT

SEQ ID NO: 1444455 - protein, 12 aa, Mycobacterium tuberculosis
GMPRQAGRWSPT

SEQ ID NO: 1444456 - protein, 13 aa, Mycobacterium tuberculosis
GMRPCGADRDRPA

SEQ ID NO: 1444457 - protein, 9 aa, Mycobacterium tuberculosis
GMRRGDAVT

SEQ ID NO: 1444458 - protein, 11 aa, Mycobacterium tuberculosis
GMSGDSSSWKG

SEQ ID NO: 1444459 - protein, 23 aa, Mycobacterium tuberculosis
GNAATNLERPGEEPPGDRCTRRQ

SEQ ID NO: 1444460 - protein, 37 aa, Mycobacterium tuberculosis
GNAGAGGRAGAGGNGASAGTAGGSGGDGGKGGNGGSV

SEQ ID NO: 1444461 - protein, 37 aa, Mycobacterium tuberculosis
GNAGAGGSAGAGGNGASAGTAGGSGDDGGKGGNGGSV

SEQ ID NO: 1444462 - protein, 9 aa, Mycobacterium tuberculosis
GNAGNNNFG

SEQ ID NO: 1444463 - protein, 153 aa, Mycobacterium tuberculosis
GNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGNGGAGGKALSPTGNNGSQGAGGDGGAGGAGGTGDTGGDGGRGAHG

SEQ ID NO: 1444464 - protein, 9 aa, Mycobacterium tuberculosis
GNAGSSNYG

SEQ ID NO: 1444465 - protein, 19 aa, Mycobacterium tuberculosis
GNAGTGNWGIGNSGAGNFG

SEQ ID NO: 1444466 - protein, 22 aa, Mycobacterium tuberculosis
GNAQHRRRQRGQCQHRRPHHGQ

SEQ ID NO: 1444467 - protein, 13 aa, Mycobacterium tuberculosis
GNARADRARNTYT

SEQ ID NO: 1444468 - protein, 5 aa, Mycobacterium tuberculosis
GNATL

SEQ ID NO: 1444469 - protein, 15 aa, Mycobacterium tuberculosis
GNAVPTAELVKVAGR

SEQ ID NO: 1444470 - protein, 23 aa, Mycobacterium tuberculosis
GNCTGPPRTSRWTGSAHSPQRPP

SEQ ID NO: 1444471 - protein, 4 aa, Mycobacterium tuberculosis
GNCY

SEQ ID NO: 1444472 - protein, 8 aa, Mycobacterium tuberculosis
GNDDNRIN

SEQ ID NO: 1444473 - protein, 39 aa, Mycobacterium tuberculosis
GNDDNVTGGGATTGQASAKVDCGGKKTLKASGSTAQANA

SEQ ID NO: 1444474 - protein, 10 aa, Mycobacterium tuberculosis
GNDGDGSTVG

SEQ ID NO: 1444475 - protein, 18 aa, Mycobacterium tuberculosis
GNGADGAAGTGQAGEAGG

SEQ ID NO: 1444476 - protein, 18 aa, Mycobacterium tuberculosis
GNGADGAAGTGQAGGAGG

SEQ ID NO: 1444477 - protein, 21 aa, Mycobacterium tuberculosis
GNGADGGAGDWAAAGPGGSCT

SEQ ID NO: 1444478 - protein, 18 aa, Mycobacterium tuberculosis
GNGANGAPGTGADGAPGG

SEQ ID NO: 1444479 - protein, 18 aa, Mycobacterium tuberculosis
GNGANGAPGTGANGAPGG

SEQ ID NO: 1444480 - protein, 4 aa, Mycobacterium tuberculosis
GNGG

SEQ ID NO: 1444481 - protein, 27 aa, Mycobacterium tuberculosis
GNGGAGGAGASNQAGNGGAGGNGGAGG

SEQ ID NO: 1444482 - protein, 34 aa, Mycobacterium tuberculosis
GNGGAGGAGGAGGAGGGAGGVGGAGGAPGTGGTL

SEQ ID NO: 1444483 - protein, 33 aa, Mycobacterium tuberculosis
GNGGAGGAGGAGGAGGRGGDGGSAGWLSGNGGD

SEQ ID NO: 1444484 - protein, 16 aa, Mycobacterium tuberculosis
GNGGAGGAGGDGKGNG

SEQ ID NO: 1444485 - protein, 22 aa, Mycobacterium tuberculosis
GNGGAGGAGGDGPGNGAAGGAG

SEQ ID NO: 1444486 - protein, 27 aa, Mycobacterium tuberculosis
GNGGAGGAGGDGPGNGAAGGPAGPAGC

SEQ ID NO: 1444487 - protein, 29 aa, Mycobacterium tuberculosis
GNGGAGGAGGDGPTNGATRSTPVTNEVAS

SEQ ID NO: 1444488 - protein, 13 aa, Mycobacterium tuberculosis
GNGGAGGAGGNVA

SEQ ID NO: 1444489 - protein, 26 aa, Mycobacterium tuberculosis
GNGGAGGAGGNVASGTAGFGGAGGAG

SEQ ID NO: 1444490 - protein, 27 aa, Mycobacterium tuberculosis
GNGGAGGAGGNVASGTAGFGGAGGTGG

SEQ ID NO: 1444491 - protein, 25 aa, Mycobacterium tuberculosis
GNGGAGGAGGSVTAGAAGAGGNGGA

SEQ ID NO: 1444492 - protein, 33 aa, Mycobacterium tuberculosis
GNGGAGGAGGTATANNGIGGAGGAGGSAMLFGA

SEQ ID NO: 1444493 - protein, 31 aa, Mycobacterium tuberculosis
GNGGAGGAGGTATANNGIGGAGGAGGSVCPL

SEQ ID NO: 1444494 - protein, 31 aa, Mycobacterium tuberculosis
GNGGAGGANIAGGNGSDGGAAGHGGAGGSAR

SEQ ID NO: 1444495 - protein, 68 aa, Mycobacterium tuberculosis
GNGGAGGNGGTAGQGGDGGTALGAGGIGGDGGTGGAGGTGGTAGIGGSSAGAGGAGGDAAPAAPAAAA

SEQ ID NO: 1444496 - protein, 60 aa, Mycobacterium tuberculosis
GNGGAGGNGGTAGQGGDGGTALGAGGIGGDGGTGGAGGTGGTAGIGGSSAGVAGSGDANE

SEQ ID NO: 1444497 - protein, 71 aa, Mycobacterium tuberculosis
GNGGAGGNGGTAGQGGDGGTALGAGGIGGDGGTGGAGGTGGTAGTGGGSSMIGGKGGTGGNGGVGGPAAPA

SEQ ID NO: 1444498 - protein, 16 aa, Mycobacterium tuberculosis
GNGGAGGSGAPGQAGG

SEQ ID NO: 1444499 - protein, 17 aa, Mycobacterium tuberculosis
GNGGAGGSGAPGQAGGP

SEQ ID NO: 1444500 - protein, 35 aa, Mycobacterium tuberculosis
GNGGAGGSGGSGAPGSVSSGGVGGAGNPGGSGGNG

SEQ ID NO: 1444501 - protein, 43 aa, Mycobacterium tuberculosis
GNGGAGGSGGSGAPGSVSSGGVGGAGNPGGSGGNGGVWYGNGG

SEQ ID NO: 1444502 - protein, 29 aa, Mycobacterium tuberculosis
GNGGAGGSGGSGAPGSVSSGGVGGAGNPW

SEQ ID NO: 1444503 - protein, 35 aa, Mycobacterium tuberculosis
GNGGAGGSGGSGAPGSVSSGGVGGAGNTRRQRRHR

SEQ ID NO: 1444504 - protein, 26 aa, Mycobacterium tuberculosis
GNGGDGGSSTVAAGGAGGNTLVGNGG

SEQ ID NO: 1444505 - protein, 42 aa, Mycobacterium tuberculosis
GNGGDGGSSTVAAGGAGGNTLVGNGGAGGAGGTSGLTGSGVA

SEQ ID NO: 1444506 - protein, 50 aa, Mycobacterium tuberculosis
GNGGDGGSSTVAAGGAGGNTLVGNGGAGGAGGTSGLTGSGVAGGAGGSVV

SEQ ID NO: 1444507 - protein, 84 aa, Mycobacterium tuberculosis; identical to SEQ ID NO: 194181

SEQ ID NO: 1444508 - protein, 6 aa, Mycobacterium tuberculosis
GNGGGA

SEQ ID NO: 1444509 - protein, 32 aa, Mycobacterium tuberculosis
GNGGGTDGNGGNGGSGGGAGSGGDGGGAGGNG

SEQ ID NO: 1444510 - protein, 9 aa, Mycobacterium tuberculosis
GNGGIGGSA

SEQ ID NO: 1444511 - protein, 57 aa, Mycobacterium tuberculosis
GNGGLGGAGRDGGAPGGDGGDGGTGGSGGFGAPPPRSIGGGDGGDGGRGGDGGRGAV

SEQ ID NO: 1444512 - protein, 5 aa, Mycobacterium tuberculosis
GNGGN

SEQ ID NO: 1444513 - protein, 20 aa, Mycobacterium tuberculosis
GNGGNAGKAGGTAGAGGAGG

SEQ ID NO: 1444514 - protein, 23 aa, Mycobacterium tuberculosis
GNGGNGAAGGERGDCRRQRRGGR

SEQ ID NO: 1444515 - protein, 46 aa, Mycobacterium tuberculosis
GNGGNGAAGGPNQAGGAGGNAGLIGNGGAGGAGGIGAVGGKGGTGG

SEQ ID NO: 1444516 - protein, 11 aa, Mycobacterium tuberculosis
GNGGNGAAGVN

SEQ ID NO: 1444517 - protein, 55 aa, Mycobacterium tuberculosis
GNGGNGAAGVNAGIAGGSGGAAGLIGNGGSGGAGGAGAAGGSGGQGGLLYGNGGA

SEQ ID NO: 1444518 - protein, 77 aa, Mycobacterium tuberculosis
  misc_feature (57)..(57): Xaa can be any naturally occurring amino acid
GNGGNGAAGVNAGIAGGSGGAAGLIGNGGSGGAGGAGAAGGSGGQGGLLYGNGGAGXNGGAATIPGGNGGAGGAGGN

SEQ ID NO: 1444519 - protein, 39 aa, Mycobacterium tuberculosis
GNGGNGAAGVNAGIAGGSGGAAGLIGNGGSGGARRSRCG

SEQ ID NO: 1444520 - protein, 20 aa, Mycobacterium tuberculosis
GNGGNGAKAGGTPGAGGTSG

SEQ ID NO: 1444521 - protein, 176 aa, Mycobacterium tuberculosis
GNGGNGASPTVAGGNGGDGGKGGSGGNVGNGGNGGAGGNGAAGQAGTPGPTSGDSGTSGTDGGAGGNGGAGGAGGTLAGHGGNGGKGGNGGQGGIGGAGERGADGAGPNANGANGENGGSGGNGGDGGAGGNGGAGGKAQAAGYTDGATGTGGDGGNGGDGGKAGDGGAGENGLNS

SEQ ID NO: 1444522 - protein, 32 aa, Mycobacterium tuberculosis
GNGGNGDNGGNSGNAGKSGGAPGHRGAGGAGG

SEQ ID NO: 1444523 - protein, 14 aa, Mycobacterium tuberculosis
GNGGNGFSQTTPGS

SEQ ID NO: 1444524 - protein, 11 aa, Mycobacterium tuberculosis
GNGGNGGAGGI

SEQ ID NO: 1444525 - protein, 53 aa, Mycobacterium tuberculosis; identical to SEQ ID NO: 176417

SEQ ID NO: 1444526 - protein, 26 aa, Mycobacterium tuberculosis
GNGGNGGNAGSGGGTGFEGSTGQGGA

SEQ ID NO: 1444527 - protein, 25 aa, Mycobacterium tuberculosis
GNGGNGGNAGSGGGTGLRRQRRPGW

SEQ ID NO: 1444528 - protein, 35 aa, Mycobacterium tuberculosis
GNGGNGGNGGIGQPGGAGGDAGLIGNGGNGGIGGP

SEQ ID NO: 1444529 - protein, 29 aa, Mycobacterium tuberculosis
GNGGNGGNGGIGQPGGAGGDAGLIGNSGN

SEQ ID NO: 1444530 - protein, 31 aa, Mycobacterium tuberculosis
GNGGNGGNGGNSVNVGKSGGCTRPKRRRRRR

SEQ ID NO: 1444531 - protein, 23 aa, Mycobacterium tuberculosis
GNGGNGGSGAAGQARGAGGPAGL

SEQ ID NO: 1444532 - protein, 38 aa, Mycobacterium tuberculosis
GNGGNGGSGAPGQAGGAGGAAGLIGNGGAGGAGGQGLP

SEQ ID NO: 1444533 - protein, 17 aa, Mycobacterium tuberculosis
GNGGNGGSGASGQAGGA

SEQ ID NO: 1444534 - protein, 13 aa, Mycobacterium tuberculosis
GNGGNGGSGATGQ

SEQ ID NO: 1444535 - protein, 14 aa, Mycobacterium tuberculosis
GNGGNGGSGATGQA

SEQ ID NO: 1444536 - protein, 78 aa, Mycobacterium tuberculosis
GNGGNGGSGGNGGNAGMGGNSGTGSGDGGAGGNGGVGGHGRHRRRRRPTGTACTGGSGGTGGDGGNGGNRSRNTGARL

SEQ ID NO: 1444537 - protein, 24 aa, Mycobacterium tuberculosis
GNGGNGGSGGVGQAGGAGGSAGLI

SEQ ID NO: 1444538 - protein, 23 aa, Mycobacterium tuberculosis
GNGGNGGSGGVNQAGGNGGNAGL

SEQ ID NO: 1444539 - protein, 53 aa, Mycobacterium tuberculosis
GNGGNGGSGGVNQAGGNGGNAGLWGNGGSGGAGGNATTAGRNGFNGGAGGSGG

SEQ ID NO: 1444540 - protein, 23 aa, Mycobacterium tuberculosis
GNGGNGGSGVAGVGGPGGSGGAA

SEQ ID NO: 1444541 - protein, 47 aa, Mycobacterium tuberculosis
GNGGNGGSSSTPAQPGGRGGAAGLIGNGGSGGAGGPGANGGAGGNGG

SEQ ID NO: 1444542 - protein, 22 aa, Mycobacterium tuberculosis
GNGGNGGSSSTPGQPGGRGGAA

SEQ ID NO: 1444543 - protein, 27 aa, Mycobacterium tuberculosis
GNGGNGGSSSTPGQPGGRGGAAGLIGN

SEQ ID NO: 1444544 - protein, 25 aa, Mycobacterium tuberculosis
GNGGNGGSSSTPGQPGGRGRRGRVD

SEQ ID NO: 1444545 - protein, 15 aa, Mycobacterium tuberculosis
GNGGNGRALRDTNTS

SEQ ID NO: 1444546 - protein, 32 aa, Mycobacterium tuberculosis
GNGGPGAPGGHGGIGGAGAPGALGDDAGERVV

SEQ ID NO: 1444547 - protein, 20 aa, Mycobacterium tuberculosis
GNGGPGNSGEAGGAGGAGGH

SEQ ID NO: 1444548 - protein, 77 aa, Mycobacterium tuberculosis
GNGGQGGAGGTGGDHSGGNGIGGKGGASGNGGNAGQVFGDGGTGGTGGAGGAGSGTKAGGTGSDGGHGGNATFDRQR

SEQ ID NO: 1444549 - protein, 72 aa, Mycobacterium tuberculosis
GNGGQGGAGGTGGDHSGGNGIGGKGGASGNGGNAGQVSAVGGSGGTGGAGGAGSGTKAGGPGSVGGHGGNAT

SEQ ID NO: 1444550 - protein, 33 aa, Mycobacterium tuberculosis
GNGGQSGAGGTGGDHSGGNGIGGKGRCQRKRRQ

SEQ ID NO: 1444551 - protein, 21 aa, Mycobacterium tuberculosis
GNGGSDSDGGPNQFGDEESTI

SEQ ID NO: 1444552 - protein, 23 aa, Mycobacterium tuberculosis
GNGGSGGSGGAGAAGGVGGSGGW

SEQ ID NO: 1444553 - protein, 18 aa, Mycobacterium tuberculosis
GNGGTGANAGSPGTGGAG

SEQ ID NO: 1444554 - protein, 22 aa, Mycobacterium tuberculosis
GNGGTGGVEGTSAAGGAGGTGG

SEQ ID NO: 1444555 - protein, 13 aa, Mycobacterium tuberculosis
GNGHEEGLGDDHG

SEQ ID NO: 1444556 - protein, 4 aa, Mycobacterium tuberculosis
GNGP

SEQ ID NO: 1444557 - protein, 21 aa, Mycobacterium tuberculosis
GNGRARRTPTSGPGGYVGAAR

SEQ ID NO: 1444558 - protein, 21 aa, Mycobacterium tuberculosis
GNGRLSGDWGGGCGYQGGFGL

SEQ ID NO: 1444559 - protein, 27 aa, Mycobacterium tuberculosis
GNGSAADQLHSPTARPGNQTGGLARRG

SEQ ID NO: 1444560 - protein, 10 aa, Mycobacterium tuberculosis
GNGSKGLPGL

SEQ ID NO: 1444561 - protein, 16 aa, Mycobacterium tuberculosis
GNGTDGSTPGQAGGHG

SEQ ID NO: 1444562 - protein, 18 aa, Mycobacterium tuberculosis
GNGTNGAPGDGQAGGPGG

SEQ ID NO: 1444563 - protein, 12 aa, Mycobacterium tuberculosis
GNGTNGAPGTGE

SEQ ID NO: 1444564 - protein, 19 aa, Mycobacterium tuberculosis
GNGTNGAPGTRPGPAGPGG

SEQ ID NO: 1444565 - protein, 30 aa, Mycobacterium tuberculosis
GNGVTGGAGGNGGTVGAGAPGGAGDAGGIA

SEQ ID NO: 1444566 - protein, 7 aa, Mycobacterium tuberculosis
GNHGGTH

SEQ ID NO: 1444567 - protein, 5 aa, Mycobacterium tuberculosis
GNKEV

SEQ ID NO: 1444568 - protein, 4 aa, Mycobacterium tuberculosis
GNLN

SEQ ID NO: 1444569 - protein, 9 aa, Mycobacterium tuberculosis
GNMGSTNTG

SEQ ID NO: 1444570 - protein, 25 aa, Mycobacterium tuberculosis
GNMSGPTGNSMPRQLGGRVAKNWWL

SEQ ID NO: 1444571 - protein, 14 aa, Mycobacterium tuberculosis
GNMSGSGNFGAGNS

SEQ ID NO: 1444572 - protein, 8 aa, Mycobacterium tuberculosis
GNPAAGER

SEQ ID NO: 1444573 - protein, 34 aa, Mycobacterium tuberculosis
GNPGNGGVGGIGGDAAAGGAGGAGGNGGAGGNGG

SEQ ID NO: 1444574 - protein, 13 aa, Mycobacterium tuberculosis
GNPSKVTDTRMVH

SEQ ID NO: 1444575 - protein, 15 aa, Mycobacterium tuberculosis
GNQCPISDPAQRHND

SEQ ID NO: 1444576 - protein, 19 aa, Mycobacterium tuberculosis
GNQRNTGSMNRPGESGDSL

SEQ ID NO: 1444577 - protein, 5 aa, Mycobacterium tuberculosis
GNQTT

SEQ ID NO: 1444578 - protein, 12 aa, Mycobacterium tuberculosis
GNRGQTNYATTK

SEQ ID NO: 1444579 - protein, 5 aa, Mycobacterium tuberculosis
GNRQI

SEQ ID NO: 1444580 - protein, 26 aa, Mycobacterium tuberculosis
GNRQRPRRFDPPGRRRPRPPIPAPAM

SEQ ID NO: 1444581 - protein, 23 aa, Mycobacterium tuberculosis
GNRRDRGGRRGPARSVGVRRQRG

SEQ ID NO: 1444582 - protein, 6 aa, Mycobacterium tuberculosis
GNRRGV

SEQ ID NO: 1444583 - protein, 19 aa, Mycobacterium tuberculosis
GNRSNRRGRGRDRGGHHAG

SEQ ID NO: 1444584 - protein, 4 aa, Mycobacterium tuberculosis
GNRV

SEQ ID NO: 1444585 - protein, 20 aa, Mycobacterium tuberculosis
GNSATSYNTGIGNTGQANTG

SEQ ID NO: 1444586 - protein, 41 aa, Mycobacterium tuberculosis; identical to SEQ ID NO: 229990

SEQ ID NO: 1444587 - protein, 14 aa, Mycobacterium tuberculosis
GNSGGQGGTPRAVP

SEQ ID NO: 1444588 - protein, 5 aa, Mycobacterium tuberculosis
GNSGI

SEQ ID NO: 1444589 - protein, 5 aa, Mycobacterium tuberculosis
GNSGL

SEQ ID NO: 1444590 - protein, 8 aa, Mycobacterium tuberculosis
GNSGLTPG

SEQ ID NO: 1444591 - protein, 6 aa, Mycobacterium tuberculosis
GNSGSY

SEQ ID NO: 1444592 - protein, 10 aa, Mycobacterium tuberculosis
GNSGTGSTGL

SEQ ID NO: 1444593 - protein, 112 aa, Mycobacterium tuberculosis
GNSLSGRGGAVGTGGTGLRGTTGATGATGTFDAGADGHGGNGGTGGVGGTGGAGGGGGNGGAGGKALSPTGNNGSQGAGGDGGAGGAGGTGGTGGDGGRGAHGTLFKQASLA

SEQ ID NO: 1444594 - protein, 10 aa, Mycobacterium tuberculosis
GNSRAKCSAK

SEQ ID NO: 1444595 - protein, 5 aa, Mycobacterium tuberculosis
GNSTS

SEQ ID NO: 1444596 - protein, 11 aa, Mycobacterium tuberculosis
GNSTTAPSSGF

SEQ ID NO: 1444597 - protein, 4 aa, Mycobacterium tuberculosis
GNSY

SEQ ID NO: 1444598 - protein, 12 aa, Mycobacterium tuberculosis
GNTGFGNAGNIN

SEQ ID NO: 1444599 - protein, 19 aa, Mycobacterium tuberculosis
GNTGSGNIGAGNTGSSNWG

SEQ ID NO: 1444600 - protein, 29 aa, Mycobacterium tuberculosis
GNTGSGNIGNNNIGNNNIGSGNTGSGNLG

SEQ ID NO: 1444601 - protein, 11 aa, Mycobacterium tuberculosis
GNTGSGNIGSA

SEQ ID NO: 1444602 - protein, 4 aa, Mycobacterium tuberculosis
GNTY

SEQ ID NO: 1444603 - protein, 13 aa, Mycobacterium tuberculosis
GNVARGDDFDTSV

SEQ ID NO: 1444604 - protein, 6 aa, Mycobacterium tuberculosis
GNVNTG

SEQ ID NO: 1444605 - protein, 39 aa, Mycobacterium tuberculosis
GNVNTGAFNSGSFNNGRCGPVTTTGWSASPSASTSPAAP

SEQ ID NO: 1444606 - protein, 9 aa, Mycobacterium tuberculosis
GNVRTEADA

SEQ ID NO: 1444607 - protein, 4 aa, Mycobacterium tuberculosis
GNWR

SEQ ID NO: 1444608 - protein, 10 aa, Mycobacterium tuberculosis
GNYAGPTINR

SEQ ID NO: 1444609 - protein, 15 aa, Mycobacterium tuberculosis
GNYPRADAKAPQNRR

SEQ ID NO: 1444610 - protein, 6 aa, Mycobacterium tuberculosis
GNYSNG

SEQ ID NO: 1444611 - protein, 8 aa, Mycobacterium tuberculosis
GPAARAEV

SEQ ID NO: 1444612 - protein, 17 aa, Mycobacterium tuberculosis
GPAATSPTVVLCQLGHG

SEQ ID NO: 1444613 - protein, 5 aa, Mycobacterium tuberculosis
GPADA

SEQ ID NO: 1444614 - protein, 10 aa, Mycobacterium tuberculosis
GPAEDSSAQV

SEQ ID NO: 1444615 - protein, 8 aa, Mycobacterium tuberculosis
GPAGDEDF

SEQ ID NO: 1444616 - protein, 6 aa, Mycobacterium tuberculosis
GPAGQT

SEQ ID NO: 1444617 - protein, 8 aa, Mycobacterium tuberculosis
GPAGSRRI

SEQ ID NO: 1444618 - protein, 5 aa, Mycobacterium tuberculosis
GPAHA

SEQ ID NO: 1444619 - protein, 13 aa, Mycobacterium tuberculosis
GPAIGPNPAAGEQ

SEQ ID NO: 1444620 - protein, 9 aa, Mycobacterium tuberculosis
GPAITNKPA

SEQ ID NO: 1444621 - protein, 5 aa, Mycobacterium tuberculosis
GPANA

SEQ ID NO: 1444622 - protein, 23 aa, Mycobacterium tuberculosis
GPAPLGGAARGRPPAPAAGARPA

SEQ ID NO: 1444623 - protein, 33 aa, Mycobacterium tuberculosis
GPARQNRCAARGAARPPRGRPDAATARHRGDVP

SEQ ID NO: 1444624 - protein, 7 aa, Mycobacterium tuberculosis
GPARRNT

SEQ ID NO: 1444625 - protein, 5 aa, Mycobacterium tuberculosis
GPATI

SEQ ID NO: 1444626 - protein, 32 aa, Mycobacterium tuberculosis
GPCRRRPGYTGQPVRRQRRHDRAAGAAAGNLR

SEQ ID NO: 1444627 - protein, 11 aa, Mycobacterium tuberculosis
GPDHRRRGRQP

SEQ ID NO: 1444628 - protein, 7 aa, Mycobacterium tuberculosis
GPDLGGR

SEQ ID NO: 1444629 - protein, 6 aa, Mycobacterium tuberculosis
GPDNRL

SEQ ID NO: 1444630 - protein, 20 aa, Mycobacterium tuberculosis
GPDNRLAEKGWTTHKNTHGH

SEQ ID NO: 1444631 - protein, 21 aa, Mycobacterium tuberculosis
GPDPLGRSRTRLPGWSPRARP

SEQ ID NO: 1444632 - protein, 10 aa, Mycobacterium tuberculosis
GPDRRRGGGG

SEQ ID NO: 1444633 - protein, 5 aa, Mycobacterium tuberculosis
GPDVT

SEQ ID NO: 1444634 - protein, 11 aa, Mycobacterium tuberculosis
GPELANGDTLS

SEQ ID NO: 1444635 - protein, 8 aa, Mycobacterium tuberculosis
GPELGPAA

SEQ ID NO: 1444636 - protein, 5 aa, Mycobacterium tuberculosis
GPEVT

SEQ ID NO: 1444637 - protein, 10 aa, Mycobacterium tuberculosis
GPFEASVNGA

SEQ ID NO: 1444638 - protein, 14 aa, Mycobacterium tuberculosis
GPGANLGPPRRPKL

SEQ ID NO: 1444639 - protein, 5 aa, Mycobacterium tuberculosis
GPGEE

SEQ ID NO: 1444640 - protein, 14 aa, Mycobacterium tuberculosis
GPGGGLDPPAGVGR

SEQ ID NO: 1444641 - protein, 16 aa, Mycobacterium tuberculosis
GPGGNAGAPGAGGVGA

SEQ ID NO: 1444642 - protein, 13 aa, Mycobacterium tuberculosis
GPGGPSGSHPVGS

SEQ ID NO: 1444643 - protein, 11 aa, Mycobacterium tuberculosis
GPGGQGGQAFG

SEQ ID NO: 1444644 - protein, 9 aa, Mycobacterium tuberculosis
GPGGSLTGS

SEQ ID NO: 1444645 - protein, 4 aa, Mycobacterium tuberculosis
GPGH

SEQ ID NO: 1444646 - protein, 19 aa, Mycobacterium tuberculosis
GPGPGPGAGVDRPILEVPV

SEQ ID NO: 1444647 - protein, 14 aa, Mycobacterium tuberculosis
GPGQAEKSLLPGNP

SEQ ID NO: 1444648 - protein, 9 aa, Mycobacterium tuberculosis
GPGQEGLDQ

SEQ ID NO: 1444649 - protein, 7 aa, Mycobacterium tuberculosis
GPGRACG

SEQ ID NO: 1444650 - protein, 13 aa, Mycobacterium tuberculosis
GPGSGGRGRPPLR

SEQ ID NO: 1444651 - protein, 7 aa, Mycobacterium tuberculosis
GPGTGKC

SEQ ID NO: 1444652 - protein, 5 aa, Mycobacterium tuberculosis
GPGVT

SEQ ID NO: 1444653 - protein, 7 aa, Mycobacterium tuberculosis
GPGWPAK

SEQ ID NO: 1444654 - protein, 13 aa, Mycobacterium tuberculosis
GPHTDQTLDGPGL

SEQ ID NO: 1444655 - protein, 7 aa, Mycobacterium tuberculosis
GPIAGYA

SEQ ID NO: 1444656 - protein, 8 aa, Mycobacterium tuberculosis
GPIRPTSA

SEQ ID NO: 1444657 - protein, 8 aa, Mycobacterium tuberculosis
GPITSSAH

SEQ ID NO: 1444658 - protein, 7 aa, Mycobacterium tuberculosis
GPKNANL

SEQ ID NO: 1444659 - protein, 22 aa, Mycobacterium tuberculosis
GPKPQEPPPDPVPFPPYQPKVW

SEQ ID NO: 1444660 - protein, 44 aa, Mycobacterium tuberculosis
GPKTPRGDGNWTQNRTGCGRCSSRQTQNPERGRKRISPATPQPR

SEQ ID NO: 1444661 - protein, 7 aa, Mycobacterium tuberculosis
GPLAPPR

SEQ ID NO: 1444662 - protein, 20 aa, Mycobacterium tuberculosis
GPLATTHSDRAPAGRRPVPN

SEQ ID NO: 1444663 - protein, 14 aa, Mycobacterium tuberculosis
GPLGGRPPARSGGL

SEQ ID NO: 1444664 - protein, 44 aa, Mycobacterium tuberculosis
GPLPHSPTESKPPPVDRPAEPVAPSSASAGQPRVSAATTPGTHV

SEQ ID NO: 1444665 - protein, 5 aa, Mycobacterium tuberculosis
GPLPV

SEQ ID NO: 1444666 - protein, 6 aa, Mycobacterium tuberculosis
GPLRPA

SEQ ID NO: 1444667 - protein, 15 aa, Mycobacterium tuberculosis
GPLSGPQTGKGYRLL

SEQ ID NO: 1444668 - protein, 6 aa, Mycobacterium tuberculosis
GPLSGR

SEQ ID NO: 1444669 - protein, 5 aa, Mycobacterium tuberculosis
GPLTA

SEQ ID NO: 1444670 - protein, 4 aa, Mycobacterium tuberculosis
GPMP

SEQ ID NO: 1444671 - protein, 12 aa, Mycobacterium tuberculosis
GPNAATHRDLPE

SEQ ID NO: 1444672 - protein, 9 aa, Mycobacterium tuberculosis
GPNAPSPSQ

SEQ ID NO: 1444673 - protein, 7 aa, Mycobacterium tuberculosis
GPPEAPD

SEQ ID NO: 1444674 - protein, 30 aa, Mycobacterium tuberculosis
GPPGCSATAGPAVPAEPPPPTTGSAGPVAL

SEQ ID NO: 1444675 - protein, 21 aa, Mycobacterium tuberculosis
GPPLPTRRRRSARRGSDLPRS

SEQ ID NO: 1444676 - protein, 20 aa, Mycobacterium tuberculosis
GPPPGEDPVTSTVASDRGAG

SEQ ID NO: 1444677 - protein, 8 aa, Mycobacterium tuberculosis
GPPPSPVQ

SEQ ID NO: 1444678 - protein, 16 aa, Mycobacterium tuberculosis
GPPQIGRQLVQGGKTF

SEQ ID NO: 1444679 - protein, 8 aa, Mycobacterium tuberculosis
GPPRNPTC

SEQ ID NO: 1444680 - protein, 18 aa, Mycobacterium tuberculosis
GPPSIGSPTSARARTVNT

SEQ ID NO: 1444681 - protein, 8 aa, Mycobacterium tuberculosis
GPPTGGLT

SEQ ID NO: 1444682 - protein, 5 aa, Mycobacterium tuberculosis
GPPTT

SEQ ID NO: 1444683 - protein, 4 aa, Mycobacterium tuberculosis
GPPW

SEQ ID NO: 1444684 - protein, 20 aa, Mycobacterium tuberculosis
GPQNGPRRSQAITPEPGAAG

SEQ ID NO: 1444685 - protein, 5 aa, Mycobacterium tuberculosis
GPQRN

SEQ ID NO: 1444686 - protein, 15 aa, Mycobacterium tuberculosis
GPQTYTTTPSGGNAF

SEQ ID NO: 1444687 - protein, 11 aa, Mycobacterium tuberculosis
GPRAFAEKQEP

SEQ ID NO: 1444688 - protein, 19 aa, Mycobacterium tuberculosis
GPRAPGSSYGSRENGPPIN

SEQ ID NO: 1444689 - protein, 19 aa, Mycobacterium tuberculosis
GPRAPGSSYGSRENGPPVN

SEQ ID NO: 1444690 - protein, 4 aa, Mycobacterium tuberculosis
GPRC

SEQ ID NO: 1444691 - protein, 14 aa, Mycobacterium tuberculosis
GPRGGRRPGAPRAG

SEQ ID NO: 1444692 - protein, 7 aa, Mycobacterium tuberculosis
GPRKRRA

SEQ ID NO: 1444693 - protein, 8 aa, Mycobacterium tuberculosis
GPRKVGEA

SEQ ID NO: 1444694 - protein, 6 aa, Mycobacterium tuberculosis
GPRNKI

SEQ ID NO: 1444695 - protein, 10 aa, Mycobacterium tuberculosis
GPRPARRDGH

SEQ ID NO: 1444696 - protein, 26 aa, Mycobacterium tuberculosis
GPRPPRRFREQRSKSCAARRTRGAVK

SEQ ID NO: 1444697 - protein, 5 aa, Mycobacterium tuberculosis
GPRRN

SEQ ID NO: 1444698 - protein, 4 aa, Mycobacterium tuberculosis
GPRS

SEQ ID NO: 1444699 - protein, 12 aa, Mycobacterium tuberculosis
GPRSSPTRRGTR

SEQ ID NO: 1444700 - protein, 5 aa, Mycobacterium tuberculosis
GPRTT

SEQ ID NO: 1444701 - protein, 6 aa, Mycobacterium tuberculosis
GPRVPA

SEQ ID NO: 1444702 - protein, 30 aa, Mycobacterium tuberculosis
GPSAGDLPAATGTGAAGAADAPASAADSVS

SEQ ID NO: 1444703 - protein, 5 aa, Mycobacterium tuberculosis
GPSRL

SEQ ID NO: 1444704 - protein, 15 aa, Mycobacterium tuberculosis
GPSSTRPSSQPSDLH

SEQ ID NO: 1444705 - protein, 4 aa, Mycobacterium tuberculosis
GPST

SEQ ID NO: 1444706 - protein, 22 aa, Mycobacterium tuberculosis
GPTARTAAPTPGLIAGRGQNLP

SEQ ID NO: 1444707 - protein, 18 aa, Mycobacterium tuberculosis
GPTCDSGRGPRRQPESNF

SEQ ID NO: 1444708 - protein, 5 aa, Mycobacterium tuberculosis
GPTEQ

SEQ ID NO: 1444709 - protein, 12 aa, Mycobacterium tuberculosis
GPTERQPKGPFG

SEQ ID NO: 1444710 - protein, 13 aa, Mycobacterium tuberculosis
GPTMPDDARAPGP

SEQ ID NO: 1444711 - protein, 7 aa, Mycobacterium tuberculosis
GPTNAPE

SEQ ID NO: 1444712 - protein, 5 aa, Mycobacterium tuberculosis
GPTNF

SEQ ID NO: 1444713 - protein, 14 aa, Mycobacterium tuberculosis
GPTPGGAPGNDDLG

SEQ ID NO: 1444714 - protein, 7 aa, Mycobacterium tuberculosis
GPTPIRG

SEQ ID NO: 1444715 - protein, 4 aa, Mycobacterium tuberculosis
GPTR

SEQ ID NO: 1444716 - protein, 75 aa, Mycobacterium tuberculosis
GPTRTAAARQTQPRRAPRPYPTGIGRRRRRRAQARTGTRCAAPGRARGKSERPGPVRSAAAPAAGPASGAGCRRR

SEQ ID NO: 1444717 - protein, 7 aa, Mycobacterium tuberculosis
GPTTPMV

SEQ ID NO: 1444718 - protein, 16 aa, Mycobacterium tuberculosis
GPTVAGSDGEQADAIR

SEQ ID NO: 1444719 - protein, 35 aa, Mycobacterium tuberculosis
GPVAAPAAPVVGGSAVPAGPLPAYGSDLRPPSWQP

SEQ ID NO: 1444720 - protein, 22 aa, Mycobacterium tuberculosis
GPVAGQDPTSFVGPPPFRPPTF

SEQ ID NO: 1444721 - protein, 44 aa, Mycobacterium tuberculosis
GPVATADNSTAPAAPAAPAARAATASACSARAAPAGPAGEAVPP

SEQ ID NO: 1444722 - protein, 9 aa, Mycobacterium tuberculosis
GPVEQDGRQ

SEQ ID NO: 1444723 - protein, 14 aa, Mycobacterium tuberculosis
GPVERGNGGPPPMR

SEQ ID NO: 1444724 - protein, 6 aa, Mycobacterium tuberculosis
GPVIND

SEQ ID NO: 1444725 - protein, 9 aa, Mycobacterium tuberculosis
GPVNTPTAA

SEQ ID NO: 1444726 - protein, 5 aa, Mycobacterium tuberculosis
GPVRR

SEQ ID NO: 1444727 - protein, 13 aa, Mycobacterium tuberculosis
GPVTGEQGTGTTA

SEQ ID NO: 1444728 - protein, 14 aa, Mycobacterium tuberculosis
GPYGRRRCSSRPAM

SEQ ID NO: 1444729 - protein, 12 aa, Mycobacterium tuberculosis
GQAAAYPASMLI

SEQ ID NO: 1444730 - protein, 6 aa, Mycobacterium tuberculosis
GQAGGI

SEQ ID NO: 1444731 - protein, 45 aa, Mycobacterium tuberculosis
GQAGPAHPQGLRRGGDLHREAGQHPNNVTKTDTRGGQAARDATST

SEQ ID NO: 1444732 - protein, 5 aa, Mycobacterium tuberculosis
GQAIT

SEQ ID NO: 1444733 - protein, 9 aa, Mycobacterium tuberculosis
GQAPDASGY

SEQ ID NO: 1444734 - protein, 5 aa, Mycobacterium tuberculosis
GQAPV

SEQ ID NO: 1444735 - protein, 5 aa, Mycobacterium tuberculosis
GQARA

SEQ ID NO: 1444736 - protein, 5 aa, Mycobacterium tuberculosis
GQARG

SEQ ID NO: 1444737 - protein, 14 aa, Mycobacterium tuberculosis
GQAYPGAQRPSAGV

SEQ ID NO: 1444738 - protein, 18 aa, Mycobacterium tuberculosis
GQDHGVTARHRRDRTTYP

SEQ ID NO: 1444739 - protein, 5 aa, Mycobacterium tuberculosis
GQDHS

SEQ ID NO: 1444740 - protein, 18 aa, Mycobacterium tuberculosis
GQDTAAAAALGAVRPWGT

SEQ ID NO: 1444741 - protein, 416 aa, Mycobacterium tuberculosis
GQGAGGAGGTGGAGGVGGDGGAGGPGNQAFNAGAGGAGGHGGDPGAGGAGGTGGAGSTIGAHGAAGASPTSGGNGGAGGNGAHFSSGGKAGGNGGAGGAGGLVGNGGAGGAGGNGAPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGVGGNGGNGGIRGIGGAGGIGGAGSTAGADGARGATPTSGGNGGTGGNGANATVAGGAGGAGGKGGNGGLVGNGGAGGKGGDGMAGVAGSSPTTAGESGTSGQNGGAGGAGGAGGRGGDFGGDGGTGGAGGNGANGANATTPGAKGGDGGHGGPGAQGGNGGQGGPGGLA

SEQ ID NO: 1444742 - protein, 425 aa, Mycobacterium tuberculosis
GQGAGGAGGTGGAGGVGGDGGAGGPGNQAFNAGAGGAGGHGGDPGAGGAGGTGGAGSTIGAHGAAGASPTSGGNGGAGGNGAHFSSGGKAGGNGGAGGAGGLVGNGGAGGAGGNGAPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGVGGNGGNGGSRGIGGAGGIGGAGSTAGADGARGATPTSGGNGGTGGNGANATVAGGAGGAGGKGGNGGLVGNGGAGGKGGDGMAGVAGSSPTTAGESGTSGQNGGAGGAGGAGGRGGDFGGDGGTGGAGGNGADGGAGGNGANGANATTPGAKGGDGGHGGPGAQGGNGGQGGPGGLA

SEQ ID NO: 1444743 - protein, 102 aa, Mycobacterium tuberculosis
GQGAGGAGGTGGAGGVGGDRGAGANGNQAFNAGAGGAGGHGGDPGTGGAGGTGGAGSTIGAHGAAGASPTSGGNGGAGGNGANATTAGTNGANGGPGGHGGL

SEQ ID NO: 1444744 - protein, 102 aa, Mycobacterium tuberculosis
GQGAGGAGGTGGAGGVGGDRGAGANGNQAFNAGAGGHGGNGGNPGTGGAGGTGGAGSITGAQGAIGATPTSGGNGGAGVNGANATTAGTNGANGGPGGHGGL

SEQ ID NO: 1444745 - protein, 26 aa, Mycobacterium tuberculosis
GQGGDSAMGSGGAGGAGGSGGAASPF

SEQ ID NO: 1444746 - protein, 13 aa, Mycobacterium tuberculosis
GQGGQFGAQPGPF

SEQ ID NO: 1444747 - protein, 6 aa, Mycobacterium tuberculosis
GQGGTI

SEQ ID NO: 1444748 - protein, 6 aa, Mycobacterium tuberculosis
GQGPTI

SEQ ID NO: 1444749 - protein, 21 aa, Mycobacterium tuberculosis
GQGQSTRLDRVSGSARSEVGP

SEQ ID NO: 1444750 - protein, 8 aa, Mycobacterium tuberculosis
GQGRVPGD

SEQ ID NO: 1444751 - protein, 11 aa, Mycobacterium tuberculosis
GQGVSPTSIGQ

SEQ ID NO: 1444752 - protein, 14 aa, Mycobacterium tuberculosis
GQHAGADPRIGAAG

SEQ ID NO: 1444753 - protein, 6 aa, Mycobacterium tuberculosis
GQHHGP

SEQ ID NO: 1444754 - protein, 16 aa, Mycobacterium tuberculosis
GQHPGLGDAHPHEPVR

SEQ ID NO: 1444755 - protein, 5 aa, Mycobacterium tuberculosis
GQHQC

SEQ ID NO: 1444756 - protein, 17 aa, Mycobacterium tuberculosis
GQHRDRAGRGPSDRDRG

SEQ ID NO: 1444757 - protein, 4 aa, Mycobacterium tuberculosis
GQLD

SEQ ID NO: 1444758 - protein, 11 aa, Mycobacterium tuberculosis
GQLGKKSGRGF

SEQ ID NO: 1444759 - protein, 9 aa, Mycobacterium tuberculosis
GQLQTHDSA

SEQ ID NO: 1444760 - protein, 7 aa, Mycobacterium tuberculosis
GQNDPKL

SEQ ID NO: 1444761 - protein, 4 aa, Mycobacterium tuberculosis
GQNT

SEQ ID NO: 1444762 - protein, 5 aa, Mycobacterium tuberculosis
GQNTP

SEQ ID NO: 1444763 - protein, 8 aa, Mycobacterium tuberculosis
GQNTPAIA

SEQ ID NO: 1444764 - protein, 6 aa, Mycobacterium tuberculosis
GQPARE

SEQ ID NO: 1444765 - protein, 7 aa, Mycobacterium tuberculosis
GQPAREV

SEQ ID NO: 1444766 - protein, 6 aa, Mycobacterium tuberculosis
GQPEGM

SEQ ID NO: 1444767 - protein, 7 aa, Mycobacterium tuberculosis
GQPEIDD

SEQ ID NO: 1444768 - protein, 7 aa, Mycobacterium tuberculosis
GQPGEIE

SEQ ID NO: 1444769 - protein, 6 aa, Mycobacterium tuberculosis
GQPPAI

SEQ ID NO: 1444770 - protein, 9 aa, Mycobacterium tuberculosis
GQPPITAKG

SEQ ID NO: 1444771 - protein, 7 aa, Mycobacterium tuberculosis
GQPPPII

SEQ ID NO: 1444772 - protein, 12 aa, Mycobacterium tuberculosis
GQPQAEKLASQW

SEQ ID NO: 1444773 - protein, 4 aa, Mycobacterium tuberculosis
GQPW

SEQ ID NO: 1444774 - protein, 32 aa, Mycobacterium tuberculosis
GQQAGGHGAQQRQTGRERNDDGDDRGHRAQRR

SEQ ID NO: 1444775 - protein, 7 aa, Mycobacterium tuberculosis
GQQGGPL

SEQ ID NO: 1444776 - protein, 12 aa, Mycobacterium tuberculosis
GQQGVGGQLGED

SEQ ID NO: 1444777 - protein, 19 aa, Mycobacterium tuberculosis
GQRDAERAVPPEPHQPWPS

SEQ ID NO: 1444778 - protein, 7 aa, Mycobacterium tuberculosis
GQRGIQP

SEQ ID NO: 1444779 - protein, 7 aa, Mycobacterium tuberculosis
GQRGPAV

SEQ ID NO: 1444780 - protein, 12 aa, Mycobacterium tuberculosis
GQRGWTPGHSTR

SEQ ID NO: 1444781 - protein, 6 aa, Mycobacterium tuberculosis
GQRPRN

SEQ ID NO: 1444782 - protein, 25 aa, Mycobacterium tuberculosis
GQRQGGTGQPGRRPYCGPGCSPRCR

SEQ ID NO: 1444783 - protein, 4 aa, Mycobacterium tuberculosis
GQRR

SEQ ID NO: 1444784 - protein, 7 aa, Mycobacterium tuberculosis
GQRRASP

SEQ ID NO: 1444785 - protein, 15 aa, Mycobacterium tuberculosis
GQRTGVGLPGESAGL

SEQ ID NO: 1444786 - protein, 7 aa, Mycobacterium tuberculosis
GQSDRPI

SEQ ID NO: 1444787 - protein, 6 aa, Mycobacterium tuberculosis
GQSPTR

SEQ ID NO: 1444788 - protein, 4 aa, Mycobacterium tuberculosis
GQSS

SEQ ID NO: 1444789 - protein, 8 aa, Mycobacterium tuberculosis
GQSTTPYQ

SEQ ID NO: 1444790 - protein, 5 aa, Mycobacterium tuberculosis
GQSVH

SEQ ID NO: 1444791 - protein, 7 aa, Mycobacterium tuberculosis
GQTFGAP

SEQ ID NO: 1444792 - protein, 8 aa, Mycobacterium tuberculosis
GQTGDSLE

SEQ ID NO: 1444793 - protein, 5 aa, Mycobacterium tuberculosis
GQTND

SEQ ID NO: 1444794 - protein, 6 aa, Mycobacterium tuberculosis
GQTTMT

SEQ ID NO: 1444795 - protein, 9 aa, Mycobacterium tuberculosis
GQVQDGERL

SEQ ID NO: 1444796 - protein, 6 aa, Mycobacterium tuberculosis
GQVSGS

SEQ ID NO: 1444797 - protein, 5 aa, Mycobacterium tuberculosis
GQWGG

SEQ ID NO: 1444798 - protein, 11 aa, Mycobacterium tuberculosis
GRAAAAGDELD

SEQ ID NO: 1444799 - protein, 12 aa, Mycobacterium tuberculosis
GRAAAAGDELDT

SEQ ID NO: 1444800 - protein, 10 aa, Mycobacterium tuberculosis
GRAAGQAPIR

SEQ ID NO: 1444801 - protein, 6 aa, Mycobacterium tuberculosis
GRAASH

SEQ ID NO: 1444802 - protein, 11 aa, Mycobacterium tuberculosis
GRAETERQVSR

SEQ ID NO: 1444803 - protein, 16 aa, Mycobacterium tuberculosis
GRAGATATALPAGAGV

SEQ ID NO: 1444804 - protein, 17 aa, Mycobacterium tuberculosis
GRAGAVERTSASGDAGI

SEQ ID NO: 1444805 - protein, 11 aa, Mycobacterium tuberculosis
GRAGGDNSMNP

SEQ ID NO: 1444806 - protein, 8 aa, Mycobacterium tuberculosis
GRAGGHNE

SEQ ID NO: 1444807 - protein, 20 aa, Mycobacterium tuberculosis
GRAGRAAAPSGALSGAGVSW

SEQ ID NO: 1444808 - protein, 55 aa, Mycobacterium tuberculosis; identical to SEQ ID NO: 192640

SEQ ID NO: 1444809 - protein, 14 aa, Mycobacterium tuberculosis
GRAGSRQLRGPAGP

SEQ ID NO: 1444810 - protein, 10 aa, Mycobacterium tuberculosis
GRAKSTSSEW

SEQ ID NO: 1444811 - protein, 14 aa, Mycobacterium tuberculosis
GRALDTSADPGHQA

SEQ ID NO: 1444812 - protein, 6 aa, Mycobacterium tuberculosis
GRANDN

SEQ ID NO: 1444813 - protein, 8 aa, Mycobacterium tuberculosis
GRANRRTQ

SEQ ID NO: 1444814 - protein, 6 aa, Mycobacterium tuberculosis
GRAPFD

SEQ ID NO: 1444815 - protein, 17 aa, Mycobacterium tuberculosis
GRAPPRGEAAQGRGRGV

SEQ ID NO: 1444816 - protein, 5 aa, Mycobacterium tuberculosis
GRAPR

SEQ ID NO: 1444817 - protein, 6 aa, Mycobacterium tuberculosis
GRARPA

SEQ ID NO: 1444818 - protein, 13 aa, Mycobacterium tuberculosis
GRARPSRRGRRGR

SEQ ID NO: 1444819 - protein, 14 aa, Mycobacterium tuberculosis
GRARSRKLRGPAGP

SEQ ID NO: 1444820 - protein, 4 aa, Mycobacterium tuberculosis
GRAS

SEQ ID NO: 1444821 - protein, 10 aa, Mycobacterium tuberculosis
GRATDQRARH

SEQ ID NO: 1444822 - protein, 15 aa, Mycobacterium tuberculosis
GRCGSRGSDLDHREC

SEQ ID NO: 1444823 - protein, 7 aa, Mycobacterium tuberculosis
GRCPAGK

SEQ ID NO: 1444824 - protein, 8 aa, Mycobacterium tuberculosis
GRCPAGQP

SEQ ID NO: 1444825 - protein, 7 aa, Mycobacterium tuberculosis
GRDDGGV

SEQ ID NO: 1444826 - protein, 7 aa, Mycobacterium tuberculosis
GRDGDNL

SEQ ID NO: 1444827 - protein, 7 aa, Mycobacterium tuberculosis
GRDPATA

SEQ ID NO: 1444828 - protein, 25 aa, Mycobacterium tuberculosis
GRDPGRTFATGSKSTGCGWPAATAS

SEQ ID NO: 1444829 - protein, 7 aa, Mycobacterium tuberculosis
GRDPRAA

SEQ ID NO: 1444830 - protein, 16 aa, Mycobacterium tuberculosis
GRDPRGGNVDTTINPR

SEQ ID NO: 1444831 - protein, 12 aa, Mycobacterium tuberculosis
GRDPSTPPTKAD

SEQ ID NO: 1444832 - protein, 17 aa, Mycobacterium tuberculosis
GRDREPRGAVSRDVAPL

SEQ ID NO: 1444833 - protein, 13 aa, Mycobacterium tuberculosis
GRDRGGPEAPAHS

SEQ ID NO: 1444834 - protein, 5 aa, Mycobacterium tuberculosis
GRDRR

SEQ ID NO: 1444835 - protein, 29 aa, Mycobacterium tuberculosis
GRDSGRLGRRGRVGRANHRTEAREIPRRS

SEQ ID NO: 1444836 - protein, 5 aa, Mycobacterium tuberculosis
GRDTR

SEQ ID NO: 1444837 - protein, 59 aa, Mycobacterium tuberculosis
GRDVGGRDSRGAARPRGRRRRGLADPADRRRRPGGARHGVAGQPRSGGGPGGLAGGGTC

SEQ ID NO: 1444838 - protein, 5 aa, Mycobacterium tuberculosis
GREAT

SEQ ID NO: 1444839 - protein, 9 aa, Mycobacterium tuberculosis
GRECAGSAA

SEQ ID NO: 1444840 - protein, 26 aa, Mycobacterium tuberculosis
GREGRTEVPAGPLADPVNGQPRPAAL

SEQ ID NO: 1444841 - protein, 17 aa, Mycobacterium tuberculosis
GRELDDSVTAGVGETFD

SEQ ID NO: 1444842 - protein, 8 aa, Mycobacterium tuberculosis
GRERASDD

SEQ ID NO: 1444843 - protein, 26 aa, Mycobacterium tuberculosis
GRERRRAASPGRWRPPSRFWPATTRV

SEQ ID NO: 1444844 - protein, 19 aa, Mycobacterium tuberculosis
GRERSGGLSTPDAYPGGAD

SEQ ID NO: 1444845 - protein, 6 aa, Mycobacterium tuberculosis
GRFDSR

SEQ ID NO: 1444846 - protein, 5 aa, Mycobacterium tuberculosis
GRGEC

SEQ ID NO: 1444847 - protein, 15 aa, Mycobacterium tuberculosis
GRGESPRVLPPRRSW

SEQ ID NO: 1444848 - protein, 7 aa, Mycobacterium tuberculosis
GRGFGSG

SEQ ID NO: 1444849 - protein, 6 aa, Mycobacterium tuberculosis
GRGGDA

SEQ ID NO: 1444850 - protein, 7 aa, Mycobacterium tuberculosis
GRGGDGV

SEQ ID NO: 1444851 - protein, 10 aa, Mycobacterium tuberculosis
GRGGTEVAKD

SEQ ID NO: 1444852 - protein, 13 aa, Mycobacterium tuberculosis
GRGIRDDEQRHVR

SEQ ID NO: 1444853 - protein, 10 aa, Mycobacterium tuberculosis
GRGLPGGASW

SEQ ID NO: 1444854 - protein, 17 aa, Mycobacterium tuberculosis
GRGMRSPAARRRCTRNQ

SEQ ID NO: 1444855 - protein, 6 aa, Mycobacterium tuberculosis
GRGPEY

SEQ ID NO: 1444856 - protein, 6 aa, Mycobacterium tuberculosis
GRGPLV

SEQ ID NO: 1444857 - protein, 22 aa, Mycobacterium tuberculosis
GRGSGRKSGSGSGRGSNLSAVR

SEQ ID NO: 1444858 - protein, 19 aa, Mycobacterium tuberculosis
GRGSRPQRARHQTPSAPIP

SEQ ID NO: 1444859 - protein, 14 aa, Mycobacterium tuberculosis
GRGSRRRVDPTPLT

SEQ ID NO: 1444860 - protein, 45 aa, Mycobacterium tuberculosis
GRHADRDRTQNHHHEPDQRMSRPERARRRARGGHGKQHHRPATRT

SEQ ID NO: 1444861 - protein, 13 aa, Mycobacterium tuberculosis
GRHEIEDEPAGWC

SEQ ID NO: 1444862 - protein, 12 aa, Mycobacterium tuberculosis
GRHGDGVPRQRA

SEQ ID NO: 1444863 - protein, 15 aa, Mycobacterium tuberculosis
GRHRDGREDHGSEAA

SEQ ID NO: 1444864 - protein, 10 aa, Mycobacterium tuberculosis
GRHRDGTGVG

SEQ ID NO: 1444865 - protein, 15 aa, Mycobacterium tuberculosis
GRIPSDKPPIKTPGE

SEQ ID NO: 1444866 - protein, 14 aa, Mycobacterium tuberculosis
GRISPRKTPPHRRV

SEQ ID NO: 1444867 - protein, 9 aa, Mycobacterium tuberculosis
GRKGHHAVE

SEQ ID NO: 1444868 - protein, 16 aa, Mycobacterium tuberculosis
GRLRPRAGAQGIRRTQ

SEQ ID NO: 1444869 - protein, 20 aa, Mycobacterium tuberculosis
GRLTTVSERAGQPGHGQQNP

SEQ ID NO: 1444870 - protein, 8 aa, Mycobacterium tuberculosis
GRNAPTVL

SEQ ID NO: 1444871 - protein, 12 aa, Mycobacterium tuberculosis
GRNGGDGGDGGG

SEQ ID NO: 1444872 - protein, 10 aa, Mycobacterium tuberculosis
GRNQRRVQPE

SEQ ID NO: 1444873 - protein, 4 aa, Mycobacterium tuberculosis
GRPA

SEQ ID NO: 1444874 - protein, 60 aa, Mycobacterium tuberculosis
GRPAAGAGTGSCRARSGAGAGRGSRSYPDDTDTAADLTGLTGSGRTPSDTPGRGVSAAGR

SEQ ID NO: 1444875 - protein, 9 aa, Mycobacterium tuberculosis
GRPAKRSPN

SEQ ID NO: 1444876 - protein, 8 aa, Mycobacterium tuberculosis
GRPAPTHR

SEQ ID NO: 1444877 - protein, 18 aa, Mycobacterium tuberculosis
GRPAPTRCRRASRRCSAA

SEQ ID NO: 1444878 - protein, 8 aa, Mycobacterium tuberculosis
GRPDEGAL

SEQ ID NO: 1444879 - protein, 9 aa, Mycobacterium tuberculosis
GRPDLPEGR

SEQ ID NO: 1444880 - protein, 9 aa, Mycobacterium tuberculosis
GRPDRCGRD

SEQ ID NO: 1444881 - protein, 16 aa, Mycobacterium tuberculosis
GRPECAGRRGRRSSRA

SEQ ID NO: 1444882 - protein, 28 aa, Mycobacterium tuberculosis
GRPERRPDTAVSDPALSRSVRGRCRGRR

SEQ ID NO: 1444883 - protein, 5 aa, Mycobacterium tuberculosis
GRPFH

SEQ ID NO: 1444884 - protein, 20 aa, Mycobacterium tuberculosis
GRPGDDAGRPAARAGAGCSH

SEQ ID NO: 1444885 - protein, 28 aa, Mycobacterium tuberculosis
GRPGDPIAGGGVAGDAPGAARLRPPTAR

SEQ ID NO: 1444886 - protein, 11 aa, Mycobacterium tuberculosis
GRPGDSGHRRG

SEQ ID NO: 1444887 - protein, 14 aa, Mycobacterium tuberculosis
GRPGGQQQHNDKGR

SEQ ID NO: 1444888 - protein, 9 aa, Mycobacterium tuberculosis
GRPGRRRGV

SEQ ID NO: 1444889 - protein, 9 aa, Mycobacterium tuberculosis
GRPIRRSAQ

SEQ ID NO: 1444890 - protein, 7 aa, Mycobacterium tuberculosis
GRPISPA

SEQ ID NO: 1444891 - protein, 4 aa, Mycobacterium tuberculosis
GRPK

SEQ ID NO: 1444892 - protein, 22 aa, Mycobacterium tuberculosis
GRPLIGNGTNGAPGTGANSGDG

SEQ ID NO: 1444893 - protein, 4 aa, Mycobacterium tuberculosis
GRPM

SEQ ID NO: 1444894 - protein, 6 aa, Mycobacterium tuberculosis
GRPPLQ

SEQ ID NO: 1444895 - protein, 4 aa, Mycobacterium tuberculosis
GRPQ

SEQ ID NO: 1444896 - protein, 5 aa, Mycobacterium tuberculosis
GRPQP

SEQ ID NO: 1444897 - protein, 20 aa, Mycobacterium tuberculosis
GRPRCRPGRPGGDRRRRRNR

SEQ ID NO: 1444898 - protein, 7 aa, Mycobacterium tuberculosis
GRPRRAG

SEQ ID NO: 1444899 - protein, 6 aa, Mycobacterium tuberculosis
GRPRRD

SEQ ID NO: 1444900 - protein, 6 aa, Mycobacterium tuberculosis
GRPSWR

SEQ ID NO: 1444901 - protein, 5 aa, Mycobacterium tuberculosis
GRPTS

SEQ ID NO: 1444902 - protein, 17 aa, Mycobacterium tuberculosis
GRQPLRRGRPVRGGADR

SEQ ID NO: 1444903 - protein, 9 aa, Mycobacterium tuberculosis
GRQPSARNF

SEQ ID NO: 1444904 - protein, 24 aa, Mycobacterium tuberculosis
GRQRAVTGGHGGCQRRKRRPRRPR

SEQ ID NO: 1444905 - protein, 16 aa, Mycobacterium tuberculosis
GRQREQQRAVDTGCGR

SEQ ID NO: 1444906 - protein, 5 aa, Mycobacterium tuberculosis
GRQRR

SEQ ID NO: 1444907 - protein, 9 aa, Mycobacterium tuberculosis
GRQSEEGSG

SEQ ID NO: 1444908 - protein, 16 aa, Mycobacterium tuberculosis
GRQTQNPERGRKRPRG

SEQ ID NO: 1444909 - protein, 8 aa, Mycobacterium tuberculosis
GRRAGGNA

SEQ ID NO: 1444910 - protein, 8 aa, Mycobacterium tuberculosis
GRRAGRQQ

SEQ ID NO: 1444911 - protein, 23 aa, Mycobacterium tuberculosis
GRRGRRARQGRLRGRGRRHRRHR

SEQ ID NO: 1444912 - protein, 8 aa, Mycobacterium tuberculosis
GRRGTNRA

SEQ ID NO: 1444913 - protein, 48 aa, Mycobacterium tuberculosis
GRRHRRADRRRPVTRAGRRGISADRGGEHGQRGQKDLRAKGTRRDAVR

SEQ ID NO: 1444914 - protein, 5 aa, Mycobacterium tuberculosis
GRRLG

SEQ ID NO: 1444915 - protein, 11 aa, Mycobacterium tuberculosis
GRRPGCDRRGQ

SEQ ID NO: 1444916 - protein, 13 aa, Mycobacterium tuberculosis
GRRPGQPGELTGV

SEQ ID NO: 1444917 - protein, 8 aa, Mycobacterium tuberculosis
GRRPGRPE

SEQ ID NO: 1444918 - protein, 23 aa, Mycobacterium tuberculosis
GRRPGRRSGPALDRGDAAVRSRP

SEQ ID NO: 1444919 - protein, 18 aa, Mycobacterium tuberculosis
GRRPRHPHGADPTNGRRA

SEQ ID NO: 1444920 - protein, 37 aa, Mycobacterium tuberculosis
GRRPRTRAGAGGSGPTPWPAGADTGRCAPPYWPPPPR

SEQ ID NO: 1444921 - protein, 20 aa, Mycobacterium tuberculosis
GRRPTPGTAAYGAAKGRPGK

SEQ ID NO: 1444922 - protein, 21 aa, Mycobacterium tuberculosis
GRRQQGVGNQVPPSPRGEGAE

SEQ ID NO: 1444923 - protein, 4 aa, Mycobacterium tuberculosis
GRRR

SEQ ID NO: 1444924 - protein, 167 aa, Mycobacterium tuberculosis
GRRRRRGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGNGGAGGKGGAGT

SEQ ID NO: 1444925 - protein, 8 aa, Mycobacterium tuberculosis
GRRRRTGR

SEQ ID NO: 1444926 - protein, 28 aa, Mycobacterium tuberculosis
GRRSAPAKRGRRGPDHDGVGPPPPDEVS

SEQ ID NO: 1444927 - protein, 30 aa, Mycobacterium tuberculosis
GRRSAVSAQPGTLGDGLHSDGPRNPFTPKR

SEQ ID NO: 1444928 - protein, 10 aa, Mycobacterium tuberculosis
GRRTGADQRA

SEQ ID NO: 1444929 - protein, 15 aa, Mycobacterium tuberculosis
GRSAAQAIEDGVEPR

SEQ ID NO: 1444930 - protein, 14 aa, Mycobacterium tuberculosis
GRSAEQRVALDLLL

SEQ ID NO: 1444931 - protein, 11 aa, Mycobacterium tuberculosis
GRSGGGSSAMG

SEQ ID NO: 1444932 - protein, 29 aa, Mycobacterium tuberculosis
GRSGVGVAESGASYAARDALAAASYLSGG

SEQ ID NO: 1444933 - protein, 16 aa, Mycobacterium tuberculosis
GRSKSNDMVLPDGKVS

SEQ ID NO: 1444934 - protein, 19 aa, Mycobacterium tuberculosis
GRSPDQLTTVGNDAGRAAG

SEQ ID NO: 1444935 - protein, 12 aa, Mycobacterium tuberculosis
GRSPRCSQTGSS

SEQ ID NO: 1444936 - protein, 13 aa, Mycobacterium tuberculosis
GRSVRRRLDRRPA

SEQ ID NO: 1444937 - protein, 10 aa, Mycobacterium tuberculosis
GRTDQRLAGP

SEQ ID NO: 1444938 - protein, 14 aa, Mycobacterium tuberculosis
GRTPATPPPRGSFS

SEQ ID NO: 1444939 - protein, 16 aa, Mycobacterium tuberculosis
GRTRGDGGAGGVGGNG

SEQ ID NO: 1444940 - protein, 16 aa, Mycobacterium tuberculosis
GRTRLRRNRSASSTDE

SEQ ID NO: 1444941 - protein, 6 aa, Mycobacterium tuberculosis
GRTTRA

SEQ ID NO: 1444942 - protein, 4 aa, Mycobacterium tuberculosis
GRTV

SEQ ID NO: 1444943 - protein, 7 aa, Mycobacterium tuberculosis
GRVATAA

SEQ ID NO: 1444944 - protein, 11 aa, Mycobacterium tuberculosis
GRVGSAASAGM

SEQ ID NO: 1444945 - protein, 13 aa, Mycobacterium tuberculosis
GRVPRQSAVAAVR

SEQ ID NO: 1444946 - protein, 18 aa, Mycobacterium tuberculosis
GRVPRSRSTARRSSPLGW

SEQ ID NO: 1444947 - protein, 18 aa, Mycobacterium tuberculosis
GRVPTVRESRRAAMSSRN

SEQ ID NO: 1444948 - protein, 12 aa, Mycobacterium tuberculosis
GRVSGSAARSGT

SEQ ID NO: 1444949 - protein, 9 aa, Mycobacterium tuberculosis
GRWGPPNPG

SEQ ID NO: 1444950 - protein, 5 aa, Mycobacterium tuberculosis
GRWTG

SEQ ID NO: 1444951 - protein, 22 aa, Mycobacterium tuberculosis
GSAAKRCAGRPPVKRPHSQPAG

SEQ ID NO: 1444952 - protein, 26 aa, Mycobacterium tuberculosis
GSAATATPPNPNDSAAIQSARSSADR

SEQ ID NO: 1444953 - protein, 9 aa, Mycobacterium tuberculosis
GSAATGGAG

SEQ ID NO: 1444954 - protein, 5 aa, Mycobacterium tuberculosis
GSACP

SEQ ID NO: 1444955 - protein, 36 aa, Mycobacterium tuberculosis
GSADCSSATAATAVPADSVPDPSALPVGSAGPGGAA

SEQ ID NO: 1444956 - protein, 21 aa, Mycobacterium tuberculosis
GSAELAESSVQGRMLELSWPG

SEQ ID NO: 1444957 - protein, 21 aa, Mycobacterium tuberculosis
GSAGQEALEGSAAPVQAAEPT

SEQ ID NO: 1444958 - protein, 9 aa, Mycobacterium tuberculosis
GSAGSGQRR

SEQ ID NO: 1444959 - protein, 33 aa, Mycobacterium tuberculosis
GSAPAAPAKAAPAAPGGTGGSGGTGGLRRQKAA

SEQ ID NO: 1444960 - protein, 10 aa, Mycobacterium tuberculosis
GSAQTGRNGA

SEQ ID NO: 1444961 - protein, 31 aa, Mycobacterium tuberculosis
GSARKGTAAPEATAASSPGNGGTRRHRRNWH

SEQ ID NO: 1444962 - protein, 6 aa, Mycobacterium tuberculosis
GSATVH

SEQ ID NO: 1444963 - protein, 15 aa, Mycobacterium tuberculosis
GSCSANPGRQGPSRR

SEQ ID NO: 1444964 - protein, 6 aa, Mycobacterium tuberculosis
GSDEER

SEQ ID NO: 1444965 - protein, 10 aa, Mycobacterium tuberculosis
GSDGADTIGA

SEQ ID NO: 1444966 - protein, 19 aa, Mycobacterium tuberculosis
GSDGVAAGSGGGSGGAGGG

SEQ ID NO: 1444967 - protein, 9 aa, Mycobacterium tuberculosis
GSDLDRRGG

SEQ ID NO: 1444968 - protein, 7 aa, Mycobacterium tuberculosis
GSDPLDD

SEQ ID NO: 1444969 - protein, 14 aa, Mycobacterium tuberculosis
GSDSRSEPSQLSDR

SEQ ID NO: 1444970 - protein, 22 aa, Mycobacterium tuberculosis
GSDTAGSIGKPAALTATVGGQT

SEQ ID NO: 1444971 - protein, 6 aa, Mycobacterium tuberculosis
GSEAGL

SEQ ID NO: 1444972 - protein, 6 aa, Mycobacterium tuberculosis
GSEAQK

SEQ ID NO: 1444973 - protein, 10 aa, Mycobacterium tuberculosis
GSEIGGSTRI

SEQ ID NO: 1444974 - protein, 12 aa, Mycobacterium tuberculosis
GSEISATPISAA

SEQ ID NO: 1444975 - protein, 33 aa, Mycobacterium tuberculosis
GSFNSGTLNTGDLNSGDFNTGWANSGDINTGGF

SEQ ID NO: 1444976 - protein, 19 aa, Mycobacterium tuberculosis
GSGAAGQAGGAGGRRADRP

SEQ ID NO: 1444977 - protein, 6 aa, Mycobacterium tuberculosis
GSGADP

SEQ ID NO: 1444978 - protein, 18 aa, Mycobacterium tuberculosis
GSGANGAPGTGQAGGDGG

SEQ ID NO: 1444979 - protein, 6 aa, Mycobacterium tuberculosis
GSGDPV

SEQ ID NO: 1444980 - protein, 4 aa, Mycobacterium tuberculosis
GSGF

SEQ ID NO: 1444981 - protein, 118 aa, Mycobacterium tuberculosis
GSGGAGGQGGTGLAGTNGVNPGSIANPNTGANGTDNSGNGNQTGGNGGPGPAGGVGEAGGVGGQGGLGESLDGNDGTGGKGGAGGTVGTDGGAGGAGGAGGIGETDGSAGGVATGGEG

SEQ ID NO: 1444982 - protein, 183 aa, Mycobacterium tuberculosis
GSGGAGGQGGTGLAGTNGVNPGSIANPNTGANGTDNSGNGNQTGGNGGPGPAGGVGEAGGVGGQGGLGESLDGNDGTGGKGGAGGTVGTDGGAGGAGGAGGIGETDGSAGGVATGGEGGDGATGGVDGGVGGAGGKGGQGHNTGVGDAFGGDGGIGGDGNGALGAAGGNGGTGGAGGNGGRGG

SEQ ID NO: 1444983 - protein, 27 aa, Mycobacterium tuberculosis
GSGGAGGSGGTGTLSGGRGGAGGNAGT

SEQ ID NO: 1444984 - protein, 10 aa, Mycobacterium tuberculosis
GSGGAGGVGG

SEQ ID NO: 1444985 - protein, 24 aa, Mycobacterium tuberculosis
GSGGDGGNGGNAGLIGNGGNGGNA

SEQ ID NO: 1444986 - protein, 12 aa, Mycobacterium tuberculosis
GSGGFGGAGGAA

SEQ ID NO: 1444987 - protein, 24 aa, Mycobacterium tuberculosis
GSGGFGGAGGAAAGGGTRRRGRER

SEQ ID NO: 1444988 - protein, 22 aa, Mycobacterium tuberculosis
GSGGFGGAGGGRGGRWAPPAAW

SEQ ID NO: 1444989 - protein, 24 aa, Mycobacterium tuberculosis
GSGGFGGAGRGRGGGGHHRRRGRG

SEQ ID NO: 1444990 - protein, 13 aa, Mycobacterium tuberculosis
GSGGGTGGAGGAG

SEQ ID NO: 1444991 - protein, 24 aa, Mycobacterium tuberculosis
GSGGNGGSGLAGSGQKGGNGGAAG

SEQ ID NO: 1444992 - protein, 6 aa, Mycobacterium tuberculosis
GSGGPV

SEQ ID NO: 1444993 - protein, 9 aa, Mycobacterium tuberculosis
GSGGSSLTA

SEQ ID NO: 1444994 - protein, 26 aa, Mycobacterium tuberculosis
GSGGVGGAGGFGETGDGGVGGAGGKA

SEQ ID NO: 1444995 - protein, 15 aa, Mycobacterium tuberculosis
GSGIGGLDDWLRLRA

SEQ ID NO: 1444996 - protein, 8 aa, Mycobacterium tuberculosis
GSGNAGAA

SEQ ID NO: 1444997 - protein, 29 aa, Mycobacterium tuberculosis
GSGNFGSTNVGSGNIGDTNFGNGNNGNFN

SEQ ID NO: 1444998 - protein, 9 aa, Mycobacterium tuberculosis
GSGNGEPTG

SEQ ID NO: 1444999 - protein, 66 aa, Mycobacterium tuberculosis
GSGNGRAGLPGSGNVGNGNLGNSNLGSGNTGNSNVGFGNTGNNNVGTGNAGSGNIGAGNTGSSNWG

SEQ ID NO: 1445000 - protein, 15 aa, Mycobacterium tuberculosis
GSGPDPLTDIAGTGG

SEQ ID NO: 1445001 - protein, 8 aa, Mycobacterium tuberculosis
GSGPPVPL

SEQ ID NO: 1445002 - protein, 5 aa, Mycobacterium tuberculosis
GSGRP

SEQ ID NO: 1445003 - protein, 12 aa, Mycobacterium tuberculosis
GSGRRRGKLSNI

SEQ ID NO: 1445004 - protein, 9 aa, Mycobacterium tuberculosis
GSGSGATEL

SEQ ID NO: 1445005 - protein, 10 aa, Mycobacterium tuberculosis
GSGSNPPRGV

SEQ ID NO: 1445006 - protein, 10 aa, Mycobacterium tuberculosis
GSGSSVTSNA

SEQ ID NO: 1445007 - protein, 8 aa, Mycobacterium tuberculosis
GSGTAWPA

SEQ ID NO: 1445008 - protein, 7 aa, Mycobacterium tuberculosis
GSGTTAR

SEQ ID NO: 1445009 - protein, 21 aa, Mycobacterium tuberculosis
GSHGRRSSSSLRSASSPAVVN

SEQ ID NO: 1445010 - protein, 8 aa, Mycobacterium tuberculosis
GSHNAGFG

SEQ ID NO: 1445011 - protein, 8 aa, Mycobacterium tuberculosis
GSHPKGAV

SEQ ID NO: 1445012 - protein, 12 aa, Mycobacterium tuberculosis
GSIADANDAAQF

SEQ ID NO: 1445013 - protein, 6 aa, Mycobacterium tuberculosis
GSIPVE

SEQ ID NO: 1445014 - protein, 53 aa, Mycobacterium tuberculosis
GSISKEQRARCRRGPQTRATQSGGGDVQPGAGHRHGRGRSGDPSTGTTIGGQR

SEQ ID NO: 1445015 - protein, 7 aa, Mycobacterium tuberculosis
GSKQERV

SEQ ID NO: 1445016 - protein, 11 aa, Mycobacterium tuberculosis
GSKTGLPSDNY

SEQ ID NO: 1445017 - protein, 19 aa, Mycobacterium tuberculosis
GSKTTGWLPPAGAFAYQGG

SEQ ID NO: 1445018 - protein, 8 aa, Mycobacterium tuberculosis
GSLAPQQP

SEQ ID NO: 1445019 - protein, 4 aa, Mycobacterium tuberculosis
GSLG

SEQ ID NO: 1445020 - protein, 14 aa, Mycobacterium tuberculosis
GSLGLPPAVKARAS

SEQ ID NO: 1445021 - protein, 8 aa, Mycobacterium tuberculosis
GSLPQRIA

SEQ ID NO: 1445022 - protein, 19 aa, Mycobacterium tuberculosis
GSLSVNRSRSAERSRRYPL

SEQ ID NO: 1445023 - protein, 10 aa, Mycobacterium tuberculosis
GSNQGVTTTD

SEQ ID NO: 1445024 - protein, 13 aa, Mycobacterium tuberculosis
GSNRVRETESTVS

SEQ ID NO: 1445025 - protein, 7 aa, Mycobacterium tuberculosis
GSNSAAV

SEQ ID NO: 1445026 - protein, 8 aa, Mycobacterium tuberculosis
GSPASWTS

SEQ ID NO: 1445027 - protein, 13 aa, Mycobacterium tuberculosis
GSPGAPETRANSA

SEQ ID NO: 1445028 - protein, 19 aa, Mycobacterium tuberculosis
GSPGGAAKVGMTENDPQAV

SEQ ID NO: 1445029 - protein, 28 aa, Mycobacterium tuberculosis
GSPGGAAKVGMTENDPQAVKDLAPQSEN

SEQ ID NO: 1445030 - protein, 29 aa, Mycobacterium tuberculosis
GSPPLPPSPPPPPSPYSHPPTPPSPPRLP

SEQ ID NO: 1445031 - protein, 14 aa, Mycobacterium tuberculosis
GSPPRPGRLPTGSM

SEQ ID NO: 1445032 - protein, 8 aa, Mycobacterium tuberculosis
GSPPYQGD

SEQ ID NO: 1445033 - protein, 27 aa, Mycobacterium tuberculosis
GSPSWNGRKPNSGNAKAATMAARLDIL

SEQ ID NO: 1445034 - protein, 7 aa, Mycobacterium tuberculosis
GSPTATC

SEQ ID NO: 1445035 - protein, 6 aa, Mycobacterium tuberculosis
GSPYPR

SEQ ID NO: 1445036 - protein, 8 aa, Mycobacterium tuberculosis
GSPYSTPT

SEQ ID NO: 1445037 - protein, 4 aa, Mycobacterium tuberculosis
GSQG

SEQ ID NO: 1445038 - protein, 13 aa, Mycobacterium tuberculosis
GSQPAFPGLDEPP

SEQ ID NO: 1445039 - protein, 10 aa, Mycobacterium tuberculosis
GSQPLADDAE

SEQ ID NO: 1445040 - protein, 13 aa, Mycobacterium tuberculosis
GSQRRARSEAVAA

SEQ ID NO: 1445041 - protein, 17 aa, Mycobacterium tuberculosis
GSRAGGAGAIADPIDAR

SEQ ID NO: 1445042 - protein, 34 aa, Mycobacterium tuberculosis
GSRCSTAKPTASTLPISPSKWPARSHCGRPRPRR

SEQ ID NO: 1445043 - protein, 20 aa, Mycobacterium tuberculosis
GSRGPRESKYAQLPGGTNGF

SEQ ID NO: 1445044 - protein, 29 aa, Mycobacterium tuberculosis
GSRKTHDDRDGSATRGGPDRRRAEPVVQP

SEQ ID NO: 1445045 - protein, 8 aa, Mycobacterium tuberculosis
GSRLSSSA

SEQ ID NO: 1445046 - protein, 7 aa, Mycobacterium tuberculosis
GSRPPEC

SEQ ID NO: 1445047 - protein, 14 aa, Mycobacterium tuberculosis
GSRRHVTAASHRAS

SEQ ID NO: 1445048 - protein, 29 aa, Mycobacterium tuberculosis
GSRRRAAGSGAAHHRATRPKPGRGSPGGA

SEQ ID NO: 1445049 - protein, 33 aa, Mycobacterium tuberculosis
GSRTPRGSRRQPDELSDDPGRGSTTSQFELSSL

SEQ ID NO: 1445050 - protein, 25 aa, Mycobacterium tuberculosis
GSRTSTITPPHRNSATTNAPHRYAR

SEQ ID NO: 1445051 - protein, 12 aa, Mycobacterium tuberculosis
GSSALPTIAVPG

SEQ ID NO: 1445052 - protein, 12 aa, Mycobacterium tuberculosis
GSSAVGGEDGVR

SEQ ID NO: 1445053 - protein, 6 aa, Mycobacterium tuberculosis
GSSCSH

SEQ ID NO: 1445054 - protein, 10 aa, Mycobacterium tuberculosis
GSSHGRRRRR

SEQ ID NO: 1445055 - protein, 7 aa, Mycobacterium tuberculosis
GSSHSSE

SEQ ID NO: 1445056 - protein, 9 aa, Mycobacterium tuberculosis
GSSPRPYGG

SEQ ID NO: 1445057 - protein, 8 aa, Mycobacterium tuberculosis
GSSRNWAS

SEQ ID NO: 1445058 - protein, 5 aa, Mycobacterium tuberculosis
GSSSG

SEQ ID NO: 1445059 - protein, 57 aa, Mycobacterium tuberculosis
GSSSSIHVNGGNGGNGGNGDHALSGNGAAGGNGGNGGNVSLRGSGGAGGPRRQRRQC

SEQ ID NO: 1445060 - protein, 15 aa, Mycobacterium tuberculosis
GSSTENSAYGTTRNP

SEQ ID NO: 1445061 - protein, 6 aa, Mycobacterium tuberculosis
GSSTGM

SEQ ID NO: 1445062 - protein, 12 aa, Mycobacterium tuberculosis
GSTAVGAGHALR

SEQ ID NO: 1445063 - protein, 15 aa, Mycobacterium tuberculosis
GSTGEFKDKYGKSSA

SEQ ID NO: 1445064 - protein, 102 aa, Mycobacterium tuberculosis
GSTGGLGGNGGSGGLGGGGGSLFGNGGAGGVGATGGNGGSGIGPASVGGNGGKGGVGAAGGLAGQIGNGGSGGSGGAGGNGGTGDTAGNGGNGGAGAVGGNA

SEQ ID NO: 1445065 - protein, 4 aa, Mycobacterium tuberculosis
GSTI

SEQ ID NO: 1445066 - protein, 24 aa, Mycobacterium tuberculosis
GSTIAASTSTAATSRRSNSRLPTT

SEQ ID NO: 1445067 - protein, 17 aa, Mycobacterium tuberculosis
GSTIAGANAAAAPNTTS

SEQ ID NO: 1445068 - protein, 34 aa, Mycobacterium tuberculosis
GSTIGTANAAAAVPTPTCRGGPHGPISKTAPQMS

SEQ ID NO: 1445069 - protein, 23 aa, Mycobacterium tuberculosis
GSTIGTANAAARGPDHDGVGRRR

SEQ ID NO: 1445070 - protein, 17 aa, Mycobacterium tuberculosis
GSTINAANAAAALPTTG

SEQ ID NO: 1445071 - protein, 12 aa, Mycobacterium tuberculosis
GSTRRGAAGVGR

SEQ ID NO: 1445072 - protein, 55 aa, Mycobacterium tuberculosis
GSTRSINAGVAAGSRCTPGYGSTRTWAAPGRPRRADTKSHESTANRAILRLLAGP

SEQ ID NO: 1445073 - protein, 6 aa, Mycobacterium tuberculosis
GSTTST

SEQ ID NO: 1445074 - protein, 7 aa, Mycobacterium tuberculosis
GSTVEQA

SEQ ID NO: 1445075 - protein, 15 aa, Mycobacterium tuberculosis
GSTVEQAYRGLIAEV

SEQ ID NO: 1445076 - protein, 15 aa, Mycobacterium tuberculosis
GSTVSAASAAASAPT

SEQ ID NO: 1445077 - protein, 6 aa, Mycobacterium tuberculosis
GSVAAA

SEQ ID NO: 1445078 - protein, 4 aa, Mycobacterium tuberculosis
GSVD

SEQ ID NO: 1445079 - protein, 18 aa, Mycobacterium tuberculosis
GSVERSSEKSRCKYFVGD

SEQ ID NO: 1445080 - protein, 9 aa, Mycobacterium tuberculosis
GSVGKPIQG

SEQ ID NO: 1445081 - protein, 27 aa, Mycobacterium tuberculosis
GSVGQRSAASGLASGKLGSSRRPATFT

SEQ ID NO: 1445082 - protein, 7 aa, Mycobacterium tuberculosis
GSVPQLP

SEQ ID NO: 1445083 - protein, 15 aa, Mycobacterium tuberculosis
GSVSDAGGVAADGPL

SEQ ID NO: 1445084 - protein, 6 aa, Mycobacterium tuberculosis
GSVTRT

SEQ ID NO: 1445085 - protein, 12 aa, Mycobacterium tuberculosis
GSWVPGQPGGPD

SEQ ID NO: 1445086 - protein, 22 aa, Mycobacterium tuberculosis
GSYDYPGVDQPDDGPLSSEGHY

SEQ ID NO: 1445087 - protein, 16 aa, Mycobacterium tuberculosis
GSYNTGVGNEGTASTG

SEQ ID NO: 1445088 - protein, 12 aa, Mycobacterium tuberculosis
GSYSKNGKLRTV

SEQ ID NO: 1445089 - protein, 7 aa, Mycobacterium tuberculosis
GSYTARA

SEQ ID NO: 1445090 - protein, 40 aa, Mycobacterium tuberculosis
GTAAGQARGPGGRRCEGRQDPIGDRGAGPGDLAQSLGREH

SEQ ID NO: 1445091 - protein, 35 aa, Mycobacterium tuberculosis
GTADRAPSPPGVPGGNTLVGNGGAGGAWRHQAVFT

SEQ ID NO: 1445092 - protein, 7 aa, Mycobacterium tuberculosis
GTAGAAV

SEQ ID NO: 1445093 - protein, 13 aa, Mycobacterium tuberculosis
GTAGKIMTDTPFR

SEQ ID NO: 1445094 - protein, 8 aa, Mycobacterium tuberculosis
GTAIPSNV

SEQ ID NO: 1445095 - protein, 6 aa, Mycobacterium tuberculosis
GTAPIR

SEQ ID NO: 1445096 - protein, 7 aa, Mycobacterium tuberculosis
GTARREA

SEQ ID NO: 1445097 - protein, 8 aa, Mycobacterium tuberculosis
GTARREAV

SEQ ID NO: 1445098 - protein, 9 aa, Mycobacterium tuberculosis
GTASHRTTD

SEQ ID NO: 1445099 - protein, 5 aa, Mycobacterium tuberculosis
GTATL

SEQ ID NO: 1445100 - protein, 16 aa, Mycobacterium tuberculosis
GTAVAGLSERGEGVTT

SEQ ID NO: 1445101 - protein, 7 aa, Mycobacterium tuberculosis
GTDEVST

SEQ ID NO: 1445102 - protein, 9 aa, Mycobacterium tuberculosis
GTDQAARTT

SEQ ID NO: 1445103 - protein, 20 aa, Mycobacterium tuberculosis
GTDREHDRDVCSPRSQHRPA

SEQ ID NO: 1445104 - protein, 17 aa, Mycobacterium tuberculosis
GTEARYGLPRKPAFVSC

SEQ ID NO: 1445105 - protein, 10 aa, Mycobacterium tuberculosis
GTEDQPVAAE

SEQ ID NO: 1445106 - protein, 21 aa, Mycobacterium tuberculosis
GTEDQPVAAETLQDHDCSITK

SEQ ID NO: 1445107 - protein, 7 aa, Mycobacterium tuberculosis
GTEEQRR

SEQ ID NO: 1445108 - protein, 39 aa, Mycobacterium tuberculosis
GTFAGSRPPWTDTGQSSNHIGETDVTDDAEVEDRTAPRP

SEQ ID NO: 1445109 - protein, 11 aa, Mycobacterium tuberculosis
GTGANGGAGGN

SEQ ID NO: 1445110 - protein, 10 aa, Mycobacterium tuberculosis
GTGEPPGIGS

SEQ ID NO: 1445111 - protein, 4 aa, Mycobacterium tuberculosis
GTGF

SEQ ID NO: 1445112 - protein, 4 aa, Mycobacterium tuberculosis
GTGG

SEQ ID NO: 1445113 - protein, 12 aa, Mycobacterium tuberculosis
GTGGAGGAGGAT

SEQ ID NO: 1445114 - protein, 25 aa, Mycobacterium tuberculosis
GTGGAGGAGGFGGFGGDGGDGGIGG

SEQ ID NO: 1445115 - protein, 12 aa, Mycobacterium tuberculosis
GTGGAGGDGGNA

SEQ ID NO: 1445116 - protein, 66 aa, Mycobacterium tuberculosis
GTGGAGGHGGQGGGTGGPPLPGQAGMGAAGGAGGLIGNGGAGGDGGVGGDSSFANGAAGGAGGAGG

SEQ ID NO: 1445117 - protein, 52 aa, Mycobacterium tuberculosis
GTGGAGGVGGGGGAGGDGGRGGVATPGGQGGDAGDGGAGGAGGNGGGASGAG

SEQ ID NO: 1445118 - protein, 53 aa, Mycobacterium tuberculosis
GTGGAGGVGGGGGAGGDGGRGGVATPGGQGGDAGDGGAGGAGGNGGGASGAGG

SEQ ID NO: 1445119 - protein, 20 aa, Mycobacterium tuberculosis
GTGGAGGVGGGGGVGGLGGL

SEQ ID NO: 1445120 - protein, 6 aa, Mycobacterium tuberculosis
GTGGAV

SEQ ID NO: 1445121 - protein, 16 aa, Mycobacterium tuberculosis
GTGGKGGNGGNGGAGM

SEQ ID NO: 1445122 - protein, 35 aa, Mycobacterium tuberculosis
GTGGKRRVTAGNGGARHDQRPASAAFGGAAGGDAF

SEQ ID NO: 1445123 - protein, 25 aa, Mycobacterium tuberculosis
GTGGNGGNGGNAGVGGTGGKAGTEL

SEQ ID NO: 1445124 - protein, 23 aa, Mycobacterium tuberculosis
GTGGQGGAGGAGGAGGAAGAGTV

SEQ ID NO: 1445125 - protein, 9 aa, Mycobacterium tuberculosis
GTGKDAITS

SEQ ID NO: 1445126 - protein, 7 aa, Mycobacterium tuberculosis
GTGNAEL

SEQ ID NO: 1445127 - protein, 15 aa, Mycobacterium tuberculosis
GTGPVSAGLGNAATI

SEQ ID NO: 1445128 - protein, 7 aa, Mycobacterium tuberculosis
GTGSRDY

SEQ ID NO: 1445129 - protein, 4 aa, Mycobacterium tuberculosis
GTGT

SEQ ID NO: 1445130 - protein, 11 aa, Mycobacterium tuberculosis
GTGTKIGDPIE

SEQ ID NO: 1445131 - protein, 10 aa, Mycobacterium tuberculosis
GTGTVASTDQ

SEQ ID NO: 1445132 - protein, 45 aa, Mycobacterium tuberculosis
GTGWNGGKGDTGSGGGAGDGGKAPAGGTGGAGGDGGAGGKGGSGG

SEQ ID NO: 1445133 - protein, 30 aa, Mycobacterium tuberculosis
GTHGSRRPAPEAAPGKGAADQRARGSVAAF

SEQ ID NO: 1445134 - protein, 11 aa, Mycobacterium tuberculosis
GTIGAQGESAD

SEQ ID NO: 1445135 - protein, 10 aa, Mycobacterium tuberculosis
GTKPGTEVPP

SEQ ID NO: 1445136 - protein, 9 aa, Mycobacterium tuberculosis
GTKPRMPKR

SEQ ID NO: 1445137 - protein, 13 aa, Mycobacterium tuberculosis
GTLPPGPTRARAA

SEQ ID NO: 1445138 - protein, 25 aa, Mycobacterium tuberculosis
GTLQRTPTGRGRGVRGGETGKTPAC

SEQ ID NO: 1445139 - protein, 4 aa, Mycobacterium tuberculosis
GTLT

SEQ ID NO: 1445140 - protein, 9 aa, Mycobacterium tuberculosis
GTPAAATAA

SEQ ID NO: 1445141 - protein, 4 aa, Mycobacterium tuberculosis
GTPE

SEQ ID NO: 1445142 - protein, 12 aa, Mycobacterium tuberculosis
GTPGRRGVGDRG

SEQ ID NO: 1445143 - protein, 15 aa, Mycobacterium tuberculosis
GTPHTATGSATASAT

SEQ ID NO: 1445144 - protein, 7 aa, Mycobacterium tuberculosis
GTPMAPH

SEQ ID NO: 1445145 - protein, 31 aa, Mycobacterium tuberculosis
GTPNPPAETTTTANQALRTTVSQRPVATAVT

SEQ ID NO: 1445146 - protein, 24 aa, Mycobacterium tuberculosis
GTPSFGVSSSGGHPDGHRATRGAN

SEQ ID NO: 1445147 - protein, 30 aa, Mycobacterium tuberculosis
GTPSRQLRRRSPRSAPPVDRSRAQRRPRTF

SEQ ID NO: 1445148 - protein, 5 aa, Mycobacterium tuberculosis
GTPTM

SEQ ID NO: 1445149 - protein, 95 aa, Mycobacterium tuberculosis
GTQAPRTSACSTPAPTTSASATRAPATGVSATPAAATPASATPAALTRASSTPASSTPVSPTRAATTPAGTTPATPTPASPTWATSTRASTTPAI

SEQ ID NO: 1445150 - protein, 7 aa, Mycobacterium tuberculosis
GTQEGGA

SEQ ID NO: 1445151 - protein, 6 aa, Mycobacterium tuberculosis
GTQGRL

SEQ ID NO: 1445152 - protein, 7 aa, Mycobacterium tuberculosis
GTQGVVP

SEQ ID NO: 1445153 - protein, 8 aa, Mycobacterium tuberculosis
GTQGVVPD

SEQ ID NO: 1445154 - protein, 8 aa, Mycobacterium tuberculosis
GTQPDYSH

SEQ ID NO: 1445155 - protein, 7 aa, Mycobacterium tuberculosis
GTRAHSA

SEQ ID NO: 1445156 - protein, 12 aa, Mycobacterium tuberculosis
GTRCTGWIAPIS

SEQ ID NO: 1445157 - protein, 7 aa, Mycobacterium tuberculosis
GTRDGDL

SEQ ID NO: 1445158 - protein, 8 aa, Mycobacterium tuberculosis
GTRGPLTD

SEQ ID NO: 1445159 - protein, 22 aa, Mycobacterium tuberculosis
GTRPTDREAANHDGTTPRNREL

SEQ ID NO: 1445160 - protein, 10 aa, Mycobacterium tuberculosis
GTRPTTQTDA

SEQ ID NO: 1445161 - protein, 9 aa, Mycobacterium tuberculosis
GTRQTLQGA

SEQ ID NO: 1445162 - protein, 13 aa, Mycobacterium tuberculosis
GTRRAEAAAESAR

SEQ ID NO: 1445163 - protein, 8 aa, Mycobacterium tuberculosis
GTRRRSPR

SEQ ID NO: 1445164 - protein, 17 aa, Mycobacterium tuberculosis
GTSDISKPVGLGFSKGG

SEQ ID NO: 1445165 - protein, 9 aa, Mycobacterium tuberculosis
GTSGSGKSE

SEQ ID NO: 1445166 - protein, 26 aa, Mycobacterium tuberculosis
GTSPTRTSAPRPWTASTRSSTPQRSS

SEQ ID NO: 1445167 - protein, 18 aa, Mycobacterium tuberculosis
GTTANTAGLAGAEPAGLA

SEQ ID NO: 1445168 - protein, 18 aa, Mycobacterium tuberculosis
GTTPAATKAPDPDEEAPA

SEQ ID NO: 1445169 - protein, 5 aa, Mycobacterium tuberculosis
GTTPL

SEQ ID NO: 1445170 - protein, 9 aa, Mycobacterium tuberculosis
GTTPQVGQG

SEQ ID NO: 1445171 - protein, 25 aa, Mycobacterium tuberculosis
GTTRPVRQQRSRRLTEPAGAGNPDL

SEQ ID NO: 1445172 - protein, 23 aa, Mycobacterium tuberculosis
GTTRRGRRPRSTSKRSTPCPSGR

SEQ ID NO: 1445173 - protein, 5 aa, Mycobacterium tuberculosis
GTTSI

SEQ ID NO: 1445174 - protein, 12 aa, Mycobacterium tuberculosis
GTTTVGDNVAVA

SEQ ID NO: 1445175 - protein, 24 aa, Mycobacterium tuberculosis
GTVGPGAGDVSAVRSRDRKRGDAR

SEQ ID NO: 1445176 - protein, 4 aa, Mycobacterium tuberculosis
GTVK

SEQ ID NO: 1445177 - protein, 10 aa, Mycobacterium tuberculosis
GTVPNRHTPV

SEQ ID NO: 1445178 - protein, 4 aa, Mycobacterium tuberculosis
GTVR

SEQ ID NO: 1445179 - protein, 8 aa, Mycobacterium tuberculosis
GTVSTAPA

SEQ ID NO: 1445180 - protein, 8 aa, Mycobacterium tuberculosis
GTWEANGG

SEQ ID NO: 1445181 - protein, 18 aa, Mycobacterium tuberculosis
GTWPSGTTVHANPDGTAF

SEQ ID NO: 1445182 - protein, 23 aa, Mycobacterium tuberculosis
GTYNTGGYNVGSTNTGSFNDGDF

SEQ ID NO: 1445183 - protein, 17 aa, Mycobacterium tuberculosis
GTYPSTASTRRYWAHEL

SEQ ID NO: 1445184 - protein, 12 aa, Mycobacterium tuberculosis
GTYTTGAQQQST

SEQ ID NO: 1445185 - protein, 13 aa, Mycobacterium tuberculosis
GVAADAAGLGVGG

SEQ ID NO: 1445186 - protein, 16 aa, Mycobacterium tuberculosis
GVAAGPASAGVHADAQ

SEQ ID NO: 1445187 - protein, 13 aa, Mycobacterium tuberculosis
GVAAGRGRLGVGG

SEQ ID NO: 1445188 - protein, 17 aa, Mycobacterium tuberculosis
GVACPDGSTAPSSETYA

SEQ ID NO: 1445189 - protein, 7 aa, Mycobacterium tuberculosis
GVADGEA

SEQ ID NO: 1445190 - protein, 11 aa, Mycobacterium tuberculosis
GVAESTASRWR

SEQ ID NO: 1445191 - protein, 16 aa, Mycobacterium tuberculosis
GVAGQGGGRRQGRHSS

SEQ ID NO: 1445192 - protein, 13 aa, Mycobacterium tuberculosis
GVAKGSAEPHKTK

SEQ ID NO: 1445193 - protein, 11 aa, Mycobacterium tuberculosis
GVANGGSYNTG

SEQ ID NO: 1445194 - protein, 28 aa, Mycobacterium tuberculosis
GVATQRVGRTDHATGRPAGGVRLVIRAT

SEQ ID NO: 1445195 - protein, 13 aa, Mycobacterium tuberculosis
GVATRSAGDHSRL

SEQ ID NO: 1445196 - protein, 28 aa, Mycobacterium tuberculosis
GVATSAGGRTDHATGRPAGGVRLVIRAT

SEQ ID NO: 1445197 - protein, 31 aa, Mycobacterium tuberculosis
GVDDGQSKPGAAGGARGVGGFRESRADCGEQ

SEQ ID NO: 1445198 - protein, 25 aa, Mycobacterium tuberculosis
GVDDQGAGAVVPGTGHGSDEGIEEK

SEQ ID NO: 1445199 - protein, 11 aa, Mycobacterium tuberculosis
GVDGDAASQRQ

SEQ ID NO: 1445200 - protein, 5 aa, Mycobacterium tuberculosis
GVDRK

SEQ ID NO: 1445201 - protein, 11 aa, Mycobacterium tuberculosis
GVEPDRATSRC

SEQ ID NO: 1445202 - protein, 22 aa, Mycobacterium tuberculosis
GVEPKDVAKAPAGPRRRGRTVG

SEQ ID NO: 1445203 - protein, 12 aa, Mycobacterium tuberculosis
GVETHPPNRHES

SEQ ID NO: 1445204 - protein, 8 aa, Mycobacterium tuberculosis
GVETRTGV

SEQ ID NO: 1445205 - protein, 11 aa, Mycobacterium tuberculosis
GVGAKDRMPTP

SEQ ID NO: 1445206 - protein, 15 aa, Mycobacterium tuberculosis
GVGAKDRMPTPYLPV

SEQ ID NO: 1445207 - protein, 6 aa, Mycobacterium tuberculosis
GVGARR

SEQ ID NO: 1445208 - protein, 18 aa, Mycobacterium tuberculosis
GVGASEGQNAGHRDHHGR

SEQ ID NO: 1445209 - protein, 10 aa, Mycobacterium tuberculosis
GVGDATGRVV

SEQ ID NO: 1445210 - protein, 17 aa, Mycobacterium tuberculosis
GVGDRAGRAGPGGIPVR

SEQ ID NO: 1445211 - protein, 8 aa, Mycobacterium tuberculosis
GVGDTGGV

SEQ ID NO: 1445212 - protein, 12 aa, Mycobacterium tuberculosis
GVGGAGGNGGTA

SEQ ID NO: 1445213 - protein, 9 aa, Mycobacterium tuberculosis
GVGGGAGHD

SEQ ID NO: 1445214 - protein, 69 aa, Mycobacterium tuberculosis
GVGGTGGSGAPGGGGGAGGDGGAANTDSAGSSRKAFGGDGGVGGDGASALGTGGEGGIGGQGGNGGAGG

SEQ ID NO: 1445215 - protein, 23 aa, Mycobacterium tuberculosis
GVGGVGGKGGFGGAGGAGGNGGL

SEQ ID NO: 1445216 - protein, 7 aa, Mycobacterium tuberculosis
GVGHPRK

SEQ ID NO: 1445217 - protein, 4 aa, Mycobacterium tuberculosis
GVGL

SEQ ID NO: 1445218 - protein, 57 aa, Mycobacterium tuberculosis
GVGNGGNGGDGGNGGDGGNGAPGGFGGGAGAGGLGGSGAGGGTDGDDGNGGSPGTDG

SEQ ID NO: 1445219 - protein, 8 aa, Mycobacterium tuberculosis
GVGNGGSF

SEQ ID NO: 1445220 - protein, 10 aa, Mycobacterium tuberculosis
GVGNSERQHR

SEQ ID NO: 1445221 - protein, 7 aa, Mycobacterium tuberculosis
GVGPDHC

SEQ ID NO: 1445222 - protein, 10 aa, Mycobacterium tuberculosis
GVGPESRRAS

SEQ ID NO: 1445223 - protein, 8 aa, Mycobacterium tuberculosis
GVGPGPPG

SEQ ID NO: 1445224 - protein, 6 aa, Mycobacterium tuberculosis
GVGTLD

SEQ ID NO: 1445225 - protein, 16 aa, Mycobacterium tuberculosis
GVGTPAGNVGAGGTGG

SEQ ID NO: 1445226 - protein, 5 aa, Mycobacterium tuberculosis
GVHER

SEQ ID NO: 1445227 - protein, 10 aa, Mycobacterium tuberculosis
GVHPNDAGHE

SEQ ID NO: 1445228 - protein, 4 aa, Mycobacterium tuberculosis
GVLS

SEQ ID NO: 1445229 - protein, 5 aa, Mycobacterium tuberculosis
GVLSG

SEQ ID NO: 1445230 - protein, 13 aa, Mycobacterium tuberculosis
GVNGGVGGAGGPR

SEQ ID NO: 1445231 - protein, 8 aa, Mycobacterium tuberculosis
GVNKPSMP

SEQ ID NO: 1445232 - protein, 12 aa, Mycobacterium tuberculosis
GVNQHPLTGAQR

SEQ ID NO: 1445233 - protein, 13 aa, Mycobacterium tuberculosis
GVNSDAPSRGLQT

SEQ ID NO: 1445234 - protein, 18 aa, Mycobacterium tuberculosis
GVPAATAATAPTSPPEVP

SEQ ID NO: 1445235 - protein, 17 aa, Mycobacterium tuberculosis
GVPAGFGPSRRNRAAAP

SEQ ID NO: 1445236 - protein, 13 aa, Mycobacterium tuberculosis
GVPAQAAAAPVDV

SEQ ID NO: 1445237 - protein, 11 aa, Mycobacterium tuberculosis
GVPDESTSSDL

SEQ ID NO: 1445238 - protein, 12 aa, Mycobacterium tuberculosis
GVPGQNTTNHIA

SEQ ID NO: 1445239 - protein, 4 aa, Mycobacterium tuberculosis
GVPK

SEQ ID NO: 1445240 - protein, 4 aa, Mycobacterium tuberculosis
GVPP

SEQ ID NO: 1445241 - protein, 25 aa, Mycobacterium tuberculosis
GVPPPPGDPVPPVDTHAGGRPADQL

SEQ ID NO: 1445242 - protein, 8 aa, Mycobacterium tuberculosis
GVPPRGVG

SEQ ID NO: 1445243 - protein, 11 aa, Mycobacterium tuberculosis
GVPRDDEPPLD

SEQ ID NO: 1445244 - protein, 10 aa, Mycobacterium tuberculosis
GVPSQNPNLI

SEQ ID NO: 1445245 - protein, 34 aa, Mycobacterium tuberculosis
GVPWSSENARSSPPPTASARCSTRSASWAVRTTQ

SEQ ID NO: 1445246 - protein, 5 aa, Mycobacterium tuberculosis
GVQKA

SEQ ID NO: 1445247 - protein, 15 aa, Mycobacterium tuberculosis
GVQPTRVDTARVETA

SEQ ID NO: 1445248 - protein, 14 aa, Mycobacterium tuberculosis
GVQQSGSRRQPRAL

SEQ ID NO: 1445249 - protein, 7 aa, Mycobacterium tuberculosis
GVRAGDG

SEQ ID NO: 1445250 - protein, 25 aa, Mycobacterium tuberculosis
GVRGEPGDRSEYRVGQRRQHNAGFG

SEQ ID NO: 1445251 - protein, 10 aa, Mycobacterium tuberculosis
GVRRGQDPHR

SEQ ID NO: 1445252 - protein, 7 aa, Mycobacterium tuberculosis
GVSGGLG

SEQ ID NO: 1445253 - protein, 17 aa, Mycobacterium tuberculosis
GVSGVDDAGVERVKVTS

SEQ ID NO: 1445254 - protein, 20 aa, Mycobacterium tuberculosis
GVSHDSSHTRPSRREAPDRN

SEQ ID NO: 1445255 - protein, 12 aa, Mycobacterium tuberculosis
GVSPNPAAAGGA

SEQ ID NO: 1445256 - protein, 37 aa, Mycobacterium tuberculosis; identical to SEQ ID NO: 194283

SEQ ID NO: 1445257 - protein, 4 aa, Mycobacterium tuberculosis
GVTE

SEQ ID NO: 1445258 - protein, 7 aa, Mycobacterium tuberculosis
GVTEPDV

SEQ ID NO: 1445259 - protein, 5 aa, Mycobacterium tuberculosis
GVTIE

SEQ ID NO: 1445260 - protein, 10 aa, Mycobacterium tuberculosis
GVVDAPEDAL

SEQ ID NO: 1445261 - protein, 66 aa, Mycobacterium tuberculosis
GVVSPNGGGPGRRRAGTGQHPPGGARRGPGGPGGAFTPHGGTGPDQVGTGGLHGGPEGQAVPAGPG

SEQ ID NO: 1445262 - protein, 20 aa, Mycobacterium tuberculosis
GWKERSNAPGYGLDAEQSGF

SEQ ID NO: 1445263 - protein, 8 aa, Mycobacterium tuberculosis
GWKSNGTV

SEQ ID NO: 1445264 - protein, 8 aa, Mycobacterium tuberculosis
GWNSGTAN

SEQ ID NO: 1445265 - protein, 12 aa, Mycobacterium tuberculosis
GWPDRARAENWS

SEQ ID NO: 1445266 - protein, 9 aa, Mycobacterium tuberculosis
GWPGGRHRR

SEQ ID NO: 1445267 - protein, 52 aa, Mycobacterium tuberculosis; identical to SEQ ID NO: 151672

SEQ ID NO: 1445268 - protein, 16 aa, Mycobacterium tuberculosis
GWPSLSGDRRLGGPAW

SEQ ID NO: 1445269 - protein, 10 aa, Mycobacterium tuberculosis
GWQRGPVRQR

SEQ ID NO: 1445270 - protein, 13 aa, Mycobacterium tuberculosis
GWRPSGGGPQAAG

SEQ ID NO: 1445271 - protein, 11 aa, Mycobacterium tuberculosis
GWSPGQTPRSR

SEQ ID NO: 1445272 - protein, 21 aa, Mycobacterium tuberculosis
GYAATGDRRVGRGHRAGSGQR

SEQ ID NO: 1445273 - protein, 10 aa, Mycobacterium tuberculosis
GYAGPDPVAR

SEQ ID NO: 1445274 - protein, 4 aa, Mycobacterium tuberculosis
GYDP

SEQ ID NO: 1445275 - protein, 7 aa, Mycobacterium tuberculosis
GYDPNGG

SEQ ID NO: 1445276 - protein, 4 aa, Mycobacterium tuberculosis
GYEA

SEQ ID NO: 1445277 - protein, 5 aa, Mycobacterium tuberculosis
GYEPE

SEQ ID NO: 1445278 - protein, 23 aa, Mycobacterium tuberculosis
GYGADKLASPVAAAGSPGSTPWT

SEQ ID NO: 1445279 - protein, 34 aa, Mycobacterium tuberculosis
GYGDRRSTSRDDAQPEQRSSPVPPLPPVPLEAPL

SEQ ID NO: 1445280 - protein, 27 aa, Mycobacterium tuberculosis
GYGRQRRPCPQRQRRRPCGNGRQRSVS

SEQ ID NO: 1445281 - protein, 9 aa, Mycobacterium tuberculosis
GYGTAGRDY

SEQ ID NO: 1445282 - protein, 4 aa, Mycobacterium tuberculosis
GYHR

SEQ ID NO: 1445283 - protein, 26 aa, Mycobacterium tuberculosis
GYLGQGGGTEHAGGLGADGTSCPPAV

SEQ ID NO: 1445284 - protein, 10 aa, Mycobacterium tuberculosis
GYLPDTATAT

SEQ ID NO: 1445285 - protein, 9 aa, Mycobacterium tuberculosis
GYPASTPVL

SEQ ID NO: 1445286 - protein, 23 aa, Mycobacterium tuberculosis
GYPPSDGPPRRGQDYTGTDRQVR

SEQ ID NO: 1445287 - protein, 13 aa, Mycobacterium tuberculosis
GYRGSGNGFSQSR

SEQ ID NO: 1445288 - protein, 14 aa, Mycobacterium tuberculosis
GYRPTGRSIAACRR

SEQ ID NO: 1445289 - protein, 13 aa, Mycobacterium tuberculosis
GYSELSDPVVQRE

SEQ ID NO: 1445290 - protein, 8 aa, Mycobacterium tuberculosis
GYSQGSAV

SEQ ID NO: 1445291 - protein, 5 aa, Mycobacterium tuberculosis
GYTSS

SEQ ID NO: 1445292 - protein, 20 aa, Mycobacterium tuberculosis
GYYGNTKDRVVDENDSAGTG

SEQ ID NO: 1445293 - protein, 9 aa, Mycobacterium tuberculosis
HAAAASTVQ

SEQ ID NO: 1445294 - protein, 59 aa, Mycobacterium tuberculosis
HAAAQPDSITAATTGGRRRKRAAPDLDATQKSLRPAAKGPKVKKVKPQKPKATKPPKVC

SEQ ID NO: 1445295 - protein, 7 aa, Mycobacterium tuberculosis
HAASGEV

SEQ ID NO: 1445296 - protein, 8 aa, Mycobacterium tuberculosis
HADSNQQL

SEQ ID NO: 1445297 - protein, 5 aa, Mycobacterium tuberculosis
HAEID

SEQ ID NO: 1445298 - protein, 5 aa, Mycobacterium tuberculosis
HAERL

SEQ ID NO: 1445299 - protein, 18 aa, Mycobacterium tuberculosis
HAETEPKGRPAGKAATGE

SEQ ID NO: 1445300 - protein, 4 aa, Mycobacterium tuberculosis
HAGD

SEQ ID NO: 1445301 - protein, 7 aa, Mycobacterium tuberculosis
HAGRARC

SEQ ID NO: 1445302 - protein, 4 aa, Mycobacterium tuberculosis
HAGT

SEQ ID NO: 1445303 - protein, 30 aa, Mycobacterium tuberculosis
HAHHPGRSGHHTRPADRAERGTAECREWVA

SEQ ID NO: 1445304 - protein, 12 aa, Mycobacterium tuberculosis
HAKARKSSSMLW

SEQ ID NO: 1445305 - protein, 7 aa, Mycobacterium tuberculosis
HANGVTH

SEQ ID NO: 1445306 - protein, 11 aa, Mycobacterium tuberculosis
HANGVTHRDVK

SEQ ID NO: 1445307 - protein, 14 aa, Mycobacterium tuberculosis
HAPDRGHGPLPPTP

SEQ ID NO: 1445308 - protein, 19 aa, Mycobacterium tuberculosis
HAPEPPAPPVPPVPPVAPP

SEQ ID NO: 1445309 - protein, 14 aa, Mycobacterium tuberculosis
HAPGPAGRIRLPRQ

SEQ ID NO: 1445310 - protein, 6 aa, Mycobacterium tuberculosis
HAPRPR

SEQ ID NO: 1445311 - protein, 17 aa, Mycobacterium tuberculosis
HAPTPTNAATARLAASE

SEQ ID NO: 1445312 - protein, 17 aa, Mycobacterium tuberculosis
HAQTGESGSDDDGAGTY

SEQ ID NO: 1445313 - protein, 14 aa, Mycobacterium tuberculosis
HARDANPGRPVPGT

SEQ ID NO: 1445314 - protein, 4 aa, Mycobacterium tuberculosis
HARQ

SEQ ID NO: 1445315 - protein, 19 aa, Mycobacterium tuberculosis
HARQDNDDVHADRRPAALR

SEQ ID NO: 1445316 - protein, 10 aa, Mycobacterium tuberculosis
HARRHRRRQP

SEQ ID NO: 1445317 - protein, 31 aa, Mycobacterium tuberculosis
HARTTPRPVRTPTSAAGRADGEIPRHARTCG

SEQ ID NO: 1445318 - protein, 16 aa, Mycobacterium tuberculosis
HASRRRAQRRLPDTPV

SEQ ID NO: 1445319 - protein, 5 aa, Mycobacterium tuberculosis
HASSM

SEQ ID NO: 1445320 - protein, 23 aa, Mycobacterium tuberculosis
HATAPNPSSCPSRRYRGRPRRGC

SEQ ID NO: 1445321 - protein, 185 aa, Mycobacterium tuberculosis
HATDGADGTTGPDGNGTDAGSGSNAFNPGVGGGAGGIGGDGTNLGQTDVSGGAGGDGGDGANFASGGAGGNGGAAQSGFGDAVGGNGGAGGNGGAGGGGGLGGAGGSANVANAGNSIGGNGGAGGNGGIGAPGGAGGAGGNANQDNPPGGNSTGGNGGAGGDGGVGASADVGGAGGFGGSGGRGG

SEQ ID NO: 1445322 - protein, 92 aa, Mycobacterium tuberculosis
HATDGADGTTGPDGNGTDAGSGSNAVNPGVGGGAGGIGGDGTNLGQTDVSGGAGGDGGDGANFASGGAGGNGGAAQSGFGDAVGGNGGAGGN

SEQ ID NO: 1445323 - protein, 135 aa, Mycobacterium tuberculosis
HATDGADGTTGPDGNGTDAGSGSNAVNPGVGGGAGGIGGDGTNLGQTDVSGGAGGDGGDGANFASGGAGGNGGAAQSGFGDAVGGNGGAGGNGGAGGGGGLGGAGGSANVANAGNSIGGATGGRPGETAVSAPPR

SEQ ID NO: 1445324 - protein, 136 aa, Mycobacterium tuberculosis
HATDGADGTTGPDGNGTDAGSGSNAVNPGVGGGAGGIGGDGTNLGQTDVSGGAGGDGGDGANFASGGAGGNGGAAQSGFGDAVGGNGGAGGNGGAGGGGGLGGAGGSANVANAGNSIGGNGGAGGNGGIGAPGGAG

SEQ ID NO: 1445325 - protein, 144 aa, Mycobacterium tuberculosis
HATDGADGTTGPDGNGTDAGSGSNAVNPGVGGGAGGIGGDGTNLGQTDVSGGAGGDGGDGANFASGGAGGNGGAAQSGFGDAVGGNGGAGGNGGAGGGGGLGGAGGSANVANAGNSIGGNGGAGGNGGIGAPGGAGGAGGKCQS

SEQ ID NO: 1445326 - protein, 194 aa, Mycobacterium tuberculosis
HATDGADGTTGPDGNGTDAGSGSNAVNPGVGGGAGGIGGDGTNLGQTDVSGGAGGDGGDGANFASGGAGGNGGAAQSGFGDAVGGNGGAGGNGGAGGGGGLGGAGGSANVANAGNSIGGNGGAGGNGGIGAPGGAGGAGGNANQDNPPGGNSTGGNGGAGGDGGVGASADVGGAGGFGGSGGRGGLLLGTGGAG

SEQ ID NO: 1445327 - protein, 195 aa, Mycobacterium tuberculosis
HATDGADGTTGPDGNGTDAGSGSNAVNPGVGGGAGGIGGDGTNLGQTDVSGGAGGDGGDGANFASGGAGGNGGAAQSGFGDAVGGNGGAGGNGGAGGGGGLGGAGGSANVANAGNSIGGNGGAGGNGGIGAPGGAGGAGGNANQDNPPGGNSTGGNGGAGGDGGVGASADVGGAGGFGGSGGRGGLLLGTGGAGG

SEQ ID NO: 1445328 - protein, 10 aa, Mycobacterium tuberculosis
HATGPERPAH

SEQ ID NO: 1445329 - protein, 8 aa, Mycobacterium tuberculosis
HATPPQPR

SEQ ID NO: 1445330 - protein, 22 aa, Mycobacterium tuberculosis
HCKQDGKQQREDPGDSHTEVSE

SEQ ID NO: 1445331 - protein, 14 aa, Mycobacterium tuberculosis
HCPAESEQDTRWGR

SEQ ID NO: 1445332 - protein, 5 aa, Mycobacterium tuberculosis
HCPRS

SEQ ID NO: 1445333 - protein, 9 aa, Mycobacterium tuberculosis
HDAHPAGGR

SEQ ID NO: 1445334 - protein, 8 aa, Mycobacterium tuberculosis
HDAPARNL

SEQ ID NO: 1445335 - protein, 20 aa, Mycobacterium tuberculosis
HDEAKAGGLSDRIGNFLSDV

SEQ ID NO: 1445336 - protein, 19 aa, Mycobacterium tuberculosis
HDERRRRPGADVLRRRGLR

SEQ ID NO: 1445337 - protein, 8 aa, Mycobacterium tuberculosis
HDGDPGHV

SEQ ID NO: 1445338 - protein, 6 aa, Mycobacterium tuberculosis
HDGPVR

SEQ ID NO: 1445339 - protein, 10 aa, Mycobacterium tuberculosis
HDHGGEPTPL

SEQ ID NO: 1445340 - protein, 9 aa, Mycobacterium tuberculosis
HDLGGGHGF

SEQ ID NO: 1445341 - protein, 8 aa, Mycobacterium tuberculosis
HDPERHPG

SEQ ID NO: 1445342 - protein, 39 aa, Mycobacterium tuberculosis
HDPGPPQRQRAGRVDPDPPGCAGAGRHRRRGGCPRRLRA

SEQ ID NO: 1445343 - protein, 7 aa, Mycobacterium tuberculosis
HDPGPVN

SEQ ID NO: 1445344 - protein, 17 aa, Mycobacterium tuberculosis
HDPPATRLVGKDAGHDP

SEQ ID NO: 1445345 - protein, 23 aa, Mycobacterium tuberculosis
HDPQRGQGDHRRAARHPRVCGQG

SEQ ID NO: 1445346 - protein, 10 aa, Mycobacterium tuberculosis
HDQPGRSTTD

SEQ ID NO: 1445347 - protein, 13 aa, Mycobacterium tuberculosis
HDRDDAMDDLHRH

SEQ ID NO: 1445348 - protein, 81 aa, Mycobacterium tuberculosis
HDRGDPGDDEPDTGAGMTGGDRLTRPYGQQPGTAGHRRTRQRHPSQRPPPGEQRQHGKAQRRTPAPTQANTREGSATAALP

SEQ ID NO: 1445349 - protein, 11 aa, Mycobacterium tuberculosis
HDRGLRDPRGA

SEQ ID NO: 1445350 - protein, 13 aa, Mycobacterium tuberculosis
HDSRGTRRSSDAD

SEQ ID NO: 1445351 - protein, 16 aa, Mycobacterium tuberculosis
HDTPDEMAYPDGTERD

SEQ ID NO: 1445352 - protein, 4 aa, Mycobacterium tuberculosis
HDVD

SEQ ID NO: 1445353 - protein, 8 aa, Mycobacterium tuberculosis
HEETEGTL

SEQ ID NO: 1445354 - protein, 16 aa, Mycobacterium tuberculosis
HEGENGGRPQRRSSPR

SEQ ID NO: 1445355 - protein, 8 aa, Mycobacterium tuberculosis
HEISAPTA

SEQ ID NO: 1445356 - protein, 13 aa, Mycobacterium tuberculosis
HENASAAASTTAV

SEQ ID NO: 1445357 - protein, 7 aa, Mycobacterium tuberculosis
HEPTGPW

SEQ ID NO: 1445358 - protein, 28 aa, Mycobacterium tuberculosis
HEQPALSSSKSNRFTSQRQTTGVGTTTV

SEQ ID NO: 1445359 - protein, 9 aa, Mycobacterium tuberculosis
HERAGADVA

SEQ ID NO: 1445360 - protein, 21 aa, Mycobacterium tuberculosis
HESNTYVAEPGPDAPALTGDR

SEQ ID NO: 1445361 - protein, 42 aa, Mycobacterium tuberculosis
HGAAENGNAAQGSPDGGHGGTGGHPGNAETGATAQWGTLSLT

SEQ ID NO: 1445362 - protein, 143 aa, Mycobacterium tuberculosis
HGAASGGNGGPGGHGGNGGNGGTGANGGNGGIGGTGGAGSTGAKGVLGTNEGDGGDGGRGGNGGRGGNGGQGLTGAGGNGGTGGTPGNGGNGGNGASGDLVTSPGDGGGGGRGGDAGRGGDAGLGGSSGPGGTPGDWGTGGTG

SEQ ID NO: 1445363 - protein, 24 aa, Mycobacterium tuberculosis
HGAATAVKAGRDGADADDDQRPAP

SEQ ID NO: 1445364 - protein, 7 aa, Mycobacterium tuberculosis
HGAGGRQ

SEQ ID NO: 1445365 - protein, 5 aa, Mycobacterium tuberculosis
HGAPG

SEQ ID NO: 1445366 - protein, 13 aa, Mycobacterium tuberculosis
HGAPGTGQNGGAG

SEQ ID NO: 1445367 - protein, 13 aa, Mycobacterium tuberculosis
HGAPGTGQPGGAG

SEQ ID NO: 1445368 - protein, 19 aa, Mycobacterium tuberculosis
HGAPQCKSQPDTSERSAPA

SEQ ID NO: 1445369 - protein, 14 aa, Mycobacterium tuberculosis
HGASAAARRRTRPG

SEQ ID NO: 1445370 - protein, 33 aa, Mycobacterium tuberculosis
HGASRQALREGVSSKVRGSARVTSPEPGGRPYQ

SEQ ID NO: 1445371 - protein, 21 aa, Mycobacterium tuberculosis
HGCPSGRAHRGGGPRGAGRAR

SEQ ID NO: 1445372 - protein, 14 aa, Mycobacterium tuberculosis
HGDTNATFPAGDVA

SEQ ID NO: 1445373 - protein, 8 aa, Mycobacterium tuberculosis
HGGAGAPA

SEQ ID NO: 1445374 - protein, 21 aa, Mycobacterium tuberculosis
HGGAGGLGGTGASGGAGGDGG

SEQ ID NO: 1445375 - protein, 6 aa, Mycobacterium tuberculosis
HGGDAQ

SEQ ID NO: 1445376 - protein, 4 aa, Mycobacterium tuberculosis
HGGE

SEQ ID NO: 1445377 - protein, 11 aa, Mycobacterium tuberculosis
HGGGQAAEHAA

SEQ ID NO: 1445378 - protein, 33 aa, Mycobacterium tuberculosis; identical to SEQ ID NO: 230179

SEQ ID NO: 1445379 - protein, 12 aa, Mycobacterium tuberculosis
HGGNGGAGGSNA

SEQ ID NO: 1445380 - protein, 22 aa, Mycobacterium tuberculosis
HGGNGGAGGSNRRRRRRCGRSR

SEQ ID NO: 1445381 - protein, 23 aa, Mycobacterium tuberculosis
HGGNGGVGALGANGGAGGTGGWL

SEQ ID NO: 1445382 - protein, 20 aa, Mycobacterium tuberculosis
HGGNGRRGRPWAPPAAPGGH

SEQ ID NO: 1445383 - protein, 5 aa, Mycobacterium tuberculosis
HGGQT

SEQ ID NO: 1445384 - protein, 8 aa, Mycobacterium tuberculosis
HGGRRRRV

SEQ ID NO: 1445385 - protein, 20 aa, Mycobacterium tuberculosis
HGGSGGAGGSGATGGAGGHG

SEQ ID NO: 1445386 - protein, 17 aa, Mycobacterium tuberculosis
HGGTGGAGGTGASGGKG

SEQ ID NO: 1445387 - protein, 24 aa, Mycobacterium tuberculosis
HGGTGGAGGTGASGGKGGTGRVAV

SEQ ID NO: 1445388 - protein, 12 aa, Mycobacterium tuberculosis
HGIGGTACSTSA

SEQ ID NO: 1445389 - protein, 4 aa, Mycobacterium tuberculosis
HGIN

SEQ ID NO: 1445390 - protein, 6 aa, Mycobacterium tuberculosis
HGLSEP

SEQ ID NO: 1445391 - protein, 8 aa, Mycobacterium tuberculosis
HGNPPGVA

SEQ ID NO: 1445392 - protein, 13 aa, Mycobacterium tuberculosis
HGPDGGALGSTRR

SEQ ID NO: 1445393 - protein, 6 aa, Mycobacterium tuberculosis
HGPPGR

SEQ ID NO: 1445394 - protein, 19 aa, Mycobacterium tuberculosis
HGPPVGAPPFPPTAPPPPF

SEQ ID NO: 1445395 - protein, 14 aa, Mycobacterium tuberculosis
HGPSGDRARRTTAP

SEQ ID NO: 1445396 - protein, 7 aa, Mycobacterium tuberculosis
HGQDYQA

SEQ ID NO: 1445397 - protein, 5 aa, Mycobacterium tuberculosis
HGQNY

SEQ ID NO: 1445398 - protein, 10 aa, Mycobacterium tuberculosis
HGQPAPTVTF

SEQ ID NO: 1445399 - protein, 41 aa, Mycobacterium tuberculosis
HGQPGAPSTNPERRPSTRTRADRQKYRRGPRREDRPGQRRL

SEQ ID NO: 1445400 - protein, 9 aa, Mycobacterium tuberculosis
HGQPRTNTF

SEQ ID NO: 1445401 - protein, 6 aa, Mycobacterium tuberculosis
HGQPVG

SEQ ID NO: 1445402 - protein, 6 aa, Mycobacterium tuberculosis
HGRQVG

SEQ ID NO: 1445403 - protein, 9 aa, Mycobacterium tuberculosis
HGRSGPIPV

SEQ ID NO: 1445404 - protein, 6 aa, Mycobacterium tuberculosis
HGRTQQ

SEQ ID NO: 1445405 - protein, 8 aa, Mycobacterium tuberculosis
HGSAAQRQ

SEQ ID NO: 1445406 - protein, 24 aa, Mycobacterium tuberculosis
HGSRQRTTSPRRQTRSPRIGGHPR

SEQ ID NO: 1445407 - protein, 6 aa, Mycobacterium tuberculosis
HGSRRC

SEQ ID NO: 1445408 - protein, 10 aa, Mycobacterium tuberculosis
HGTATRARRS

SEQ ID NO: 1445409 - protein, 16 aa, Mycobacterium tuberculosis
HGTDDSEANRSGNPGL

SEQ ID NO: 1445410 - protein, 11 aa, Mycobacterium tuberculosis
HGTGTPVGDPV

SEQ ID NO: 1445411 - protein, 12 aa, Mycobacterium tuberculosis
HGTTDPAMQQRD

SEQ ID NO: 1445412 - protein, 10 aa, Mycobacterium tuberculosis
HGVAASESSV

SEQ ID NO: 1445413 - protein, 7 aa, Mycobacterium tuberculosis
HGVDPAV

SEQ ID NO: 1445414 - protein, 49 aa, Mycobacterium tuberculosis
HGVQPPPNGAPPDPRRTQGLATPPRAGCGGAPQTPEAPPPQGRFGPPRQ

SEQ ID NO: 1445415 - protein, 9 aa, Mycobacterium tuberculosis
HGVRPGDPY

SEQ ID NO: 1445416 - protein, 19 aa, Mycobacterium tuberculosis
HHAGPDAHASQSPAANGRV

SEQ ID NO: 1445417 - protein, 14 aa, Mycobacterium tuberculosis
HHAGPDAHASQSSG

SEQ ID NO: 1445418 - protein, 15 aa, Mycobacterium tuberculosis
HHGGYHRSARPNRAL

SEQ ID NO: 1445419 - protein, 12 aa, Mycobacterium tuberculosis
HHGGYHRSARRT

SEQ ID NO: 1445420 - protein, 14 aa, Mycobacterium tuberculosis
HHHPDRPANRRRQG

SEQ ID NO: 1445421 - protein, 6 aa, Mycobacterium tuberculosis
HHPDVQ

SEQ ID NO: 1445422 - protein, 8 aa, Mycobacterium tuberculosis
HHPGPASG

SEQ ID NO: 1445423 - protein, 6 aa, Mycobacterium tuberculosis
HHPRPR

SEQ ID NO: 1445424 - protein, 10 aa, Mycobacterium tuberculosis
HHRDPGLEQG

SEQ ID NO: 1445425 - protein, 27 aa, Mycobacterium tuberculosis
HHTARGVAGPRPSPRRARADPRDRSAR

SEQ ID NO: 1445426 - protein, 7 aa, Mycobacterium tuberculosis
HIPKGSA

SEQ ID NO: 1445427 - protein, 6 aa, Mycobacterium tuberculosis
HISGGA

SEQ ID NO: 1445428 - protein, 8 aa, Mycobacterium tuberculosis
HKADTAIS

SEQ ID NO: 1445429 - protein, 12 aa, Mycobacterium tuberculosis
HKAGGGTTPIGT

SEQ ID NO: 1445430 - protein, 15 aa, Mycobacterium tuberculosis
HKASSDWPASTSPSR

SEQ ID NO: 1445431 - protein, 9 aa, Mycobacterium tuberculosis
HKPESAAVG

SEQ ID NO: 1445432 - protein, 9 aa, Mycobacterium tuberculosis
HKQTAASSN

SEQ ID NO: 1445433 - protein, 9 aa, Mycobacterium tuberculosis
HLPGPSRRL

SEQ ID NO: 1445434 - protein, 8 aa, Mycobacterium tuberculosis
HLRGRTGC

SEQ ID NO: 1445435 - protein, 24 aa, Mycobacterium tuberculosis
HMPRKAGAGRPTRRSRRSWMASRR

SEQ ID NO: 1445436 - protein, 7 aa, Mycobacterium tuberculosis
HNGGKST

SEQ ID NO: 1445437 - protein, 10 aa, Mycobacterium tuberculosis
HNPAGASALA

SEQ ID NO: 1445438 - protein, 13 aa, Mycobacterium tuberculosis
HNPDTSRRLTGEQ

SEQ ID NO: 1445439 - protein, 6 aa, Mycobacterium tuberculosis
HNPEVQ

SEQ ID NO: 1445440 - protein, 4 aa, Mycobacterium tuberculosis
HNTN

SEQ ID NO: 1445441 - protein, 38 aa, Mycobacterium tuberculosis
HNTVTGSPITVGTAPTGVGGQPRHPARSMSPTSPATRC

SEQ ID NO: 1445442 - protein, 29 aa, Mycobacterium tuberculosis
HPAAARSGRHRPGRLSGRRRRRRDQRPPV

SEQ ID NO: 1445443 - protein, 5 aa, Mycobacterium tuberculosis
HPAAL

SEQ ID NO: 1445444 - protein, 12 aa, Mycobacterium tuberculosis
HPADRPATAADV

SEQ ID NO: 1445445 - protein, 25 aa, Mycobacterium tuberculosis
HPAGAGGAVSSNGGCPAAPAGSEVF

SEQ ID NO: 1445446 - protein, 19 aa, Mycobacterium tuberculosis
HPARRPAVSASSSSGCCRT

SEQ ID NO: 1445447 - protein, 11 aa, Mycobacterium tuberculosis
HPASPASRASP

SEQ ID NO: 1445448 - protein, 25 aa, Mycobacterium tuberculosis
HPATGGAVSATPRAEVQGQAGDAAL

SEQ ID NO: 1445449 - protein, 8 aa, Mycobacterium tuberculosis
HPATPGID

SEQ ID NO: 1445450 - protein, 6 aa, Mycobacterium tuberculosis
HPATTT

SEQ ID NO: 1445451 - protein, 14 aa, Mycobacterium tuberculosis
HPAYPGRAERPQAP

SEQ ID NO: 1445452 - protein, 12 aa, Mycobacterium tuberculosis
HPDATGTPAGSA

SEQ ID NO: 1445453 - protein, 5 aa, Mycobacterium tuberculosis
HPDIA

SEQ ID NO: 1445454 - protein, 8 aa, Mycobacterium tuberculosis
HPDLPIDT

SEQ ID NO: 1445455 - protein, 15 aa, Mycobacterium tuberculosis
HPEAQGPATGTTVSP

SEQ ID NO: 1445456 - protein, 14 aa, Mycobacterium tuberculosis
HPECRSTDAVATQS

SEQ ID NO: 1445457 - protein, 9 aa, Mycobacterium tuberculosis
HPFPPPGGV

SEQ ID NO: 1445458 - protein, 5 aa, Mycobacterium tuberculosis
HPGDL

SEQ ID NO: 1445459 - protein, 11 aa, Mycobacterium tuberculosis
HPGEQGGRVSG

SEQ ID NO: 1445460 - protein, 7 aa, Mycobacterium tuberculosis
HPGHPRR

SEQ ID NO: 1445461 - protein, 11 aa, Mycobacterium tuberculosis
HPGVEGDHRAI

SEQ ID NO: 1445462 - protein, 8 aa, Mycobacterium tuberculosis
HPGVGSAS

SEQ ID NO: 1445463 - protein, 5 aa, Mycobacterium tuberculosis
HPGVR

SEQ ID NO: 1445464 - protein, 27 aa, Mycobacterium tuberculosis
HPHETAQPRDQEGDHPGRNRRGRQHAE

SEQ ID NO: 1445465 - protein, 16 aa, Mycobacterium tuberculosis
HPHRGTPVGAEHDARC

SEQ ID NO: 1445466 - protein, 6 aa, Mycobacterium tuberculosis
HPKEEP

SEQ ID NO: 1445467 - protein, 14 aa, Mycobacterium tuberculosis
HPLAGGSGPSAGAG

SEQ ID NO: 1445468 - protein, 5 aa, Mycobacterium tuberculosis
HPLPG

SEQ ID NO: 1445469 - protein, 14 aa, Mycobacterium tuberculosis
HPLSSATDEPEPHW

SEQ ID NO: 1445470 - protein, 10 aa, Mycobacterium tuberculosis
HPNDDRCRPP

SEQ ID NO: 1445471 - protein, 4 aa, Mycobacterium tuberculosis
HPNG

SEQ ID NO: 1445472 - protein, 6 aa, Mycobacterium tuberculosis
HPNQPM

SEQ ID NO: 1445473 - protein, 33 aa, Mycobacterium tuberculosis
HPPDPPTPPAAPAPPDPPDPPLPNNPAAPPGPP

SEQ ID NO: 1445474 - protein, 30 aa, Mycobacterium tuberculosis; identical to SEQ ID NO: 178184

SEQ ID NO: 1445475 - protein, 12 aa, Mycobacterium tuberculosis
HPPLREGNPGQD

SEQ ID NO: 1445476 - protein, 7 aa, Mycobacterium tuberculosis
HPPNPKA

SEQ ID NO: 1445477 - protein, 4 aa, Mycobacterium tuberculosis
HPPP

SEQ ID NO: 1445478 - protein, 8 aa, Mycobacterium tuberculosis
HPPSDPHR

SEQ ID NO: 1445479 - protein, 14 aa, Mycobacterium tuberculosis
HPQAQNSSTWRAGV

SEQ ID NO: 1445480 - protein, 6 aa, Mycobacterium tuberculosis
HPQDRA

SEQ ID NO: 1445481 - protein, 23 aa, Mycobacterium tuberculosis
HPQPAAPRTRRYGRRNGRRCGGA

SEQ ID NO: 1445482 - protein, 11 aa, Mycobacterium tuberculosis
HPQPHPGRQNR

SEQ ID NO: 1445483 - protein, 4 aa, Mycobacterium tuberculosis
HPQR

SEQ ID NO: 1445484 - protein, 11 aa, Mycobacterium tuberculosis
HPQRCGARSQD

SEQ ID NO: 1445485 - protein, 8 aa, Mycobacterium tuberculosis
HPQRRRQR

SEQ ID NO: 1445486 - protein, 4 aa, Mycobacterium tuberculosis
HPQY

SEQ ID NO: 1445487 - protein, 5 aa, Mycobacterium tuberculosis
HPRDL

SEQ ID NO: 1445488 - protein, 8 aa, Mycobacterium tuberculosis
HPRNPYQR

SEQ ID NO: 1445489 - protein, 5 aa, Mycobacterium tuberculosis
HPRPG

SEQ ID NO: 1445490 - protein, 9 aa, Mycobacterium tuberculosis
HPRREQGAD

SEQ ID NO: 1445491 - protein, 55 aa, Mycobacterium tuberculosis
HPRRPDGRTPARGRARDRASGRTSLTGTGQRRRGIQGVNGRPTANGCLPSAGNPT

SEQ ID NO: 1445492 - protein, 9 aa, Mycobacterium tuberculosis
HPRSSGDTA

SEQ ID NO: 1445493 - protein, 7 aa, Mycobacterium tuberculosis
HPSAPAY

SEQ ID NO: 1445494 - protein, 4 aa, Mycobacterium tuberculosis
HPSE

SEQ ID NO: 1445495 - protein, 33 aa, Mycobacterium tuberculosis
HPSPSYEDQYYSPDFGAATGAAVPLDDYGYSDY

SEQ ID NO: 1445496 - protein, 14 aa, Mycobacterium tuberculosis
HPSSTCRRPHPAVS

SEQ ID NO: 1445497 - protein, 16 aa, Mycobacterium tuberculosis
HPTALGPADPISPPGV

SEQ ID NO: 1445498 - protein, 17 aa, Mycobacterium tuberculosis
HPTPRGLGGPRQNRAHE

SEQ ID NO: 1445499 - protein, 5 aa, Mycobacterium tuberculosis
HPVDP

SEQ ID NO: 1445500 - protein, 16 aa, Mycobacterium tuberculosis
HPVPQGRRRTCGQARG

SEQ ID NO: 1445501 - protein, 39 aa, Mycobacterium tuberculosis
HPVTATRTSCSGASDGPTKSSVDSAETTRMTAPYGDQSL

SEQ ID NO: 1445502 - protein, 6 aa, Mycobacterium tuberculosis
HPYPAG

SEQ ID NO: 1445503 - protein, 18 aa, Mycobacterium tuberculosis
HQADGNCGDRRAGGDAEQ

SEQ ID NO: 1445504 - protein, 14 aa, Mycobacterium tuberculosis
HQDGTPDMIGMEAV

SEQ ID NO: 1445505 - protein, 8 aa, Mycobacterium tuberculosis
HQDPRRRY

SEQ ID NO: 1445506 - protein, 9 aa, Mycobacterium tuberculosis
HQGGVGPRM

SEQ ID NO: 1445507 - protein, 8 aa, Mycobacterium tuberculosis
HQGPRTLS

SEQ ID NO: 1445508 - protein, 11 aa, Mycobacterium tuberculosis
HQGQGAPSPRV

SEQ ID NO: 1445509 - protein, 13 aa, Mycobacterium tuberculosis
HQGRAGRVRRRGR

SEQ ID NO: 1445510 - protein, 14 aa, Mycobacterium tuberculosis
HQHRHRQRGHRQHG

SEQ ID NO: 1445511 - protein, 10 aa, Mycobacterium tuberculosis
HQLEPDDTAL

SEQ ID NO: 1445512 - protein, 18 aa, Mycobacterium tuberculosis
HQNEATREECLSDPTPTD

SEQ ID NO: 1445513 - protein, 5 aa, Mycobacterium tuberculosis
HQPGW

SEQ ID NO: 1445514 - protein, 12 aa, Mycobacterium tuberculosis
HQPHPGPQGRGE

SEQ ID NO: 1445515 - protein, 12 aa, Mycobacterium tuberculosis
HQPPSLQRNSTM

SEQ ID NO: 1445516 - protein, 5 aa, Mycobacterium tuberculosis
HQPRP

SEQ ID NO: 1445517 - protein, 10 aa, Mycobacterium tuberculosis
HQQGADGLRR

SEQ ID NO: 1445518 - protein, 30 aa, Mycobacterium tuberculosis
HQRAGLDDAADPATRASEAEQVHRQSRLSD

SEQ ID NO: 1445519 - protein, 4 aa, Mycobacterium tuberculosis
HQRH

SEQ ID NO: 1445520 - protein, 8 aa, Mycobacterium tuberculosis
HQRPTAAL

SEQ ID NO: 1445521 - protein, 12 aa, Mycobacterium tuberculosis
HQRRDDRHNGHH

SEQ ID NO: 1445522 - protein, 15 aa, Mycobacterium tuberculosis
HQRRSRAAPAATAAT

SEQ ID NO: 1445523 - protein, 15 aa, Mycobacterium tuberculosis
HQSPAAAGEHRGPAR

SEQ ID NO: 1445524 - protein, 18 aa, Mycobacterium tuberculosis
HQSRSTRNDRNAGPPRGR

SEQ ID NO: 1445525 - protein, 11 aa, Mycobacterium tuberculosis
HQVTDDDVAAA

SEQ ID NO: 1445526 - protein, 4 aa, Mycobacterium tuberculosis
HQYP

SEQ ID NO: 1445527 - protein, 4 aa, Mycobacterium tuberculosis
HRAG

SEQ ID NO: 1445528 - protein, 9 aa, Mycobacterium tuberculosis
HRAPGGGDG

SEQ ID NO: 1445529 - protein, 18 aa, Mycobacterium tuberculosis
HRAPPRRRASHHRGNPGG

SEQ ID NO: 1445530 - protein, 6 aa, Mycobacterium tuberculosis
HRAPSA

SEQ ID NO: 1445531 - protein, 10 aa, Mycobacterium tuberculosis
HRARPEGEPP

SEQ ID NO: 1445532 - protein, 21 aa, Mycobacterium tuberculosis
HRDGEGPPQPPTRGHHRDPYH

SEQ ID NO: 1445533 - protein, 11 aa, Mycobacterium tuberculosis
HRDKPRSPEGL

SEQ ID NO: 1445534 - protein, 27 aa, Mycobacterium tuberculosis
HRDPDRSGVAGRHHRPGRRQGRDPGIR

SEQ ID NO: 1445535 - protein, 54 aa, Mycobacterium tuberculosis
HRDSDVTDGVAGGCAGQTQQSAQGLPTDSSGQGAQLGPLGPSGGGTHDAQGRDL

SEQ ID NO: 1445536 - protein, 5 aa, Mycobacterium tuberculosis
HRDVS

SEQ ID NO: 1445537 - protein, 20 aa, Mycobacterium tuberculosis
HREKRPARVRRRPRSRRRQL

SEQ ID NO: 1445538 - protein, 4 aa, Mycobacterium tuberculosis
HREL

SEQ ID NO: 1445539 - protein, 8 aa, Mycobacterium tuberculosis
HRERGQHQ

SEQ ID NO: 1445540 - protein, 4 aa, Mycobacterium tuberculosis
HRGA

SEQ ID NO: 1445541 - protein, 27 aa, Mycobacterium tuberculosis
HRGDGRLARRGRRRQHSLRRGTRCPPA

SEQ ID NO: 1445542 - protein, 24 aa, Mycobacterium tuberculosis
HRGNPRPGRRLPGPLRPAGQGTGE

SEQ ID NO: 1445543 - protein, 9 aa, Mycobacterium tuberculosis
HRGRAEQGE

SEQ ID NO: 1445544 - protein, 5 aa, Mycobacterium tuberculosis
HRGRG

SEQ ID NO: 1445545 - protein, 7 aa, Mycobacterium tuberculosis
HRGSQRG

SEQ ID NO: 1445546 - protein, 13 aa, Mycobacterium tuberculosis
HRGSSAEPAENLP

SEQ ID NO: 1445547 - protein, 7 aa, Mycobacterium tuberculosis
HRHRGHR

SEQ ID NO: 1445548 - protein, 7 aa, Mycobacterium tuberculosis
HRLGSNS

SEQ ID NO: 1445549 - protein, 9 aa, Mycobacterium tuberculosis
HRPDDRGYH

SEQ ID NO: 1445550 - protein, 18 aa, Mycobacterium tuberculosis
HRPDPTPAVGRGVGRGAR

SEQ ID NO: 1445551 - protein, 21 aa, Mycobacterium tuberculosis
HRPKRGSARSPRRSPKITSWP

SEQ ID NO: 1445552 - protein, 15 aa, Mycobacterium tuberculosis
HRPPIRGNGSPPPKM

SEQ ID NO: 1445553 - protein, 21 aa, Mycobacterium tuberculosis
HRPPPTAVAAATKAAEERGLT

SEQ ID NO: 1445554 - protein, 14 aa, Mycobacterium tuberculosis
HRPRGPAPGRRHHR

SEQ ID NO: 1445555 - protein, 11 aa, Mycobacterium tuberculosis
HRPRPTSLPPR

SEQ ID NO: 1445556 - protein, 25 aa, Mycobacterium tuberculosis
HRPSSDPAKPSPPAPSSDPATPAAP

SEQ ID NO: 1445557 - protein, 19 aa, Mycobacterium tuberculosis
HRPTRTPAAAGLHAARSRI

SEQ ID NO: 1445558 - protein, 12 aa, Mycobacterium tuberculosis
HRQHRQRQHRQR

SEQ ID NO: 1445559 - protein, 36 aa, Mycobacterium tuberculosis
HRQNQERRRRPTDHRAAAQRRRAGRGGAGPSPWTTA

SEQ ID NO: 1445560 - protein, 16 aa, Mycobacterium tuberculosis
HRQRTEPFAGQRPPVV

SEQ ID NO: 1445561 - protein, 20 aa, Mycobacterium tuberculosis
HRRAGDVQSGHRRRPRLGGA

SEQ ID NO: 1445562 - protein, 5 aa, Mycobacterium tuberculosis
HRRAH

SEQ ID NO: 1445563 - protein, 12 aa, Mycobacterium tuberculosis
HRRATGQCELPD

SEQ ID NO: 1445564 - protein, 22 aa, Mycobacterium tuberculosis
HRRDDPGHHGRRTGAPQRPDVH

SEQ ID NO: 1445565 - protein, 10 aa, Mycobacterium tuberculosis
HRRGARGHKP

SEQ ID NO: 1445566 - protein, 17 aa, Mycobacterium tuberculosis
HRRGRRGRRQVRSVRSR

SEQ ID NO: 1445567 - protein, 16 aa, Mycobacterium tuberculosis
HRRKAPIPAPKPPHTK

SEQ ID NO: 1445568 - protein, 23 aa, Mycobacterium tuberculosis
HRRPASAGGQSVLRPTGPRSGLL

SEQ ID NO: 1445569 - protein, 23 aa, Mycobacterium tuberculosis
HRRPATSPRRPPKRPKSRTSPIR

SEQ ID NO: 1445570 - protein, 39 aa, Mycobacterium tuberculosis
HRRPRQCYPGRGHGCGDRSRAGPAARRRPACRTVGAGSA

SEQ ID NO: 1445571 - protein, 13 aa, Mycobacterium tuberculosis
HRRQRDARPHPAH

SEQ ID NO: 1445572 - protein, 13 aa, Mycobacterium tuberculosis
HRRRDGGRGIGSG

SEQ ID NO: 1445573 - protein, 10 aa, Mycobacterium tuberculosis
HRRRDRPLRG

SEQ ID NO: 1445574 - protein, 5 aa, Mycobacterium tuberculosis
HRRRP

SEQ ID NO: 1445575 - protein, 9 aa, Mycobacterium tuberculosis
HRRRPGVSP

SEQ ID NO: 1445576 - protein, 8 aa, Mycobacterium tuberculosis
HRRRRRPL

SEQ ID NO: 1445577 - protein, 27 aa, Mycobacterium tuberculosis
HRRSRRGHPAAQNTSHAGRAPGSAGLR

SEQ ID NO: 1445578 - protein, 9 aa, Mycobacterium tuberculosis
HRSGEDRGC

SEQ ID NO: 1445579 - protein, 14 aa, Mycobacterium tuberculosis
HRSGSLGGQDPRHT

SEQ ID NO: 1445580 - protein, 16 aa, Mycobacterium tuberculosis
HRSGSQRRPTRTGRRG

SEQ ID NO: 1445581 - protein, 10 aa, Mycobacterium tuberculosis
HRSRHPPAQH

SEQ ID NO: 1445582 - protein, 12 aa, Mycobacterium tuberculosis
HRSRNRRGASEI

SEQ ID NO: 1445583 - protein, 12 aa, Mycobacterium tuberculosis
HRSRSSRTRARR

SEQ ID NO: 1445584 - protein, 5 aa, Mycobacterium tuberculosis
HRSTH

SEQ ID NO: 1445585 - protein, 10 aa, Mycobacterium tuberculosis
HRTKRREGSN

SEQ ID NO: 1445586 - protein, 16 aa, Mycobacterium tuberculosis
HRTPGAECGGEPADRH

SEQ ID NO: 1445587 - protein, 6 aa, Mycobacterium tuberculosis
HRTPIK

SEQ ID NO: 1445588 - protein, 13 aa, Mycobacterium tuberculosis
HRTPRRRAADRGR

SEQ ID NO: 1445589 - protein, 12 aa, Mycobacterium tuberculosis
HRVAAPSRRAWI

SEQ ID NO: 1445590 - protein, 22 aa, Mycobacterium tuberculosis
HRVTSARRSPSTTVCSRSQKAS

SEQ ID NO: 1445591 - protein, 5 aa, Mycobacterium tuberculosis
HSADG

SEQ ID NO: 1445592 - protein, 15 aa, Mycobacterium tuberculosis
HSAGGSGRQLRWLHT

SEQ ID NO: 1445593 - protein, 6 aa, Mycobacterium tuberculosis
HSARAS

SEQ ID NO: 1445594 - protein, 15 aa, Mycobacterium tuberculosis
HSAWQDPQSSVPRRR

SEQ ID NO: 1445595 - protein, 5 aa, Mycobacterium tuberculosis
HSDGD

SEQ ID NO: 1445596 - protein, 9 aa, Mycobacterium tuberculosis
HSDGSDGAE

SEQ ID NO: 1445597 - protein, 6 aa, Mycobacterium tuberculosis
HSDQLA

SEQ ID NO: 1445598 - protein, 12 aa, Mycobacterium tuberculosis
HSDRQRRGRREW

SEQ ID NO: 1445599 - protein, 8 aa, Mycobacterium tuberculosis
HSGATTAS

SEQ ID NO: 1445600 - protein, 13 aa, Mycobacterium tuberculosis
HSHRRTRRRWPPN

SEQ ID NO: 1445601 - protein, 17 aa, Mycobacterium tuberculosis
HSNRRCSTRRWPARCST

SEQ ID NO: 1445602 - protein, 9 aa, Mycobacterium tuberculosis
HSPAPERGT

SEQ ID NO: 1445603 - protein, 10 aa, Mycobacterium tuberculosis
HSPARPRGAL

SEQ ID NO: 1445604 - protein, 4 aa, Mycobacterium tuberculosis
HSPT

SEQ ID NO: 1445605 - protein, 32 aa, Mycobacterium tuberculosis
HSQEDPWHSTDADFKRPARTGGSTTPTLYGPD

SEQ ID NO: 1445606 - protein, 15 aa, Mycobacterium tuberculosis
HSQSHYAAAKAGVMA

SEQ ID NO: 1445607 - protein, 4 aa, Mycobacterium tuberculosis
HSQV

SEQ ID NO: 1445608 - protein, 31 aa, Mycobacterium tuberculosis
HSRRRAAGTVSGPARSCASSTRRYRPPGARW

SEQ ID NO: 1445609 - protein, 9 aa, Mycobacterium tuberculosis
HSRSSERFG

SEQ ID NO: 1445610 - protein, 17 aa, Mycobacterium tuberculosis
HSRVPGQLSRRRGASAR

SEQ ID NO: 1445611 - protein, 32 aa, Mycobacterium tuberculosis
HSSRTRSQRGASARKGKWHDGDDTTGHGRRTS

SEQ ID NO: 1445612 - protein, 8 aa, Mycobacterium tuberculosis
HSTTSVPA

SEQ ID NO: 1445613 - protein, 4 aa, Mycobacterium tuberculosis
HTAC

SEQ ID NO: 1445614 - protein, 10 aa, Mycobacterium tuberculosis
HTAGARSDPF

SEQ ID NO: 1445615 - protein, 20 aa, Mycobacterium tuberculosis
HTAGQGRKTACRPPLSGPFD

SEQ ID NO: 1445616 - protein, 14 aa, Mycobacterium tuberculosis
HTAGQLAARRRGGC

SEQ ID NO: 1445617 - protein, 11 aa, Mycobacterium tuberculosis
HTAGSPSPTCP

SEQ ID NO: 1445618 - protein, 5 aa, Mycobacterium tuberculosis
HTDAR

SEQ ID NO: 1445619 - protein, 12 aa, Mycobacterium tuberculosis
HTDTPSTIAVRT

SEQ ID NO: 1445620 - protein, 6 aa, Mycobacterium tuberculosis
HTGDGT

SEQ ID NO: 1445621 - protein, 9 aa, Mycobacterium tuberculosis
HTGDRKPIR

SEQ ID NO: 1445622 - protein, 13 aa, Mycobacterium tuberculosis
HTGPAPVHRQTRR

SEQ ID NO: 1445623 - protein, 23 aa, Mycobacterium tuberculosis
HTGQRSSLGEVAGGAGVDDGDDR

SEQ ID NO: 1445624 - protein, 16 aa, Mycobacterium tuberculosis
HTGSVQPLPWPTARWA

SEQ ID NO: 1445625 - protein, 8 aa, Mycobacterium tuberculosis
HTHAGPGG

SEQ ID NO: 1445626 - protein, 26 aa, Mycobacterium tuberculosis
HTIPERQDQIDRRKAKGSAGGRPPAF

SEQ ID NO: 1445627 - protein, 57 aa, Mycobacterium tuberculosis
HTIPERQDQIDRRKARGLPAGGHQHSTPRSTGYATPSNAASIDSSSGAASQPATTNT

SEQ ID NO: 1445628 - protein, 10 aa, Mycobacterium tuberculosis
HTNEASPLDA

SEQ ID NO: 1445629 - protein, 13 aa, Mycobacterium tuberculosis
HTNTPGSKNPKRW

SEQ ID NO: 1445630 - protein, 7 aa, Mycobacterium tuberculosis
HTPESAD

SEQ ID NO: 1445631 - protein, 12 aa, Mycobacterium tuberculosis
HTPGSIALASAG

SEQ ID NO: 1445632 - protein, 4 aa, Mycobacterium tuberculosis
HTPQ

SEQ ID NO: 1445633 - protein, 9 aa, Mycobacterium tuberculosis
HTPYPGTGH

SEQ ID NO: 1445634 - protein, 6 aa, Mycobacterium tuberculosis
HTQPNR

SEQ ID NO: 1445635 - protein, 21 aa, Mycobacterium tuberculosis
HTQPNRRLQRPPPHPASPAAN

SEQ ID NO: 1445636 - protein, 8 aa, Mycobacterium tuberculosis
HTQQQTRH

SEQ ID NO: 1445637 - protein, 9 aa, Mycobacterium tuberculosis
HTRQPLAGR

SEQ ID NO: 1445638 - protein, 25 aa, Mycobacterium tuberculosis
HTRVGGDRQRVEPAEPRGHRDRARV

SEQ ID NO: 1445639 - protein, 5 aa, Mycobacterium tuberculosis
HTTER

SEQ ID NO: 1445640 - protein, 7 aa, Mycobacterium tuberculosis
HTTRDTS

SEQ ID NO: 1445641 - protein, 5 aa, Mycobacterium tuberculosis
HTVAE

SEQ ID NO: 1445642 - protein, 12 aa, Mycobacterium tuberculosis
HTVRGSKSNTSS

SEQ ID NO: 1445643 - protein, 4 aa, Mycobacterium tuberculosis
HVGD

SEQ ID NO: 1445644 - protein, 9 aa, Mycobacterium tuberculosis
HVGDSSPQF

SEQ ID NO: 1445645 - protein, 8 aa, Mycobacterium tuberculosis
HVKPTGSA

SEQ ID NO: 1445646 - protein, 13 aa, Mycobacterium tuberculosis
HWEPGSKALATRA

SEQ ID NO: 1445647 - protein, 19 aa, Mycobacterium tuberculosis
HWEPGSKALATRAASGCGA

SEQ ID NO: 1445648 - protein, 36 aa, Mycobacterium tuberculosis
HWPGRSSGRRDFAGGAVSQASHRPTRLRGQRAAHAC

SEQ ID NO: 1445649 - protein, 6 aa, Mycobacterium tuberculosis
HYDKSN

SEQ ID NO: 1445650 - protein, 15 aa, Mycobacterium tuberculosis
IAAGAPSPADGSAQR

SEQ ID NO: 1445651 - protein, 6 aa, Mycobacterium tuberculosis
IAAGPR

SEQ ID NO: 1445652 - protein, 17 aa, Mycobacterium tuberculosis
IAARAAGAGVTAQTDVP

SEQ ID NO: 1445653 - protein, 10 aa, Mycobacterium tuberculosis
IAATDGPGAL

SEQ ID NO: 1445654 - protein, 18 aa, Mycobacterium tuberculosis
IAEADADIASGRTYGEDE

SEQ ID NO: 1445655 - protein, 6 aa, Mycobacterium tuberculosis
IAEAEE

SEQ ID NO: 1445656 - protein, 8 aa, Mycobacterium tuberculosis
IAEAEGAA

SEQ ID NO: 1445657 - protein, 8 aa, Mycobacterium tuberculosis
IAEPDTAD

SEQ ID NO: 1445658 - protein, 19 aa, Mycobacterium tuberculosis
IAEPRVAQAGRAGGQTRIA

SEQ ID NO: 1445659 - protein, 14 aa, Mycobacterium tuberculosis
IAGASGLSTGGNPG

SEQ ID NO: 1445660 - protein, 5 aa, Mycobacterium tuberculosis
IAGRD

SEQ ID NO: 1445661 - protein, 6 aa, Mycobacterium tuberculosis
IAGRDT

SEQ ID NO: 1445662 - protein, 9 aa, Mycobacterium tuberculosis
IAKPGPGQR

SEQ ID NO: 1445663 - protein, 7 aa, Mycobacterium tuberculosis
IANGSSL

SEQ ID NO: 1445664 - protein, 28 aa, Mycobacterium tuberculosis
IANPSMNEGFSPNDTGKGLSREVIRVPE

SEQ ID NO: 1445665 - protein, 10 aa, Mycobacterium tuberculosis
IAPNQDAQAD

SEQ ID NO: 1445666 - protein, 9 aa, Mycobacterium tuberculosis
IAPNTGNAI

SEQ ID NO: 1445667 - protein, 12 aa, Mycobacterium tuberculosis
IAPWQEQREPGW

SEQ ID NO: 1445668 - protein, 10 aa, Mycobacterium tuberculosis
IARSEGKSVG

SEQ ID NO: 1445669 - protein, 5 aa, Mycobacterium tuberculosis
IASEQ

SEQ ID NO: 1445670 - protein, 22 aa, Mycobacterium tuberculosis
IASGGVDAGTGCEAHTPRSTPD

SEQ ID NO: 1445671 - protein, 8 aa, Mycobacterium tuberculosis
IASRPDTA

SEQ ID NO: 1445672 - protein, 11 aa, Mycobacterium tuberculosis
IASTRTAEPSL

SEQ ID NO: 1445673 - protein, 31 aa, Mycobacterium tuberculosis
IATDAYPGGLAGGRRFPGKPGVPPASRHRRR

SEQ ID NO: 1445674 - protein, 11 aa, Mycobacterium tuberculosis
IATERAGKPVQ

SEQ ID NO: 1445675 - protein, 20 aa, Mycobacterium tuberculosis
IATGNDADADRHGIVTLTKG

SEQ ID NO: 1445676 - protein, 10 aa, Mycobacterium tuberculosis
IATKSGAAIT

SEQ ID NO: 1445677 - protein, 7 aa, Mycobacterium tuberculosis
IATRSPL

SEQ ID NO: 1445678 - protein, 30 aa, Mycobacterium tuberculosis
IATRSRPIRSPSQAGFTPTTLAPLNRVIRV

SEQ ID NO: 1445679 - protein, 6 aa, Mycobacterium tuberculosis
IDDEPS

SEQ ID NO: 1445680 - protein, 11 aa, Mycobacterium tuberculosis
IDDRDAAVGHG

SEQ ID NO: 1445681 - protein, 5 aa, Mycobacterium tuberculosis
IDEPG

SEQ ID NO: 1445682 - protein, 8 aa, Mycobacterium tuberculosis
IDERRRMN

SEQ ID NO: 1445683 - protein, 12 aa, Mycobacterium tuberculosis
IDERSNQRNGYR

SEQ ID NO: 1445684 - protein, 9 aa, Mycobacterium tuberculosis
IDETERRRA

SEQ ID NO: 1445685 - protein, 35 aa, Mycobacterium tuberculosis
IDETERRRPSRSPTTRPTESTHSRCAKRSPTSSIR

SEQ ID NO: 1445686 - protein, 7 aa, Mycobacterium tuberculosis
IDGEEAP

SEQ ID NO: 1445687 - protein, 9 aa, Mycobacterium tuberculosis
IDGKTNAEA

SEQ ID NO: 1445688 - protein, 9 aa, Mycobacterium tuberculosis
IDGNPATSW

SEQ ID NO: 1445689 - protein, 5 aa, Mycobacterium tuberculosis
IDGPT

SEQ ID NO: 1445690 - protein, 6 aa, Mycobacterium tuberculosis
IDIPSD

SEQ ID NO: 1445691 - protein, 14 aa, Mycobacterium tuberculosis
IDKEGADPGQDSRA

SEQ ID NO: 1445692 - protein, 12 aa, Mycobacterium tuberculosis
IDPDPRQRFTTA

SEQ ID NO: 1445693 - protein, 14 aa, Mycobacterium tuberculosis
IDPGDRGGCLGDGH

SEQ ID NO: 1445694 - protein, 14 aa, Mycobacterium tuberculosis
IDPGPDRPRRSIDR

SEQ ID NO: 1445695 - protein, 10 aa, Mycobacterium tuberculosis
IDPLPTNRPR

SEQ ID NO: 1445696 - protein, 5 aa, Mycobacterium tuberculosis
IDPQR

SEQ ID NO: 1445697 - protein, 9 aa, Mycobacterium tuberculosis
IDPSASAET

SEQ ID NO: 1445698 - protein, 17 aa, Mycobacterium tuberculosis
IDQAEEELAERSTPATM

SEQ ID NO: 1445699 - protein, 8 aa, Mycobacterium tuberculosis
IDQPSEQI

SEQ ID NO: 1445700 - protein, 8 aa, Mycobacterium tuberculosis
IDQTETPV

SEQ ID NO: 1445701 - protein, 7 aa, Mycobacterium tuberculosis
IDREPDP

SEQ ID NO: 1445702 - protein, 6 aa, Mycobacterium tuberculosis
IDRPAR

SEQ ID NO: 1445703 - protein, 40 aa, Mycobacterium tuberculosis
IDSAASSSRSAASTSPIRSSATARSQRTATRAARGTLGSS

SEQ ID NO: 1445704 - protein, 7 aa, Mycobacterium tuberculosis
IDSTRDA

SEQ ID NO: 1445705 - protein, 11 aa, Mycobacterium tuberculosis
IDTDGLADTEH

SEQ ID NO: 1445706 - protein, 14 aa, Mycobacterium tuberculosis
IDTTPDAAAIDRDT

SEQ ID NO: 1445707 - protein, 9 aa, Mycobacterium tuberculosis
IEADPANPV

SEQ ID NO: 1445708 - protein, 17 aa, Mycobacterium tuberculosis
IEAETEELRDGAGSRRY

SEQ ID NO: 1445709 - protein, 24 aa, Mycobacterium tuberculosis
IEAGPNAKAYPAKPFSNPTKKLPK

SEQ ID NO: 1445710 - protein, 12 aa, Mycobacterium tuberculosis
IECSTGSACTAG

SEQ ID NO: 1445711 - protein, 9 aa, Mycobacterium tuberculosis
IEDSGRVEQ

SEQ ID NO: 1445712 - protein, 63 aa, Mycobacterium tuberculosis
IEGEPGLGGEPGAGDVGAGGGGGGTTPTGYLGPPPVPTSSPPTTPAGAPAKSVTPDPVSGTPR

SEQ ID NO: 1445713 - protein, 10 aa, Mycobacterium tuberculosis
IEGIGRPRVE

SEQ ID NO: 1445714 - protein, 10 aa, Mycobacterium tuberculosis
IEGPGGQVTE

SEQ ID NO: 1445715 - protein, 8 aa, Mycobacterium tuberculosis
IEGVASPQ

SEQ ID NO: 1445716 - protein, 8 aa, Mycobacterium tuberculosis
IEKEDESF

SEQ ID NO: 1445717 - protein, 11 aa, Mycobacterium tuberculosis
IEPADLDDPDA

SEQ ID NO: 1445718 - protein, 6 aa, Mycobacterium tuberculosis
IEPPPS

SEQ ID NO: 1445719 - protein, 12 aa, Mycobacterium tuberculosis
IEPQGGPVYGSD

SEQ ID NO: 1445720 - protein, 13 aa, Mycobacterium tuberculosis
IEPRGAQALPPGG

SEQ ID NO: 1445721 - protein, 6 aa, Mycobacterium tuberculosis
IEPRTS

SEQ ID NO: 1445722 - protein, 19 aa, Mycobacterium tuberculosis
IEPTRVEQPRAGNPRITDP

SEQ ID NO: 1445723 - protein, 8 aa, Mycobacterium tuberculosis
IEQPGDEQ

SEQ ID NO: 1445724 - protein, 14 aa, Mycobacterium tuberculosis
IERAKGAAAVTRRR

SEQ ID NO: 1445725 - protein, 34 aa, Mycobacterium tuberculosis
IERSSRPEPPRQCRPAPHQTRRATAPAAAADHDD

SEQ ID NO: 1445726 - protein, 8 aa, Mycobacterium tuberculosis
IETATAAS

SEQ ID NO: 1445727 - protein, 10 aa, Mycobacterium tuberculosis
IETFGKDELG

SEQ ID NO: 1445728 - protein, 160 aa, Mycobacterium tuberculosis
IETGETDGEGGTGDAGKDGGKGKIGFDGGRGGDGGPGGGGGTGGDGSGTFNAQANNGGDGGAGGVGGAGGTGGTGGVGADGGRGGDSGRGGDGGNAGHGGAAQFSGRGAYGGEGGSGGAGGNAGGAGTGGTAGSGGAGGFGGNGADGGNGGNGGNGGFGG

SEQ ID NO: 1445729 - protein, 43 aa, Mycobacterium tuberculosis
IGAAPAPKHAPEPVPEPAPTPKAEPAPSPPAAQPAGCGRGRTV

SEQ ID NO: 1445730 - protein, 24 aa, Mycobacterium tuberculosis
IGAAPAPKPRRKPSPSSADVKDNP

SEQ ID NO: 1445731 - protein, 4 aa, Mycobacterium tuberculosis
IGAE

SEQ ID NO: 1445732 - protein, 9 aa, Mycobacterium tuberculosis
IGAGAGAGE

SEQ ID NO: 1445733 - protein, 142 aa, Mycobacterium tuberculosis
IGAGGDGGVGGVGAPGTNGMNPPPNQTSQAANGSPGANNGAGSGGAGLPGNPGAVPGRAGGAGGLGGSGSDTSEGPVTGGNGGNGGDGGPGAPGGNGAPGGIGVNTGTGWAYGGNGGNGGDGGAGARGGDGGNGGQRPSAKR

SEQ ID NO: 1445734 - protein, 15 aa, Mycobacterium tuberculosis
IGAPSWTADYGSETL

SEQ ID NO: 1445735 - protein, 28 aa, Mycobacterium tuberculosis
IGASSGEVAAASAAAYAPPPEVNACTNW

SEQ ID NO: 1445736 - protein, 43 aa, Mycobacterium tuberculosis
IGDGGAGGTGGDSVRGAAGSGRTGGTGGLIGDGGAGGAGGTGI

SEQ ID NO: 1445737 - protein, 34 aa, Mycobacterium tuberculosis
IGDGGNGGNGGAGGTGGFPWGPADPAGPAGLGGF

SEQ ID NO: 1445738 - protein, 26 aa, Mycobacterium tuberculosis
IGDGGNGGNGGAGRHRGHPGARRTRR

SEQ ID NO: 1445739 - protein, 26 aa, Mycobacterium tuberculosis
IGDGGNGGQRRRGRHRGHPGARRTRR

SEQ ID NO: 1445740 - protein, 6 aa, Mycobacterium tuberculosis
IGEGGV

SEQ ID NO: 1445741 - protein, 64 aa, Mycobacterium tuberculosis
IGEPPPAPSRPSASPAEPPTRPAPQHSRRARRGHRYRTDTERNVGKVATGPSIQGAAAGRGSIR

SEQ ID NO: 1445742 - protein, 37 aa, Mycobacterium tuberculosis
IGEPPPAPSRPSASPAEPPTRPAPQHSRRARRGSPLS

SEQ ID NO: 1445743 - protein, 75 aa, Mycobacterium tuberculosis; identical to SEQ ID NO: 232184

SEQ ID NO: 1445744 - protein, 41 aa, Mycobacterium tuberculosis
IGGDGGAGGRAGAIGNGGDGGNGGTSNTPGGSGATAAMAGN

SEQ ID NO: 1445745 - protein, 66 aa, Mycobacterium tuberculosis
IGGEPGLGSGAGGGDVGGGGAGGTTPTGYLGPSPVPTSSPPTTPAGAPTKSATMPPPGGASPASAH

SEQ ID NO: 1445746 - protein, 23 aa, Mycobacterium tuberculosis
IGGPPGQSRAGHRNSCANSRTSL

SEQ ID NO: 1445747 - protein, 4 aa, Mycobacterium tuberculosis
IGGQ

SEQ ID NO: 1445748 - protein, 6 aa, Mycobacterium tuberculosis
IGGQED

SEQ ID NO: 1445749 - protein, 5 aa, Mycobacterium tuberculosis
IGGRG

SEQ ID NO: 1445750 - protein, 14 aa, Mycobacterium tuberculosis
IGGRRGGIRRNHSG

SEQ ID NO: 1445751 - protein, 9 aa, Mycobacterium tuberculosis
IGGSVAARG

SEQ ID NO: 1445752 - protein, 12 aa, Mycobacterium tuberculosis
IGLPDESYYRDE

SEQ ID NO: 1445753 - protein, 14 aa, Mycobacterium tuberculosis
IGNGGAGGAGRPRA

SEQ ID NO: 1445754 - protein, 30 aa, Mycobacterium tuberculosis; identical to SEQ ID NO: 178592

SEQ ID NO: 1445755 - protein, 22 aa, Mycobacterium tuberculosis
IGNGGDGGAGGAGGAGSPAGAP

SEQ ID NO: 1445756 - protein, 29 aa, Mycobacterium tuberculosis
IGNGGDGGAGGAGSPAGAPGNGGTGGTGG

SEQ ID NO: 1445757 - protein, 34 aa, Mycobacterium tuberculosis
IGNGGDGGHGGNGGHGNSGGAGGAGGAGCAGGVG

SEQ ID NO: 1445758 - protein, 30 aa, Mycobacterium tuberculosis; identical to SEQ ID NO: 178596

SEQ ID NO: 1445759 - protein, 24 aa, Mycobacterium tuberculosis
IGNGGHGGAGGTGVPNGSGGAGGL

SEQ ID NO: 1445760 - protein, 23 aa, Mycobacterium tuberculosis
IGNGGIGGDGAGGGNATSTSSIP

SEQ ID NO: 1445761 - protein, 19 aa, Mycobacterium tuberculosis
IGNGGNGGGGGNGGTGARH

SEQ ID NO: 1445762 - protein, 33 aa, Mycobacterium tuberculosis; identical to SEQ ID NO: 230242

SEQ ID NO: 1445763 - protein, 49 aa, Mycobacterium tuberculosis
IGNGGNGGGGRGTADPGATPGHRRRRGPPGAPGGHRCSGPPRNHRAPKA

SEQ ID NO: 1445764 - protein, 10 aa, Mycobacterium tuberculosis
IGNGGNGGNA

SEQ ID NO: 1445765 - protein, 25 aa, Mycobacterium tuberculosis
IGNGGSGGAGGAGAAGGSGGTRRAA

SEQ ID NO: 1445766 - protein, 14 aa, Mycobacterium tuberculosis
IGNGGTGGAGFAGE

SEQ ID NO: 1445767 - protein, 24 aa, Mycobacterium tuberculosis
IGNGGTGGAGGTGVPNGSGGAGGL

SEQ ID NO: 1445768 - protein, 19 aa, Mycobacterium tuberculosis
IGNLGGVDATDDPWHGRPA

SEQ ID NO: 1445769 - protein, 6 aa, Mycobacterium tuberculosis
IGNPGL

SEQ ID NO: 1445770 - protein, 39 aa, Mycobacterium tuberculosis
IGNQGNANLGGGNIGNNNIGSGNRGSDNFGAGNVGTGNI

SEQ ID NO: 1445771 - protein, 68 aa, Mycobacterium tuberculosis
IGNQGNANLGGGNTGSGNIGNGNKGSSNLGGGNIGNNNIGSGNRGSDNFGAGNVGTGNIGFGNQGPID

SEQ ID NO: 1445772 - protein, 21 aa, Mycobacterium tuberculosis
IGPAGTRRSNAAGSAGSPGPN

SEQ ID NO: 1445773 - protein, 17 aa, Mycobacterium tuberculosis
IGPASDSGPGTGRPTAS

SEQ ID NO: 1445774 - protein, 9 aa, Mycobacterium tuberculosis
IGPDSPDPL

SEQ ID NO: 1445775 - protein, 6 aa, Mycobacterium tuberculosis
IGPGYG

SEQ ID NO: 1445776 - protein, 23 aa, Mycobacterium tuberculosis
IGPPRQLPADSPTRASHPRSVPR

SEQ ID NO: 1445777 - protein, 6 aa, Mycobacterium tuberculosis
IGPPTT

SEQ ID NO: 1445778 - protein, 4 aa, Mycobacterium tuberculosis
IGPR

SEQ ID NO: 1445779 - protein, 7 aa, Mycobacterium tuberculosis
IGQAAED

SEQ ID NO: 1445780 - protein, 39 aa, Mycobacterium tuberculosis; identical to SEQ ID NO: 192733

SEQ ID NO: 1445781 - protein, 7 aa, Mycobacterium tuberculosis
IGRPSHQ

SEQ ID NO: 1445782 - protein, 24 aa, Mycobacterium tuberculosis
IGRPTTPPSSRSADPGATHPAAGG

SEQ ID NO: 1445783 - protein, 6 aa, Mycobacterium tuberculosis
IGRQEA

SEQ ID NO: 1445784 - protein, 5 aa, Mycobacterium tuberculosis
IGRQG

SEQ ID NO: 1445785 - protein, 6 aa, Mycobacterium tuberculosis
IGRQTR

SEQ ID NO: 1445786 - protein, 6 aa, Mycobacterium tuberculosis
IGRTQY

SEQ ID NO: 1445787 - protein, 28 aa, Mycobacterium tuberculosis
IGSEEPSEEASEATEESAVSADRSDDSA

SEQ ID NO: 1445788 - protein, 16 aa, Mycobacterium tuberculosis
IGSGRDPYLAVLGRLV

SEQ ID NO: 1445789 - protein, 10 aa, Mycobacterium tuberculosis
IGSMGTDTSQ

SEQ ID NO: 1445790 - protein, 47 aa, Mycobacterium tuberculosis
IGSPSTRQETHERGRLGAGRTAGPGRTGNMTPRSRGPRRRPLDPARR

SEQ ID NO: 1445791 - protein, 19 aa, Mycobacterium tuberculosis
IGSQSYDVSPRSRTRTPVQ

SEQ ID NO: 1445792 - protein, 12 aa, Mycobacterium tuberculosis
IGSRVSTRPRGQ

SEQ ID NO: 1445793 - protein, 17 aa, Mycobacterium tuberculosis
IGSTIGTANAAAAVPTT

SEQ ID NO: 1445794 - protein, 7 aa, Mycobacterium tuberculosis
IGTEATA

SEQ ID NO: 1445795 - protein, 28 aa, Mycobacterium tuberculosis
IGTGRTQGGGVESVSAGAAATAGTALAA

SEQ ID NO: 1445796 - protein, 10 aa, Mycobacterium tuberculosis
IGTPPYAGRR

SEQ ID NO: 1445797 - protein, 6 aa, Mycobacterium tuberculosis
IGTQVS

SEQ ID NO: 1445798 - protein, 5 aa, Mycobacterium tuberculosis
IGTTA

SEQ ID NO: 1445799 - protein, 14 aa, Mycobacterium tuberculosis
IGVPPGSRGCANYT

SEQ ID NO: 1445800 - protein, 15 aa, Mycobacterium tuberculosis
IGVPSGSRGCANYTR

SEQ ID NO: 1445801 - protein, 12 aa, Mycobacterium tuberculosis
IHGHPRNPYQRA

SEQ ID NO: 1445802 - protein, 7 aa, Mycobacterium tuberculosis
IHPTADT

SEQ ID NO: 1445803 - protein, 5 aa, Mycobacterium tuberculosis
IHRQT

SEQ ID NO: 1445804 - protein, 20 aa, Mycobacterium tuberculosis
IITPTSSVHRRGANTCLTGV

SEQ ID NO: 1445805 - protein, 20 aa, Mycobacterium tuberculosis
IKDQPGRRPRRRPGTQGTHA

SEQ ID NO: 1445806 - protein, 13 aa, Mycobacterium tuberculosis
IKGRQGRSGAGSS

SEQ ID NO: 1445807 - protein, 7 aa, Mycobacterium tuberculosis
IKKDHPC

SEQ ID NO: 1445808 - protein, 39 aa, Mycobacterium tuberculosis
IKPGDAPASGSRSPPMRSSPPNPAFQSTRSTTCWNTVAT

SEQ ID NO: 1445809 - protein, 8 aa, Mycobacterium tuberculosis
IKPGGEPI

SEQ ID NO: 1445810 - protein, 7 aa, Mycobacterium tuberculosis
IKPTSPT

SEQ ID NO: 1445811 - protein, 15 aa, Mycobacterium tuberculosis
INDPTSSAQYRVREV

SEQ ID NO: 1445812 - protein, 16 aa, Mycobacterium tuberculosis
INGATTLPGLYAAGET

SEQ ID NO: 1445813 - protein, 6 aa, Mycobacterium tuberculosis
INGSDM

SEQ ID NO: 1445814 - protein, 32 aa, Mycobacterium tuberculosis
INPGAPPAPPAPPAAVPARPPRAASTAGAAGA

SEQ ID NO: 1445815 - protein, 6 aa, Mycobacterium tuberculosis
INQATA

SEQ ID NO: 1445816 - protein, 26 aa, Mycobacterium tuberculosis
INRGSAPGTPVPPTPACSTRAPTTSV

SEQ ID NO: 1445817 - protein, 23 aa, Mycobacterium tuberculosis
INTANTAAAATTQVFATAYTLWW

SEQ ID NO: 1445818 - protein, 5 aa, Mycobacterium tuberculosis
INTRG

SEQ ID NO: 1445819 - protein, 5 aa, Mycobacterium tuberculosis
IPAQS

SEQ ID NO: 1445820 - protein, 6 aa, Mycobacterium tuberculosis
IPAQTR

SEQ ID NO: 1445821 - protein, 5 aa, Mycobacterium tuberculosis
IPART

SEQ ID NO: 1445822 - protein, 4 aa, Mycobacterium tuberculosis
IPDR

SEQ ID NO: 1445823 - protein, 6 aa, Mycobacterium tuberculosis
IPDSGV

SEQ ID NO: 1445824 - protein, 8 aa, Mycobacterium tuberculosis
IPESGGSR

SEQ ID NO: 1445825 - protein, 4 aa, Mycobacterium tuberculosis
IPGA

SEQ ID NO: 1445826 - protein, 12 aa, Mycobacterium tuberculosis
IPGGAQDGVKRV

SEQ ID NO: 1445827 - protein, 13 aa, Mycobacterium tuberculosis
IPGGATSARPPSV

SEQ ID NO: 1445828 - protein, 16 aa, Mycobacterium tuberculosis
IPGKTKVNPSGGPLAA

SEQ ID NO: 1445829 - protein, 15 aa, Mycobacterium tuberculosis
IPKTKPRVRRKRGAA

SEQ ID NO: 1445830 - protein, 6 aa, Mycobacterium tuberculosis
IPLDDN

SEQ ID NO: 1445831 - protein, 4 aa, Mycobacterium tuberculosis
IPPA

SEQ ID NO: 1445832 - protein, 13 aa, Mycobacterium tuberculosis
IPPARKVLAGADD

SEQ ID NO: 1445833 - protein, 11 aa, Mycobacterium tuberculosis
IPPEDIPGQFS

SEQ ID NO: 1445834 - protein, 17 aa, Mycobacterium tuberculosis
IPPKNPQLTAPRADGPM

SEQ ID NO: 1445835 - protein, 12 aa, Mycobacterium tuberculosis
IPPLGSATLPTN

SEQ ID NO: 1445836 - protein, 12 aa, Mycobacterium tuberculosis
IPPNSDPRSGLS

SEQ ID NO: 1445837 - protein, 8 aa, Mycobacterium tuberculosis
IPPPPHRA

SEQ ID NO: 1445838 - protein, 31 aa, Mycobacterium tuberculosis
IPQNQPRARRSEAPRHSRGAAAGRAGQVDGR

SEQ ID NO: 1445839 - protein, 11 aa, Mycobacterium tuberculosis
IPQPSAIRPGI

SEQ ID NO: 1445840 - protein, 5 aa, Mycobacterium tuberculosis
IPRGS

SEQ ID NO: 1445841 - protein, 10 aa, Mycobacterium tuberculosis
IPRPSTVRPG

SEQ ID NO: 1445842 - protein, 8 aa, Mycobacterium tuberculosis
IPRRPPRA

SEQ ID NO: 1445843 - protein, 23 aa, Mycobacterium tuberculosis
IPRTPGARRPLPRGRGRDRRRRA

SEQ ID NO: 1445844 - protein, 5 aa, Mycobacterium tuberculosis
IPSAR

SEQ ID NO: 1445845 - protein, 11 aa, Mycobacterium tuberculosis
IPSGAATTHST

SEQ ID NO: 1445846 - protein, 7 aa, Mycobacterium tuberculosis
IPSPAAE

SEQ ID NO: 1445847 - protein, 7 aa, Mycobacterium tuberculosis
IPSPAAG

SEQ ID NO: 1445848 - protein, 9 aa, Mycobacterium tuberculosis
IPSSEGSMA

SEQ ID NO: 1445849 - protein, 7 aa, Mycobacterium tuberculosis
IPTGTCP

SEQ ID NO: 1445850 - protein, 5 aa, Mycobacterium tuberculosis
IPTPA

SEQ ID NO: 1445851 - protein, 9 aa, Mycobacterium tuberculosis
IPYSAGDTD

SEQ ID NO: 1445852 - protein, 7 aa, Mycobacterium tuberculosis
IQAPDTR

SEQ ID NO: 1445853 - protein, 4 aa, Mycobacterium tuberculosis
IQDA

SEQ ID NO: 1445854 - protein, 25 aa, Mycobacterium tuberculosis
IQNEDEVTSDQGNNGGPNGGGRLAP

SEQ ID NO: 1445855 - protein, 4 aa, Mycobacterium tuberculosis
IQPG

SEQ ID NO: 1445856 - protein, 11 aa, Mycobacterium tuberculosis
IQPGDSGGPVV

SEQ ID NO: 1445857 - protein, 12 aa, Mycobacterium tuberculosis
IQTGPARGADDL

SEQ ID NO: 1445858 - protein, 15 aa, Mycobacterium tuberculosis
IRASKTSATCCRAGR

SEQ ID NO: 1445859 - protein, 5 aa, Mycobacterium tuberculosis
IREEV

SEQ ID NO: 1445860 - protein, 13 aa, Mycobacterium tuberculosis
IRESPDSPGRFNA

SEQ ID NO: 1445861 - protein, 15 aa, Mycobacterium tuberculosis
IRGSPARREKARAKE

SEQ ID NO: 1445862 - protein, 4 aa, Mycobacterium tuberculosis
IRKG

SEQ ID NO: 1445863 - protein, 14 aa, Mycobacterium tuberculosis
IRLGGSDEADHDRV

SEQ ID NO: 1445864 - protein, 31 aa, Mycobacterium tuberculosis
IRNRRSRKRSQSHMPPRTPPRGRCLRAPEAL

SEQ ID NO: 1445865 - protein, 22 aa, Mycobacterium tuberculosis
IRNRRSRKSSQSHMPPRTPPRG

SEQ ID NO: 1445866 - protein, 27 aa, Mycobacterium tuberculosis
IRPGQGGRGESTDDPLPDPADDPRRHP

SEQ ID NO: 1445867 - protein, 5 aa, Mycobacterium tuberculosis
IRPRS

SEQ ID NO: 1445868 - protein, 13 aa, Mycobacterium tuberculosis
IRPRTRPCKTDTM

SEQ ID NO: 1445869 - protein, 29 aa, Mycobacterium tuberculosis
IRPSRASSTPPHARSPAASSAPGAAAGSD

SEQ ID NO: 1445870 - protein, 5 aa, Mycobacterium tuberculosis
IRQRA

SEQ ID NO: 1445871 - protein, 6 aa, Mycobacterium tuberculosis
IRRADE

SEQ ID NO: 1445872 - protein, 16 aa, Mycobacterium tuberculosis
IRRTRAGLKDPKRPSG

SEQ ID NO: 1445873 - protein, 26 aa, Mycobacterium tuberculosis
IRRTRAGLKTPSARRARSSSPARPVS

SEQ ID NO: 1445874 - protein, 11 aa, Mycobacterium tuberculosis
IRSGGGSPTVH

SEQ ID NO: 1445875 - protein, 15 aa, Mycobacterium tuberculosis
IRSGPHQRLGSGDYK

SEQ ID NO: 1445876 - protein, 11 aa, Mycobacterium tuberculosis
IRSQQSAYASH

SEQ ID NO: 1445877 - protein, 8 aa, Mycobacterium tuberculosis
IRSRPAQE

SEQ ID NO: 1445878 - protein, 5 aa, Mycobacterium tuberculosis
IRTDV

SEQ ID NO: 1445879 - protein, 9 aa, Mycobacterium tuberculosis
ISAPSTSTG

SEQ ID NO: 1445880 - protein, 6 aa, Mycobacterium tuberculosis
ISASDR

SEQ ID NO: 1445881 - protein, 8 aa, Mycobacterium tuberculosis
ISATGSPC

SEQ ID NO: 1445882 - protein, 5 aa, Mycobacterium tuberculosis
ISDAT

SEQ ID NO: 1445883 - protein, 6 aa, Mycobacterium tuberculosis
ISDDPN

SEQ ID NO: 1445884 - protein, 30 aa, Mycobacterium tuberculosis
ISDGGNGGNGGAGGTGGTPGPGGPGGSGGL

SEQ ID NO: 1445885 - protein, 14 aa, Mycobacterium tuberculosis
ISDGTSARRTICST

SEQ ID NO: 1445886 - protein, 12 aa, Mycobacterium tuberculosis
ISERDDAENARV

SEQ ID NO: 1445887 - protein, 12 aa, Mycobacterium tuberculosis
ISESRAEGAPDD

SEQ ID NO: 1445888 - protein, 17 aa, Mycobacterium tuberculosis
ISGGAPLAGGDAQLPHG

SEQ ID NO: 1445889 - protein, 4 aa, Mycobacterium tuberculosis
ISGR

SEQ ID NO: 1445890 - protein, 21 aa, Mycobacterium tuberculosis
ISGSSTSRQAASPTTPSPPSQ

SEQ ID NO: 1445891 - protein, 13 aa, Mycobacterium tuberculosis
ISKAGADAVETNT

SEQ ID NO: 1445892 - protein, 7 aa, Mycobacterium tuberculosis
ISKDGEQ

SEQ ID NO: 1445893 - protein, 10 aa, Mycobacterium tuberculosis
ISNTATTDCT

SEQ ID NO: 1445894 - protein, 9 aa, Mycobacterium tuberculosis
ISPASSPNS

SEQ ID NO: 1445895 - protein, 12 aa, Mycobacterium tuberculosis
ISPGRPRRPGTL

SEQ ID NO: 1445896 - protein, 7 aa, Mycobacterium tuberculosis
ISPPRSC

SEQ ID NO: 1445897 - protein, 13 aa, Mycobacterium tuberculosis
ISPPSGATDVRDE

SEQ ID NO: 1445898 - protein, 13 aa, Mycobacterium tuberculosis
ISPPSRATDVRDE

SEQ ID NO: 1445899 - protein, 4 aa, Mycobacterium tuberculosis
ISPR

SEQ ID NO: 1445900 - protein, 12 aa, Mycobacterium tuberculosis
ISPSAKPGLGAA

SEQ ID NO: 1445901 - protein, 7 aa, Mycobacterium tuberculosis
ISSAAGT

SEQ ID NO: 1445902 - protein, 24 aa, Mycobacterium tuberculosis
ISSDGGAGGDGGDGGNGGAGGTGG

SEQ ID NO: 1445903 - protein, 27 aa, Mycobacterium tuberculosis
ISSDGGAGGDGGDGGNGGSGGAGGTGG

SEQ ID NO: 1445904 - protein, 10 aa, Mycobacterium tuberculosis
ISSGSGGQPV

SEQ ID NO: 1445905 - protein, 12 aa, Mycobacterium tuberculosis
ISSRSPAGPPVR

SEQ ID NO: 1445906 - protein, 10 aa, Mycobacterium tuberculosis
ISTANGAAAL

SEQ ID NO: 1445907 - protein, 8 aa, Mycobacterium tuberculosis
ISTVPADR

SEQ ID NO: 1445908 - protein, 15 aa, Mycobacterium tuberculosis
ITAGPGGGKRGDQVG

SEQ ID NO: 1445909 - protein, 15 aa, Mycobacterium tuberculosis
ITAGPGGGRRGDQVG

SEQ ID NO: 1445910 - protein, 5 aa, Mycobacterium tuberculosis
ITDNA

SEQ ID NO: 1445911 - protein, 4 aa, Mycobacterium tuberculosis
ITDP

SEQ ID NO: 1445912 - protein, 9 aa, Mycobacterium tuberculosis
ITGGSRDPR

SEQ ID NO: 1445913 - protein, 36 aa, Mycobacterium tuberculosis
ITGNPGDPRYPYRPEPPAPPPGGPPPGPPAQQPGDQ

SEQ ID NO: 1445914 - protein, 7 aa, Mycobacterium tuberculosis
ITGQDGS

SEQ ID NO: 1445915 - protein, 4 aa, Mycobacterium tuberculosis
ITGR

SEQ ID NO: 1445916 - protein, 7 aa, Mycobacterium tuberculosis
ITKTPEW

SEQ ID NO: 1445917 - protein, 12 aa, Mycobacterium tuberculosis
ITNPANRHAAER

SEQ ID NO: 1445918 - protein, 24 aa, Mycobacterium tuberculosis
ITNPGGSLSRPSRSRRPSTPPRRT

SEQ ID NO: 1445919 - protein, 16 aa, Mycobacterium tuberculosis
ITPGPQGACPPRGWGG

SEQ ID NO: 1445920 - protein, 7 aa, Mycobacterium tuberculosis
ITPPRRR

SEQ ID NO: 1445921 - protein, 11 aa, Mycobacterium tuberculosis
ITRESGCSQGD

SEQ ID NO: 1445922 - protein, 17 aa, Mycobacterium tuberculosis
ITRPDYHPGSNQRRLRR

SEQ ID NO: 1445923 - protein, 6 aa, Mycobacterium tuberculosis
ITRRSG

SEQ ID NO: 1445924 - protein, 6 aa, Mycobacterium tuberculosis
ITRRSR

SEQ ID NO: 1445925 - protein, 8 aa, Mycobacterium tuberculosis
ITRTRSGS

SEQ ID NO: 1445926 - protein, 14 aa, Mycobacterium tuberculosis
ITTATNNEFGSTTC

SEQ ID NO: 1445927 - protein, 4 aa, Mycobacterium tuberculosis
ITTP

SEQ ID NO: 1445928 - protein, 6 aa, Mycobacterium tuberculosis
ITTPPL

SEQ ID NO: 1445929 - protein, 5 aa, Mycobacterium tuberculosis
ITTSS

SEQ ID NO: 1445930 - protein, 8 aa, Mycobacterium tuberculosis
IYGSGLPS

SEQ ID NO: 1445931 - protein, 7 aa, Mycobacterium tuberculosis
IYRGDAS

SEQ ID NO: 1445932 - protein, 4 aa, Mycobacterium tuberculosis
KAAA

SEQ ID NO: 1445933 - protein, 18 aa, Mycobacterium tuberculosis
KAAATAAGAAGSVRQLPV

SEQ ID NO: 1445934 - protein, 13 aa, Mycobacterium tuberculosis
KAAGGPRGAQSGH

SEQ ID NO: 1445935 - protein, 17 aa, Mycobacterium tuberculosis
KAAPTPAAPAAPAAPVK

SEQ ID NO: 1445936 - protein, 13 aa, Mycobacterium tuberculosis
KAAQVATTLTGTQ

SEQ ID NO: 1445937 - protein, 19 aa, Mycobacterium tuberculosis
KAASGQSRPHTDRDVGQRQ

SEQ ID NO: 1445938 - protein, 17 aa, Mycobacterium tuberculosis
KAATSSMTTMQRSGAAS

SEQ ID NO: 1445939 - protein, 8 aa, Mycobacterium tuberculosis
KAAVPAAS

SEQ ID NO: 1445940 - protein, 4 aa, Mycobacterium tuberculosis
KACP

SEQ ID NO: 1445941 - protein, 9 aa, Mycobacterium tuberculosis
KAERSENTL

SEQ ID NO: 1445942 - protein, 13 aa, Mycobacterium tuberculosis
KAGLGGARREPRH

SEQ ID NO: 1445943 - protein, 163 aa, Mycobacterium tuberculosis
KAGNGGAGGNGGNVGVAGQGGAGGKGAIPAMKGATGADGTAPTSGGDGGNGGNGGAGGAGGTLAGHGGNGGKGGNGGQGGIGGAGERGADGAGPNANGANGENGGSGGNGGDGGAGGNGGAGGKAQAAGYTDGATGTGGDGGNGGDGGKAGDGGAGENGLNSG

SEQ ID NO: 1445944 - protein, 11 aa, Mycobacterium tuberculosis
KAGRGGGPALW

SEQ ID NO: 1445945 - protein, 15 aa, Mycobacterium tuberculosis
KAGSPGWAQHWARAH

SEQ ID NO: 1445946 - protein, 24 aa, Mycobacterium tuberculosis
KAGVAGGGEDGKPATEVTITSVLL

SEQ ID NO: 1445947 - protein, 10 aa, Mycobacterium tuberculosis
KAMREAGPRK

SEQ ID NO: 1445948 - protein, 33 aa, Mycobacterium tuberculosis
KAPAATVPAAAAAAATRGQSRARRRRRSELRDY

SEQ ID NO: 1445949 - protein, 6 aa, Mycobacterium tuberculosis
KAPGRC

SEQ ID NO: 1445950 - protein, 13 aa, Mycobacterium tuberculosis
KAQKQAGRWSRDT

SEQ ID NO: 1445951 - protein, 99 aa, Mycobacterium tuberculosis
KARENPAPPAPPAPPAPPAPASQPPRPPVPPSPASPPTPPDVPCGDKSSPAAPATPSAPCPPAPPCPPTPNSPAAPPTPPCPPTPPIGPGPPAPPCPPA

SEQ ID NO: 1445952 - protein, 18 aa, Mycobacterium tuberculosis
KARHAATGSPTWTTATPL

SEQ ID NO: 1445953 - protein, 8 aa, Mycobacterium tuberculosis
KARSRLTG

SEQ ID NO: 1445954 - protein, 28 aa, Mycobacterium tuberculosis
KASGGAGGSGGSSLSGKAGAGGAGGSAG

SEQ ID NO: 1445955 - protein, 8 aa, Mycobacterium tuberculosis
KASTVGTI

SEQ ID NO: 1445956 - protein, 18 aa, Mycobacterium tuberculosis
KATAITPGLESPTIAPLA

SEQ ID NO: 1445957 - protein, 30 aa, Mycobacterium tuberculosis
KATAQRPRSRGTAQAPTAAAGCLTGVSDQR

SEQ ID NO: 1445958 - protein, 13 aa, Mycobacterium tuberculosis
KATGLSAKGAKTF

SEQ ID NO: 1445959 - protein, 8 aa, Mycobacterium tuberculosis
KATTPITQ

SEQ ID NO: 1445960 - protein, 9 aa, Mycobacterium tuberculosis
KATTWPPPS

SEQ ID NO: 1445961 - protein, 29 aa, Mycobacterium tuberculosis
KAVTAAPAGYSTKRGGPAETAVPPGRPGL

SEQ ID NO: 1445962 - protein, 14 aa, Mycobacterium tuberculosis
KCSSAGRPSPEAKG

SEQ ID NO: 1445963 - protein, 10 aa, Mycobacterium tuberculosis
KDAPPLPASK

SEQ ID NO: 1445964 - protein, 8 aa, Mycobacterium tuberculosis
KDEGGGTR

SEQ ID NO: 1445965 - protein, 15 aa, Mycobacterium tuberculosis
KDEGGRHTQTPDQYR

SEQ ID NO: 1445966 - protein, 14 aa, Mycobacterium tuberculosis
KDEGGRHTRSSQLP

SEQ ID NO: 1445967 - protein, 12 aa, Mycobacterium tuberculosis
KDEKKTAETFPD

SEQ ID NO: 1445968 - protein, 8 aa, Mycobacterium tuberculosis
KDESPNVY

SEQ ID NO: 1445969 - protein, 8 aa, Mycobacterium tuberculosis
KDESTANI

SEQ ID NO: 1445970 - protein, 6 aa, Mycobacterium tuberculosis
KDGDDA

SEQ ID NO: 1445971 - protein, 4 aa, Mycobacterium tuberculosis
KDIG

SEQ ID NO: 1445972 - protein, 6 aa, Mycobacterium tuberculosis
KDIRTT

SEQ ID NO: 1445973 - protein, 8 aa, Mycobacterium tuberculosis
KDLQPQNS

SEQ ID NO: 1445974 - protein, 8 aa, Mycobacterium tuberculosis
KDPSTPKI

SEQ ID NO: 1445975 - protein, 4 aa, Mycobacterium tuberculosis
KDQS

SEQ ID NO: 1445976 - protein, 10 aa, Mycobacterium tuberculosis
KDRAATDPLE

SEQ ID NO: 1445977 - protein, 16 aa, Mycobacterium tuberculosis
KDRTPRSGRQRRRGSA

SEQ ID NO: 1445978 - protein, 9 aa, Mycobacterium tuberculosis
KDSPPTWRG

SEQ ID NO: 1445979 - protein, 6 aa, Mycobacterium tuberculosis
KEACGA

SEQ ID NO: 1445980 - protein, 17 aa, Mycobacterium tuberculosis
KEAYADGIDGAVDAYWN

SEQ ID NO: 1445981 - protein, 13 aa, Mycobacterium tuberculosis
KECYSSGSADLAQ

SEQ ID NO: 1445982 - protein, 6 aa, Mycobacterium tuberculosis
KEFDET

SEQ ID NO: 1445983 - protein, 8 aa, Mycobacterium tuberculosis
KEGNTDQR

SEQ ID NO: 1445984 - protein, 9 aa, Mycobacterium tuberculosis
KEHPPKPMS

SEQ ID NO: 1445985 - protein, 9 aa, Mycobacterium tuberculosis
KEKDGGERR

SEQ ID NO: 1445986 - protein, 9 aa, Mycobacterium tuberculosis
KELNEESNF

SEQ ID NO: 1445987 - protein, 12 aa, Mycobacterium tuberculosis
KENSNDVAAGRR

SEQ ID NO: 1445988 - protein, 7 aa, Mycobacterium tuberculosis
KERKPSA

SEQ ID NO: 1445989 - protein, 5 aa, Mycobacterium tuberculosis
KETDV

SEQ ID NO: 1445990 - protein, 15 aa, Mycobacterium tuberculosis
KFSPRTSGGDPQLAQ

SEQ ID NO: 1445991 - protein, 7 aa, Mycobacterium tuberculosis
KFTDQSS

SEQ ID NO: 1445992 - protein, 12 aa, Mycobacterium tuberculosis
KGAGTSAGPRRG

SEQ ID NO: 1445993 - protein, 4 aa, Mycobacterium tuberculosis
KGAR

SEQ ID NO: 1445994 - protein, 5 aa, Mycobacterium tuberculosis
KGARI

SEQ ID NO: 1445995 - protein, 7 aa, Mycobacterium tuberculosis
KGAVTDA

SEQ ID NO: 1445996 - protein, 38 aa, Mycobacterium tuberculosis
KGDTGSGGGAGDGGKAPAGGTGGAGGDGGAGGKGGSGG

SEQ ID NO: 1445997 - protein, 34 aa, Mycobacterium tuberculosis
KGEAGGPEDNVASGTAGFEGAETPEGSHLRSTRD

SEQ ID NO: 1445998 - protein, 22 aa, Mycobacterium tuberculosis
KGGAFGGLGGAGGAGGKGGAGT

SEQ ID NO: 1445999 - protein, 7 aa, Mycobacterium tuberculosis
KGGKDLG

SEQ ID NO: 1446000 - protein, 18 aa, Mycobacterium tuberculosis
KGGNGGVGGTGGNAVAPR

SEQ ID NO: 1446001 - protein, 8 aa, Mycobacterium tuberculosis
KGGPLPRG

SEQ ID NO: 1446002 - protein, 22 aa, Mycobacterium tuberculosis
KGGQLTEKVRASGSWVGLVRRN

SEQ ID NO: 1446003 - protein, 7 aa, Mycobacterium tuberculosis
KGGRAVA

SEQ ID NO: 1446004 - protein, 8 aa, Mycobacterium tuberculosis
KGGSAVKP

SEQ ID NO: 1446005 - protein, 14 aa, Mycobacterium tuberculosis
KGKADLLKPSSGCQ

SEQ ID NO: 1446006 - protein, 13 aa, Mycobacterium tuberculosis
KGLGSGGAKGCPK

SEQ ID NO: 1446007 - protein, 8 aa, Mycobacterium tuberculosis
KGNGVSNV

SEQ ID NO: 1446008 - protein, 13 aa, Mycobacterium tuberculosis
KGQLDGPGSVGGV

SEQ ID NO: 1446009 - protein, 7 aa, Mycobacterium tuberculosis
KGRPPRR

SEQ ID NO: 1446010 - protein, 16 aa, Mycobacterium tuberculosis
KGRRGRSPARPNAPIG

SEQ ID NO: 1446011 - protein, 11 aa, Mycobacterium tuberculosis
KGSAQRTAEQR

SEQ ID NO: 1446012 - protein, 8 aa, Mycobacterium tuberculosis
KGTMSGMQ

SEQ ID NO: 1446013 - protein, 6 aa, Mycobacterium tuberculosis
KGTTEQ

SEQ ID NO: 1446014 - protein, 39 aa, Mycobacterium tuberculosis
KGTTTKKYSEGAAAGTEDAERAPVEADAGGGQKVLVRNV

SEQ ID NO: 1446015 - protein, 12 aa, Mycobacterium tuberculosis
KGWRPSARDAHP

SEQ ID NO: 1446016 - protein, 12 aa, Mycobacterium tuberculosis
KHAEVPTTTSFE

SEQ ID NO: 1446017 - protein, 15 aa, Mycobacterium tuberculosis
KHATAGGPLSAPKLE

SEQ ID NO: 1446018 - protein, 11 aa, Mycobacterium tuberculosis
KHCQRGNSCRT

SEQ ID NO: 1446019 - protein, 8 aa, Mycobacterium tuberculosis
KHDQPPWT

SEQ ID NO: 1446020 - protein, 6 aa, Mycobacterium tuberculosis
KHGDAA

SEQ ID NO: 1446021 - protein, 6 aa, Mycobacterium tuberculosis
KHGGGV

SEQ ID NO: 1446022 - protein, 4 aa, Mycobacterium tuberculosis
KHHR

SEQ ID NO: 1446023 - protein, 6 aa, Mycobacterium tuberculosis
KIAEDG

SEQ ID NO: 1446024 - protein, 4 aa, Mycobacterium tuberculosis
KIAN

SEQ ID NO: 1446025 - protein, 9 aa, Mycobacterium tuberculosis
KIEADPANP

SEQ ID NO: 1446026 - protein, 8 aa, Mycobacterium tuberculosis
KIEPAGDK

SEQ ID NO: 1446027 - protein, 8 aa, Mycobacterium tuberculosis
KIPSSQMR

SEQ ID NO: 1446028 - protein, 19 aa, Mycobacterium tuberculosis
KITSSTRRSIRGPWTPGKK

SEQ ID NO: 1446029 - protein, 6 aa, Mycobacterium tuberculosis
KITSWP

SEQ ID NO: 1446030 - protein, 14 aa, Mycobacterium tuberculosis
KKDPVSRRPLPGPR

SEQ ID NO: 1446031 - protein, 10 aa, Mycobacterium tuberculosis
KKHSDAVPRA

SEQ ID NO: 1446032 - protein, 23 aa, Mycobacterium tuberculosis
KKKKKEKKKRKKKTSAGGDDDSW

SEQ ID NO: 1446033 - protein, 30 aa, Mycobacterium tuberculosis
KKKKKKKKIKKKKKKKKKKKKKKKKKKKTK

SEQ ID NO: 1446034 - protein, 9 aa, Mycobacterium tuberculosis
KKLAPDTAL

SEQ ID NO: 1446035 - protein, 7 aa, Mycobacterium tuberculosis
KKRRNEA

SEQ ID NO: 1446036 - protein, 8 aa, Mycobacterium tuberculosis
KKYESRQV

SEQ ID NO: 1446037 - protein, 6 aa, Mycobacterium tuberculosis
KLADTQ

SEQ ID NO: 1446038 - protein, 5 aa, Mycobacterium tuberculosis
KLANP

SEQ ID NO: 1446039 - protein, 12 aa, Mycobacterium tuberculosis
KLGGGYIDTWAC

SEQ ID NO: 1446040 - protein, 18 aa, Mycobacterium tuberculosis
KLGPGVDVNRPGESGDSL

SEQ ID NO: 1446041 - protein, 5 aa, Mycobacterium tuberculosis
KLGQH

SEQ ID NO: 1446042 - protein, 20 aa, Mycobacterium tuberculosis
KLGTGGLQCSDPGNNVRHNQ

SEQ ID NO: 1446043 - protein, 21 aa, Mycobacterium tuberculosis
KLNPDRGSSRRVPRRQADGGI

SEQ ID NO: 1446044 - protein, 6 aa, Mycobacterium tuberculosis
KLPPQY

SEQ ID NO: 1446045 - protein, 6 aa, Mycobacterium tuberculosis
KLPPSI

SEQ ID NO: 1446046 - protein, 15 aa, Mycobacterium tuberculosis
KLPRTGKVPTDPAQV

SEQ ID NO: 1446047 - protein, 13 aa, Mycobacterium tuberculosis
KLSASRRKSPRTL

SEQ ID NO: 1446048 - protein, 11 aa, Mycobacterium tuberculosis
KLTNMRSSTAD

SEQ ID NO: 1446049 - protein, 5 aa, Mycobacterium tuberculosis
KLVGR

SEQ ID NO: 1446050 - protein, 7 aa, Mycobacterium tuberculosis
KNASAYE

SEQ ID NO: 1446051 - protein, 7 aa, Mycobacterium tuberculosis
KNEPPGI

SEQ ID NO: 1446052 - protein, 9 aa, Mycobacterium tuberculosis
KNHHSAGSF

SEQ ID NO: 1446053 - protein, 5 aa, Mycobacterium tuberculosis
KNPFV

SEQ ID NO: 1446054 - protein, 16 aa, Mycobacterium tuberculosis
KNPRAPWERAKSGVLE

SEQ ID NO: 1446055 - protein, 5 aa, Mycobacterium tuberculosis
KNPRC

SEQ ID NO: 1446056 - protein, 26 aa, Mycobacterium tuberculosis
KNRKSVNLDNPNRTERPTRQLRNYRA

SEQ ID NO: 1446057 - protein, 15 aa, Mycobacterium tuberculosis
KNSKARGFYEKKDFS

SEQ ID NO: 1446058 - protein, 10 aa, Mycobacterium tuberculosis
KNSSAYPTVE

SEQ ID NO: 1446059 - protein, 11 aa, Mycobacterium tuberculosis
KPAEQRRNTGR

SEQ ID NO: 1446060 - protein, 15 aa, Mycobacterium tuberculosis
KPDCPSGAGNDERAA

SEQ ID NO: 1446061 - protein, 6 aa, Mycobacterium tuberculosis
KPDDGH

SEQ ID NO: 1446062 - protein, 5 aa, Mycobacterium tuberculosis
KPDLR

SEQ ID NO: 1446063 - protein, 10 aa, Mycobacterium tuberculosis
KPDQRASFRT

SEQ ID NO: 1446064 - protein, 7 aa, Mycobacterium tuberculosis
KPGKDAH

SEQ ID NO: 1446065 - protein, 4 aa, Mycobacterium tuberculosis
KPGP

SEQ ID NO: 1446066 - protein, 7 aa, Mycobacterium tuberculosis
KPGTGST

SEQ ID NO: 1446067 - protein, 7 aa, Mycobacterium tuberculosis
KPGTPDC

SEQ ID NO: 1446068 - protein, 11 aa, Mycobacterium tuberculosis
KPISPTKTRTR

SEQ ID NO: 1446069 - protein, 7 aa, Mycobacterium tuberculosis
KPKLPKP

SEQ ID NO: 1446070 - protein, 9 aa, Mycobacterium tuberculosis
KPKPAARTR

SEQ ID NO: 1446071 - protein, 11 aa, Mycobacterium tuberculosis
KPNEVDEDELR

SEQ ID NO: 1446072 - protein, 8 aa, Mycobacterium tuberculosis
KPNPGRSG

SEQ ID NO: 1446073 - protein, 6 aa, Mycobacterium tuberculosis
KPNTPV

SEQ ID NO: 1446074 - protein, 26 aa, Mycobacterium tuberculosis
KPPAEAWGSTGISDLGGLGGDETPVE

SEQ ID NO: 1446075 - protein, 17 aa, Mycobacterium tuberculosis
KPPLTASSTGGSDSLPP

SEQ ID NO: 1446076 - protein, 4 aa, Mycobacterium tuberculosis
KPPM

SEQ ID NO: 1446077 - protein, 5 aa, Mycobacterium tuberculosis
KPPTA

SEQ ID NO: 1446078 - protein, 7 aa, Mycobacterium tuberculosis
KPQLGDP

SEQ ID NO: 1446079 - protein, 18 aa, Mycobacterium tuberculosis
KPQPDPDHRTRRSQRVRR

SEQ ID NO: 1446080 - protein, 6 aa, Mycobacterium tuberculosis
KPQPRL

SEQ ID NO: 1446081 - protein, 4 aa, Mycobacterium tuberculosis
KPQV

SEQ ID NO: 1446082 - protein, 7 aa, Mycobacterium tuberculosis
KPRDALS

SEQ ID NO: 1446083 - protein, 35 aa, Mycobacterium tuberculosis
KPRPPRRRRRPGPGAPRPRRLPPLPPQPPRRYPPA

SEQ ID NO: 1446084 - protein, 16 aa, Mycobacterium tuberculosis
KPSDARTDRRGRTTGV

SEQ ID NO: 1446085 - protein, 7 aa, Mycobacterium tuberculosis
KPTSPPV

SEQ ID NO: 1446086 - protein, 10 aa, Mycobacterium tuberculosis
KPVAAPRPGL

SEQ ID NO: 1446087 - protein, 6 aa, Mycobacterium tuberculosis
KPVPTA

SEQ ID NO: 1446088 - protein, 6 aa, Mycobacterium tuberculosis
KPWTPR

SEQ ID NO: 1446089 - protein, 6 aa, Mycobacterium tuberculosis
KPYTDV

SEQ ID NO: 1446090 - protein, 6 aa, Mycobacterium tuberculosis
KQAPGW

SEQ ID NO: 1446091 - protein, 6 aa, Mycobacterium tuberculosis
KQASAA

SEQ ID NO: 1446092 - protein, 6 aa, Mycobacterium tuberculosis
KQDEVS

SEQ ID NO: 1446093 - protein, 10 aa, Mycobacterium tuberculosis
KQGGEPAVNA

SEQ ID NO: 1446094 - protein, 14 aa, Mycobacterium tuberculosis
KQSGVGRELGPDAP

SEQ ID NO: 1446095 - protein, 26 aa, Mycobacterium tuberculosis
KQSGVGRELGPDAPLQFTETKNVFIA

SEQ ID NO: 1446096 - protein, 27 aa, Mycobacterium tuberculosis
KQVAARQREDRVDTTGFKSARDKPASM

SEQ ID NO: 1446097 - protein, 8 aa, Mycobacterium tuberculosis
KQVEPTPG

SEQ ID NO: 1446098 - protein, 26 aa, Mycobacterium tuberculosis
KRAATSTSCSRRSPSSPPRWPTPCSD

SEQ ID NO: 1446099 - protein, 10 aa, Mycobacterium tuberculosis
KRAELGGDLS

SEQ ID NO: 1446100 - protein, 7 aa, Mycobacterium tuberculosis
KRAFTSE

SEQ ID NO: 1446101 - protein, 9 aa, Mycobacterium tuberculosis
KRAKTLSES

SEQ ID NO: 1446102 - protein, 6 aa, Mycobacterium tuberculosis
KRALTN

SEQ ID NO: 1446103 - protein, 6 aa, Mycobacterium tuberculosis
KRAPMG

SEQ ID NO: 1446104 - protein, 5 aa, Mycobacterium tuberculosis
KRCRD

SEQ ID NO: 1446105 - protein, 4 aa, Mycobacterium tuberculosis
KRDS

SEQ ID NO: 1446106 - protein, 7 aa, Mycobacterium tuberculosis
KRGIDPE

SEQ ID NO: 1446107 - protein, 7 aa, Mycobacterium tuberculosis
KRGISPE

SEQ ID NO: 1446108 - protein, 8 aa, Mycobacterium tuberculosis
KRKPSSSP

SEQ ID NO: 1446109 - protein, 5 aa, Mycobacterium tuberculosis
KRLAA

SEQ ID NO: 1446110 - protein, 10 aa, Mycobacterium tuberculosis
KRLAKEVSAE

SEQ ID NO: 1446111 - protein, 6 aa, Mycobacterium tuberculosis
KRLPEV

SEQ ID NO: 1446112 - protein, 35 aa, Mycobacterium tuberculosis; identical to SEQ ID NO: 1366200

SEQ ID NO: 1446113 - protein, 11 aa, Mycobacterium tuberculosis
KRNRRNDPDRL

SEQ ID NO: 1446114 - protein, 25 aa, Mycobacterium tuberculosis
KRPGTPAAQLDGTAAESRLCRNAMN

SEQ ID NO: 1446115 - protein, 4 aa, Mycobacterium tuberculosis
KRPR

SEQ ID NO: 1446116 - protein, 10 aa, Mycobacterium tuberculosis
KRPTRAPARG

SEQ ID NO: 1446117 - protein, 5 aa, Mycobacterium tuberculosis
KRPVD

SEQ ID NO: 1446118 - protein, 21 aa, Mycobacterium tuberculosis
KRQPKARARSARGGPSQPNEP

SEQ ID NO: 1446119 - protein, 16 aa, Mycobacterium tuberculosis
KRRGPAETAVPPGSPG

SEQ ID NO: 1446120 - protein, 4 aa, Mycobacterium tuberculosis
KRRN

SEQ ID NO: 1446121 - protein, 31 aa, Mycobacterium tuberculosis
KRRPRRRHTKVPASGSGPACRRRRDARSAGE

SEQ ID NO: 1446122 - protein, 6 aa, Mycobacterium tuberculosis
KRRPST

SEQ ID NO: 1446123 - protein, 25 aa, Mycobacterium tuberculosis
KRRWRQASTDVDGAGGYGGSGGRGG

SEQ ID NO: 1446124 - protein, 11 aa, Mycobacterium tuberculosis
KRRYAGNGRTA

SEQ ID NO: 1446125 - protein, 11 aa, Mycobacterium tuberculosis
KRSCRGQPDDQ

SEQ ID NO: 1446126 - protein, 11 aa, Mycobacterium tuberculosis
KRSPAGKPDYR

SEQ ID NO: 1446127 - protein, 22 aa, Mycobacterium tuberculosis
KRTAQKSRRRVDRARFRSRRRA

SEQ ID NO: 1446128 - protein, 10 aa, Mycobacterium tuberculosis
KRTSTRISNP

SEQ ID NO: 1446129 - protein, 8 aa, Mycobacterium tuberculosis
KRTTTPDV

SEQ ID NO: 1446130 - protein, 14 aa, Mycobacterium tuberculosis
KRVGNESLRGQPGA

SEQ ID NO: 1446131 - protein, 18 aa, Mycobacterium tuberculosis
KRVPGGLTTGKADTATGL

SEQ ID NO: 1446132 - protein, 7 aa, Mycobacterium tuberculosis
KRWKDGG

SEQ ID NO: 1446133 - protein, 6 aa, Mycobacterium tuberculosis
KSAARD

SEQ ID NO: 1446134 - protein, 7 aa, Mycobacterium tuberculosis
KSAGRRC

SEQ ID NO: 1446135 - protein, 5 aa, Mycobacterium tuberculosis
KSALR

SEQ ID NO: 1446136 - protein, 6 aa, Mycobacterium tuberculosis
KSAPQP

SEQ ID NO: 1446137 - protein, 6 aa, Mycobacterium tuberculosis
KSARVD

SEQ ID NO: 1446138 - protein, 8 aa, Mycobacterium tuberculosis
KSASDLGA

SEQ ID NO: 1446139 - protein, 7 aa, Mycobacterium tuberculosis
KSAVMGG

SEQ ID NO: 1446140 - protein, 9 aa, Mycobacterium tuberculosis
KSDDTNARV

SEQ ID NO: 1446141 - protein, 10 aa, Mycobacterium tuberculosis
KSDEYGPIRA

SEQ ID NO: 1446142 - protein, 6 aa, Mycobacterium tuberculosis
KSDSIG

SEQ ID NO: 1446143 - protein, 21 aa, Mycobacterium tuberculosis
KSDSLGPADRADLGLCGIGQL

SEQ ID NO: 1446144 - protein, 18 aa, Mycobacterium tuberculosis
KSEASTTRCPTSRFSPQL

SEQ ID NO: 1446145 - protein, 11 aa, Mycobacterium tuberculosis
KSFPDSSVTRA

SEQ ID NO: 1446146 - protein, 8 aa, Mycobacterium tuberculosis
KSHPGSGD

SEQ ID NO: 1446147 - protein, 9 aa, Mycobacterium tuberculosis
KSKAVGSSG

SEQ ID NO: 1446148 - protein, 9 aa, Mycobacterium tuberculosis
KSLAGKGVD

SEQ ID NO: 1446149 - protein, 15 aa, Mycobacterium tuberculosis
KSLRSRLTSYLPTWP

SEQ ID NO: 1446150 - protein, 6 aa, Mycobacterium tuberculosis
KSMSGP

SEQ ID NO: 1446151 - protein, 20 aa, Mycobacterium tuberculosis
KSRRSSSTGGAPPRSRRSVP

SEQ ID NO: 1446152 - protein, 13 aa, Mycobacterium tuberculosis
KSRSARKADRAGL

SEQ ID NO: 1446153 - protein, 19 aa, Mycobacterium tuberculosis
KSRSNTRSRRSQWKAAKTE

SEQ ID NO: 1446154 - protein, 8 aa, Mycobacterium tuberculosis
KSRSSNEF

SEQ ID NO: 1446155 - protein, 19 aa, Mycobacterium tuberculosis
KSRWADAEANRRPDQPQLW

SEQ ID NO: 1446156 - protein, 4 aa, Mycobacterium tuberculosis
KSSA

SEQ ID NO: 1446157 - protein, 7 aa, Mycobacterium tuberculosis
KSSRNAV

SEQ ID NO: 1446158 - protein, 14 aa, Mycobacterium tuberculosis
KSSRPTRTGYSPGV

SEQ ID NO: 1446159 - protein, 5 aa, Mycobacterium tuberculosis
KSSRT

SEQ ID NO: 1446160 - protein, 6 aa, Mycobacterium tuberculosis
KSSSER

SEQ ID NO: 1446161 - protein, 11 aa, Mycobacterium tuberculosis
KSTALELGPSG

SEQ ID NO: 1446162 - protein, 5 aa, Mycobacterium tuberculosis
KSTTL

SEQ ID NO: 1446163 - protein, 6 aa, Mycobacterium tuberculosis
KSVYRA

SEQ ID NO: 1446164 - protein, 11 aa, Mycobacterium tuberculosis
KSYQSGDLANA

SEQ ID NO: 1446165 - protein, 5 aa, Mycobacterium tuberculosis
KTAAT

SEQ ID NO: 1446166 - protein, 7 aa, Mycobacterium tuberculosis
KTAGLQP

SEQ ID NO: 1446167 - protein, 5 aa, Mycobacterium tuberculosis
KTARE

SEQ ID NO: 1446168 - protein, 17 aa, Mycobacterium tuberculosis
KTDPPDGQVPEGTNASQ

SEQ ID NO: 1446169 - protein, 4 aa, Mycobacterium tuberculosis
KTFQ

SEQ ID NO: 1446170 - protein, 17 aa, Mycobacterium tuberculosis
KTGAERDGTRGSLGRGR

SEQ ID NO: 1446171 - protein, 22 aa, Mycobacterium tuberculosis
KTGAGARGGPFATASDGWTSTR

SEQ ID NO: 1446172 - protein, 15 aa, Mycobacterium tuberculosis
KTGARPNGRGSGCPD

SEQ ID NO: 1446173 - protein, 8 aa, Mycobacterium tuberculosis
KTGEGSDK

SEQ ID NO: 1446174 - protein, 5 aa, Mycobacterium tuberculosis
KTGQP

SEQ ID NO: 1446175 - protein, 6 aa, Mycobacterium tuberculosis
KTHADS

SEQ ID NO: 1446176 - protein, 6 aa, Mycobacterium tuberculosis
KTPHIR

SEQ ID NO: 1446177 - protein, 5 aa, Mycobacterium tuberculosis
KTPIE

SEQ ID NO: 1446178 - protein, 6 aa, Mycobacterium tuberculosis
KTPPTL

SEQ ID NO: 1446179 - protein, 6 aa, Mycobacterium tuberculosis
KTPRIR

SEQ ID NO: 1446180 - protein, 6 aa, Mycobacterium tuberculosis
KTPSRS

SEQ ID NO: 1446181 - protein, 6 aa, Mycobacterium tuberculosis
KTQAGR

SEQ ID NO: 1446182 - protein, 8 aa, Mycobacterium tuberculosis
KTRPVTGL

SEQ ID NO: 1446183 - protein, 16 aa, Mycobacterium tuberculosis
KTRRSTPRIGHGPRPS

SEQ ID NO: 1446184 - protein, 7 aa, Mycobacterium tuberculosis
KTTDADI

SEQ ID NO: 1446185 - protein, 5 aa, Mycobacterium tuberculosis
KTTQT

SEQ ID NO: 1446186 - protein, 6 aa, Mycobacterium tuberculosis
KTTSVS

SEQ ID NO: 1446187 - protein, 5 aa, Mycobacterium tuberculosis
KTTTT

SEQ ID NO: 1446188 - protein, 12 aa, Mycobacterium tuberculosis
KVDAARRVGRNR

SEQ ID NO: 1446189 - protein, 10 aa, Mycobacterium tuberculosis
KVDPAADPAV

SEQ ID NO: 1446190 - protein, 18 aa, Mycobacterium tuberculosis
KVEHRDRQQLAAQSGYSE

SEQ ID NO: 1446191 - protein, 6 aa, Mycobacterium tuberculosis
KVGPGF

SEQ ID NO: 1446192 - protein, 9 aa, Mycobacterium tuberculosis
KVGPSGRPT

SEQ ID NO: 1446193 - protein, 13 aa, Mycobacterium tuberculosis
KVNDPQLGVHRLA

SEQ ID NO: 1446194 - protein, 4 aa, Mycobacterium tuberculosis
KVNK

SEQ ID NO: 1446195 - protein, 6 aa, Mycobacterium tuberculosis
KVPRAA

SEQ ID NO: 1446196 - protein, 16 aa, Mycobacterium tuberculosis
KVPRSSVGQRSKWATS

SEQ ID NO: 1446197 - protein, 19 aa, Mycobacterium tuberculosis
KVSSKTAPTPIHMVTMAGN

SEQ ID NO: 1446198 - protein, 16 aa, Mycobacterium tuberculosis
KVSTSCRPAWPTSTCP

SEQ ID NO: 1446199 - protein, 9 aa, Mycobacterium tuberculosis
KVTDPGSRV

SEQ ID NO: 1446200 - protein, 9 aa, Mycobacterium tuberculosis
KVTPPAGRR

SEQ ID NO: 1446201 - protein, 6 aa, Mycobacterium tuberculosis
KVYPEE

SEQ ID NO: 1446202 - protein, 6 aa, Mycobacterium tuberculosis
KWDQRG

SEQ ID NO: 1446203 - protein, 8 aa, Mycobacterium tuberculosis
KWGSARRR

SEQ ID NO: 1446204 - protein, 9 aa, Mycobacterium tuberculosis
KYGSEHGDP

SEQ ID NO: 1446205 - protein, 4 aa, Mycobacterium tuberculosis
KYPD

SEQ ID NO: 1446206 - protein, 6 aa, Mycobacterium tuberculosis
KYPTSV

SEQ ID NO: 1446207 - protein, 11 aa, Mycobacterium tuberculosis
KYRADKKITAT

SEQ ID NO: 1446208 - protein, 9 aa, Mycobacterium tuberculosis
LAAADTGLN

SEQ ID NO: 1446209 - protein, 5 aa, Mycobacterium tuberculosis
LAADP

SEQ ID NO: 1446210 - protein, 18 aa, Mycobacterium tuberculosis
LAADRDALTAAATASGHR

SEQ ID NO: 1446211 - protein, 4 aa, Mycobacterium tuberculosis
LAAG

SEQ ID NO: 1446212 - protein, 5 aa, Mycobacterium tuberculosis
LAAGD

SEQ ID NO: 1446213 - protein, 11 aa, Mycobacterium tuberculosis
LAAGGNTPVVG

SEQ ID NO: 1446214 - protein, 23 aa, Mycobacterium tuberculosis
LAAGQHDYRGRTSRSAQRTSPTR

SEQ ID NO: 1446215 - protein, 6 aa, Mycobacterium tuberculosis
LAAGRQ

SEQ ID NO: 1446216 - protein, 35 aa, Mycobacterium tuberculosis
LAAGTGKDAVAAPAADTAVAAATGHGADGTAAVGP

SEQ ID NO: 1446217 - protein, 8 aa, Mycobacterium tuberculosis
LAANRNQP

SEQ ID NO: 1446218 - protein, 8 aa, Mycobacterium tuberculosis
LAAPAGVR

SEQ ID NO: 1446219 - protein, 6 aa, Mycobacterium tuberculosis
LAAPGE

SEQ ID NO: 1446220 - protein, 12 aa, Mycobacterium tuberculosis
LAAPKTVYASPA

SEQ ID NO: 1446221 - protein, 8 aa, Mycobacterium tuberculosis
LAASGTPA

SEQ ID NO: 1446222 - protein, 11 aa, Mycobacterium tuberculosis
LAATSPQVGRD

SEQ ID NO: 1446223 - protein, 8 aa, Mycobacterium tuberculosis
LADAGPAL

SEQ ID NO: 1446224 - protein, 7 aa, Mycobacterium tuberculosis
LADATTT

SEQ ID NO: 1446225 - protein, 6 aa, Mycobacterium tuberculosis
LADQVA

SEQ ID NO: 1446226 - protein, 4 aa, Mycobacterium tuberculosis
LADR

SEQ ID NO: 1446227 - protein, 13 aa, Mycobacterium tuberculosis
LADTASRCTRSPP

SEQ ID NO: 1446228 - protein, 71 aa, Mycobacterium tuberculosis
LAEQPGVPGQHAGGGTQSGPAHADESAASVTPAAASGVPGARAAAAAPSGTAVGAGARSSVGTAAASGAGS

SEQ ID NO: 1446229 - protein, 97 aa, Mycobacterium tuberculosis
LAEQPGVPGQHAGGGTQSGPAHADESAASVTPAAASGVPGARAAAAAPSGTAVGAGARSSVGTAAASGAGSHAATGRAPVATRTRRRHRARGRPRRG

SEQ ID NO: 1446230 - protein, 36 aa, Mycobacterium tuberculosis
LAEQPGVPGQHAGGGTQSGPAHADESAASVTPVAAS

SEQ ID NO: 1446231 - protein, 5 aa, Mycobacterium tuberculosis
LAGAA

SEQ ID NO: 1446232 - protein, 5 aa, Mycobacterium tuberculosis
LAGAE

SEQ ID NO: 1446233 - protein, 34 aa, Mycobacterium tuberculosis
LAGASAPAAPAPPAPPWPPVPPTPTAPAAPPALK

SEQ ID NO: 1446234 - protein, 4 aa, Mycobacterium tuberculosis
LAGD

SEQ ID NO: 1446235 - protein, 16 aa, Mycobacterium tuberculosis
LAGGDERAGRTEGAGR

SEQ ID NO: 1446236 - protein, 19 aa, Mycobacterium tuberculosis
LAGGGPGFGDGEQFGGHRE

SEQ ID NO: 1446237 - protein, 15 aa, Mycobacterium tuberculosis
LAGPAAMGAWPAGVA

SEQ ID NO: 1446238 - protein, 14 aa, Mycobacterium tuberculosis
LAGPGGAGGTGGRG

SEQ ID NO: 1446239 - protein, 11 aa, Mycobacterium tuberculosis
LAGPGNNGLED

SEQ ID NO: 1446240 - protein, 17 aa, Mycobacterium tuberculosis
LAGPGPDRAGWLRRFGC

SEQ ID NO: 1446241 - protein, 13 aa, Mycobacterium tuberculosis
LAGPNATHDADKP

SEQ ID NO: 1446242 - protein, 12 aa, Mycobacterium tuberculosis
LAGQGGNGGAGG

SEQ ID NO: 1446243 - protein, 14 aa, Mycobacterium tuberculosis
LAGRPDQAQPGDHL

SEQ ID NO: 1446244 - protein, 7 aa, Mycobacterium tuberculosis
LAGRQRR

SEQ ID NO: 1446245 - protein, 6 aa, Mycobacterium tuberculosis
LAGTAR

SEQ ID NO: 1446246 - protein, 32 aa, Mycobacterium tuberculosis
LAGTPDVGLTAQDATTALGVPTRRRASSGGIP

SEQ ID NO: 1446247 - protein, 31 aa, Mycobacterium tuberculosis
LAGTPGATVAGGAAVTAGAAAATGTTQAGHR

SEQ ID NO: 1446248 - protein, 6 aa, Mycobacterium tuberculosis
LAGTSA

SEQ ID NO: 1446249 - protein, 8 aa, Mycobacterium tuberculosis
LAHGGQPV

SEQ ID NO: 1446250 - protein, 20 aa, Mycobacterium tuberculosis
LAHPRGAARPAAGPARRRRP

SEQ ID NO: 1446251 - protein, 14 aa, Mycobacterium tuberculosis
LAKETSSNKQDATV

SEQ ID NO: 1446252 - protein, 28 aa, Mycobacterium tuberculosis
LAKEVSPLPPTSCSGARGWGRQRRSMGR

SEQ ID NO: 1446253 - protein, 5 aa, Mycobacterium tuberculosis
LAKPT

SEQ ID NO: 1446254 - protein, 14 aa, Mycobacterium tuberculosis
LALPPGPARPAGAA

SEQ ID NO: 1446255 - protein, 30 aa, Mycobacterium tuberculosis
LALPPGPARPGGGGGAGGSLFGSPGTTGPH

SEQ ID NO: 1446256 - protein, 5 aa, Mycobacterium tuberculosis
LANKD

SEQ ID NO: 1446257 - protein, 20 aa, Mycobacterium tuberculosis
LANPTRPPANPQALTPPKVP

SEQ ID NO: 1446258 - protein, 15 aa, Mycobacterium tuberculosis
LAPARRAELGDSPPV

SEQ ID NO: 1446259 - protein, 5 aa, Mycobacterium tuberculosis
LAPEH

SEQ ID NO: 1446260 - protein, 16 aa, Mycobacterium tuberculosis
LAPGGLPARRGAGAFG

SEQ ID NO: 1446261 - protein, 25 aa, Mycobacterium tuberculosis
LAPGNRGTHLEQRNQRTAHALAERC

SEQ ID NO: 1446262 - protein, 27 aa, Mycobacterium tuberculosis
LAPGPPGSGSSSRSPAGRGPSRNASAT

SEQ ID NO: 1446263 - protein, 10 aa, Mycobacterium tuberculosis
LAPGQPARSR

SEQ ID NO: 1446264 - protein, 11 aa, Mycobacterium tuberculosis
LAPKSAKSLSL

SEQ ID NO: 1446265 - protein, 22 aa, Mycobacterium tuberculosis
LAPNTAGTGGVGGVGGAGGQGG

SEQ ID NO: 1446266 - protein, 34 aa, Mycobacterium tuberculosis
LAPPAPPDPPSPPRPPVPPVPPLPPSPPSPPTGW

SEQ ID NO: 1446267 - protein, 22 aa, Mycobacterium tuberculosis
LAPPEPGAGRRRGHLRVLPDPA

SEQ ID NO: 1446268 - protein, 29 aa, Mycobacterium tuberculosis
LAPPTRPAPTEPPPSPSPQRNSGRRAERR

SEQ ID NO: 1446269 - protein, 19 aa, Mycobacterium tuberculosis
LAPQAADALAAEQAERGRT

SEQ ID NO: 1446270 - protein, 9 aa, Mycobacterium tuberculosis
LAPQDGDGV

SEQ ID NO: 1446271 - protein, 17 aa, Mycobacterium tuberculosis
LAPQRRQLGDRVLRFRP

SEQ ID NO: 1446272 - protein, 8 aa, Mycobacterium tuberculosis
LAPTTAER

SEQ ID NO: 1446273 - protein, 7 aa, Mycobacterium tuberculosis
LAPTTSV

SEQ ID NO: 1446274 - protein, 5 aa, Mycobacterium tuberculosis
LAQAE

SEQ ID NO: 1446275 - protein, 8 aa, Mycobacterium tuberculosis
LAQEKTGE

SEQ ID NO: 1446276 - protein, 8 aa, Mycobacterium tuberculosis
LAQPRPLD

SEQ ID NO: 1446277 - protein, 31 aa, Mycobacterium tuberculosis
LAQRDRRKRVPGIRPGDHGDAHRPYPATAPQ

SEQ ID NO: 1446278 - protein, 16 aa, Mycobacterium tuberculosis
LAQRSGAPTEEPGQLG

SEQ ID NO: 1446279 - protein, 10 aa, Mycobacterium tuberculosis
LARKQTMSAQ

SEQ ID NO: 1446280 - protein, 24 aa, Mycobacterium tuberculosis
LARPEQGRPGSSGRQGRHRFPAGA

SEQ ID NO: 1446281 - protein, 5 aa, Mycobacterium tuberculosis
LARRE

SEQ ID NO: 1446282 - protein, 21 aa, Mycobacterium tuberculosis
LASGGSDARGAAGSTDAGRRV

SEQ ID NO: 1446283 - protein, 8 aa, Mycobacterium tuberculosis
LASPTPSS

SEQ ID NO: 1446284 - protein, 11 aa, Mycobacterium tuberculosis
LASSDKTQVSI

SEQ ID NO: 1446285 - protein, 12 aa, Mycobacterium tuberculosis
LASSPTGPAITA

SEQ ID NO: 1446286 - protein, 12 aa, Mycobacterium tuberculosis
LASTTGRGQDHE

SEQ ID NO: 1446287 - protein, 6 aa, Mycobacterium tuberculosis
LATAAQ

SEQ ID NO: 1446288 - protein, 6 aa, Mycobacterium tuberculosis
LATATD

SEQ ID NO: 1446289 - protein, 12 aa, Mycobacterium tuberculosis
LATDPQARQRRE

SEQ ID NO: 1446290 - protein, 4 aa, Mycobacterium tuberculosis
LATP

SEQ ID NO: 1446291 - protein, 24 aa, Mycobacterium tuberculosis
LATPRRRPHRHRTRPQTRHHPEQP

SEQ ID NO: 1446292 - protein, 4 aa, Mycobacterium tuberculosis
LATS

SEQ ID NO: 1446293 - protein, 28 aa, Mycobacterium tuberculosis
LDAASKAQLERGAGWSSCSSSRNPSPCP

SEQ ID NO: 1446294 - protein, 7 aa, Mycobacterium tuberculosis
LDADGVA

SEQ ID NO: 1446295 - protein, 5 aa, Mycobacterium tuberculosis
LDAED

SEQ ID NO: 1446296 - protein, 7 aa, Mycobacterium tuberculosis
LDAEDAK

SEQ ID NO: 1446297 - protein, 5 aa, Mycobacterium tuberculosis
LDAEL

SEQ ID NO: 1446298 - protein, 15 aa, Mycobacterium tuberculosis
LDAPPSALRASAKEV

SEQ ID NO: 1446299 - protein, 4 aa, Mycobacterium tuberculosis
LDAQ

SEQ ID NO: 1446300 - protein, 23 aa, Mycobacterium tuberculosis
LDAQPDPHLSGDEPPSRPLTPET

SEQ ID NO: 1446301 - protein, 32 aa, Mycobacterium tuberculosis
LDARRSQGAGQKSGKPLSDSGGDARRPGPRAQ

SEQ ID NO: 1446302 - protein, 26 aa, Mycobacterium tuberculosis
LDASTGAGVASTTAPPDGQVPDGTNL

SEQ ID NO: 1446303 - protein, 20 aa, Mycobacterium tuberculosis
LDATDTPPPAPATSGQTSLD

SEQ ID NO: 1446304 - protein, 8 aa, Mycobacterium tuberculosis
LDATKGLT

SEQ ID NO: 1446305 - protein, 8 aa, Mycobacterium tuberculosis
LDDADAEA

SEQ ID NO: 1446306 - protein, 4 aa, Mycobacterium tuberculosis
LDDQ

SEQ ID NO: 1446307 - protein, 8 aa, Mycobacterium tuberculosis
LDDTTDMK

SEQ ID NO: 1446308 - protein, 5 aa, Mycobacterium tuberculosis
LDDYS

SEQ ID NO: 1446309 - protein, 20 aa, Mycobacterium tuberculosis
LDEGESIRRSEHSRSGCGAD

SEQ ID NO: 1446310 - protein, 11 aa, Mycobacterium tuberculosis
LDEGGDGPHGV

SEQ ID NO: 1446311 - protein, 9 aa, Mycobacterium tuberculosis
LDGASTRRV

SEQ ID NO: 1446312 - protein, 10 aa, Mycobacterium tuberculosis
LDGDGAVQRG

SEQ ID NO: 1446313 - protein, 4 aa, Mycobacterium tuberculosis
LDGE

SEQ ID NO: 1446314 - protein, 26 aa, Mycobacterium tuberculosis
LDGGPPGDRAAAAGGGVGLGSRPAVR

SEQ ID NO: 1446315 - protein, 7 aa, Mycobacterium tuberculosis
LDGRTNE

SEQ ID NO: 1446316 - protein, 17 aa, Mycobacterium tuberculosis
LDHPPRRSRPRRTTRRM

SEQ ID NO: 1446317 - protein, 8 aa, Mycobacterium tuberculosis
LDKGGGRL

SEQ ID NO: 1446318 - protein, 12 aa, Mycobacterium tuberculosis
LDLPPPAALTGE

SEQ ID NO: 1446319 - protein, 8 aa, Mycobacterium tuberculosis
LDPATGRV

SEQ ID NO: 1446320 - protein, 5 aa, Mycobacterium tuberculosis
LDPQA

SEQ ID NO: 1446321 - protein, 19 aa, Mycobacterium tuberculosis
LDPQPGKLPDWSPTSSRTW

SEQ ID NO: 1446322 - protein, 4 aa, Mycobacterium tuberculosis
LDPR

SEQ ID NO: 1446323 - protein, 18 aa, Mycobacterium tuberculosis
LDPRSTRRLDGHTDAPAD

SEQ ID NO: 1446324 - protein, 37 aa, Mycobacterium tuberculosis
LDPRTSQADRTRQGAGHGTGGSAAAGRGRHRTDQRGA

SEQ ID NO: 1446325 - protein, 11 aa, Mycobacterium tuberculosis
LDPSGGNRDMR

SEQ ID NO: 1446326 - protein, 5 aa, Mycobacterium tuberculosis
LDPVN

SEQ ID NO: 1446327 - protein, 36 aa, Mycobacterium tuberculosis
LDRPRRRRAHPSTDRAPLGAARDPPAVGGAPGRCQR

SEQ ID NO: 1446328 - protein, 4 aa, Mycobacterium tuberculosis
LDRT

SEQ ID NO: 1446329 - protein, 13 aa, Mycobacterium tuberculosis
LDSDSARPAADPG

SEQ ID NO: 1446330 - protein, 8 aa, Mycobacterium tuberculosis
LDSDTGDK

SEQ ID NO: 1446331 - protein, 5 aa, Mycobacterium tuberculosis
LDSEG

SEQ ID NO: 1446332 - protein, 20 aa, Mycobacterium tuberculosis
LDSRDQGAADRRDVLAAADG

SEQ ID NO: 1446333 - protein, 10 aa, Mycobacterium tuberculosis
LDSTGPGQAI

SEQ ID NO: 1446334 - protein, 11 aa, Mycobacterium tuberculosis
LDTLGQAEAAG

SEQ ID NO: 1446335 - protein, 23 aa, Mycobacterium tuberculosis
LDTLGQAEAAGAVRVGSDSDTSE

SEQ ID NO: 1446336 - protein, 23 aa, Mycobacterium tuberculosis
LDTLGQAEANGAVRVGPDSDTSE

SEQ ID NO: 1446337 - protein, 7 aa, Mycobacterium tuberculosis
LDTPASA

SEQ ID NO: 1446338 - protein, 39 aa, Mycobacterium tuberculosis
LDVEDSDSDDEDSDEDAADADVDEEDAAGLDGSPAEVDV

SEQ ID NO: 1446339 - protein, 13 aa, Mycobacterium tuberculosis
LEARKTGGSVVLL

SEQ ID NO: 1446340 - protein, 4 aa, Mycobacterium tuberculosis
LEGD

SEQ ID NO: 1446341 - protein, 4 aa, Mycobacterium tuberculosis
LEGF

SEQ ID NO: 1446342 - protein, 9 aa, Mycobacterium tuberculosis
LEGKPHGVE

SEQ ID NO: 1446343 - protein, 12 aa, Mycobacterium tuberculosis
LEGTGEVQTPLS

SEQ ID NO: 1446344 - protein, 12 aa, Mycobacterium tuberculosis
LEGVSADRAPQI

SEQ ID NO: 1446345 - protein, 19 aa, Mycobacterium tuberculosis
LEPTGGSIQSASGAHYSAA

SEQ ID NO: 1446346 - protein, 16 aa, Mycobacterium tuberculosis
LEPTSETPAFRWRWRP

SEQ ID NO: 1446347 - protein, 5 aa, Mycobacterium tuberculosis
LERGT

SEQ ID NO: 1446348 - protein, 10 aa, Mycobacterium tuberculosis
LERNNTSEGS

SEQ ID NO: 1446349 - protein, 17 aa, Mycobacterium tuberculosis
LERPGDEPPGDRCTRRQ

SEQ ID NO: 1446350 - protein, 12 aa, Mycobacterium tuberculosis
LESGSNSGYRPY

SEQ ID NO: 1446351 - protein, 15 aa, Mycobacterium tuberculosis
LESKKISKTQAVTSN

SEQ ID NO: 1446352 - protein, 6 aa, Mycobacterium tuberculosis
LESQGK

SEQ ID NO: 1446353 - protein, 9 aa, Mycobacterium tuberculosis
LETSTERLT

SEQ ID NO: 1446354 - protein, 6 aa, Mycobacterium tuberculosis
LFDPDS

SEQ ID NO: 1446355 - protein, 9 aa, Mycobacterium tuberculosis
LGADSRHAG

SEQ ID NO: 1446356 - protein, 11 aa, Mycobacterium tuberculosis
LGAESEGERGR

SEQ ID NO: 1446357 - protein, 17 aa, Mycobacterium tuberculosis
LGAGAGGAGGVGGAGGL

SEQ ID NO: 1446358 - protein, 13 aa, Mycobacterium tuberculosis
LGAPDFPSPGYPL

SEQ ID NO: 1446359 - protein, 17 aa, Mycobacterium tuberculosis
LGAPGPPAGGGVRRRRR

SEQ ID NO: 1446360 - protein, 6 aa, Mycobacterium tuberculosis
LGAPNG

SEQ ID NO: 1446361 - protein, 9 aa, Mycobacterium tuberculosis
LGARGTAQV

SEQ ID NO: 1446362 - protein, 14 aa, Mycobacterium tuberculosis
LGATPARGRADRQT

SEQ ID NO: 1446363 - protein, 7 aa, Mycobacterium tuberculosis
LGATPAT

SEQ ID NO: 1446364 - protein, 13 aa, Mycobacterium tuberculosis
LGATPNTGPAPQG

SEQ ID NO: 1446365 - protein, 8 aa, Mycobacterium tuberculosis
LGDAPDGV

SEQ ID NO: 1446366 - protein, 5 aa, Mycobacterium tuberculosis
LGDGG

SEQ ID NO: 1446367 - protein, 67 aa, Mycobacterium tuberculosis
LGDGGNGGAGGQGGAGRGGSTDGGGGVGGHGGAGGDAGMNGGGGTGGQGGNGAAGGAGWSPDSDLKG

SEQ ID NO: 1446368 - protein, 16 aa, Mycobacterium tuberculosis
LGDPLAADNPPGAVDP

SEQ ID NO: 1446369 - protein, 8 aa, Mycobacterium tuberculosis
LGDRRLPD

SEQ ID NO: 1446370 - protein, 13 aa, Mycobacterium tuberculosis
LGDRSRSVSLSGT

SEQ ID NO: 1446371 - protein, 13 aa, Mycobacterium tuberculosis
LGEARAATARTQM

SEQ ID NO: 1446372 - protein, 12 aa, Mycobacterium tuberculosis
LGEDARSQHIDP

SEQ ID NO: 1446373 - protein, 6 aa, Mycobacterium tuberculosis
LGENTA

SEQ ID NO: 1446374 - protein, 6 aa, Mycobacterium tuberculosis
LGEPAA

SEQ ID NO: 1446375 - protein, 16 aa, Mycobacterium tuberculosis
LGEPGEHSLPASTPIT

SEQ ID NO: 1446376 - protein, 5 aa, Mycobacterium tuberculosis
LGERT

SEQ ID NO: 1446377 - protein, 5 aa, Mycobacterium tuberculosis
LGESA

SEQ ID NO: 1446378 - protein, 9 aa, Mycobacterium tuberculosis
LGGASTRRV

SEQ ID NO: 1446379 - protein, 9 aa, Mycobacterium tuberculosis
LGGERTSGF

SEQ ID NO: 1446380 - protein, 14 aa, Mycobacterium tuberculosis
LGGGFRSRRASMPA

SEQ ID NO: 1446381 - protein, 118 aa, Mycobacterium tuberculosis
  misc_feature (70)..(71): Xaa can be any naturally occurring amino acid
LGGGGGAGGVGGTGGIGGIGGAGGNGGAGGAGTTTGGGATIGGGGGTGGVGGAGGTGGTGGAGGTTGGSXXAGGLIGWAGAAGGTGAGGTGGQGGLGGQGGNGGNGGTGATGGQGGDF

SEQ ID NO: 1446382 - protein, 13 aa, Mycobacterium tuberculosis
LGGNDGDGGDGGG

SEQ ID NO: 1446383 - protein, 12 aa, Mycobacterium tuberculosis
LGGNGGNGGNAQ

SEQ ID NO: 1446384 - protein, 4 aa, Mycobacterium tuberculosis
LGGP

SEQ ID NO: 1446385 - protein, 10 aa, Mycobacterium tuberculosis
LGGPDAARRQ

SEQ ID NO: 1446386 - protein, 239 aa, Mycobacterium tuberculosis
LGGPGGNGGTGGNASATGTNGVANAGNGGKGGDGGQFGAGGNGGAGGSVTDGSAGSTAGNGGNGGNATNGTIAGQPAGGNGSAGGKGGDGGNIAAGATGTAGNGGNGGNGNDGAVNAGTGGSGGNGGNAGGGGANGGDGGAGGAGGAGGRGGKGIDGGFGGDGGNGGSNNGTGAGGNGGNGGTGGVGSVGAAGGDGGNGGTGGFAGFGGTAGNGGSGGTGGAGGDGGTGGDGGNGGTGV

SEQ ID NO: 1446387 - protein, 6 aa, Mycobacterium tuberculosis
LGGPRP

SEQ ID NO: 1446388 - protein, 12 aa, Mycobacterium tuberculosis
LGGQGGNGGAGG

SEQ ID NO: 1446389 - protein, 12 aa, Mycobacterium tuberculosis
LGGQHRGSQPGS

SEQ ID NO: 1446390 - protein, 9 aa, Mycobacterium tuberculosis
LGGRELGAG

SEQ ID NO: 1446391 - protein, 12 aa, Mycobacterium tuberculosis
LGGRLDETGYPT

SEQ ID NO: 1446392 - protein, 19 aa, Mycobacterium tuberculosis
LGGRPESADDFPASRHDDS

SEQ ID NO: 1446393 - protein, 5 aa, Mycobacterium tuberculosis
LGGRR

SEQ ID NO: 1446394 - protein, 18 aa, Mycobacterium tuberculosis
LGNAGSGNVGFGNMGVGN

SEQ ID NO: 1446395 - protein, 47 aa, Mycobacterium tuberculosis
LGNGGDGGAGGAQRARRVGASPGAGAAGGGGGAGGSLFGSPGTTGPH

SEQ ID NO: 1446396 - protein, 47 aa, Mycobacterium tuberculosis
LGNGGDGRAGRGRRARRVGASPEAGAAGGGGGAGGSLFGSPGTTGPH

SEQ ID NO: 1446397 - protein, 27 aa, Mycobacterium tuberculosis
LGNGGNGGNGGTGTSAGSPGAGGAGGS

SEQ ID NO: 1446398 - protein, 8 aa, Mycobacterium tuberculosis
LGNGGQPR

SEQ ID NO: 1446399 - protein, 32 aa, Mycobacterium tuberculosis
LGNPGLDGGTGGNGGAGGSGGAWAGNGGTGGA

SEQ ID NO: 1446400 - protein, 63 aa, Mycobacterium tuberculosis
LGNPGLDGGTGGNGGAGGSGGAWAGNGGTGGAGGTGGVGGTGGSGRAGVNGSSAGADGHPGGT

SEQ ID NO: 1446401 - protein, 182 aa, Mycobacterium tuberculosis
LGNPGLDGGTGGNGGAGGSGGAWAGNGGTGGAGGTGGVGGTGGSGSDGVNGSSAGADGHPGGTGGVGGTGGKGGDGGDGGAAPNGVAGSQGPGGAGGDGGTGGVGGNGGRGIDGTDGATAGARGQDGGAGGAGGKGGRGGTGGPGGAGPAGTTGSQGAGGNGGSGGTGGDPGDGGNGANGSV

SEQ ID NO: 1446402 - protein, 27 aa, Mycobacterium tuberculosis
LGPAPGPAPPPAAPGPPAPPGPGPQLP

SEQ ID NO: 1446403 - protein, 4 aa, Mycobacterium tuberculosis
LGPE

SEQ ID NO: 1446404 - protein, 35 aa, Mycobacterium tuberculosis
LGPGDSDWMTPQSRREVRDGQRRHPSDNTDEPARA

SEQ ID NO: 1446405 - protein, 12 aa, Mycobacterium tuberculosis
LGPGPVTTGAAA

SEQ ID NO: 1446406 - protein, 27 aa, Mycobacterium tuberculosis
LGPGRSGRSDRHSGPQYRSAQRPGQRL

SEQ ID NO: 1446407 - protein, 14 aa, Mycobacterium tuberculosis
LGPGTSTSAASRAL

SEQ ID NO: 1446408 - protein, 7 aa, Mycobacterium tuberculosis
LGPTHPS

SEQ ID NO: 1446409 - protein, 21 aa, Mycobacterium tuberculosis
LGPYAAQRGLDASPAALAADP

SEQ ID NO: 1446410 - protein, 16 aa, Mycobacterium tuberculosis
LGQAANSFSSATAALA

SEQ ID NO: 1446411 - protein, 19 aa, Mycobacterium tuberculosis
LGQESNESRPGGGCRSSRG

SEQ ID NO: 1446412 - protein, 24 aa, Mycobacterium tuberculosis
LGQPAGRLSGRTGGPGRPRWATSA

SEQ ID NO: 1446413 - protein, 98 aa, Mycobacterium tuberculosis
LGQPGGNGGQGDAGQAGGAGGAGGAGGAGGSVSGDGGAGGNGGAGGNGGVGASGGAGARGANGIDSIGGTGGAGGGGGDGGAGGVDGHGGDGGVGGAG

SEQ ID NO: 1446414 - protein, 15 aa, Mycobacterium tuberculosis
LGQSGQRPGRRHVPA

SEQ ID NO: 1446415 - protein, 35 aa, Mycobacterium tuberculosis
LGRAGTAGGDRRGPVGGIGGAGGVGGAGGAAGAVT

SEQ ID NO: 1446416 - protein, 13 aa, Mycobacterium tuberculosis
LGRASGSTRCARG

SEQ ID NO: 1446417 - protein, 6 aa, Mycobacterium tuberculosis
LGRDGV

SEQ ID NO: 1446418 - protein, 48 aa, Mycobacterium tuberculosis
LGRGGAGGAGNHHRRAARHQSARGQQPAAGTDADRDHHREPSGQEHWR

SEQ ID NO: 1446419 - protein, 48 aa, Mycobacterium tuberculosis
LGRGGAGGAGNHHRRAARHQSARGQQPAAGTDADRDHHREPSGQQHWR

SEQ ID NO: 1446420 - protein, 16 aa, Mycobacterium tuberculosis
LGRNGNAGHLGHVVVD

SEQ ID NO: 1446421 - protein, 16 aa, Mycobacterium tuberculosis
LGRRDRASQTERRADA

SEQ ID NO: 1446422 - protein, 6 aa, Mycobacterium tuberculosis
LGRRTR

SEQ ID NO: 1446423 - protein, 4 aa, Mycobacterium tuberculosis
LGRS

SEQ ID NO: 1446424 - protein, 19 aa, Mycobacterium tuberculosis
LGRSDPGRRWRCRTGPAAL

SEQ ID NO: 1446425 - protein, 12 aa, Mycobacterium tuberculosis
LGRSEGAPAVRG

SEQ ID NO: 1446426 - protein, 5 aa, Mycobacterium tuberculosis
LGRSG

SEQ ID NO: 1446427 - protein, 6 aa, Mycobacterium tuberculosis
LGRTQA

SEQ ID NO: 1446428 - protein, 6 aa, Mycobacterium tuberculosis
LGSDNA

SEQ ID NO: 1446429 - protein, 18 aa, Mycobacterium tuberculosis
LGSEQTAAAEGQVGNVRR

SEQ ID NO: 1446430 - protein, 11 aa, Mycobacterium tuberculosis
LGSGGANAAHR

SEQ ID NO: 1446431 - protein, 42 aa, Mycobacterium tuberculosis
LGSGGSGGTGGDGGNGGLGAGSGAKGNGGNGGDGGKGGDAQL

SEQ ID NO: 1446432 - protein, 28 aa, Mycobacterium tuberculosis
LGSGNTGDTNVGSGNIGNTNLGSGNYGS

SEQ ID NO: 1446433 - protein, 11 aa, Mycobacterium tuberculosis
LGSSDVAKPRG

SEQ ID NO: 1446434 - protein, 11 aa, Mycobacterium tuberculosis
LGSSLGSSGLG

SEQ ID NO: 1446435 - protein, 13 aa, Mycobacterium tuberculosis
LGSSLGSSGLGGG

SEQ ID NO: 1446436 - protein, 9 aa, Mycobacterium tuberculosis
LGSTATELA

SEQ ID NO: 1446437 - protein, 8 aa, Mycobacterium tuberculosis
LGTPARQA

SEQ ID NO: 1446438 - protein, 4 aa, Mycobacterium tuberculosis
LGTT

SEQ ID NO: 1446439 - protein, 6 aa, Mycobacterium tuberculosis
LGVGTP

SEQ ID NO: 1446440 - protein, 8 aa, Mycobacterium tuberculosis
LGVPPNPV

SEQ ID NO: 1446441 - protein, 5 aa, Mycobacterium tuberculosis
LGYGT

SEQ ID NO: 1446442 - protein, 14 aa, Mycobacterium tuberculosis
LHAQKGAAGVLLER

SEQ ID NO: 1446443 - protein, 5 aa, Mycobacterium tuberculosis
LHGTG

SEQ ID NO: 1446444 - protein, 30 aa, Mycobacterium tuberculosis
LHPGRQTRRLPTGDRSRNSARRRHNHRRLP

SEQ ID NO: 1446445 - protein, 11 aa, Mycobacterium tuberculosis
LHQSQRSSGRL

SEQ ID NO: 1446446 - protein, 24 aa, Mycobacterium tuberculosis
LIGNGGAGGAGGPGANGGAGGNGG

SEQ ID NO: 1446447 - protein, 15 aa, Mycobacterium tuberculosis
LIGSSSGDTAAASAA

SEQ ID NO: 1446448 - protein, 15 aa, Mycobacterium tuberculosis
LKAAPPSPPAPPLPH

SEQ ID NO: 1446449 - protein, 9 aa, Mycobacterium tuberculosis
LKDPRGNPV

SEQ ID NO: 1446450 - protein, 11 aa, Mycobacterium tuberculosis
LKDSGKTISDT

SEQ ID NO: 1446451 - protein, 7 aa, Mycobacterium tuberculosis
LKEPERN

SEQ ID NO: 1446452 - protein, 7 aa, Mycobacterium tuberculosis
LKEPRES

SEQ ID NO: 1446453 - protein, 7 aa, Mycobacterium tuberculosis
LKESQEF

SEQ ID NO: 1446454 - protein, 10 aa, Mycobacterium tuberculosis
LKGDKGEPCW

SEQ ID NO: 1446455 - protein, 13 aa, Mycobacterium tuberculosis
LKGRTAAPQHRGA

SEQ ID NO: 1446456 - protein, 5 aa, Mycobacterium tuberculosis
LKGVT

SEQ ID NO: 1446457 - protein, 6 aa, Mycobacterium tuberculosis
LKPARR

SEQ ID NO: 1446458 - protein, 10 aa, Mycobacterium tuberculosis
LKPGRSHDEV

SEQ ID NO: 1446459 - protein, 10 aa, Mycobacterium tuberculosis
LKRSKGQKLP

SEQ ID NO: 1446460 - protein, 9 aa, Mycobacterium tuberculosis
LKSASPALK

SEQ ID NO: 1446461 - protein, 14 aa, Mycobacterium tuberculosis
LKSGTVNLEVVDVG

SEQ ID NO: 1446462 - protein, 15 aa, Mycobacterium tuberculosis
LKTSHRATSHSPEQP

SEQ ID NO: 1446463 - protein, 9 aa, Mycobacterium tuberculosis
LLGGDGGDI

SEQ ID NO: 1446464 - protein, 13 aa, Mycobacterium tuberculosis
LLGSPGQGAYAAA

SEQ ID NO: 1446465 - protein, 12 aa, Mycobacterium tuberculosis
LMPGSGLARDYP

SEQ ID NO: 1446466 - protein, 9 aa, Mycobacterium tuberculosis
LNADKTVEQ

SEQ ID NO: 1446467 - protein, 7 aa, Mycobacterium tuberculosis
LNAPTQA

SEQ ID NO: 1446468 - protein, 6 aa, Mycobacterium tuberculosis
LNDGTS

SEQ ID NO: 1446469 - protein, 6 aa, Mycobacterium tuberculosis
LNGDGE

SEQ ID NO: 1446470 - protein, 42 aa, Mycobacterium tuberculosis
LNGGKGDTGSGGGAGDGGKAPAGGTGGAGGDGGAGGKGGSGG

SEQ ID NO: 1446471 - protein, 68 aa, Mycobacterium tuberculosis
LNGGNGGNGGIGGNGGSAAGTGGDGGKGGNGGAGANGQDFSASANGANGGQGGNGGNGGIGGKGGDAF

SEQ ID NO: 1446472 - protein, 40 aa, Mycobacterium tuberculosis
LNGGNGGNGGIGGNGGSAAGTGGDGGKGGNGGAGPNGQDF

SEQ ID NO: 1446473 - protein, 4 aa, Mycobacterium tuberculosis
LNGL

SEQ ID NO: 1446474 - protein, 12 aa, Mycobacterium tuberculosis
LNGRTAAPSTEA

SEQ ID NO: 1446475 - protein, 62 aa, Mycobacterium tuberculosis
LNGSAGANGTAPTSGGNGGNGGAGATPTVAGENGGAGGNGGHGGSVGNGGAGGAGGNGVAGT

SEQ ID NO: 1446476 - protein, 6 aa, Mycobacterium tuberculosis
LNNPKL

SEQ ID NO: 1446477 - protein, 12 aa, Mycobacterium tuberculosis
LNQGQGASGVGQ

SEQ ID NO: 1446478 - protein, 7 aa, Mycobacterium tuberculosis
LNRPGLR

SEQ ID NO: 1446479 - protein, 17 aa, Mycobacterium tuberculosis
LNSGGGQHVGISNSGNR

SEQ ID NO: 1446480 - protein, 17 aa, Mycobacterium tuberculosis
LNSGNNNIGFGNSGNNN

SEQ ID NO: 1446481 - protein, 17 aa, Mycobacterium tuberculosis
LNSGSGNIGFSNSGTGN

SEQ ID NO: 1446482 - protein, 8 aa, Mycobacterium tuberculosis
LNSGSPQY

SEQ ID NO: 1446483 - protein, 10 aa, Mycobacterium tuberculosis
LNTPADNDHQ

SEQ ID NO: 1446484 - protein, 9 aa, Mycobacterium tuberculosis
LNVNGSSLA

SEQ ID NO: 1446485 - protein, 14 aa, Mycobacterium tuberculosis
LPAGAASLDAGDFA

SEQ ID NO: 1446486 - protein, 26 aa, Mycobacterium tuberculosis
LPAGGKTVGGHRGRRHPGQGGGQERH

SEQ ID NO: 1446487 - protein, 11 aa, Mycobacterium tuberculosis
LPAGPAVAGSV

SEQ ID NO: 1446488 - protein, 5 aa, Mycobacterium tuberculosis
LPAGQ

SEQ ID NO: 1446489 - protein, 20 aa, Mycobacterium tuberculosis
LPAPDEATAAATSTETSTYP

SEQ ID NO: 1446490 - protein, 8 aa, Mycobacterium tuberculosis
LPAPKSCP

SEQ ID NO: 1446491 - protein, 23 aa, Mycobacterium tuberculosis
LPAPTLPKPDTPPAPELKNPDDG

SEQ ID NO: 1446492 - protein, 17 aa, Mycobacterium tuberculosis
LPASKPGLDAGAHDRLE

SEQ ID NO: 1446493 - protein, 6 aa, Mycobacterium tuberculosis
LPCPED

SEQ ID NO: 1446494 - protein, 9 aa, Mycobacterium tuberculosis
LPDDPDGNR

SEQ ID NO: 1446495 - protein, 6 aa, Mycobacterium tuberculosis
LPDETV

SEQ ID NO: 1446496 - protein, 4 aa, Mycobacterium tuberculosis
LPDP

SEQ ID NO: 1446497 - protein, 6 aa, Mycobacterium tuberculosis
LPDSAQ

SEQ ID NO: 1446498 - protein, 12 aa, Mycobacterium tuberculosis
LPEDVNAPSGET

SEQ ID NO: 1446499 - protein, 7 aa, Mycobacterium tuberculosis
LPEEPER

SEQ ID NO: 1446500 - protein, 8 aa, Mycobacterium tuberculosis
LPEERSRE

SEQ ID NO: 1446501 - protein, 6 aa, Mycobacterium tuberculosis
LPEGKT

SEQ ID NO: 1446502 - protein, 6 aa, Mycobacterium tuberculosis
LPEPPR

SEQ ID NO: 1446503 - protein, 19 aa, Mycobacterium tuberculosis
LPERGQPGGARHGRGNGHD

SEQ ID NO: 1446504 - protein, 16 aa, Mycobacterium tuberculosis
LPESRGEVADRRRRLP

SEQ ID NO: 1446505 - protein, 4 aa, Mycobacterium tuberculosis
LPEV

SEQ ID NO: 1446506 - protein, 6 aa, Mycobacterium tuberculosis
LPGAAR

SEQ ID NO: 1446507 - protein, 7 aa, Mycobacterium tuberculosis
LPGAGDA

SEQ ID NO: 1446508 - protein, 23 aa, Mycobacterium tuberculosis
LPGAGTQSGGADAGRPDHRRCRA

SEQ ID NO: 1446509 - protein, 11 aa, Mycobacterium tuberculosis
LPGARDQLRGT

SEQ ID NO: 1446510 - protein, 6 aa, Mycobacterium tuberculosis
LPGART

SEQ ID NO: 1446511 - protein, 8 aa, Mycobacterium tuberculosis
LPGDRPAV

SEQ ID NO: 1446512 - protein, 6 aa, Mycobacterium tuberculosis
LPGFPG

SEQ ID NO: 1446513 - protein, 38 aa, Mycobacterium tuberculosis
LPGGGTVGKPPVPGGKRRQTAATPGVGRPRKAKARPRL

SEQ ID NO: 1446514 - protein, 98 aa, Mycobacterium tuberculosis; identical to SEQ ID NO: 194470

SEQ ID NO: 1446515 - protein, 11 aa, Mycobacterium tuberculosis
LPGGRGYAPGW

SEQ ID NO: 1446516 - protein, 22 aa, Mycobacterium tuberculosis
LPGLNGSGIHGGDGGNGAPGGV

SEQ ID NO: 1446517 - protein, 21 aa, Mycobacterium tuberculosis
LPGPAGRSKPIEPSPDLPTSR

SEQ ID NO: 1446518 - protein, 31 aa, Mycobacterium tuberculosis
LPGPAGRSKPIEPSPYLPSSDASSTLSTFGW

SEQ ID NO: 1446519 - protein, 17 aa, Mycobacterium tuberculosis
LPGRDDIGDQDQRRRAG

SEQ ID NO: 1446520 - protein, 6 aa, Mycobacterium tuberculosis
LPGRRG

SEQ ID NO: 1446521 - protein, 13 aa, Mycobacterium tuberculosis
LPGSAPDRGSTVT

SEQ ID NO: 1446522 - protein, 6 aa, Mycobacterium tuberculosis
LPGSGC

SEQ ID NO: 1446523 - protein, 14 aa, Mycobacterium tuberculosis
LPGSGQKSGNGGAA

SEQ ID NO: 1446524 - protein, 8 aa, Mycobacterium tuberculosis
LPGTDRRN

SEQ ID NO: 1446525 - protein, 7 aa, Mycobacterium tuberculosis
LPIEQES

SEQ ID NO: 1446526 - protein, 8 aa, Mycobacterium tuberculosis
LPKAARSA

SEQ ID NO: 1446527 - protein, 9 aa, Mycobacterium tuberculosis
LPKDASPAY

SEQ ID NO: 1446528 - protein, 14 aa, Mycobacterium tuberculosis
LPKDPRSSVTRTAT

SEQ ID NO: 1446529 - protein, 8 aa, Mycobacterium tuberculosis
LPLPPRRR

SEQ ID NO: 1446530 - protein, 9 aa, Mycobacterium tuberculosis
LPNGASASI

SEQ ID NO: 1446531 - protein, 15 aa, Mycobacterium tuberculosis
LPNPTAPALASGPAA

SEQ ID NO: 1446532 - protein, 5 aa, Mycobacterium tuberculosis
LPNQK

SEQ ID NO: 1446533 - protein, 6 aa, Mycobacterium tuberculosis
LPPAAN

SEQ ID NO: 1446534 - protein, 44 aa, Mycobacterium tuberculosis
LPPAGKALPAPAGTAGPAGTAATRACSSAPAAPAAPAGSAAPPA

SEQ ID NO: 1446535 - protein, 11 aa, Mycobacterium tuberculosis
LPPAPAAPPLP

SEQ ID NO: 1446536 - protein, 32 aa, Mycobacterium tuberculosis
LPPAPAGRHRSPPAPPVPPAPPPPLLADAITR

SEQ ID NO: 1446537 - protein, 19 aa, Mycobacterium tuberculosis
LPPAPPAPPAPPENPVPPV

SEQ ID NO: 1446538 - protein, 51 aa, Mycobacterium tuberculosis
LPPAPPAPPGAPGATGTAVATGTAGAAVAGQQAATAAVTADATAAASAARR

SEQ ID NO: 1446539 - protein, 47 aa, Mycobacterium tuberculosis
LPPAPPAPPTPESNNGTVVSPPLPPAPPAPPLPYSRPALPPAPPAPA

SEQ ID NO: 1446540 - protein, 19 aa, Mycobacterium tuberculosis
LPPAPPSPPAPPANPAPPV

SEQ ID NO: 1446541 - protein, 22 aa, Mycobacterium tuberculosis
LPPAPPSPPIATAAPPLPPTPP

SEQ ID NO: 1446542 - protein, 93 aa, Mycobacterium tuberculosis
LPPAPPTPPSTPPVAPSPPSPPVATPPALPSVSPMPPAPPAPPAPPSVPAVPPAPPLPPVPSLPSSDSPSPPCPPTPPASPTPPAGPGPPFPP

SEQ ID NO: 1446543 - protein, 14 aa, Mycobacterium tuberculosis
LPPASRRKIAHFLD

SEQ ID NO: 1446544 - protein, 19 aa, Mycobacterium tuberculosis
LPPCPPAPPPPPAPPMTPL

SEQ ID NO: 1446545 - protein, 6 aa, Mycobacterium tuberculosis
LPPDAI

SEQ ID NO: 1446546 - protein, 6 aa, Mycobacterium tuberculosis
LPPDAP

SEQ ID NO: 1446547 - protein, 5 aa, Mycobacterium tuberculosis
LPPDN

SEQ ID NO: 1446548 - protein, 8 aa, Mycobacterium tuberculosis
LPPGIPQV

SEQ ID NO: 1446549 - protein, 33 aa, Mycobacterium tuberculosis
LPPGRPGAVHREGAGEGRHEDRRHRHRRDQRGV

SEQ ID NO: 1446550 - protein, 25 aa, Mycobacterium tuberculosis
LPPIDEPDTYYRSPAGGAYGPDGDG

SEQ ID NO: 1446551 - protein, 12 aa, Mycobacterium tuberculosis
LPPISPPGFPSL

SEQ ID NO: 1446552 - protein, 30 aa, Mycobacterium tuberculosis
LPPLPPGVAPAPPAPASPPFPPLPQLQTVG

SEQ ID NO: 1446553 - protein, 14 aa, Mycobacterium tuberculosis
LPPLPPTPSPPLSN

SEQ ID NO: 1446554 - protein, 4 aa, Mycobacterium tuberculosis
LPPM

SEQ ID NO: 1446555 - protein, 7 aa, Mycobacterium tuberculosis
LPPNPDT

SEQ ID NO: 1446556 - protein, 9 aa, Mycobacterium tuberculosis
LPPPAPQPA

SEQ ID NO: 1446557 - protein, 20 aa, Mycobacterium tuberculosis
LPPPGGQTGGDANPGHRPGH

SEQ ID NO: 1446558 - protein, 15 aa, Mycobacterium tuberculosis
LPPPGRDGSGSAEQL

SEQ ID NO: 1446559 - protein, 15 aa, Mycobacterium tuberculosis
LPPPPPQPGIDCRAA

SEQ ID NO: 1446560 - protein, 15 aa, Mycobacterium tuberculosis
LPPTRDNPAAPEPSM

SEQ ID NO: 1446561 - protein, 17 aa, Mycobacterium tuberculosis
LPPTSSGFARPTAGPAG

SEQ ID NO: 1446562 - protein, 18 aa, Mycobacterium tuberculosis
LPPWPPGPPFPPLAAPWP

SEQ ID NO: 1446563 - protein, 13 aa, Mycobacterium tuberculosis
LPQRQDTSRRAAQ

SEQ ID NO: 1446564 - protein, 9 aa, Mycobacterium tuberculosis
LPRAVTPRT

SEQ ID NO: 1446565 - protein, 6 aa, Mycobacterium tuberculosis
LPRDAK

SEQ ID NO: 1446566 - protein, 4 aa, Mycobacterium tuberculosis
LPRH

SEQ ID NO: 1446567 - protein, 11 aa, Mycobacterium tuberculosis
LPRPKRDYGRL

SEQ ID NO: 1446568 - protein, 6 aa, Mycobacterium tuberculosis
LPRRNS

SEQ ID NO: 1446569 - protein, 15 aa, Mycobacterium tuberculosis
LPRRQEQRGHTALER

SEQ ID NO: 1446570 - protein, 9 aa, Mycobacterium tuberculosis
LPRTGNQNA

SEQ ID NO: 1446571 - protein, 8 aa, Mycobacterium tuberculosis
LPSPNRQI

SEQ ID NO: 1446572 - protein, 13 aa, Mycobacterium tuberculosis
LPSPPAPPPPPGP

SEQ ID NO: 1446573 - protein, 84 aa, Mycobacterium tuberculosis
LPSPPRPAGPTPGEPATPGSPPPPPLPPLPAAPPSPELPETPNRPPAPPAPPAPPSPPAPPSPPIPPLPPSPASPPTPGCPGAA

SEQ ID NO: 1446574 - protein, 14 aa, Mycobacterium tuberculosis
LPSRGSRAYPPRPL

SEQ ID NO: 1446575 - protein, 7 aa, Mycobacterium tuberculosis
LPSTATH

SEQ ID NO: 1446576 - protein, 10 aa, Mycobacterium tuberculosis
LPTAPPVPPV

SEQ ID NO: 1446577 - protein, 8 aa, Mycobacterium tuberculosis
LPTAPTSF

SEQ ID NO: 1446578 - protein, 5 aa, Mycobacterium tuberculosis
LPTDD

SEQ ID NO: 1446579 - protein, 10 aa, Mycobacterium tuberculosis
LPTNEQRDRA

SEQ ID NO: 1446580 - protein, 6 aa, Mycobacterium tuberculosis
LPTSAN

SEQ ID NO: 1446581 - protein, 11 aa, Mycobacterium tuberculosis
LPTSSPPESWP

SEQ ID NO: 1446582 - protein, 4 aa, Mycobacterium tuberculosis
LPVG

SEQ ID NO: 1446583 - protein, 9 aa, Mycobacterium tuberculosis
LPVSDRGAC

SEQ ID NO: 1446584 - protein, 4 aa, Mycobacterium tuberculosis
LQAP

SEQ ID NO: 1446585 - protein, 12 aa, Mycobacterium tuberculosis
LQATQQECEKRL

SEQ ID NO: 1446586 - protein, 11 aa, Mycobacterium tuberculosis
LQEIPEPPGFG

SEQ ID NO: 1446587 - protein, 21 aa, Mycobacterium tuberculosis
LQGRRAAGTGARRVAVVRLPR

SEQ ID NO: 1446588 - protein, 5 aa, Mycobacterium tuberculosis
LQNGA

SEQ ID NO: 1446589 - protein, 8 aa, Mycobacterium tuberculosis
LQPEHPGG

SEQ ID NO: 1446590 - protein, 5 aa, Mycobacterium tuberculosis
LQPGK

SEQ ID NO: 1446591 - protein, 9 aa, Mycobacterium tuberculosis
LQPPAPHRP

SEQ ID NO: 1446592 - protein, 7 aa, Mycobacterium tuberculosis
LQPQAAP

SEQ ID NO: 1446593 - protein, 12 aa, Mycobacterium tuberculosis
LQPTGGASGLSA

SEQ ID NO: 1446594 - protein, 14 aa, Mycobacterium tuberculosis
LQQAQQPQTGRTGD

SEQ ID NO: 1446595 - protein, 11 aa, Mycobacterium tuberculosis
LQRRDSPSGYY

SEQ ID NO: 1446596 - protein, 20 aa, Mycobacterium tuberculosis
LQSAATRRPGARQRQDHPGA

SEQ ID NO: 1446597 - protein, 11 aa, Mycobacterium tuberculosis
LQSGSQEDETA

SEQ ID NO: 1446598 - protein, 6 aa, Mycobacterium tuberculosis
LQTPKG

SEQ ID NO: 1446599 - protein, 48 aa, Mycobacterium tuberculosis
LRADRGVQEGAGKSRDGDHRHRPGRDQRGLRGAGPGLGARAGHRRGQA

SEQ ID NO: 1446600 - protein, 8 aa, Mycobacterium tuberculosis
LRAEREQG

SEQ ID NO: 1446601 - protein, 5 aa, Mycobacterium tuberculosis
LRAES

SEQ ID NO: 1446602 - protein, 39 aa, Mycobacterium tuberculosis
LRDGGQLGAAAARRRRRRRAGANGDRRGPGQSRHHPGGS

SEQ ID NO: 1446603 - protein, 13 aa, Mycobacterium tuberculosis
LRDPRPSRVRLRT

SEQ ID NO: 1446604 - protein, 15 aa, Mycobacterium tuberculosis
LRDTNGDPVTARGAE

SEQ ID NO: 1446605 - protein, 4 aa, Mycobacterium tuberculosis
LREG

SEQ ID NO: 1446606 - protein, 24 aa, Mycobacterium tuberculosis
LREHAGGRRVGDRRGLGCRACGSR

SEQ ID NO: 1446607 - protein, 14 aa, Mycobacterium tuberculosis
LREPPEADTNVPGP

SEQ ID NO: 1446608 - protein, 12 aa, Mycobacterium tuberculosis
LREPPPQQVQRP

SEQ ID NO: 1446609 - protein, 17 aa, Mycobacterium tuberculosis
LRERDRRNGGAGGADEH

SEQ ID NO: 1446610 - protein, 14 aa, Mycobacterium tuberculosis
LREREHPQHRLGER

SEQ ID NO: 1446611 - protein, 5 aa, Mycobacterium tuberculosis
LRGDN

SEQ ID NO: 1446612 - protein, 24 aa, Mycobacterium tuberculosis
LRGGGGQYGGAHRPVSAPAGQGVG

SEQ ID NO: 1446613 - protein, 5 aa, Mycobacterium tuberculosis
LRGHP

SEQ ID NO: 1446614 - protein, 8 aa, Mycobacterium tuberculosis
LRGHRGAN

SEQ ID NO: 1446615 - protein, 11 aa, Mycobacterium tuberculosis
LRGKGRLTDAD

SEQ ID NO: 1446616 - protein, 12 aa, Mycobacterium tuberculosis
LRGPASGAITTC

SEQ ID NO: 1446617 - protein, 5 aa, Mycobacterium tuberculosis
LRGPG

SEQ ID NO: 1446618 - protein, 12 aa, Mycobacterium tuberculosis
LRGQGHTPLLVA

SEQ ID NO: 1446619 - protein, 33 aa, Mycobacterium tuberculosis
LRGRPERGGTARPTNRRRPAGRDRGAHRRGRWP

SEQ ID NO: 1446620 - protein, 27 aa, Mycobacterium tuberculosis
LRGTGQSPRHPPADRGPASAPGARADL

SEQ ID NO: 1446621 - protein, 6 aa, Mycobacterium tuberculosis
LRHPGH

SEQ ID NO: 1446622 - protein, 11 aa, Mycobacterium tuberculosis
LRKPTKSPNQL

SEQ ID NO: 1446623 - protein, 56 aa, Mycobacterium tuberculosis
LRNAAKAYGEVDEEAATALDNDGEGTVQAESAGAVGGDSSAELTDTPRVATTGEPN

SEQ ID NO: 1446624 - protein, 5 aa, Mycobacterium tuberculosis
LRNGE

SEQ ID NO: 1446625 - protein, 7 aa, Mycobacterium tuberculosis
LRPAGAD

SEQ ID NO: 1446626 - protein, 6 aa, Mycobacterium tuberculosis
LRPAHG

SEQ ID NO: 1446627 - protein, 7 aa, Mycobacterium tuberculosis
LRPASRR

SEQ ID NO: 1446628 - protein, 23 aa, Mycobacterium tuberculosis
LRPATTASTGHHPDTRRSAIGTT

SEQ ID NO: 1446629 - protein, 14 aa, Mycobacterium tuberculosis
LRPDPESTAQPAWS

SEQ ID NO: 1446630 - protein, 12 aa, Mycobacterium tuberculosis
LRPDRCEGVDLQ

SEQ ID NO: 1446631 - protein, 22 aa, Mycobacterium tuberculosis
LRPGASPGSMPPRPGGTVVGAR

SEQ ID NO: 1446632 - protein, 6 aa, Mycobacterium tuberculosis
LRPGDR

SEQ ID NO: 1446633 - protein, 4 aa, Mycobacterium tuberculosis
LRPP

SEQ ID NO: 1446634 - protein, 21 aa, Mycobacterium tuberculosis
LRPPAGAGHPRRRTTVNALRS

SEQ ID NO: 1446635 - protein, 8 aa, Mycobacterium tuberculosis
LRPPERAQ

SEQ ID NO: 1446636 - protein, 11 aa, Mycobacterium tuberculosis
LRPRHRDGHRR

SEQ ID NO: 1446637 - protein, 23 aa, Mycobacterium tuberculosis
LRPRRRDGRRRAAGAGAAGPGVR

SEQ ID NO: 1446638 - protein, 12 aa, Mycobacterium tuberculosis
LRQPTGRRGAGR

SEQ ID NO: 1446639 - protein, 26 aa, Mycobacterium tuberculosis
LRQRDRHGRAGALRGDTGQRQASGRP

SEQ ID NO: 1446640 - protein, 6 aa, Mycobacterium tuberculosis
LRQTAQ

SEQ ID NO: 1446641 - protein, 17 aa, Mycobacterium tuberculosis
LRRDGEQHCAEREADED

SEQ ID NO: 1446642 - protein, 10 aa, Mycobacterium tuberculosis
LRRGDTPGEV

SEQ ID NO: 1446643 - protein, 11 aa, Mycobacterium tuberculosis
LRRGKDRRKVH

SEQ ID NO: 1446644 - protein, 8 aa, Mycobacterium tuberculosis
LRRGPTSW

SEQ ID NO: 1446645 - protein, 125 aa, Mycobacterium tuberculosis
LRRGRPAASPRPARSSRPRRVPATPDASRRPRRGCRGAAGAARDHARPTRARKRPARPGSRRTRRSGRRGRAGRRRPTPRWGPGPPPVPSTPTASDRFARPGAGRAGSAPASPAAPIATTATAKR

SEQ ID NO: 1446646 - protein, 20 aa, Mycobacterium tuberculosis
LRRPGPPGDHRPPQRAQRHR

SEQ ID NO: 1446647 - protein, 9 aa, Mycobacterium tuberculosis
LRSGGDDEL

SEQ ID NO: 1446648 - protein, 14 aa, Mycobacterium tuberculosis
LRSGVGSPTVFATS

SEQ ID NO: 1446649 - protein, 11 aa, Mycobacterium tuberculosis
LRSQSDGSHPE

SEQ ID NO: 1446650 - protein, 4 aa, Mycobacterium tuberculosis
LRSS

SEQ ID NO: 1446651 - protein, 8 aa, Mycobacterium tuberculosis
LRSSGIRS

SEQ ID NO: 1446652 - protein, 6 aa, Mycobacterium tuberculosis
LRSSPP

SEQ ID NO: 1446653 - protein, 5 aa, Mycobacterium tuberculosis
LRSTQ

SEQ ID NO: 1446654 - protein, 16 aa, Mycobacterium tuberculosis
LRTAAENGRLAADAPA

SEQ ID NO: 1446655 - protein, 12 aa, Mycobacterium tuberculosis
LRTPDGPTGFPP

SEQ ID NO: 1446656 - protein, 4 aa, Mycobacterium tuberculosis
LRTQ

SEQ ID NO: 1446657 - protein, 7 aa, Mycobacterium tuberculosis
LRTRKAG

SEQ ID NO: 1446658 - protein, 13 aa, Mycobacterium tuberculosis
LRTSGARRLAGRA

SEQ ID NO: 1446659 - protein, 4 aa, Mycobacterium tuberculosis
LRYP

SEQ ID NO: 1446660 - protein, 21 aa, Mycobacterium tuberculosis
LSAAAAPEEQIQPQLRGDPKI

SEQ ID NO: 1446661 - protein, 11 aa, Mycobacterium tuberculosis
LSAAATAGASH

SEQ ID NO: 1446662 - protein, 18 aa, Mycobacterium tuberculosis
LSAASGEHRAGQTQRCPR

SEQ ID NO: 1446663 - protein, 8 aa, Mycobacterium tuberculosis
LSADGSTV

SEQ ID NO: 1446664 - protein, 7 aa, Mycobacterium tuberculosis
LSAGQSW

SEQ ID NO: 1446665 - protein, 17 aa, Mycobacterium tuberculosis
LSAPPREQTQNRTAPAR

SEQ ID NO: 1446666 - protein, 17 aa, Mycobacterium tuberculosis
LSASASWAANGKITSDD

SEQ ID NO: 1446667 - protein, 19 aa, Mycobacterium tuberculosis
LSDDHTPAADNTEPGPGPL

SEQ ID NO: 1446668 - protein, 9 aa, Mycobacterium tuberculosis
LSDFDEDEL

SEQ ID NO: 1446669 - protein, 17 aa, Mycobacterium tuberculosis
LSDGRADTFPTVNPATE

SEQ ID NO: 1446670 - protein, 9 aa, Mycobacterium tuberculosis
LSDPGGVRN

SEQ ID NO: 1446671 - protein, 13 aa, Mycobacterium tuberculosis
LSEDGKGGPPNNG

SEQ ID NO: 1446672 - protein, 7 aa, Mycobacterium tuberculosis
LSEERKV

SEQ ID NO: 1446673 - protein, 10 aa, Mycobacterium tuberculosis
LSGAARPVEG

SEQ ID NO: 1446674 - protein, 12 aa, Mycobacterium tuberculosis
LSGARTTGARLD

SEQ ID NO: 1446675 - protein, 22 aa, Mycobacterium tuberculosis
LSGDRRVAGRPVTEGKTLEQLV

SEQ ID NO: 1446676 - protein, 5 aa, Mycobacterium tuberculosis
LSGFS

SEQ ID NO: 1446677 - protein, 59 aa, Mycobacterium tuberculosis
LSGGAADGRGHPNRDGVAPASRRSGRSGIAAPGQPAARPAECPARGGGPHRTASRGQAV

SEQ ID NO: 1446678 - protein, 8 aa, Mycobacterium tuberculosis
LSGGEQQR

SEQ ID NO: 1446679 - protein, 6 aa, Mycobacterium tuberculosis
LSGGGT

SEQ ID NO: 1446680 - protein, 9 aa, Mycobacterium tuberculosis
LSGGRIDRD

SEQ ID NO: 1446681 - protein, 25 aa, Mycobacterium tuberculosis
LSGGSYQNLETSASPDLATAVNIFL

SEQ ID NO: 1446682 - protein, 27 aa, Mycobacterium tuberculosis
LSGNAGAGGHGGAGGSSTAATTTGTPL

SEQ ID NO: 1446683 - protein, 30 aa, Mycobacterium tuberculosis
LSGNGGAGGSGGSAGSGGAGGKGGDTPNGL

SEQ ID NO: 1446684 - protein, 13 aa, Mycobacterium tuberculosis
LSGNTANALRWIS

SEQ ID NO: 1446685 - protein, 25 aa, Mycobacterium tuberculosis
LSGPSNVGVEEEDTDAVDTTPTPVV

SEQ ID NO: 1446686 - protein, 39 aa, Mycobacterium tuberculosis
LSGPVGDSGNGGAGGDVGAGVSATDIAGTGGRGGNGGHG

SEQ ID NO: 1446687 - protein, 18 aa, Mycobacterium tuberculosis
LSGQAADPFKIPPGTASG

SEQ ID NO: 1446688 - protein, 6 aa, Mycobacterium tuberculosis
LSGSNR

SEQ ID NO: 1446689 - protein, 14 aa, Mycobacterium tuberculosis
LSGTPRGQSPQDHD

SEQ ID NO: 1446690 - protein, 13 aa, Mycobacterium tuberculosis
LSGTTAASPQDHD

SEQ ID NO: 1446691 - protein, 14 aa, Mycobacterium tuberculosis
LSGTTPRQSPQDHD

SEQ ID NO: 1446692 - protein, 14 aa, Mycobacterium tuberculosis
LSGTTRGKARRTTI

SEQ ID NO: 1446693 - protein, 23 aa, Mycobacterium tuberculosis
LSGTTRGKARRTTIADPATARPA

SEQ ID NO: 1446694 - protein, 5 aa, Mycobacterium tuberculosis
LSKQP

SEQ ID NO: 1446695 - protein, 6 aa, Mycobacterium tuberculosis
LSKSQV

SEQ ID NO: 1446696 - protein, 9 aa, Mycobacterium tuberculosis
LSKSSLHPA

SEQ ID NO: 1446697 - protein, 8 aa, Mycobacterium tuberculosis
LSMGSSAQ

SEQ ID NO: 1446698 - protein, 9 aa, Mycobacterium tuberculosis
LSNATPREV

SEQ ID NO: 1446699 - protein, 5 aa, Mycobacterium tuberculosis
LSNKD

SEQ ID NO: 1446700 - protein, 17 aa, Mycobacterium tuberculosis
LSNTGASGGAGGAGGAA

SEQ ID NO: 1446701 - protein, 18 aa, Mycobacterium tuberculosis
LSPAPSPRPPATSTEGVS

SEQ ID NO: 1446702 - protein, 6 aa, Mycobacterium tuberculosis
LSPDAP

SEQ ID NO: 1446703 - protein, 16 aa, Mycobacterium tuberculosis
LSPEQARGDSVDARSD

SEQ ID NO: 1446704 - protein, 6 aa, Mycobacterium tuberculosis
LSPGSS

SEQ ID NO: 1446705 - protein, 14 aa, Mycobacterium tuberculosis
LSPPAPPAPPAPPL

SEQ ID NO: 1446706 - protein, 31 aa, Mycobacterium tuberculosis
LSPPSQTTNPGAGWPPSPPRSARLPPPLPST

SEQ ID NO: 1446707 - protein, 29 aa, Mycobacterium tuberculosis
LSPPSQTTNPGGLASQSAAVGSAAATAAV

SEQ ID NO: 1446708 - protein, 11 aa, Mycobacterium tuberculosis
LSPTFSNTNPH

SEQ ID NO: 1446709 - protein, 9 aa, Mycobacterium tuberculosis
LSQNADKVE

SEQ ID NO: 1446710 - protein, 8 aa, Mycobacterium tuberculosis
LSQTGGSS

SEQ ID NO: 1446711 - protein, 9 aa, Mycobacterium tuberculosis
LSRAPETYL

SEQ ID NO: 1446712 - protein, 19 aa, Mycobacterium tuberculosis
LSRARGAAAEALTGYREPK

SEQ ID NO: 1446713 - protein, 9 aa, Mycobacterium tuberculosis
LSREPPPVD

SEQ ID NO: 1446714 - protein, 4 aa, Mycobacterium tuberculosis
LSRP

SEQ ID NO: 1446715 - protein, 23 aa, Mycobacterium tuberculosis
LSRPLSSSSYNRRYTLNATSAWT

SEQ ID NO: 1446716 - protein, 6 aa, Mycobacterium tuberculosis
LSRRGR

SEQ ID NO: 1446717 - protein, 12 aa, Mycobacterium tuberculosis
LSRSRRNHPRHH

SEQ ID NO: 1446718 - protein, 22 aa, Mycobacterium tuberculosis
LSRSRRNHPRHHRRPRPAAPGA

SEQ ID NO: 1446719 - protein, 11 aa, Mycobacterium tuberculosis
LSRSRTSSTSW

SEQ ID NO: 1446720 - protein, 7 aa, Mycobacterium tuberculosis
LSSNPTF

SEQ ID NO: 1446721 - protein, 6 aa, Mycobacterium tuberculosis
LSSPDE

SEQ ID NO: 1446722 - protein, 5 aa, Mycobacterium tuberculosis
LSTST

SEQ ID NO: 1446723 - protein, 12 aa, Mycobacterium tuberculosis
LSYDRGPSAPSL

SEQ ID NO: 1446724 - protein, 11 aa, Mycobacterium tuberculosis
LTAAGAPTEAD

SEQ ID NO: 1446725 - protein, 5 aa, Mycobacterium tuberculosis
LTAGA

SEQ ID NO: 1446726 - protein, 11 aa, Mycobacterium tuberculosis
LTAGAAPGRPM

SEQ ID NO: 1446727 - protein, 5 aa, Mycobacterium tuberculosis
LTAPD

SEQ ID NO: 1446728 - protein, 8 aa, Mycobacterium tuberculosis
LTAPEGTP

SEQ ID NO: 1446729 - protein, 10 aa, Mycobacterium tuberculosis
LTAPPQPGET

SEQ ID NO: 1446730 - protein, 9 aa, Mycobacterium tuberculosis
LTAPSSGRI

SEQ ID NO: 1446731 - protein, 13 aa, Mycobacterium tuberculosis
LTARNGGRIHSRP

SEQ ID NO: 1446732 - protein, 22 aa, Mycobacterium tuberculosis
LTDPNKPTMQNTTGMPEGEGVD

SEQ ID NO: 1446733 - protein, 15 aa, Mycobacterium tuberculosis
LTDPPTGQPGTPPLP

SEQ ID NO: 1446734 - protein, 9 aa, Mycobacterium tuberculosis
LTEAERTGL

SEQ ID NO: 1446735 - protein, 19 aa, Mycobacterium tuberculosis
LTGKSKDEVTAELNEEGRP

SEQ ID NO: 1446736 - protein, 20 aa, Mycobacterium tuberculosis
LTGRTGFTRPAKLPTRIRQT

SEQ ID NO: 1446737 - protein, 6 aa, Mycobacterium tuberculosis
LTNAPQ

SEQ ID NO: 1446738 - protein, 10 aa, Mycobacterium tuberculosis
LTNPKGWTHN

SEQ ID NO: 1446739 - protein, 10 aa, Mycobacterium tuberculosis
LTPARRTDAV

SEQ ID NO: 1446740 - protein, 10 aa, Mycobacterium tuberculosis
LTPDEAAAEA

SEQ ID NO: 1446741 - protein, 11 aa, Mycobacterium tuberculosis
LTPGQGQGRGV

SEQ ID NO: 1446742 - protein, 7 aa, Mycobacterium tuberculosis
LTPGRRQ

SEQ ID NO: 1446743 - protein, 8 aa, Mycobacterium tuberculosis
LTPPPSSD

SEQ ID NO: 1446744 - protein, 6 aa, Mycobacterium tuberculosis
LTPPTA

SEQ ID NO: 1446745 - protein, 35 aa, Mycobacterium tuberculosis
LTPSSGWPTRASAATSTCSRTTPIRRATPTAATKT

SEQ ID NO: 1446746 - protein, 37 aa, Mycobacterium tuberculosis
LTQAGANSGFGNLGTGNSGWGNKACRNSDRTTCSPVG

SEQ ID NO: 1446747 - protein, 8 aa, Mycobacterium tuberculosis
LTQGPGFP

SEQ ID NO: 1446748 - protein, 19 aa, Mycobacterium tuberculosis
LTQRSPKDHHPSCNSRHPH

SEQ ID NO: 1446749 - protein, 12 aa, Mycobacterium tuberculosis
LTRPSHITNPAG

SEQ ID NO: 1446750 - protein, 14 aa, Mycobacterium tuberculosis
LTRQDSSDLPPTTE

SEQ ID NO: 1446751 - protein, 14 aa, Mycobacterium tuberculosis
LTRRSRRAPNNRAA

SEQ ID NO: 1446752 - protein, 13 aa, Mycobacterium tuberculosis
LTSAGQPSKFSMP

SEQ ID NO: 1446753 - protein, 17 aa, Mycobacterium tuberculosis
LTSAPAGDTFPTAAPRS

SEQ ID NO: 1446754 - protein, 6 aa, Mycobacterium tuberculosis
LTSGCS

SEQ ID NO: 1446755 - protein, 14 aa, Mycobacterium tuberculosis
LTSGGGAYAAAEAA

SEQ ID NO: 1446756 - protein, 19 aa, Mycobacterium tuberculosis
LTSGGGAYAAAEAAATSPL

SEQ ID NO: 1446757 - protein, 15 aa, Mycobacterium tuberculosis
LTSPPACGRAPRGFE

SEQ ID NO: 1446758 - protein, 8 aa, Mycobacterium tuberculosis
LTSPTFPN

SEQ ID NO: 1446759 - protein, 20 aa, Mycobacterium tuberculosis
LTSRPPPHQPTSPWVPSACP

SEQ ID NO: 1446760 - protein, 10 aa, Mycobacterium tuberculosis
LTSTAGPGCR

SEQ ID NO: 1446761 - protein, 19 aa, Mycobacterium tuberculosis
LTSTEEPAKQQTTNTPALT

SEQ ID NO: 1446762 - protein, 12 aa, Mycobacterium tuberculosis
LTTAPGNGAALG

SEQ ID NO: 1446763 - protein, 18 aa, Mycobacterium tuberculosis
LTTDNQMSYNDSRAEGTR

SEQ ID NO: 1446764 - protein, 12 aa, Mycobacterium tuberculosis
LTTGEQVSVSTD

SEQ ID NO: 1446765 - protein, 5 aa, Mycobacterium tuberculosis
LTTGR

SEQ ID NO: 1446766 - protein, 6 aa, Mycobacterium tuberculosis
LTTPPI

SEQ ID NO: 1446767 - protein, 9 aa, Mycobacterium tuberculosis
LTTSEQHQA

SEQ ID NO: 1446768 - protein, 10 aa, Mycobacterium tuberculosis
LTTSEQHQAT

SEQ ID NO: 1446769 - protein, 22 aa, Mycobacterium tuberculosis
LTTSTTNGGGTAFGEGFPASAT

SEQ ID NO: 1446770 - protein, 33 aa, Mycobacterium tuberculosis
LTTTPRRPRWPNTSTARLDQPPAVGDQQILAER

SEQ ID NO: 1446771 - protein, 13 aa, Mycobacterium tuberculosis
LVDPEDDLTPARY

SEQ ID NO: 1446772 - protein, 11 aa, Mycobacterium tuberculosis
LVPEDRAGDHA

SEQ ID NO: 1446773 - protein, 7 aa, Mycobacterium tuberculosis
LYGRRSR

SEQ ID NO: 1446774 - protein, 4 aa, Mycobacterium tuberculosis
LYPN

SEQ ID NO: 1446775 - protein, 12 aa, Mycobacterium tuberculosis
MAAAKAAGKVRI

SEQ ID NO: 1446776 - protein, 54 aa, Mycobacterium tuberculosis
MAAPGAAVASAAAPASAPAASTVASATPAPPPAPGAAGSAIPTPSLRPASGSAR

SEQ ID NO: 1446777 - protein, 38 aa, Mycobacterium tuberculosis
MAAPGAAVASAAAPATALEASQDGSATPAPPPAPGAAE

SEQ ID NO: 1446778 - protein, 11 aa, Mycobacterium tuberculosis
MAATPRPARRV

SEQ ID NO: 1446779 - protein, 5 aa, Mycobacterium tuberculosis
MADPA

SEQ ID NO: 1446780 - protein, 26 aa, Mycobacterium tuberculosis
MAGPAGPAGSARPASRAGPAAPAAPA

SEQ ID NO: 1446781 - protein, 17 aa, Mycobacterium tuberculosis
MAPSRRSRRACTNSLST

SEQ ID NO: 1446782 - protein, 36 aa, Mycobacterium tuberculosis
MAPSSGTSSAGVPTTRTTNAPTNHPTASPNNERAGT

SEQ ID NO: 1446783 - protein, 20 aa, Mycobacterium tuberculosis
MAPTPGRRTRNGSVNGHPGM

SEQ ID NO: 1446784 - protein, 33 aa, Mycobacterium tuberculosis
MAPTPGRRTRNGSVNGHPGMANYPPDDANYRRS

SEQ ID NO: 1446785 - protein, 18 aa, Mycobacterium tuberculosis
MARPERAAGGGRRAHRRW

SEQ ID NO: 1446786 - protein, 7 aa, Mycobacterium tuberculosis
MATPTSA

SEQ ID NO: 1446787 - protein, 18 aa, Mycobacterium tuberculosis
MDATSEQHSSGQPPQATR

SEQ ID NO: 1446788 - protein, 10 aa, Mycobacterium tuberculosis
MDNPSGPARL

SEQ ID NO: 1446789 - protein, 20 aa, Mycobacterium tuberculosis
MDSGSPVSPDYAPGSNAFNG

SEQ ID NO: 1446790 - protein, 13 aa, Mycobacterium tuberculosis
MENPNAVEAEISG

SEQ ID NO: 1446791 - protein, 11 aa, Mycobacterium tuberculosis
MEPRSAATEAY

SEQ ID NO: 1446792 - protein, 19 aa, Mycobacterium tuberculosis
MESNGKSTRADGSPVSADT

SEQ ID NO: 1446793 - protein, 17 aa, Mycobacterium tuberculosis
MGGSSAARCAARIVADR

SEQ ID NO: 1446794 - protein, 12 aa, Mycobacterium tuberculosis
MGQRPSVDIFTQ

SEQ ID NO: 1446795 - protein, 7 aa, Mycobacterium tuberculosis
MGSSTAS

SEQ ID NO: 1446796 - protein, 6 aa, Mycobacterium tuberculosis
MGTPED

SEQ ID NO: 1446797 - protein, 4 aa, Mycobacterium tuberculosis
MHGP

SEQ ID NO: 1446798 - protein, 12 aa, Mycobacterium tuberculosis
MKPRTGDGPFGS

SEQ ID NO: 1446799 - protein, 4 aa, Mycobacterium tuberculosis
MKTG

SEQ ID NO: 1446800 - protein, 11 aa, Mycobacterium tuberculosis
MMPSKSSTRWS

SEQ ID NO: 1446801 - protein, 9 aa, Mycobacterium tuberculosis
MNGSPTPWA

SEQ ID NO: 1446802 - protein, 6 aa, Mycobacterium tuberculosis
MNPAQA

SEQ ID NO: 1446803 - protein, 15 aa, Mycobacterium tuberculosis
MPAASVGRAEPEAPV

SEQ ID NO: 1446804 - protein, 12 aa, Mycobacterium tuberculosis
MPGQDVAQLLDQ

SEQ ID NO: 1446805 - protein, 20 aa, Mycobacterium tuberculosis
MPGSGGGQAAPLADGIPGPP

SEQ ID NO: 1446806 - protein, 11 aa, Mycobacterium tuberculosis
MPNDEGGNGRL

SEQ ID NO: 1446807 - protein, 8 aa, Mycobacterium tuberculosis
MPPAKTRQ

SEQ ID NO: 1446808 - protein, 15 aa, Mycobacterium tuberculosis
MPPLPAGLRPFPAVP

SEQ ID NO: 1446809 - protein, 44 aa, Mycobacterium tuberculosis
MPPPPSPPLPPLPPVRPSPPMPPWPPKPPTPPSPPAPPTPINTD

SEQ ID NO: 1446810 - protein, 8 aa, Mycobacterium tuberculosis
MPPPRASV

SEQ ID NO: 1446811 - protein, 11 aa, Mycobacterium tuberculosis
MPQPPAGARGD

SEQ ID NO: 1446812 - protein, 10 aa, Mycobacterium tuberculosis
MPQPPGYDTN

SEQ ID NO: 1446813 - protein, 7 aa, Mycobacterium tuberculosis
MPRGQDS

SEQ ID NO: 1446814 - protein, 9 aa, Mycobacterium tuberculosis
MPRNPAATW

SEQ ID NO: 1446815 - protein, 13 aa, Mycobacterium tuberculosis
MPRPGPSSPALNG

SEQ ID NO: 1446816 - protein, 12 aa, Mycobacterium tuberculosis
MPSAGAGPDAVA

SEQ ID NO: 1446817 - protein, 35 aa, Mycobacterium tuberculosis
MPTPNNDVAAPPSPPAPPEPPQAEAAAGPRRPRHY

SEQ ID NO: 1446818 - protein, 5 aa, Mycobacterium tuberculosis
MQASA

SEQ ID NO: 1446819 - protein, 11 aa, Mycobacterium tuberculosis
MQATGRDGSER

SEQ ID NO: 1446820 - protein, 11 aa, Mycobacterium tuberculosis
MQEDRDRSLRD

SEQ ID NO: 1446821 - protein, 5 aa, Mycobacterium tuberculosis
MQGTG

SEQ ID NO: 1446822 - protein, 23 aa, Mycobacterium tuberculosis
MQKGGTGQPGRRPYRGPGALRGA

SEQ ID NO: 1446823 - protein, 18 aa, Mycobacterium tuberculosis
MRAKGEEERAADREGAEE

SEQ ID NO: 1446824 - protein, 15 aa, Mycobacterium tuberculosis
MRNTTNTGQPRIARR

SEQ ID NO: 1446825 - protein, 12 aa, Mycobacterium tuberculosis
MRPGAAARRVRV

SEQ ID NO: 1446826 - protein, 12 aa, Mycobacterium tuberculosis
MRPLPGPQAHPA

SEQ ID NO: 1446827 - protein, 17 aa, Mycobacterium tuberculosis
MRRSGANGPRRRRCKAQ

SEQ ID NO: 1446828 - protein, 15 aa, Mycobacterium tuberculosis
MRTDSGSGPDARARG

SEQ ID NO: 1446829 - protein, 6 aa, Mycobacterium tuberculosis
MSAGLG

SEQ ID NO: 1446830 - protein, 8 aa, Mycobacterium tuberculosis
MSAPQTVS

SEQ ID NO: 1446831 - protein, 9 aa, Mycobacterium tuberculosis
MSAPQTVSG

SEQ ID NO: 1446832 - protein, 9 aa, Mycobacterium tuberculosis
MSASPGARQ

SEQ ID NO: 1446833 - protein, 4 aa, Mycobacterium tuberculosis
MSDE

SEQ ID NO: 1446834 - protein, 16 aa, Mycobacterium tuberculosis
MSDVAGRAAPLPAPAA

SEQ ID NO: 1446835 - protein, 16 aa, Mycobacterium tuberculosis
MSEPIGAAGGAHAGDC

SEQ ID NO: 1446836 - protein, 10 aa, Mycobacterium tuberculosis
MSGDSSSWKG

SEQ ID NO: 1446837 - protein, 9 aa, Mycobacterium tuberculosis
MSSSRAQRA

SEQ ID NO: 1446838 - protein, 21 aa, Mycobacterium tuberculosis
MSTPAASSPAITATGSGGGAI

SEQ ID NO: 1446839 - protein, 50 aa, Mycobacterium tuberculosis
MSTPAPSSPATSATASCGAATTRAWPASPWATPSRCSPRWAPTSAAGSAR

SEQ ID NO: 1446840 - protein, 5 aa, Mycobacterium tuberculosis
MTDQS

SEQ ID NO: 1446841 - protein, 33 aa, Mycobacterium tuberculosis
MTGGALGAAAPAIYTGSGARARANGRTPSAEPV

SEQ ID NO: 1446842 - protein, 12 aa, Mycobacterium tuberculosis
MTGLSGHSRSEL

SEQ ID NO: 1446843 - protein, 4 aa, Mycobacterium tuberculosis
MTPE

SEQ ID NO: 1446844 - protein, 17 aa, Mycobacterium tuberculosis
MTPPTPTPEAAHNPTMN

SEQ ID NO: 1446845 - protein, 21 aa, Mycobacterium tuberculosis
MTSRARVDAPHRVRGEIFRPG

SEQ ID NO: 1446846 - protein, 32 aa, Mycobacterium tuberculosis
MTTPGRGGDHTADVDQHPARWSPRSRSSSAPA

SEQ ID NO: 1446847 - protein, 11 aa, Mycobacterium tuberculosis
MTTQGREAITP

SEQ ID NO: 1446848 - protein, 12 aa, Mycobacterium tuberculosis
MWGPKEDPAWQR

SEQ ID NO: 1446849 - protein, 9 aa, Mycobacterium tuberculosis
NAAASIPTT

SEQ ID NO: 1446850 - protein, 5 aa, Mycobacterium tuberculosis
NAAAY

SEQ ID NO: 1446851 - protein, 9 aa, Mycobacterium tuberculosis
NAAGLATQG

SEQ ID NO: 1446852 - protein, 10 aa, Mycobacterium tuberculosis
NAARGTPSRG

SEQ ID NO: 1446853 - protein, 11 aa, Mycobacterium tuberculosis
NAARSANAEIP

SEQ ID NO: 1446854 - protein, 9 aa, Mycobacterium tuberculosis
NAASPPLKN

SEQ ID NO: 1446855 - protein, 13 aa, Mycobacterium tuberculosis
NADGCRASGTMGR

SEQ ID NO: 1446856 - protein, 8 aa, Mycobacterium tuberculosis
NADGSAAQ

SEQ ID NO: 1446857 - protein, 5 aa, Mycobacterium tuberculosis
NAEEA

SEQ ID NO: 1446858 - protein, 9 aa, Mycobacterium tuberculosis
NAEPNAERH

SEQ ID NO: 1446859 - protein, 13 aa, Mycobacterium tuberculosis
NAGADADGPVATT

SEQ ID NO: 1446860 - protein, 15 aa, Mycobacterium tuberculosis
NAGERLSATKAGSAM

SEQ ID NO: 1446861 - protein, 9 aa, Mycobacterium tuberculosis
NAGGLGPMQ

SEQ ID NO: 1446862 - protein, 19 aa, Mycobacterium tuberculosis
NAGNAGNAEKPGARRVPAA

SEQ ID NO: 1446863 - protein, 8 aa, Mycobacterium tuberculosis
NAGPIGVP

SEQ ID NO: 1446864 - protein, 9 aa, Mycobacterium tuberculosis
NAGPNTNSS

SEQ ID NO: 1446865 - protein, 8 aa, Mycobacterium tuberculosis
NAGQPMTL

SEQ ID NO: 1446866 - protein, 9 aa, Mycobacterium tuberculosis
NAGQPMTLP

SEQ ID NO: 1446867 - protein, 6 aa, Mycobacterium tuberculosis
NAGRGI

SEQ ID NO: 1446868 - protein, 27 aa, Mycobacterium tuberculosis
NAGSGGTGGFGDTDGGAGGAGGDAGWL

SEQ ID NO: 1446869 - protein, 16 aa, Mycobacterium tuberculosis
NAHGQKIQALVATWPK

SEQ ID NO: 1446870 - protein, 8 aa, Mycobacterium tuberculosis
NAHPTGEM

SEQ ID NO: 1446871 - protein, 8 aa, Mycobacterium tuberculosis
NALPGSIS

SEQ ID NO: 1446872 - protein, 8 aa, Mycobacterium tuberculosis
NALPRRAS

SEQ ID NO: 1446873 - protein, 6 aa, Mycobacterium tuberculosis
NALQGG

SEQ ID NO: 1446874 - protein, 9 aa, Mycobacterium tuberculosis
NANPDSMRA

SEQ ID NO: 1446875 - protein, 9 aa, Mycobacterium tuberculosis
NAPASTSPL

SEQ ID NO: 1446876 - protein, 11 aa, Mycobacterium tuberculosis
NAPSRGGADGV

SEQ ID NO: 1446877 - protein, 6 aa, Mycobacterium tuberculosis
NAPTEA

SEQ ID NO: 1446878 - protein, 5 aa, Mycobacterium tuberculosis
NAPTQ

SEQ ID NO: 1446879 - protein, 13 aa, Mycobacterium tuberculosis
NAPTQARGREARD

SEQ ID NO: 1446880 - protein, 12 aa, Mycobacterium tuberculosis
NAPTQTLLGRPL

SEQ ID NO: 1446881 - protein, 6 aa, Mycobacterium tuberculosis
NAPVVG

SEQ ID NO: 1446882 - protein, 18 aa, Mycobacterium tuberculosis
NAPYDTDGANLYAQYRLS

SEQ ID NO: 1446883 - protein, 7 aa, Mycobacterium tuberculosis
NAQDAGG

SEQ ID NO: 1446884 - protein, 12 aa, Mycobacterium tuberculosis
NAQLTTLTSVLA

SEQ ID NO: 1446885 - protein, 7 aa, Mycobacterium tuberculosis
NAQQAEL

SEQ ID NO: 1446886 - protein, 9 aa, Mycobacterium tuberculosis
NARAGLANP

SEQ ID NO: 1446887 - protein, 18 aa, Mycobacterium tuberculosis
NARDQPPAEVSDQRVSGL

SEQ ID NO: 1446888 - protein, 9 aa, Mycobacterium tuberculosis
NARGGNVST

SEQ ID NO: 1446889 - protein, 11 aa, Mycobacterium tuberculosis
NARGGPGGAPG

SEQ ID NO: 1446890 - protein, 8 aa, Mycobacterium tuberculosis
NARRAPNR

SEQ ID NO: 1446891 - protein, 8 aa, Mycobacterium tuberculosis
NARTGAAE

SEQ ID NO: 1446892 - protein, 6 aa, Mycobacterium tuberculosis
NASAQT

SEQ ID NO: 1446893 - protein, 8 aa, Mycobacterium tuberculosis
NASGAGGF

SEQ ID NO: 1446894 - protein, 28 aa, Mycobacterium tuberculosis
NASKGMVGDGGTGGAGRKRRADWKRRNG

SEQ ID NO: 1446895 - protein, 6 aa, Mycobacterium tuberculosis
NASRLI

SEQ ID NO: 1446896 - protein, 11 aa, Mycobacterium tuberculosis
NASRSAQGRAD

SEQ ID NO: 1446897 - protein, 15 aa, Mycobacterium tuberculosis
NASSSRGRRLTRREW

SEQ ID NO: 1446898 - protein, 18 aa, Mycobacterium tuberculosis
NATDPGAAAQFNASPVAQ

SEQ ID NO: 1446899 - protein, 10 aa, Mycobacterium tuberculosis
NATHADATAA

SEQ ID NO: 1446900 - protein, 11 aa, Mycobacterium tuberculosis
NATKARKNGWA

SEQ ID NO: 1446901 - protein, 4 aa, Mycobacterium tuberculosis
NATL

SEQ ID NO: 1446902 - protein, 5 aa, Mycobacterium tuberculosis
NATQV

SEQ ID NO: 1446903 - protein, 12 aa, Mycobacterium tuberculosis
NATSASHVRAVA

SEQ ID NO: 1446904 - protein, 18 aa, Mycobacterium tuberculosis
NATSPTAPITSLGSTTCA

SEQ ID NO: 1446905 - protein, 12 aa, Mycobacterium tuberculosis
NAVNGGAGSAVS

SEQ ID NO: 1446906 - protein, 15 aa, Mycobacterium tuberculosis
NAVRRSQLSRGEDPA

SEQ ID NO: 1446907 - protein, 52 aa, Mycobacterium tuberculosis
NAVSTVNGDAVGGEGGKGGEGAYGGAGGAGGSAASIGNAAIGGNGGAGGNAQ

SEQ ID NO: 1446908 - protein, 17 aa, Mycobacterium tuberculosis
NAWPPDPPAPPAPPSPA

SEQ ID NO: 1446909 - protein, 15 aa, Mycobacterium tuberculosis
NCGQPEEWGASPPCL

SEQ ID NO: 1446910 - protein, 12 aa, Mycobacterium tuberculosis
NCSSSGRKPRNV

SEQ ID NO: 1446911 - protein, 9 aa, Mycobacterium tuberculosis
NDALPDTPL

SEQ ID NO: 1446912 - protein, 5 aa, Mycobacterium tuberculosis
NDDGS

SEQ ID NO: 1446913 - protein, 6 aa, Mycobacterium tuberculosis
NDDRKD

SEQ ID NO: 1446914 - protein, 5 aa, Mycobacterium tuberculosis
NDEVT

SEQ ID NO: 1446915 - protein, 39 aa, Mycobacterium tuberculosis
NDGAGGSGRPARPAAQVEPRGYSATAGRVGPGVTARATA

SEQ ID NO: 1446916 - protein, 6 aa, Mycobacterium tuberculosis
NDGLAQ

SEQ ID NO: 1446917 - protein, 9 aa, Mycobacterium tuberculosis
NDIDGSCST

SEQ ID NO: 1446918 - protein, 4 aa, Mycobacterium tuberculosis
NDKQ

SEQ ID NO: 1446919 - protein, 13 aa, Mycobacterium tuberculosis
NDPDGVAVDNSGN

SEQ ID NO: 1446920 - protein, 12 aa, Mycobacterium tuberculosis
NDPNSTNTRIAT

SEQ ID NO: 1446921 - protein, 8 aa, Mycobacterium tuberculosis
NDPQNRIN

SEQ ID NO: 1446922 - protein, 21 aa, Mycobacterium tuberculosis
NDPSPTGRPSATASTTPPRVS

SEQ ID NO: 1446923 - protein, 12 aa, Mycobacterium tuberculosis
NDRPCSSLHLIF

SEQ ID NO: 1446924 - protein, 25 aa, Mycobacterium tuberculosis
NDTEPTYPNSKSDPNVCMGHITPLF

SEQ ID NO: 1446925 - protein, 8 aa, Mycobacterium tuberculosis
NEAIGPGG

SEQ ID NO: 1446926 - protein, 9 aa, Mycobacterium tuberculosis
NEANAAEQM

SEQ ID NO: 1446927 - protein, 17 aa, Mycobacterium tuberculosis
NEANGAPGTGANGGDGG

SEQ ID NO: 1446928 - protein, 7 aa, Mycobacterium tuberculosis
NEENGAL

SEQ ID NO: 1446929 - protein, 4 aa, Mycobacterium tuberculosis
NEGL

SEQ ID NO: 1446930 - protein, 20 aa, Mycobacterium tuberculosis
NEIEPVTSGPHPYEFALYYD

SEQ ID NO: 1446931 - protein, 5 aa, Mycobacterium tuberculosis
NEPGF

SEQ ID NO: 1446932 - protein, 6 aa, Mycobacterium tuberculosis
NESPCT

SEQ ID NO: 1446933 - protein, 7 aa, Mycobacterium tuberculosis
NESRTAK

SEQ ID NO: 1446934 - protein, 4 aa, Mycobacterium tuberculosis
NETL

SEQ ID NO: 1446935 - protein, 153 aa, Mycobacterium tuberculosis
NFAGGQGGAGGRGGAGGNGANGVGDNAAGGDGGNGGAGGLGGGGGTGGTNGNGGLGGGGGNGGAGGAGGTPTGSGTEGTGGDGGDAGAGGNGGSATGVGNGGNGGDGGNGGDGGNGAPGGFGGGAGAGGLGGSGAGGGTDGDDGNGGSPGTDG

SEQ ID NO: 1446936 - protein, 12 aa, Mycobacterium tuberculosis
NGAAGGAGGAGG

SEQ ID NO: 1446937 - protein, 9 aa, Mycobacterium tuberculosis
NGAASIPTT

SEQ ID NO: 1446938 - protein, 324 aa, Mycobacterium tuberculosis
NGADATVAGANGGKGGAGGNGGLVGDGGAGGDGGSGAAGANGANVGEDGADGTLSGQPGEGSEANGGQGGVGGGGAGGAGGDGGAGSSALGSGGNGGRGDAGQAGGAGGAGGAGGAGGSVSGDGGPGGKGGAGGAGGAGASGGGGGKGASGADSAEAVGGAGGKGGDGGVGGVGGDGGPGGDGGAGGAAPAGQVGSHGVGGVGGDGGLGGAGGNGGDGGHGSDGGDGGDGGDPGAGGLGGLGGDSGNGTRAASGVDASDHGPGSGGNGGNGGNGAQASVAGGAGGNGGDGGNAGRVGDGGAGGNGGDGAAGANGANSGAPGSDA

SEQ ID NO: 1446939 - protein, 18 aa, Mycobacterium tuberculosis
NGADGAPGTGQPGGPGAL

SEQ ID NO: 1446940 - protein, 21 aa, Mycobacterium tuberculosis
NGADGGPGQNGGPGGLLYGNG

SEQ ID NO: 1446941 - protein, 15 aa, Mycobacterium tuberculosis
NGADGTAANPNGQAG

SEQ ID NO: 1446942 - protein, 15 aa, Mycobacterium tuberculosis
NGADGTAPGQPGAAG

SEQ ID NO: 1446943 - protein, 10 aa, Mycobacterium tuberculosis
NGADGVAGDR

SEQ ID NO: 1446944 - protein, 19 aa, Mycobacterium tuberculosis
NGADGVAGTGSNAGGNGGA

SEQ ID NO: 1446945 - protein, 11 aa, Mycobacterium tuberculosis
NGADGVAGTGV

SEQ ID NO: 1446946 - protein, 17 aa, Mycobacterium tuberculosis
NGANGAPGTGADGAPGG

SEQ ID NO: 1446947 - protein, 17 aa, Mycobacterium tuberculosis
NGANGKPGTGQDGGAGG

SEQ ID NO: 1446948 - protein, 29 aa, Mycobacterium tuberculosis
NGAPTTPGRGHLPRPTNPARRSTGGLGNY

SEQ ID NO: 1446949 - protein, 20 aa, Mycobacterium tuberculosis
NGATAEKEAELRANADAKEA

SEQ ID NO: 1446950 - protein, 9 aa, Mycobacterium tuberculosis
NGAYNQRQQ

SEQ ID NO: 1446951 - protein, 6 aa, Mycobacterium tuberculosis
NGCGQL

SEQ ID NO: 1446952 - protein, 18 aa, Mycobacterium tuberculosis
NGCQRNRYGHGPRRAGLG

SEQ ID NO: 1446953 - protein, 8 aa, Mycobacterium tuberculosis
NGDLTPWA

SEQ ID NO: 1446954 - protein, 5 aa, Mycobacterium tuberculosis
NGDQD

SEQ ID NO: 1446955 - protein, 4 aa, Mycobacterium tuberculosis
NGDV

SEQ ID NO: 1446956 - protein, 13 aa, Mycobacterium tuberculosis
NGDVGRDGENGGL

SEQ ID NO: 1446957 - protein, 9 aa, Mycobacterium tuberculosis
NGEAGTRVD

SEQ ID NO: 1446958 - protein, 17 aa, Mycobacterium tuberculosis
NGGAAGAAGQGGPGMNT

SEQ ID NO: 1446959 - protein, 26 aa, Mycobacterium tuberculosis
NGGAAGSGGNGAMQVPASSSQRFPPG

SEQ ID NO: 1446960 - protein, 32 aa, Mycobacterium tuberculosis
NGGAGARGQAVASAAPAPPAVPAAKAVMVAMR

SEQ ID NO: 1446961 - protein, 49 aa, Mycobacterium tuberculosis
NGGAGDQGAIAGAGGAGANGVSSTNGGGTGGNGGIGGTGGSGGAGGNAG

SEQ ID NO: 1446962 - protein, 11 aa, Mycobacterium tuberculosis
NGGAGGAGGDA

SEQ ID NO: 1446963 - protein, 27 aa, Mycobacterium tuberculosis
NGGAGGAGGGAGGVGGAGGAPGTGGTL

SEQ ID NO: 1446964 - protein, 16 aa, Mycobacterium tuberculosis
NGGAGGAGGNGGPAPL

SEQ ID NO: 1446965 - protein, 24 aa, Mycobacterium tuberculosis
NGGAGGAGGQGAVTGGTGGAGGDG

SEQ ID NO: 1446966 - protein, 19 aa, Mycobacterium tuberculosis
NGGAGGAGGTGGTGGGGAD

SEQ ID NO: 1446967 - protein, 13 aa, Mycobacterium tuberculosis
NGGAGGAGGVGGD

SEQ ID NO: 1446968 - protein, 19 aa, Mycobacterium tuberculosis
NGGAGGAGNSGGDGGTGLN

SEQ ID NO: 1446969 - protein, 15 aa, Mycobacterium tuberculosis
NGGAGGFGGAGAVGG

SEQ ID NO: 1446970 - protein, 22 aa, Mycobacterium tuberculosis
NGGAGGFGGAGAVGGNGGAGGT

SEQ ID NO: 1446971 - protein, 12 aa, Mycobacterium tuberculosis
NGGAGGGGGTGG

SEQ ID NO: 1446972 - protein, 10 aa, Mycobacterium tuberculosis
NGGAGGIGGI

SEQ ID NO: 1446973 - protein, 13 aa, Mycobacterium tuberculosis
NGGAGGKRRDRWG

SEQ ID NO: 1446974 - protein, 28 aa, Mycobacterium tuberculosis
NGGAGGPGGFGSPAGAGGIGGAGGNGGL

SEQ ID NO: 1446975 - protein, 11 aa, Mycobacterium tuberculosis
NGGAGGPQRPK

SEQ ID NO: 1446976 - protein, 33 aa, Mycobacterium tuberculosis
NGGAGGQGSSGGIGGPGATGGAGGKGGDGGDAQ

SEQ ID NO: 1446977 - protein, 21 aa, Mycobacterium tuberculosis
NGGAGGSGAAGMPGGNGGAAG

SEQ ID NO: 1446978 - protein, 52 aa, Mycobacterium tuberculosis; identical to SEQ ID NO: 192868

SEQ ID NO: 1446979 - protein, 35 aa, Mycobacterium tuberculosis
NGGAGGSGAAGVNGGAGGNGGAGGLIGNGGAGGDA

SEQ ID NO: 1446980 - protein, 27 aa, Mycobacterium tuberculosis
NGGAGGSGAAGVYGGAAATAGAGGLHR

SEQ ID NO: 1446981 - protein, 34 aa, Mycobacterium tuberculosis
NGGAGGSGAGGASSAHGGARRPGRSCSATAGKAA

SEQ ID NO: 1446982 - protein, 50 aa, Mycobacterium tuberculosis
NGGAGGSGAPGAGAGGNGGAGGLFGSGGAGGASTDVAGGAGGAGGAGGNA

SEQ ID NO: 1446983 - protein, 22 aa, Mycobacterium tuberculosis
NGGAGGSGAPGQVGGAGGAAGL

SEQ ID NO: 1446984 - protein, 10 aa, Mycobacterium tuberculosis
NGGAGGSGGS

SEQ ID NO: 1446985 - protein, 78 aa, Mycobacterium tuberculosis
NGGAGGVGATGGNGGSGIGPASVGGNGGKGGVGAAGGLAGQIGNGGSGGSGGAGGNGGTGDTAGNGGNGGAGAVGGNA

SEQ ID NO: 1446986 - protein, 70 aa, Mycobacterium tuberculosis
NGGAGGVGGTAGAGGTGGSGGAGGAGGAGGGGTNSGPGAAFGGNGNTGGNGGNGGAFGALGGKGGSGGLI

SEQ ID NO: 1446987 - protein, 70 aa, Mycobacterium tuberculosis; identical to SEQ ID NO: 192872

SEQ ID NO: 1446988 - protein, 125 aa, Mycobacterium tuberculosis
NGGAGGVGGTAGAGGTGGTGGAGGAGGAGGGGTNSGPGAAFGGNGNTGGNGGNGGAPGALGGKGGSGGLIGRAGSDGGVGAGGAGGAGGAGGTGGEGGTGGDGKTTDGNPGMGGSPGSAGQPGQP

SEQ ID NO: 1446989 - protein, 30 aa, Mycobacterium tuberculosis
NGGAGGVGGTGDNGVGDLGAGGGGGDGGLG

SEQ ID NO: 1446990 - protein, 67 aa, Mycobacterium tuberculosis
NGGAGGVGGVGGAGGAGAAGGAGGAGATGINGPAGISAAGGDGGAGGNGGAGGNGGVGGAGGAGGSA

SEQ ID NO: 1446991 - protein, 70 aa, Mycobacterium tuberculosis
NGGAGGVGGVGGAGGAGAAGGAGGAGATGINGPAGISAAGGDGGAGGNGGAGGNGGVGGAGGAGGSAGLL

SEQ ID NO: 1446992 - protein, 12 aa, Mycobacterium tuberculosis
NGGARGAGGTSV

SEQ ID NO: 1446993 - protein, 17 aa, Mycobacterium tuberculosis
NGGDGGAGVSAVSAGPV

SEQ ID NO: 1446994 - protein, 22 aa, Mycobacterium tuberculosis
NGGDGGSGAAGLPGGNGGAAGL

SEQ ID NO: 1446995 - protein, 33 aa, Mycobacterium tuberculosis; identical to SEQ ID NO: 230570

SEQ ID NO: 1446996 - protein, 18 aa, Mycobacterium tuberculosis
NGGDTGNAGNGGNGGSAA

SEQ ID NO: 1446997 - protein, 22 aa, Mycobacterium tuberculosis
NGGEGGDGGALGGNGGNGGNAQ

SEQ ID NO: 1446998 - protein, 13 aa, Mycobacterium tuberculosis
NGGGAGGAGGAGG

SEQ ID NO: 1446999 - protein, 43 aa, Mycobacterium tuberculosis
NGGGAGGAGGSGVSGGAGGEGGAGGSGGGGSVAGDGGAGGNAG

SEQ ID NO: 1447000 - protein, 21 aa, Mycobacterium tuberculosis
NGGGRRGRRGRLNQGCHWWAG

SEQ ID NO: 1447001 - protein, 25 aa, Mycobacterium tuberculosis
NGGGTGGNGGIGGTGGSGGAGGNAG

SEQ ID NO: 1447002 - protein, 21 aa, Mycobacterium tuberculosis
NGGHGEAGAAGQDRGAGNSAR

SEQ ID NO: 1447003 - protein, 26 aa, Mycobacterium tuberculosis
NGGHGGSGGTGLPNGSGGARRPQRAA

SEQ ID NO: 1447004 - protein, 22 aa, Mycobacterium tuberculosis
NGGNAGIGGTGPTAGDTGAGGI

SEQ ID NO: 1447005 - protein, 12 aa, Mycobacterium tuberculosis
NGGNAGNGGTAG

SEQ ID NO: 1447006 - protein, 21 aa, Mycobacterium tuberculosis
NGGNAGVGTPAGNGGAGGTGG

SEQ ID NO: 1447007 - protein, 22 aa, Mycobacterium tuberculosis
NGGNGAAGAVGQVGGAGGAAGL

SEQ ID NO: 1447008 - protein, 11 aa, Mycobacterium tuberculosis
NGGNGAAGGAV

SEQ ID NO: 1447009 - protein, 17 aa, Mycobacterium tuberculosis
NGGNGFPKPPPGSPGGP

SEQ ID NO: 1447010 - protein, 12 aa, Mycobacterium tuberculosis
NGGNGFSPAAGP

SEQ ID NO: 1447011 - protein, 19 aa, Mycobacterium tuberculosis
NGGNGFSPAAGPGGNGGAA

SEQ ID NO: 1447012 - protein, 30 aa, Mycobacterium tuberculosis
NGGNGFSPAAGPGGNGGAAGLLGHGGNGGV

SEQ ID NO: 1447013 - protein, 35 aa, Mycobacterium tuberculosis
NGGNGFSQTTAGLTGGTGGSAGLIGNGGNGGAGGA

SEQ ID NO: 1447014 - protein, 42 aa, Mycobacterium tuberculosis
NGGNGFSQTTAGLTGGTGGSAGLIGNGGNGGAGGAGANESAD

SEQ ID NO: 1447015 - protein, 40 aa, Mycobacterium tuberculosis
NGGNGFSQTTAGLTGGTGGSAGLIGNGGNGGAGGAGVTAA

SEQ ID NO: 1447016 - protein, 47 aa, Mycobacterium tuberculosis
NGGNGFSQTTAGVAGGAGGSAGLIGNGGNGGAGGAGAAGGAGGAGRM

SEQ ID NO: 1447017 - protein, 44 aa, Mycobacterium tuberculosis
NGGNGFSQTTAGVAGGAGGSAGLIGNGGNGGAGGAGAAGGAGRS

SEQ ID NO: 1447018 - protein, 45 aa, Mycobacterium tuberculosis
NGGNGFSQTTAGVAGGAGGSAGLIGNGGNGGAGGAGAVGGAGGAG

SEQ ID NO: 1447019 - protein, 45 aa, Mycobacterium tuberculosis
NGGNGFSQTTAGVAGGASGSAGLIGNGGNGGAGGAGAAGGAGGAG

SEQ ID NO: 1447020 - protein, 44 aa, Mycobacterium tuberculosis
NGGNGFSQTTPGLTGGTGGSAGLIGNGGNGGAGGAGANGGAGGN

SEQ ID NO: 1447021 - protein, 20 aa, Mycobacterium tuberculosis
NGGNGGAGDTANPNGGNGGS

SEQ ID NO: 1447022 - protein, 70 aa, Mycobacterium tuberculosis
NGGNGGAGDTANPNGGNGGSAGLIGNGGAGGAGAATGAGKLRPALPNGCPDTRARGRPGFDPPGGPALCD

SEQ ID NO: 1447023 - protein, 18 aa, Mycobacterium tuberculosis
NGGNGGAGGFRIPVVVVV

SEQ ID NO: 1447024 - protein, 15 aa, Mycobacterium tuberculosis
NGGNGGAGGNGGARR

SEQ ID NO: 1447025 - protein, 22 aa, Mycobacterium tuberculosis
NGGNGGAGGPDGGAGGNGGAAG

SEQ ID NO: 1447026 - protein, 23 aa, Mycobacterium tuberculosis
NGGNGGAGGPDGGAGGNGGAAGL

SEQ ID NO: 1447027 - protein, 57 aa, Mycobacterium tuberculosis
NGGNGGAGGRGGPGGAGGAGASGAHATNLGADGQAGGNGGNGGAGGTGGVGGPGGGH

SEQ ID NO: 1447028 - protein, 96 aa, Mycobacterium tuberculosis
NGGNGGAGRTRTGPAGPAGRPGSSATVATAGTAGPERTAAPAAPPAGSSASAATAGPAGSVLPASTAVSAAPAATAATPGSSATAATAAWAGPGRP

SEQ ID NO: 1447029 - protein, 52 aa, Mycobacterium tuberculosis
NGGNGGDGGASVTGTGGNGGAGGNGVQIGNGGNGGSGGTGAAAGKAGLGGLG

SEQ ID NO: 1447030 - protein, 25 aa, Mycobacterium tuberculosis
NGGNGGDTHEPRGCRGSRRSAGLIG

SEQ ID NO: 1447031 - protein, 9 aa, Mycobacterium tuberculosis
NGGNGGIGG

SEQ ID NO: 1447032 - protein, 17 aa, Mycobacterium tuberculosis
NGGNGGKAGFSPGPTNF

SEQ ID NO: 1447033 - protein, 29 aa, Mycobacterium tuberculosis
NGGNGGKAGGTPGAGGTSGLIIGENGLNG

SEQ ID NO: 1447034 - protein, 34 aa, Mycobacterium tuberculosis
NGGNGGNAGSGTLNGSAGTGGAGGLLGKNGMNGL

SEQ ID NO: 1447035 - protein, 17 aa, Mycobacterium tuberculosis
NGGNGGNGGIGQPGGAG

SEQ ID NO: 1447036 - protein, 62 aa, Mycobacterium tuberculosis
NGGNGGNGGIGQPGGPGGDAGLIGNGGNGGIGGPGANRLSGGAGGGRADCSSATAATAVPGG

SEQ ID NO: 1447037 - protein, 32 aa, Mycobacterium tuberculosis
NGGNGGNGGKAGVTPGAGGTSGLIIGENGLNG

SEQ ID NO: 1447038 - protein, 74 aa, Mycobacterium tuberculosis
NGGNGGNGGNGAAGGNGAIGGTGGAGGVPANQGGNSALGTQPVGGDGGDGGNGGTGGTGGRGGDGGSGGAGGAS

SEQ ID NO: 1447039 - protein, 31 aa, Mycobacterium tuberculosis
NGGNGGNGGNSGNAGKSGGAPGPAGAGGAGG

SEQ ID NO: 1447040 - protein, 38 aa, Mycobacterium tuberculosis; identical to SEQ ID NO: 230578

SEQ ID NO: 1447041 - protein, 24 aa, Mycobacterium tuberculosis
NGGNGGQGTIGGVNGGAGGAGGAG

SEQ ID NO: 1447042 - protein, 21 aa, Mycobacterium tuberculosis
NGGNGGSGAAGQVGGPGGAAG

SEQ ID NO: 1447043 - protein, 19 aa, Mycobacterium tuberculosis
NGGNGGSGAPGKTGGPSDR

SEQ ID NO: 1447044 - protein, 15 aa, Mycobacterium tuberculosis
NGGNGGSGAPGQAGG

SEQ ID NO: 1447045 - protein, 22 aa, Mycobacterium tuberculosis
NGGNGGSGAPGQAGGAAGAAGL

SEQ ID NO: 1447046 - protein, 18 aa, Mycobacterium tuberculosis
NGGNGGSGAPGQAGGAGG

SEQ ID NO: 1447047 - protein, 21 aa, Mycobacterium tuberculosis
NGGNGGSGAPGQAGGAGGAAG

SEQ ID NO: 1447048 - protein, 29 aa, Mycobacterium tuberculosis
NGGNGGSGAPGQAGGAGGAAGLIGNGGAG

SEQ ID NO: 1447049 - protein, 35 aa, Mycobacterium tuberculosis
NGGNGGSGAPGQAGGAGGAAGLIGNGGAGGTGGAV

SEQ ID NO: 1447050 - protein, 35 aa, Mycobacterium tuberculosis
NGGNGGSGAPGQAGGAGGASGLIDNGGAGGTGGAV

SEQ ID NO: 1447051 - protein, 21 aa, Mycobacterium tuberculosis
NGGNGGSGAPGQAGGAGGGGR

SEQ ID NO: 1447052 - protein, 43 aa, Mycobacterium tuberculosis
NGGNGGSGAPGQPGGAGGDAGLIGNGGTGGKGGDGLVGSGAAG

SEQ ID NO: 1447053 - protein, 53 aa, Mycobacterium tuberculosis
NGGNGGSGAPGQPGGAGGDAGLIGNGGTGGKGGDGLVGSGAARGCRWSRWMVA

SEQ ID NO: 1447054 - protein, 21 aa, Mycobacterium tuberculosis
NGGNGGSGAPGQPGGRGGDAG

SEQ ID NO: 1447055 - protein, 23 aa, Mycobacterium tuberculosis
NGGNGGSGAPGQRGGAGGAAGLI

SEQ ID NO: 1447056 - protein, 45 aa, Mycobacterium tuberculosis
NGGNGGSGAPGQRGGAGGAAGLIGNGGNGGAGGVGTTGGAGGHGG

SEQ ID NO: 1447057 - protein, 43 aa, Mycobacterium tuberculosis
NGGNGGSGAPGQRGGAGGAAGLIGNGGNGGAGGVVPPAGPVVT

SEQ ID NO: 1447058 - protein, 13 aa, Mycobacterium tuberculosis
NGGNGGSGAPGQT

SEQ ID NO: 1447059 - protein, 17 aa, Mycobacterium tuberculosis
NGGNGGSGAPGQTGGAA

SEQ ID NO: 1447060 - protein, 29 aa, Mycobacterium tuberculosis
NGGNGGSGAPGQTGGAGGAAGLLGHGGTG

SEQ ID NO: 1447061 - protein, 21 aa, Mycobacterium tuberculosis
NGGNGGSGGGRPSRRKPAVAP

SEQ ID NO: 1447062 - protein, 44 aa, Mycobacterium tuberculosis
NGGNGGSGGVGQAGGAGGSAASIGNAAIGGNARSGRERPGPRRC

SEQ ID NO: 1447063 - protein, 27 aa, Mycobacterium tuberculosis
NGGNGGSGVAGVGGPGGSGGAAGLFGH

SEQ ID NO: 1447064 - protein, 32 aa, Mycobacterium tuberculosis
NGGNGGSGVAGVGGPGGSGGAAGLFGHGGNGG

SEQ ID NO: 1447065 - protein, 20 aa, Mycobacterium tuberculosis
NGGNGGTGANAGSPGTGGAG

SEQ ID NO: 1447066 - protein, 24 aa, Mycobacterium tuberculosis
NGGNGVACGSGATITAPPLPMRGP

SEQ ID NO: 1447067 - protein, 36 aa, Mycobacterium tuberculosis
NGGNGVNGGTGGSGGVGGNGSIGGDGAGVRKTPTEH

SEQ ID NO: 1447068 - protein, 46 aa, Mycobacterium tuberculosis
NGGNVGSSSTPGQPGGRGGAAGLIGNGGAGGAGGPGANGGAGGNGG

SEQ ID NO: 1447069 - protein, 14 aa, Mycobacterium tuberculosis
NGGPGGAAGLGTAG

SEQ ID NO: 1447070 - protein, 42 aa, Mycobacterium tuberculosis
NGGPGGAAGLGTAGESQPRRRGRRGRRAVGPCGSGGPGCSVS

SEQ ID NO: 1447071 - protein, 16 aa, Mycobacterium tuberculosis
NGGPGGAAGLGTAGGV

SEQ ID NO: 1447072 - protein, 20 aa, Mycobacterium tuberculosis
NGGPGGAAGLGTAGGVSPAG

SEQ ID NO: 1447073 - protein, 27 aa, Mycobacterium tuberculosis
NGGPGGAAGLGTAGGVSPAGGAGGAAG

SEQ ID NO: 1447074 - protein, 24 aa, Mycobacterium tuberculosis
NGGPGGAAGLGTTGGVFPRQTERH

SEQ ID NO: 1447075 - protein, 21 aa, Mycobacterium tuberculosis
NGGQGADTGNAGNGGHGGSAA

SEQ ID NO: 1447076 - protein, 29 aa, Mycobacterium tuberculosis
NGGSGGHGGAVTAGNTGIGGAGGVGGDAR

SEQ ID NO: 1447077 - protein, 27 aa, Mycobacterium tuberculosis
NGGTGGAGGAAGATLVGGTGGVGGATG

SEQ ID NO: 1447078 - protein, 25 aa, Mycobacterium tuberculosis
NGGTGGASDLAGTGRGGVGGAGGAG

SEQ ID NO: 1447079 - protein, 26 aa, Mycobacterium tuberculosis
NGGTGGASDLAGTGRGGVGGAGGAGG

SEQ ID NO: 1447080 - protein, 10 aa, Mycobacterium tuberculosis
NGGTGGNGGA

SEQ ID NO: 1447081 - protein, 25 aa, Mycobacterium tuberculosis
NGGTGGSGGADGAGSVGNGGAGGNA

SEQ ID NO: 1447082 - protein, 13 aa, Mycobacterium tuberculosis
NGGVGGSGGNATL

SEQ ID NO: 1447083 - protein, 26 aa, Mycobacterium tuberculosis
NGHRDNPSARESSQFTAGSTAKAVTK

SEQ ID NO: 1447084 - protein, 19 aa, Mycobacterium tuberculosis
NGHTSVHTSPASEPGGRYP

SEQ ID NO: 1447085 - protein, 25 aa, Mycobacterium tuberculosis
NGIVSTSATTCNYPPAANDSAQDGF

SEQ ID NO: 1447086 - protein, 7 aa, Mycobacterium tuberculosis
NGKGGQP

SEQ ID NO: 1447087 - protein, 12 aa, Mycobacterium tuberculosis
NGKPSDLGGNNL

SEQ ID NO: 1447088 - protein, 12 aa, Mycobacterium tuberculosis
NGLPDRRVDRDG

SEQ ID NO: 1447089 - protein, 14 aa, Mycobacterium tuberculosis
NGMGGDAYRTDPLD

SEQ ID NO: 1447090 - protein, 27 aa, Mycobacterium tuberculosis
NGNAKIARPYPRYTRSDCDGDSTPTIS

SEQ ID NO: 1447091 - protein, 21 aa, Mycobacterium tuberculosis
NGNGGAGGAGGTGANGGAGGN

SEQ ID NO: 1447092 - protein, 32 aa, Mycobacterium tuberculosis
NGNIGLNGATGGIGSTTLTNGDRTAAAGEYHR

SEQ ID NO: 1447093 - protein, 4 aa, Mycobacterium tuberculosis
NGPA

SEQ ID NO: 1447094 - protein, 6 aa, Mycobacterium tuberculosis
NGPAGS

SEQ ID NO: 1447095 - protein, 16 aa, Mycobacterium tuberculosis
NGPLSPDPGPPLVLQA

SEQ ID NO: 1447096 - protein, 28 aa, Mycobacterium tuberculosis
NGPPASPGPPGPPPPRGHCPPTAPTCAH

SEQ ID NO: 1447097 - protein, 7 aa, Mycobacterium tuberculosis
NGPPPPF

SEQ ID NO: 1447098 - protein, 7 aa, Mycobacterium tuberculosis
NGPPSWA

SEQ ID NO: 1447099 - protein, 18 aa, Mycobacterium tuberculosis
NGPWPGRAFPSDAGGFCG

SEQ ID NO: 1447100 - protein, 6 aa, Mycobacterium tuberculosis
NGQREG

SEQ ID NO: 1447101 - protein, 7 aa, Mycobacterium tuberculosis
NGRAFSG

SEQ ID NO: 1447102 - protein, 5 aa, Mycobacterium tuberculosis
NGRFT

SEQ ID NO: 1447103 - protein, 13 aa, Mycobacterium tuberculosis
NGRGRRRRGERSV

SEQ ID NO: 1447104 - protein, 6 aa, Mycobacterium tuberculosis
NGRIAG

SEQ ID NO: 1447105 - protein, 12 aa, Mycobacterium tuberculosis
NGRRSRAPAGWR

SEQ ID NO: 1447106 - protein, 30 aa, Mycobacterium tuberculosis
NGRSGGNGGVGVAGDPGGVGGAGGAGGAAG

SEQ ID NO: 1447107 - protein, 14 aa, Mycobacterium tuberculosis
NGRSYDPTLGLLRH

SEQ ID NO: 1447108 - protein, 5 aa, Mycobacterium tuberculosis
NGSDM

SEQ ID NO: 1447109 - protein, 10 aa, Mycobacterium tuberculosis
NGSEPVSPAS

SEQ ID NO: 1447110 - protein, 4 aa, Mycobacterium tuberculosis
NGSP

SEQ ID NO: 1447111 - protein, 39 aa, Mycobacterium tuberculosis
NGSPGAGCTAPCRGTPTSGWTPKMPSTYRAGARRAPGPA

SEQ ID NO: 1447112 - protein, 6 aa, Mycobacterium tuberculosis
NGSTTL

SEQ ID NO: 1447113 - protein, 19 aa, Mycobacterium tuberculosis
NGTAPSASSGGVDRGINAG

SEQ ID NO: 1447114 - protein, 10 aa, Mycobacterium tuberculosis
NGTGKTTTVG

SEQ ID NO: 1447115 - protein, 10 aa, Mycobacterium tuberculosis
NGTPPPEGPI

SEQ ID NO: 1447116 - protein, 4 aa, Mycobacterium tuberculosis
NGTQ

SEQ ID NO: 1447117 - protein, 31 aa, Mycobacterium tuberculosis
NGTRSGMTGPPTSRSRRCAGTSPTTWPPTSR

SEQ ID NO: 1447118 - protein, 8 aa, Mycobacterium tuberculosis
NGTSGPLR

SEQ ID NO: 1447119 - protein, 7 aa, Mycobacterium tuberculosis
NGTTVAA

SEQ ID NO: 1447120 - protein, 7 aa, Mycobacterium tuberculosis
NGVAQTV

SEQ ID NO: 1447121 - protein, 13 aa, Mycobacterium tuberculosis
NGVGGLGGLGGQG

SEQ ID NO: 1447122 - protein, 14 aa, Mycobacterium tuberculosis
NGVGGLGGLGGQGA

SEQ ID NO: 1447123 - protein, 19 aa, Mycobacterium tuberculosis
NGVTGTAAAPNGGPGGFAI

SEQ ID NO: 1447124 - protein, 5 aa, Mycobacterium tuberculosis
NHDAH

SEQ ID NO: 1447125 - protein, 34 aa, Mycobacterium tuberculosis
NHDDHHREEQQHHRDDAEFDDGSSDFHGLIVLSP

SEQ ID NO: 1447126 - protein, 4 aa, Mycobacterium tuberculosis
NHDG

SEQ ID NO: 1447127 - protein, 5 aa, Mycobacterium tuberculosis
NHDGT

SEQ ID NO: 1447128 - protein, 19 aa, Mycobacterium tuberculosis
NHESAGKRHHGARRKGNQH

SEQ ID NO: 1447129 - protein, 19 aa, Mycobacterium tuberculosis
NHPQPGPRGTRRGDGRGLT

SEQ ID NO: 1447130 - protein, 12 aa, Mycobacterium tuberculosis
NHPRPRRHRGQH

SEQ ID NO: 1447131 - protein, 7 aa, Mycobacterium tuberculosis
NHRPAGC

SEQ ID NO: 1447132 - protein, 4 aa, Mycobacterium tuberculosis
NHYP

SEQ ID NO: 1447133 - protein, 10 aa, Mycobacterium tuberculosis
NIATRGPQRQ

SEQ ID NO: 1447134 - protein, 12 aa, Mycobacterium tuberculosis
NIETLGKDELGD

SEQ ID NO: 1447135 - protein, 18 aa, Mycobacterium tuberculosis
NIGSTINAANAAAALPTT

SEQ ID NO: 1447136 - protein, 4 aa, Mycobacterium tuberculosis
NIPV

SEQ ID NO: 1447137 - protein, 9 aa, Mycobacterium tuberculosis
NKDNTDPKR

SEQ ID NO: 1447138 - protein, 4 aa, Mycobacterium tuberculosis
NKDP

SEQ ID NO: 1447139 - protein, 6 aa, Mycobacterium tuberculosis
NKEQGA

SEQ ID NO: 1447140 - protein, 10 aa, Mycobacterium tuberculosis
NKGRTVGTPY

SEQ ID NO: 1447141 - protein, 13 aa, Mycobacterium tuberculosis
NKGSYEAARERLT

SEQ ID NO: 1447142 - protein, 4 aa, Mycobacterium tuberculosis
NLAG

SEQ ID NO: 1447143 - protein, 21 aa, Mycobacterium tuberculosis
NLESVGSALNEAAAAAAPATV

SEQ ID NO: 1447144 - protein, 56 aa, Mycobacterium tuberculosis
NLGGGNTGDYNLGSGNSGNANVGSGNSGNANVGSGNDGATNLGSGKYRQHQSRQRK

SEQ ID NO: 1447145 - protein, 59 aa, Mycobacterium tuberculosis
NLGGGNTGDYNLGSGNSGNANVGSGNSGNANVGSGNDGATNLGSGNIGNTNLGSGNVGN

SEQ ID NO: 1447146 - protein, 43 aa, Mycobacterium tuberculosis
NLNTGFGNTTDGLGENSGFGNAGSGNSGFNNSGRGNSGAQNVG

SEQ ID NO: 1447147 - protein, 30 aa, Mycobacterium tuberculosis; identical to SEQ ID NO: 232273

SEQ ID NO: 1447148 - protein, 13 aa, Mycobacterium tuberculosis
NLPRRRGMRRHVH

SEQ ID NO: 1447149 - protein, 17 aa, Mycobacterium tuberculosis
NMPTGNQDVQASNPVFG

SEQ ID NO: 1447150 - protein, 8 aa, Mycobacterium tuberculosis
NMSTPTAS

SEQ ID NO: 1447151 - protein, 4 aa, Mycobacterium tuberculosis
NNAA

SEQ ID NO: 1447152 - protein, 18 aa, Mycobacterium tuberculosis
NNGLGSHAGTWRGCGART

SEQ ID NO: 1447153 - protein, 8 aa, Mycobacterium tuberculosis
NNLSGYAN

SEQ ID NO: 1447154 - protein, 5 aa, Mycobacterium tuberculosis
NNNVD

SEQ ID NO: 1447155 - protein, 6 aa, Mycobacterium tuberculosis
NNPELT

SEQ ID NO: 1447156 - protein, 7 aa, Mycobacterium tuberculosis
NNPQFPV

SEQ ID NO: 1447157 - protein, 39 aa, Mycobacterium tuberculosis
NNPTDANPAADRGPQTVAPAPQPPSGGRNGSGGGDLFGG

SEQ ID NO: 1447158 - protein, 9 aa, Mycobacterium tuberculosis
NNPTSTVVG

SEQ ID NO: 1447159 - protein, 24 aa, Mycobacterium tuberculosis
NNQALPPAPPLAPVPPAPPAPPLP

SEQ ID NO: 1447160 - protein, 8 aa, Mycobacterium tuberculosis
NNQRGDLT

SEQ ID NO: 1447161 - protein, 8 aa, Mycobacterium tuberculosis
NNRGKKSV

SEQ ID NO: 1447162 - protein, 22 aa, Mycobacterium tuberculosis
NNSASTVSGSLSAGAVRATGGC

SEQ ID NO: 1447163 - protein, 5 aa, Mycobacterium tuberculosis
NNSPV

SEQ ID NO: 1447164 - protein, 15 aa, Mycobacterium tuberculosis
NNSYGLQQPPRLGAD

SEQ ID NO: 1447165 - protein, 4 aa, Mycobacterium tuberculosis
NPAG

SEQ ID NO: 1447166 - protein, 6 aa, Mycobacterium tuberculosis
NPAGTV

SEQ ID NO: 1447167 - protein, 12 aa, Mycobacterium tuberculosis
NPAKKIERETVR

SEQ ID NO: 1447168 - protein, 11 aa, Mycobacterium tuberculosis
NPAPYTVSQSR

SEQ ID NO: 1447169 - protein, 21 aa, Mycobacterium tuberculosis
NPASAPPEPPDLSASRSAIDS

SEQ ID NO: 1447170 - protein, 17 aa, Mycobacterium tuberculosis
NPATDAQRESMRREPGF

SEQ ID NO: 1447171 - protein, 5 aa, Mycobacterium tuberculosis
NPATG

SEQ ID NO: 1447172 - protein, 16 aa, Mycobacterium tuberculosis
NPAYPYESEAERSAAR

SEQ ID NO: 1447173 - protein, 6 aa, Mycobacterium tuberculosis
NPCGAG

SEQ ID NO: 1447174 - protein, 4 aa, Mycobacterium tuberculosis
NPDA

SEQ ID NO: 1447175 - protein, 7 aa, Mycobacterium tuberculosis
NPDDHTP

SEQ ID NO: 1447176 - protein, 8 aa, Mycobacterium tuberculosis
NPDDHTPV

SEQ ID NO: 1447177 - protein, 24 aa, Mycobacterium tuberculosis
NPDGSKQPVLRNDGTPIPDQVDSV

SEQ ID NO: 1447178 - protein, 4 aa, Mycobacterium tuberculosis
NPDM

SEQ ID NO: 1447179 - protein, 15 aa, Mycobacterium tuberculosis
NPDRPPTATRPGYRQ

SEQ ID NO: 1447180 - protein, 12 aa, Mycobacterium tuberculosis
NPDRRAAGPAAV

SEQ ID NO: 1447181 - protein, 9 aa, Mycobacterium tuberculosis
NPDTPTGRA

SEQ ID NO: 1447182 - protein, 11 aa, Mycobacterium tuberculosis
NPETGKYGPIY

SEQ ID NO: 1447183 - protein, 39 aa, Mycobacterium tuberculosis
NPGAHRGDRRVRSPPRQCRPAPRQPRRATAPAAAADHDD

SEQ ID NO: 1447184 - protein, 15 aa, Mycobacterium tuberculosis
NPGGTGGSGVTGGSE

SEQ ID NO: 1447185 - protein, 7 aa, Mycobacterium tuberculosis
NPGTGNM

SEQ ID NO: 1447186 - protein, 16 aa, Mycobacterium tuberculosis
NPIAGETFASDKGSPL

SEQ ID NO: 1447187 - protein, 5 aa, Mycobacterium tuberculosis
NPNCP

SEQ ID NO: 1447188 - protein, 8 aa, Mycobacterium tuberculosis
NPNNPNGG

SEQ ID NO: 1447189 - protein, 31 aa, Mycobacterium tuberculosis
NPPAPPAPAAPASIPALPPVPPVPPMPPTRD

SEQ ID NO: 1447190 - protein, 7 aa, Mycobacterium tuberculosis
NPPAPRR

SEQ ID NO: 1447191 - protein, 42 aa, Mycobacterium tuberculosis
NPPFPPSPPRPPGAPAPPMPPLPPAPPAPPLPINPALLPAPR

SEQ ID NO: 1447192 - protein, 15 aa, Mycobacterium tuberculosis
NPPLKTSAMPPRTDS

SEQ ID NO: 1447193 - protein, 12 aa, Mycobacterium tuberculosis
NPPPRPETAYGE

SEQ ID NO: 1447194 - protein, 51 aa, Mycobacterium tuberculosis
NPQGERQEHSRRDPVHGRRPLAGDSHDPNDPIATAEQEGTAGTAQEGRRTV

SEQ ID NO: 1447195 - protein, 13 aa, Mycobacterium tuberculosis
NPQPLGGGSRPLR

SEQ ID NO: 1447196 - protein, 7 aa, Mycobacterium tuberculosis
NPRLDRA

SEQ ID NO: 1447197 - protein, 7 aa, Mycobacterium tuberculosis
NPRLPAS

SEQ ID NO: 1447198 - protein, 6 aa, Mycobacterium tuberculosis
NPSAND

SEQ ID NO: 1447199 - protein, 8 aa, Mycobacterium tuberculosis
NPSGRAGG

SEQ ID NO: 1447200 - protein, 8 aa, Mycobacterium tuberculosis
NPSNDTAA

SEQ ID NO: 1447201 - protein, 12 aa, Mycobacterium tuberculosis
NPSNRAGGSLSS

SEQ ID NO: 1447202 - protein, 20 aa, Mycobacterium tuberculosis
NPSPPGEDGRGRNTTIKERQ

SEQ ID NO: 1447203 - protein, 10 aa, Mycobacterium tuberculosis
NPTELSEERG

SEQ ID NO: 1447204 - protein, 12 aa, Mycobacterium tuberculosis
NPTELSEERGWP

SEQ ID NO: 1447205 - protein, 6 aa, Mycobacterium tuberculosis
NPTIAT

SEQ ID NO: 1447206 - protein, 25 aa, Mycobacterium tuberculosis
NPTLPAPELNNPRLPAPEFKPPMPV

SEQ ID NO: 1447207 - protein, 6 aa, Mycobacterium tuberculosis
NPTNTA

SEQ ID NO: 1447208 - protein, 6 aa, Mycobacterium tuberculosis
NPTSRM

SEQ ID NO: 1447209 - protein, 14 aa, Mycobacterium tuberculosis
NPWDDSAHPLTDDQ

SEQ ID NO: 1447210 - protein, 5 aa, Mycobacterium tuberculosis
NQAGQ

SEQ ID NO: 1447211 - protein, 12 aa, Mycobacterium tuberculosis
NQGAGGDGGNGG

SEQ ID NO: 1447212 - protein, 50 aa, Mycobacterium tuberculosis
NQMPQSDHGGQHPDHRRAEHESADQRRDDHRRGAPAPAFDDSGQPTDVGT

SEQ ID NO: 1447213 - protein, 16 aa, Mycobacterium tuberculosis
NQPPGAPSAPVPGAPL

SEQ ID NO: 1447214 - protein, 13 aa, Mycobacterium tuberculosis
NQPQPRPEHVDDL

SEQ ID NO: 1447215 - protein, 14 aa, Mycobacterium tuberculosis
NQQEQAIRVVGVGR

SEQ ID NO: 1447216 - protein, 17 aa, Mycobacterium tuberculosis
NQRGGREGRIRLNTARE

SEQ ID NO: 1447217 - protein, 7 aa, Mycobacterium tuberculosis
NQRQPGV

SEQ ID NO: 1447218 - protein, 5 aa, Mycobacterium tuberculosis
NQRRE

SEQ ID NO: 1447219 - protein, 6 aa, Mycobacterium tuberculosis
NQSETE

SEQ ID NO: 1447220 - protein, 6 aa, Mycobacterium tuberculosis
NQSTAL

SEQ ID NO: 1447221 - protein, 4 aa, Mycobacterium tuberculosis
NQVT

SEQ ID NO: 1447222 - protein, 7 aa, Mycobacterium tuberculosis
NRADPLA

SEQ ID NO: 1447223 - protein, 7 aa, Mycobacterium tuberculosis
NRAGKST

SEQ ID NO: 1447224 - protein, 10 aa, Mycobacterium tuberculosis
NRDELDALSD

SEQ ID NO: 1447225 - protein, 36 aa, Mycobacterium tuberculosis
NRDRSKSSALTSPRWGQRNADRCAATSRWSSKTRWR

SEQ ID NO: 1447226 - protein, 8 aa, Mycobacterium tuberculosis
NREPGAHR

SEQ ID NO: 1447227 - protein, 15 aa, Mycobacterium tuberculosis
NREPSRRELRDGELK

SEQ ID NO: 1447228 - protein, 20 aa, Mycobacterium tuberculosis
NRESVASDQVDHPGRQPGGL

SEQ ID NO: 1447229 - protein, 22 aa, Mycobacterium tuberculosis
NRGGAGPNSPRKNRASPGPSLA

SEQ ID NO: 1447230 - protein, 20 aa, Mycobacterium tuberculosis
NRGPEQRTIRTDAADSGNRA

SEQ ID NO: 1447231 - protein, 18 aa, Mycobacterium tuberculosis
NRGTDAPDEQRSSHRRWN

SEQ ID NO: 1447232 - protein, 6 aa, Mycobacterium tuberculosis
NRGTLG

SEQ ID NO: 1447233 - protein, 4 aa, Mycobacterium tuberculosis
NRHY

SEQ ID NO: 1447234 - protein, 7 aa, Mycobacterium tuberculosis
NRLDTAG

SEQ ID NO: 1447235 - protein, 5 aa, Mycobacterium tuberculosis
NRPAR

SEQ ID NO: 1447236 - protein, 4 aa, Mycobacterium tuberculosis
NRPG

SEQ ID NO: 1447237 - protein, 26 aa, Mycobacterium tuberculosis
NRPGGPGGPGGPGGPGGPGGPGGPGR

SEQ ID NO: 1447238 - protein, 10 aa, Mycobacterium tuberculosis
NRPGQPPVGP

SEQ ID NO: 1447239 - protein, 6 aa, Mycobacterium tuberculosis
NRPPCV

SEQ ID NO: 1447240 - protein, 11 aa, Mycobacterium tuberculosis
NRQKDAATAQT

SEQ ID NO: 1447241 - protein, 14 aa, Mycobacterium tuberculosis
NRQPLRPAQPPDLG

SEQ ID NO: 1447242 - protein, 12 aa, Mycobacterium tuberculosis
NRRAPRISHHSQ

SEQ ID NO: 1447243 - protein, 26 aa, Mycobacterium tuberculosis
NRRPAGSDCRAPHPAVPGPNRRPEGP

SEQ ID NO: 1447244 - protein, 14 aa, Mycobacterium tuberculosis
NRRPAGSDCRAPHR

SEQ ID NO: 1447245 - protein, 4 aa, Mycobacterium tuberculosis
NRRR

SEQ ID NO: 1447246 - protein, 6 aa, Mycobacterium tuberculosis
NRRRAS

SEQ ID NO: 1447247 - protein, 10 aa, Mycobacterium tuberculosis
NRRRRQRRPR

SEQ ID NO: 1447248 - protein, 21 aa, Mycobacterium tuberculosis
NRRSAANPLGNPGGVAARASS

SEQ ID NO: 1447249 - protein, 14 aa, Mycobacterium tuberculosis
NRRSTPDSCLPSST

SEQ ID NO: 1447250 - protein, 6 aa, Mycobacterium tuberculosis
NRSDNG

SEQ ID NO: 1447251 - protein, 14 aa, Mycobacterium tuberculosis
NRSNLGELRPGSRV

SEQ ID NO: 1447252 - protein, 29 aa, Mycobacterium tuberculosis
NRSSSNSVEESEIGVPSRVGGDPRRQIAP

SEQ ID NO: 1447253 - protein, 7 aa, Mycobacterium tuberculosis
NRSTAVG

SEQ ID NO: 1447254 - protein, 10 aa, Mycobacterium tuberculosis
NRTHSADSRA

SEQ ID NO: 1447255 - protein, 9 aa, Mycobacterium tuberculosis
NRWPDKPGR

SEQ ID NO: 1447256 - protein, 25 aa, Mycobacterium tuberculosis
NSAAQARKAVGTGVRKKTPEPDCDD

SEQ ID NO: 1447257 - protein, 58 aa, Mycobacterium tuberculosis
NSAAQARKAVGTGVRKKTPEPDSAEAPAAAAAPRGTGSTAAASAAKDQTARPRFTNTW

SEQ ID NO: 1447258 - protein, 58 aa, Mycobacterium tuberculosis
NSAAQARKAVGTGVRKKTSGTRQRRGPSGRGGAPSNRFNRSGVGRPKIKQLGRGYDTW

SEQ ID NO: 1447259 - protein, 9 aa, Mycobacterium tuberculosis
NSDAQRSDA

SEQ ID NO: 1447260 - protein, 15 aa, Mycobacterium tuberculosis
NSDCPSSAGNHRQAT

SEQ ID NO: 1447261 - protein, 5 aa, Mycobacterium tuberculosis
NSDGS

SEQ ID NO: 1447262 - protein, 6 aa, Mycobacterium tuberculosis
NSERIR

SEQ ID NO: 1447263 - protein, 19 aa, Mycobacterium tuberculosis
NSGAGSASGFGNFGAPRRA

SEQ ID NO: 1447264 - protein, 13 aa, Mycobacterium tuberculosis
NSGDGGAAGNGAG

SEQ ID NO: 1447265 - protein, 34 aa, Mycobacterium tuberculosis
NSGDGGAAGNGAGISQNGPASGFGGNGGHAGTTG

SEQ ID NO: 1447266 - protein, 64 aa, Mycobacterium tuberculosis
NSGDGGAAGNGAGISQNGPASGFGGNGGHAGTTGLIGNGGNGGAGGAGGDVSADFGGVRVWRAR

SEQ ID NO: 1447267 - protein, 22 aa, Mycobacterium tuberculosis
NSGLTAGAAGLGTRGSAMPAAP

SEQ ID NO: 1447268 - protein, 19 aa, Mycobacterium tuberculosis
NSGRMNRPGMSGDSSSWKG

SEQ ID NO: 1447269 - protein, 12 aa, Mycobacterium tuberculosis
NSGRVGTARPRS

SEQ ID NO: 1447270 - protein, 19 aa, Mycobacterium tuberculosis
NSGSFNTGLGNTGSTNTSL

SEQ ID NO: 1447271 - protein, 16 aa, Mycobacterium tuberculosis
NSGSGNIGSGNSGTNN

SEQ ID NO: 1447272 - protein, 6 aa, Mycobacterium tuberculosis
NSHGTH

SEQ ID NO: 1447273 - protein, 7 aa, Mycobacterium tuberculosis
NSLRGVP

SEQ ID NO: 1447274 - protein, 8 aa, Mycobacterium tuberculosis
NSLTPDVR

SEQ ID NO: 1447275 - protein, 10 aa, Mycobacterium tuberculosis
NSNARLGPSG

SEQ ID NO: 1447276 - protein, 8 aa, Mycobacterium tuberculosis
NSPGHSAR

SEQ ID NO: 1447277 - protein, 24 aa, Mycobacterium tuberculosis
NSPRGPKQRPKPWPPTPAPPPPMP

SEQ ID NO: 1447278 - protein, 5 aa, Mycobacterium tuberculosis
NSPRK

SEQ ID NO: 1447279 - protein, 4 aa, Mycobacterium tuberculosis
NSPS

SEQ ID NO: 1447280 - protein, 9 aa, Mycobacterium tuberculosis
NSRADDDCA

SEQ ID NO: 1447281 - protein, 8 aa, Mycobacterium tuberculosis
NSRQLGTA

SEQ ID NO: 1447282 - protein, 16 aa, Mycobacterium tuberculosis
NSRSGKRDGKRMGFSP

SEQ ID NO: 1447283 - protein, 9 aa, Mycobacterium tuberculosis
NSSATPSSG

SEQ ID NO: 1447284 - protein, 9 aa, Mycobacterium tuberculosis
NSSDWPEGK

SEQ ID NO: 1447285 - protein, 26 aa, Mycobacterium tuberculosis
NSSGNRTASSLRDNPAYRDWLIPQSY

SEQ ID NO: 1447286 - protein, 7 aa, Mycobacterium tuberculosis
NSSPARS

SEQ ID NO: 1447287 - protein, 15 aa, Mycobacterium tuberculosis
NSSVGGDGGNGGNAY

SEQ ID NO: 1447288 - protein, 6 aa, Mycobacterium tuberculosis
NSTASI

SEQ ID NO: 1447289 - protein, 4 aa, Mycobacterium tuberculosis
NSTL

SEQ ID NO: 1447290 - protein, 9 aa, Mycobacterium tuberculosis
NSTPLTDGA

SEQ ID NO: 1447291 - protein, 16 aa, Mycobacterium tuberculosis
NSVASTGWIAKCVSVS

SEQ ID NO: 1447292 - protein, 17 aa, Mycobacterium tuberculosis
NSVPPVPPAAPAPPVPG

SEQ ID NO: 1447293 - protein, 19 aa, Mycobacterium tuberculosis
NSWPATTNPDAEGKRPPEC

SEQ ID NO: 1447294 - protein, 7 aa, Mycobacterium tuberculosis
NTAADQL

SEQ ID NO: 1447295 - protein, 13 aa, Mycobacterium tuberculosis
NTAEQNAANAGKE

SEQ ID NO: 1447296 - protein, 9 aa, Mycobacterium tuberculosis
NTEPAAGSV

SEQ ID NO: 1447297 - protein, 30 aa, Mycobacterium tuberculosis; identical to SEQ ID NO: 6024

SEQ ID NO: 1447298 - protein, 5 aa, Mycobacterium tuberculosis
NTGDR

SEQ ID NO: 1447299 - protein, 7 aa, Mycobacterium tuberculosis
NTGEPDV

SEQ ID NO: 1447300 - protein, 8 aa, Mycobacterium tuberculosis
NTGHRGQR

SEQ ID NO: 1447301 - protein, 15 aa, Mycobacterium tuberculosis
NTGHYNTGSFNAGSF

SEQ ID NO: 1447302 - protein, 15 aa, Mycobacterium tuberculosis
NTGLANAGSYNTGSF

SEQ ID NO: 1447303 - protein, 14 aa, Mycobacterium tuberculosis
NTGNGNSGFSNAGP

SEQ ID NO: 1447304 - protein, 7 aa, Mycobacterium tuberculosis
NTGSNNL

SEQ ID NO: 1447305 - protein, 19 aa, Mycobacterium tuberculosis
NTGTATSDRAGRDHRTGIG

SEQ ID NO: 1447306 - protein, 6 aa, Mycobacterium tuberculosis
NTHPRG

SEQ ID NO: 1447307 - protein, 8 aa, Mycobacterium tuberculosis
NTKPGQEV

SEQ ID NO: 1447308 - protein, 4 aa, Mycobacterium tuberculosis
NTLN

SEQ ID NO: 1447309 - protein, 4 aa, Mycobacterium tuberculosis
NTLR

SEQ ID NO: 1447310 - protein, 10 aa, Mycobacterium tuberculosis
NTPGGRTQFD

SEQ ID NO: 1447311 - protein, 7 aa, Mycobacterium tuberculosis
NTQRRAA

SEQ ID NO: 1447312 - protein, 15 aa, Mycobacterium tuberculosis
NTRSRRSQWKAAKTE

SEQ ID NO: 1447313 - protein, 7 aa, Mycobacterium tuberculosis
NTSTGTT

SEQ ID NO: 1447314 - protein, 7 aa, Mycobacterium tuberculosis
NTTAIRR

SEQ ID NO: 1447315 - protein, 8 aa, Mycobacterium tuberculosis
NTTGNRQR

SEQ ID NO: 1447316 - protein, 9 aa, Mycobacterium tuberculosis
NTTTPARTA

SEQ ID NO: 1447317 - protein, 5 aa, Mycobacterium tuberculosis
NTTVA

SEQ ID NO: 1447318 - protein, 28 aa, Mycobacterium tuberculosis
NTTVSRDGLTTPGVDRLGPGAISGPPLA

SEQ ID NO: 1447319 - protein, 5 aa, Mycobacterium tuberculosis
NTVTM

SEQ ID NO: 1447320 - protein, 12 aa, Mycobacterium tuberculosis
NVGELRQGDRTG

SEQ ID NO: 1447321 - protein, 4 aa, Mycobacterium tuberculosis
NVGN

SEQ ID NO: 1447322 - protein, 6 aa, Mycobacterium tuberculosis
NVGPNE

SEQ ID NO: 1447323 - protein, 12 aa, Mycobacterium tuberculosis
NVGTGNLGFANV

SEQ ID NO: 1447324 - protein, 31 aa, Mycobacterium tuberculosis
NVGYPQSGRHPCGRAPPRPSLRRRNRGKSRR

SEQ ID NO: 1447325 - protein, 13 aa, Mycobacterium tuberculosis
NVNDGTRRNGFPP

SEQ ID NO: 1447326 - protein, 14 aa, Mycobacterium tuberculosis
NVPAAQAIPPPSVD

SEQ ID NO: 1447327 - protein, 5 aa, Mycobacterium tuberculosis
NVSTE

SEQ ID NO: 1447328 - protein, 20 aa, Mycobacterium tuberculosis
NWKGDPNATVPGLGSGQDIP

SEQ ID NO: 1447329 - protein, 13 aa, Mycobacterium tuberculosis
NWRRPTRVRANVS

SEQ ID NO: 1447330 - protein, 5 aa, Mycobacterium tuberculosis
NYRGS

SEQ ID NO: 1447331 - protein, 6 aa, Mycobacterium tuberculosis
NYRGSM

SEQ ID NO: 1447332 - protein, 5 aa, Mycobacterium tuberculosis
NYTQR

SEQ ID NO: 1447333 - protein, 10 aa, Mycobacterium tuberculosis
PAAADSTDEG

SEQ ID NO: 1447334 - protein, 16 aa, Mycobacterium tuberculosis
PAAAQTGSKAIPPTET

SEQ ID NO: 1447335 - protein, 35 aa, Mycobacterium tuberculosis
PAAATGAPTGGGGLAPPEPGAGRRRGHLRVLPDPA

SEQ ID NO: 1447336 - protein, 7 aa, Mycobacterium tuberculosis
PAADPVS

SEQ ID NO: 1447337 - protein, 9 aa, Mycobacterium tuberculosis
PAADTPDSC

SEQ ID NO: 1447338 - protein, 13 aa, Mycobacterium tuberculosis
PAAEDVPGVPDVS

SEQ ID NO: 1447339 - protein, 21 aa, Mycobacterium tuberculosis
PAAEQGRRRRGGADRTPRRVG

SEQ ID NO: 1447340 - protein, 6 aa, Mycobacterium tuberculosis
PAAESM

SEQ ID NO: 1447341 - protein, 8 aa, Mycobacterium tuberculosis
PAAGEPEL

SEQ ID NO: 1447342 - protein, 12 aa, Mycobacterium tuberculosis
PAAGGDGPADVG

SEQ ID NO: 1447343 - protein, 8 aa, Mycobacterium tuberculosis
PAAGLSTF

SEQ ID NO: 1447344 - protein, 11 aa, Mycobacterium tuberculosis
PAAGPASPADP

SEQ ID NO: 1447345 - protein, 7 aa, Mycobacterium tuberculosis
PAAGSSW

SEQ ID NO: 1447346 - protein, 39 aa, Mycobacterium tuberculosis
PAALPPAPPAPPTDPNSMPVPPAPPAPPSPINPPVPPVR

SEQ ID NO: 1447347 - protein, 15 aa, Mycobacterium tuberculosis
PAAMGTSTAGQVSIS

SEQ ID NO: 1447348 - protein, 26 aa, Mycobacterium tuberculosis
PAAMGTSTAGQVSISSPGDPDRRAQG

SEQ ID NO: 1447349 - protein, 23 aa, Mycobacterium tuberculosis
PAAPAAGAGRPAAGLRRAASRRV

SEQ ID NO: 1447350 - protein, 9 aa, Mycobacterium tuberculosis
PAAPAAPAG

SEQ ID NO: 1447351 - protein, 9 aa, Mycobacterium tuberculosis
PAAPAVPAV

SEQ ID NO: 1447352 - protein, 26 aa, Mycobacterium tuberculosis
PAAPPEAPLPPFPPLPNSRALPPALP

SEQ ID NO: 1447353 - protein, 36 aa, Mycobacterium tuberculosis
PAAPTTPPVPPVPAAPPAPPAPALPPVPPAPPSAPI

SEQ ID NO: 1447354 - protein, 29 aa, Mycobacterium tuberculosis
PAARNPASTRIGGGGLAGRSGDPDNRQPL

SEQ ID NO: 1447355 - protein, 30 aa, Mycobacterium tuberculosis
PAARSPISGTAVKAGGAGVPRNNNSQERYP

SEQ ID NO: 1447356 - protein, 24 aa, Mycobacterium tuberculosis
PAASAAPPCSSGPAARVASAPTAW

SEQ ID NO: 1447357 - protein, 12 aa, Mycobacterium tuberculosis
PAASAARGAWTS

SEQ ID NO: 1447358 - protein, 29 aa, Mycobacterium tuberculosis
PAASAGGGGRGTTAIGGDGGAGGAGGAGG

SEQ ID NO: 1447359 - protein, 13 aa, Mycobacterium tuberculosis
PAASAPITVGADT

SEQ ID NO: 1447360 - protein, 15 aa, Mycobacterium tuberculosis
PAASVATAGKGGFAD

SEQ ID NO: 1447361 - protein, 79 aa, Mycobacterium tuberculosis
PAATAATAGPGRPPKGKDGLGGNGGAGGNGGVSTTGGDGGAGGKGGNGGDGGNVGLGGDAGSGGAGGNGGIGTDAGGAG

SEQ ID NO: 1447362 - protein, 10 aa, Mycobacterium tuberculosis
PAATAGPGGN

SEQ ID NO: 1447363 - protein, 6 aa, Mycobacterium tuberculosis
PAATGA

SEQ ID NO: 1447364 - protein, 9 aa, Mycobacterium tuberculosis
PAATPPGPL

SEQ ID NO: 1447365 - protein, 9 aa, Mycobacterium tuberculosis
PAATTIPGR

SEQ ID NO: 1447366 - protein, 17 aa, Mycobacterium tuberculosis
PAATTPANITVGAFSLP

SEQ ID NO: 1447367 - protein, 10 aa, Mycobacterium tuberculosis
PADEATAAGE

SEQ ID NO: 1447368 - protein, 4 aa, Mycobacterium tuberculosis
PADF

SEQ ID NO: 1447369 - protein, 5 aa, Mycobacterium tuberculosis
PADGR

SEQ ID NO: 1447370 - protein, 12 aa, Mycobacterium tuberculosis
PADIERAAADRA

SEQ ID NO: 1447371 - protein, 6 aa, Mycobacterium tuberculosis
PADNQI

SEQ ID NO: 1447372 - protein, 12 aa, Mycobacterium tuberculosis
PADTREQDPHDQ

SEQ ID NO: 1447373 - protein, 5 aa, Mycobacterium tuberculosis
PADVE

SEQ ID NO: 1447374 - protein, 4 aa, Mycobacterium tuberculosis
PAEA

SEQ ID NO: 1447375 - protein, 4 aa, Mycobacterium tuberculosis
PAEP

SEQ ID NO: 1447376 - protein, 195 aa, Mycobacterium tuberculosis
PAEPASATGSEQPAGPTRPTSPTGTAGPAGPASAAASEQPSGPTRPTNPTGTAGPGSPASTADPAAGEQPTSPTGAAGPTGARRCEPAEPAAAAAGEQPAGPTGATGPTSCAGTAGTPGPAGPTGTEQQGSPACPTGPSDDTRDRGVSTGPAGTSDTDQPRGPAGPTDGAGRPGPAGPAVADQPPAGPPGAPVPG

SEQ ID NO: 1447377 - protein, 15 aa, Mycobacterium tuberculosis
PAEPDGADDEEADHP

SEQ ID NO: 1447378 - protein, 46 aa, Mycobacterium tuberculosis
PAETAATPAKCSATAGPAEPAARAAPGSGTKAGGTGSDGGHGGQRH

SEQ ID NO: 1447379 - protein, 4 aa, Mycobacterium tuberculosis
PAEV

SEQ ID NO: 1447380 - protein, 5 aa, Mycobacterium tuberculosis
PAEVA

SEQ ID NO: 1447381 - protein, 18 aa, Mycobacterium tuberculosis
PAEVAEAGPESPADPEIE

SEQ ID NO: 1447382 - protein, 4 aa, Mycobacterium tuberculosis
PAFA

SEQ ID NO: 1447383 - protein, 4 aa, Mycobacterium tuberculosis
PAFG

SEQ ID NO: 1447384 - protein, 15 aa, Mycobacterium tuberculosis
PAFPPVPPLAPTPPV

SEQ ID NO: 1447385 - protein, 20 aa, Mycobacterium tuberculosis
PAFRGDGTITAGSASQISDG

SEQ ID NO: 1447386 - protein, 11 aa, Mycobacterium tuberculosis
PAFRPNGTVTA

SEQ ID NO: 1447387 - protein, 13 aa, Mycobacterium tuberculosis
PAFRPNGTVTAGN

SEQ ID NO: 1447388 - protein, 5 aa, Mycobacterium tuberculosis
PAFSS

SEQ ID NO: 1447389 - protein, 15 aa, Mycobacterium tuberculosis
PAGEVDRGDERKTSR

SEQ ID NO: 1447390 - protein, 13 aa, Mycobacterium tuberculosis
PAGLPRRQGPPPH

SEQ ID NO: 1447391 - protein, 5 aa, Mycobacterium tuberculosis
PAGPA

SEQ ID NO: 1447392 - protein, 6 aa, Mycobacterium tuberculosis
PAGPAA

SEQ ID NO: 1447393 - protein, 10 aa, Mycobacterium tuberculosis
PAGPAAPAPM

SEQ ID NO: 1447394 - protein, 8 aa, Mycobacterium tuberculosis
PAGPGDDE

SEQ ID NO: 1447395 - protein, 28 aa, Mycobacterium tuberculosis
PAGPGGAGTNGGVGGSGGFVYGKRRRRR

SEQ ID NO: 1447396 - protein, 14 aa, Mycobacterium tuberculosis
PAGPGLRRGGVPPV

SEQ ID NO: 1447397 - protein, 9 aa, Mycobacterium tuberculosis
PAGPGVGPG

SEQ ID NO: 1447398 - protein, 7 aa, Mycobacterium tuberculosis
PAGPGYF

SEQ ID NO: 1447399 - protein, 16 aa, Mycobacterium tuberculosis
PAGPPSPGGPWWPQTS

SEQ ID NO: 1447400 - protein, 14 aa, Mycobacterium tuberculosis
PAGRSHSVSAGPAI

SEQ ID NO: 1447401 - protein, 7 aa, Mycobacterium tuberculosis
PAGSARR

SEQ ID NO: 1447402 - protein, 11 aa, Mycobacterium tuberculosis
PAGSKSRSHAA

SEQ ID NO: 1447403 - protein, 13 aa, Mycobacterium tuberculosis
PAGSPSSVPDDLD

SEQ ID NO: 1447404 - protein, 13 aa, Mycobacterium tuberculosis
PAGTGGAGGPRGD

SEQ ID NO: 1447405 - protein, 17 aa, Mycobacterium tuberculosis
PAGTLPDGGPFTEAGDK

SEQ ID NO: 1447406 - protein, 22 aa, Mycobacterium tuberculosis
PAGTTAATAVGEAGLPRRDTPD

SEQ ID NO: 1447407 - protein, 22 aa, Mycobacterium tuberculosis
PAHPPALPDPLPGWPDPGAYRW

SEQ ID NO: 1447408 - protein, 9 aa, Mycobacterium tuberculosis
PAHRPSSQA

SEQ ID NO: 1447409 - protein, 25 aa, Mycobacterium tuberculosis
PAIPAAQRNVPAGTGGAGGAGRRRP

SEQ ID NO: 1447410 - protein, 9 aa, Mycobacterium tuberculosis
PAIPTPTSP

SEQ ID NO: 1447411 - protein, 24 aa, Mycobacterium tuberculosis
PAKAPQGDSGRRRRAGARALPQPL

SEQ ID NO: 1447412 - protein, 5 aa, Mycobacterium tuberculosis
PAKGR

SEQ ID NO: 1447413 - protein, 11 aa, Mycobacterium tuberculosis
PAKLSGGQRQR

SEQ ID NO: 1447414 - protein, 10 aa, Mycobacterium tuberculosis
PAKSVAAAAS

SEQ ID NO: 1447415 - protein, 15 aa, Mycobacterium tuberculosis
PAKSVATAASASGIV

SEQ ID NO: 1447416 - protein, 12 aa, Mycobacterium tuberculosis
PAKTPNQKRDRI

SEQ ID NO: 1447417 - protein, 9 aa, Mycobacterium tuberculosis
PALGSTPDN

SEQ ID NO: 1447418 - protein, 15 aa, Mycobacterium tuberculosis
PALNPGSALRSTQVG

SEQ ID NO: 1447419 - protein, 4 aa, Mycobacterium tuberculosis
PALP

SEQ ID NO: 1447420 - protein, 15 aa, Mycobacterium tuberculosis
PALPPTPPAPPVSPT

SEQ ID NO: 1447421 - protein, 4 aa, Mycobacterium tuberculosis
PALQ

SEQ ID NO: 1447422 - protein, 4 aa, Mycobacterium tuberculosis
PANA

SEQ ID NO: 1447423 - protein, 14 aa, Mycobacterium tuberculosis
PANAGNGGHGGSAA

SEQ ID NO: 1447424 - protein, 11 aa, Mycobacterium tuberculosis
PANATAKIGQT

SEQ ID NO: 1447425 - protein, 24 aa, Mycobacterium tuberculosis
PAPAPTTSAAPTAPSTPGSSAAQG

SEQ ID NO: 1447426 - protein, 15 aa, Mycobacterium tuberculosis
PAPAVTRRGPPAPIS

SEQ ID NO: 1447427 - protein, 5 aa, Mycobacterium tuberculosis
PAPDD

SEQ ID NO: 1447428 - protein, 11 aa, Mycobacterium tuberculosis
PAPKPSTRIGH

SEQ ID NO: 1447429 - protein, 6 aa, Mycobacterium tuberculosis
PAPLGA

SEQ ID NO: 1447430 - protein, 17 aa, Mycobacterium tuberculosis
PAPNSMADPPAPPAPPI

SEQ ID NO: 1447431 - protein, 14 aa, Mycobacterium tuberculosis
PAPPAPPAPPLPPG

SEQ ID NO: 1447432 - protein, 9 aa, Mycobacterium tuberculosis
PAPPAPPLP

SEQ ID NO: 1447433 - protein, 54 aa, Mycobacterium tuberculosis
PAPPAPPSVPAVPPAPPLPPVPSLPSSDSPSPPCPPTPPASPTPPAGPGPPFPP

SEQ ID NO: 1447434 - protein, 14 aa, Mycobacterium tuberculosis
PAPPAPPWPPAPIS

SEQ ID NO: 1447435 - protein, 7 aa, Mycobacterium tuberculosis
PAPPLPP

SEQ ID NO: 1447436 - protein, 26 aa, Mycobacterium tuberculosis
PAPPLPPLPPSPPVPAADPPLPPMPP

SEQ ID NO: 1447437 - protein, 32 aa, Mycobacterium tuberculosis
PAPPLTPAAPDPPAPPLPINQPPSPPLAPVPG

SEQ ID NO: 1447438 - protein, 13 aa, Mycobacterium tuberculosis
PAPPPDGVGVAFG

SEQ ID NO: 1447439 - protein, 9 aa, Mycobacterium tuberculosis
PAPPRRGGH

SEQ ID NO: 1447440 - protein, 16 aa, Mycobacterium tuberculosis
PAPPSPPPPPAPPVPP

SEQ ID NO: 1447441 - protein, 9 aa, Mycobacterium tuberculosis
PAPPTPPLL

SEQ ID NO: 1447442 - protein, 25 aa, Mycobacterium tuberculosis
PAPPVPPAPPAPGSPPWPPAPPAPA

SEQ ID NO: 1447443 - protein, 49 aa, Mycobacterium tuberculosis
PAPPVPSSSPPRPPLPPKPPAPPTSAEAPTPPSPPAPPLPPVELPPGGL

SEQ ID NO: 1447444 - protein, 12 aa, Mycobacterium tuberculosis
PAPPWPPAPALP

SEQ ID NO: 1447445 - protein, 10 aa, Mycobacterium tuberculosis
PAPQATGPGC

SEQ ID NO: 1447446 - protein, 45 aa, Mycobacterium tuberculosis
PAPQAVPRPSAAAAEPKHQPAREPETGAGPPPPASERTPRGPRFG

SEQ ID NO: 1447447 - protein, 28 aa, Mycobacterium tuberculosis
PAPRRQNLPPAPRRSATPVGVPSDASTP

SEQ ID NO: 1447448 - protein, 9 aa, Mycobacterium tuberculosis
PAPSRTPSF

SEQ ID NO: 1447449 - protein, 22 aa, Mycobacterium tuberculosis
PAPTERHRPPTTPNKWPSRSPT

SEQ ID NO: 1447450 - protein, 7 aa, Mycobacterium tuberculosis
PAPTPQQ

SEQ ID NO: 1447451 - protein, 13 aa, Mycobacterium tuberculosis
PAPTRRWGGKRHR

SEQ ID NO: 1447452 - protein, 7 aa, Mycobacterium tuberculosis
PAPTTPT

SEQ ID NO: 1447453 - protein, 4 aa, Mycobacterium tuberculosis
PAPV

SEQ ID NO: 1447454 - protein, 13 aa, Mycobacterium tuberculosis
PAPVEPQGPRCGR

SEQ ID NO: 1447455 - protein, 5 aa, Mycobacterium tuberculosis
PAPVT

SEQ ID NO: 1447456 - protein, 27 aa, Mycobacterium tuberculosis
PAQARDSGGDAGWGVQGGARRQVHRRG

SEQ ID NO: 1447457 - protein, 6 aa, Mycobacterium tuberculosis
PAQGTL

SEQ ID NO: 1447458 - protein, 4 aa, Mycobacterium tuberculosis
PAQL

SEQ ID NO: 1447459 - protein, 7 aa, Mycobacterium tuberculosis
PAQPGAA

SEQ ID NO: 1447460 - protein, 8 aa, Mycobacterium tuberculosis
PAQPVDDG

SEQ ID NO: 1447461 - protein, 9 aa, Mycobacterium tuberculosis
PAQTTAEPC

SEQ ID NO: 1447462 - protein, 13 aa, Mycobacterium tuberculosis
PARAARVLGFPRG

SEQ ID NO: 1447463 - protein, 11 aa, Mycobacterium tuberculosis
PARAGRRSAVA

SEQ ID NO: 1447464 - protein, 15 aa, Mycobacterium tuberculosis
PARARKPKDKPRVER

SEQ ID NO: 1447465 - protein, 13 aa, Mycobacterium tuberculosis
PARNSDGAPGHSA

SEQ ID NO: 1447466 - protein, 15 aa, Mycobacterium tuberculosis
PARPERSTSEPTASS

SEQ ID NO: 1447467 - protein, 11 aa, Mycobacterium tuberculosis
PARPPKPTWPA

SEQ ID NO: 1447468 - protein, 51 aa, Mycobacterium tuberculosis
PARPTGGTGGDGATATAGSGKATGGAGGDGGTAAAGGGGGNGGDGGVAQGD

SEQ ID NO: 1447469 - protein, 4 aa, Mycobacterium tuberculosis
PARR

SEQ ID NO: 1447470 - protein, 14 aa, Mycobacterium tuberculosis
PARRPSRESSGCSR

SEQ ID NO: 1447471 - protein, 20 aa, Mycobacterium tuberculosis
PARRSLRSNARDRCQAGTRT

SEQ ID NO: 1447472 - protein, 18 aa, Mycobacterium tuberculosis
PARTARKEGQDQGEALTG

SEQ ID NO: 1447473 - protein, 19 aa, Mycobacterium tuberculosis
PARTTASRCPAVDQSEAVD

SEQ ID NO: 1447474 - protein, 21 aa, Mycobacterium tuberculosis
PARVASKRSPSGNTSAPPGWR

SEQ ID NO: 1447475 - protein, 4 aa, Mycobacterium tuberculosis
PASC

SEQ ID NO: 1447476 - protein, 34 aa, Mycobacterium tuberculosis
PASDTERSGLGFRPGSSAPANSAKASRANSPACP

SEQ ID NO: 1447477 - protein, 14 aa, Mycobacterium tuberculosis
PASERRADMDGGDI

SEQ ID NO: 1447478 - protein, 11 aa, Mycobacterium tuberculosis
PASNRRLTDYD

SEQ ID NO: 1447479 - protein, 42 aa, Mycobacterium tuberculosis
PASPASPPAPPLPPVPPPLPPAPPAPPLAPPPPLPPAPPVPL

SEQ ID NO: 1447480 - protein, 13 aa, Mycobacterium tuberculosis
PASSNTTTTGRER

SEQ ID NO: 1447481 - protein, 4 aa, Mycobacterium tuberculosis
PASV

SEQ ID NO: 1447482 - protein, 18 aa, Mycobacterium tuberculosis
PATAGGTVGPARKSQGQA

SEQ ID NO: 1447483 - protein, 12 aa, Mycobacterium tuberculosis
PATAPLNPTSMG

SEQ ID NO: 1447484 - protein, 7 aa, Mycobacterium tuberculosis
PATDDRC

SEQ ID NO: 1447485 - protein, 9 aa, Mycobacterium tuberculosis
PATDSTSPE

SEQ ID NO: 1447486 - protein, 90 aa, Mycobacterium tuberculosis
PATLTGPDRPLPPSPPAPPVPHSPADPPAPPLPPATPGITDVPPAPPAPPLPYSHPPAPPLPPAAPAPPPPPAPPLPISPAAPPLPPDTP

SEQ ID NO: 1447487 - protein, 12 aa, Mycobacterium tuberculosis
PATPAGPAGAGV

SEQ ID NO: 1447488 - protein, 6 aa, Mycobacterium tuberculosis
PATPRM

SEQ ID NO: 1447489 - protein, 15 aa, Mycobacterium tuberculosis
PATPSAAPQAPAVGA

SEQ ID NO: 1447490 - protein, 14 aa, Mycobacterium tuberculosis
PATPSAAPQHPPSV

SEQ ID NO: 1447491 - protein, 28 aa, Mycobacterium tuberculosis
PATSGCSTPGPGTSGCSTRAASTPASAM

SEQ ID NO: 1447492 - protein, 30 aa, Mycobacterium tuberculosis
PATSGSSTPGPATSGCSTPAASTPASAIAE

SEQ ID NO: 1447493 - protein, 18 aa, Mycobacterium tuberculosis
PATSPTPNRTAGRSARPP

SEQ ID NO: 1447494 - protein, 7 aa, Mycobacterium tuberculosis
PATSSPA

SEQ ID NO: 1447495 - protein, 10 aa, Mycobacterium tuberculosis
PATVTSSWTD

SEQ ID NO: 1447496 - protein, 10 aa, Mycobacterium tuberculosis
PAVAAEPTRR

SEQ ID NO: 1447497 - protein, 11 aa, Mycobacterium tuberculosis
PAVGGGPAQHL

SEQ ID NO: 1447498 - protein, 10 aa, Mycobacterium tuberculosis
PAVGSPAPAF

SEQ ID NO: 1447499 - protein, 4 aa, Mycobacterium tuberculosis
PAVN

SEQ ID NO: 1447500 - protein, 32 aa, Mycobacterium tuberculosis
PAVPDRGHRLGESVRGRGPLGNRRGQRDRGMR

SEQ ID NO: 1447501 - protein, 14 aa, Mycobacterium tuberculosis
PAVPPAPPLPPLPP

SEQ ID NO: 1447502 - protein, 14 aa, Mycobacterium tuberculosis
PAVTAGKAGTAAAS

SEQ ID NO: 1447503 - protein, 16 aa, Mycobacterium tuberculosis
PAVTEPPQPIPFSGPA

SEQ ID NO: 1447504 - protein, 12 aa, Mycobacterium tuberculosis
PAVTGGEGPRLD

SEQ ID NO: 1447505 - protein, 11 aa, Mycobacterium tuberculosis
PAWAESSTSHY

SEQ ID NO: 1447506 - protein, 5 aa, Mycobacterium tuberculosis
PAWAG

SEQ ID NO: 1447507 - protein, 32 aa, Mycobacterium tuberculosis
PAYTGPSAGDLPAATGTGAPVPPTPQRRQPTR

SEQ ID NO: 1447508 - protein, 16 aa, Mycobacterium tuberculosis
PAYTPPGWRQPPTRRD

SEQ ID NO: 1447509 - protein, 39 aa, Mycobacterium tuberculosis
PCGSPRSGLSEGQAGAHTRLGGARGGMGLGTPPRQTLQY

SEQ ID NO: 1447510 - protein, 21 aa, Mycobacterium tuberculosis
PCKGLRGKGRLTDADIDATTR

SEQ ID NO: 1447511 - protein, 74 aa, Mycobacterium tuberculosis; identical to SEQ ID NO: 152707

SEQ ID NO: 1447512 - protein, 12 aa, Mycobacterium tuberculosis
PCPPDGRGWPGT

SEQ ID NO: 1447513 - protein, 42 aa, Mycobacterium tuberculosis
PCPREVSGSQRGSSEFGSSRGSSWSGPSSVGSCGSGSKCADA

SEQ ID NO: 1447514 - protein, 7 aa, Mycobacterium tuberculosis
PCRPGVA

SEQ ID NO: 1447515 - protein, 43 aa, Mycobacterium tuberculosis
PCRTGRGKRRPSAADCGRRPGGRGEHASTVDRSGGKSARGRCG

SEQ ID NO: 1447516 - protein, 8 aa, Mycobacterium tuberculosis
PDAARSLG

SEQ ID NO: 1447517 - protein, 15 aa, Mycobacterium tuberculosis
PDAASRGVVDAPEDA

SEQ ID NO: 1447518 - protein, 9 aa, Mycobacterium tuberculosis
PDADGNNVS

SEQ ID NO: 1447519 - protein, 8 aa, Mycobacterium tuberculosis
PDADGPRD

SEQ ID NO: 1447520 - protein, 7 aa, Mycobacterium tuberculosis
PDADGVL

SEQ ID NO: 1447521 - protein, 5 aa, Mycobacterium tuberculosis
PDAES

SEQ ID NO: 1447522 - protein, 10 aa, Mycobacterium tuberculosis
PDAGNPASFG

SEQ ID NO: 1447523 - protein, 9 aa, Mycobacterium tuberculosis
PDAPGGVRG

SEQ ID NO: 1447524 - protein, 7 aa, Mycobacterium tuberculosis
PDASTVR

SEQ ID NO: 1447525 - protein, 4 aa, Mycobacterium tuberculosis
PDAT

SEQ ID NO: 1447526 - protein, 6 aa, Mycobacterium tuberculosis
PDATEL

SEQ ID NO: 1447527 - protein, 15 aa, Mycobacterium tuberculosis
PDDDGSDGAAKARAY

SEQ ID NO: 1447528 - protein, 13 aa, Mycobacterium tuberculosis
PDEAAAPAAAGLG

SEQ ID NO: 1447529 - protein, 8 aa, Mycobacterium tuberculosis
PDEFGEPY

SEQ ID NO: 1447530 - protein, 7 aa, Mycobacterium tuberculosis
PDELDEG

SEQ ID NO: 1447531 - protein, 5 aa, Mycobacterium tuberculosis
PDEND

SEQ ID NO: 1447532 - protein, 9 aa, Mycobacterium tuberculosis
PDEPRAGAG

SEQ ID NO: 1447533 - protein, 12 aa, Mycobacterium tuberculosis
PDEVGGPPIEEA

SEQ ID NO: 1447534 - protein, 6 aa, Mycobacterium tuberculosis
PDFAGR

SEQ ID NO: 1447535 - protein, 4 aa, Mycobacterium tuberculosis
PDGA

SEQ ID NO: 1447536 - protein, 8 aa, Mycobacterium tuberculosis
PDGAGTVA

SEQ ID NO: 1447537 - protein, 16 aa, Mycobacterium tuberculosis
PDGDYTDEDRARRRGL

SEQ ID NO: 1447538 - protein, 10 aa, Mycobacterium tuberculosis
PDGNARGRGL

SEQ ID NO: 1447539 - protein, 8 aa, Mycobacterium tuberculosis
PDGPPGVS

SEQ ID NO: 1447540 - protein, 20 aa, Mycobacterium tuberculosis
PDGPTIAGDCGHSSGRNLRR

SEQ ID NO: 1447541 - protein, 5 aa, Mycobacterium tuberculosis
PDGPV

SEQ ID NO: 1447542 - protein, 5 aa, Mycobacterium tuberculosis
PDGQI

SEQ ID NO: 1447543 - protein, 4 aa, Mycobacterium tuberculosis
PDHH

SEQ ID NO: 1447544 - protein, 5 aa, Mycobacterium tuberculosis
PDIRP

SEQ ID NO: 1447545 - protein, 4 aa, Mycobacterium tuberculosis
PDKL

SEQ ID NO: 1447546 - protein, 5 aa, Mycobacterium tuberculosis
PDNCP

SEQ ID NO: 1447547 - protein, 18 aa, Mycobacterium tuberculosis
PDNPVKTISASRGRSRST

SEQ ID NO: 1447548 - protein, 7 aa, Mycobacterium tuberculosis
PDPAGDE

SEQ ID NO: 1447549 - protein, 31 aa, Mycobacterium tuberculosis
PDPAHVGDEPGRDSRDVDHPDAARGALPGAD

SEQ ID NO: 1447550 - protein, 10 aa, Mycobacterium tuberculosis
PDPAPALPPL

SEQ ID NO: 1447551 - protein, 7 aa, Mycobacterium tuberculosis
PDPDKSA

SEQ ID NO: 1447552 - protein, 7 aa, Mycobacterium tuberculosis
PDPGIAD

SEQ ID NO: 1447553 - protein, 5 aa, Mycobacterium tuberculosis
PDPGT

SEQ ID NO: 1447554 - protein, 55 aa, Mycobacterium tuberculosis
PDPNGTRFPNGAPPAAPPVREGTPKHPGPAVPPGTPCSYTPAAGALPRPDTPLPC

SEQ ID NO: 1447555 - protein, 20 aa, Mycobacterium tuberculosis
PDPNGTRFPNGAPPPPPPVL

SEQ ID NO: 1447556 - protein, 24 aa, Mycobacterium tuberculosis
PDPPAPPLPINQPPGAPSAPVPGA

SEQ ID NO: 1447557 - protein, 7 aa, Mycobacterium tuberculosis
PDPSTAR

SEQ ID NO: 1447558 - protein, 5 aa, Mycobacterium tuberculosis
PDPTE

SEQ ID NO: 1447559 - protein, 8 aa, Mycobacterium tuberculosis
PDPTPQPL

SEQ ID NO: 1447560 - protein, 13 aa, Mycobacterium tuberculosis
PDQCAHPGRCWGV

SEQ ID NO: 1447561 - protein, 5 aa, Mycobacterium tuberculosis
PDQQA

SEQ ID NO: 1447562 - protein, 9 aa, Mycobacterium tuberculosis
PDRDPRSCS

SEQ ID NO: 1447563 - protein, 23 aa, Mycobacterium tuberculosis
PDRGAEPELGPQPDLPSRRGRRL

SEQ ID NO: 1447564 - protein, 14 aa, Mycobacterium tuberculosis
PDRNAGFSTANPGR

SEQ ID NO: 1447565 - protein, 5 aa, Mycobacterium tuberculosis
PDRPE

SEQ ID NO: 1447566 - protein, 16 aa, Mycobacterium tuberculosis
PDRPPTPVDGSPGRAV

SEQ ID NO: 1447567 - protein, 18 aa, Mycobacterium tuberculosis
PDRQHGRAGRSGRRGQPC

SEQ ID NO: 1447568 - protein, 13 aa, Mycobacterium tuberculosis
PDRQTVRPGDGER

SEQ ID NO: 1447569 - protein, 4 aa, Mycobacterium tuberculosis
PDRR

SEQ ID NO: 1447570 - protein, 16 aa, Mycobacterium tuberculosis
PDRRAAGAARRCPEGA

SEQ ID NO: 1447571 - protein, 15 aa, Mycobacterium tuberculosis
PDRTFNRRRRQRRPR

SEQ ID NO: 1447572 - protein, 13 aa, Mycobacterium tuberculosis
PDRYRDDSAARGG

SEQ ID NO: 1447573 - protein, 15 aa, Mycobacterium tuberculosis
PDSATDETTAEDEVG

SEQ ID NO: 1447574 - protein, 10 aa, Mycobacterium tuberculosis
PDSGRVTHRR

SEQ ID NO: 1447575 - protein, 7 aa, Mycobacterium tuberculosis
PDSGTHS

SEQ ID NO: 1447576 - protein, 8 aa, Mycobacterium tuberculosis
PDSKSSKS

SEQ ID NO: 1447577 - protein, 15 aa, Mycobacterium tuberculosis
PDSPPAATKQVRKME

SEQ ID NO: 1447578 - protein, 5 aa, Mycobacterium tuberculosis
PDSSS

SEQ ID NO: 1447579 - protein, 14 aa, Mycobacterium tuberculosis
PDTAAGVPKGNTLV

SEQ ID NO: 1447580 - protein, 8 aa, Mycobacterium tuberculosis
PDTADTAA

SEQ ID NO: 1447581 - protein, 15 aa, Mycobacterium tuberculosis
PDTETAKSRDPTGTV

SEQ ID NO: 1447582 - protein, 7 aa, Mycobacterium tuberculosis
PDTIDES

SEQ ID NO: 1447583 - protein, 9 aa, Mycobacterium tuberculosis
PDTKSPVTG

SEQ ID NO: 1447584 - protein, 10 aa, Mycobacterium tuberculosis
PDTNGDPGRC

SEQ ID NO: 1447585 - protein, 5 aa, Mycobacterium tuberculosis
PDTNS

SEQ ID NO: 1447586 - protein, 8 aa, Mycobacterium tuberculosis
PDTQDTRA

SEQ ID NO: 1447587 - protein, 4 aa, Mycobacterium tuberculosis
PDTS

SEQ ID NO: 1447588 - protein, 7 aa, Mycobacterium tuberculosis
PDVEQSI

SEQ ID NO: 1447589 - protein, 29 aa, Mycobacterium tuberculosis
PDVREGPGRAPRKAPRAVRRRPRSRRRQL

SEQ ID NO: 1447590 - protein, 8 aa, Mycobacterium tuberculosis
PDWRSPRS

SEQ ID NO: 1447591 - protein, 16 aa, Mycobacterium tuberculosis
PEAAAPAAAAVATQGN

SEQ ID NO: 1447592 - protein, 7 aa, Mycobacterium tuberculosis
PEAARTL

SEQ ID NO: 1447593 - protein, 10 aa, Mycobacterium tuberculosis
PEAASEVSTA

SEQ ID NO: 1447594 - protein, 7 aa, Mycobacterium tuberculosis
PEAPRIT

SEQ ID NO: 1447595 - protein, 5 aa, Mycobacterium tuberculosis
PEAQW

SEQ ID NO: 1447596 - protein, 14 aa, Mycobacterium tuberculosis
PEASLADATDRLRR

SEQ ID NO: 1447597 - protein, 7 aa, Mycobacterium tuberculosis
PEEPERH

SEQ ID NO: 1447598 - protein, 9 aa, Mycobacterium tuberculosis
PEGACPGPF

SEQ ID NO: 1447599 - protein, 19 aa, Mycobacterium tuberculosis
PEGACPGPFGAPIPGFARS

SEQ ID NO: 1447600 - protein, 4 aa, Mycobacterium tuberculosis
PEGC

SEQ ID NO: 1447601 - protein, 31 aa, Mycobacterium tuberculosis
PEGGAGGGNRCRPRHSGGRCRGAGELHREVS

SEQ ID NO: 1447602 - protein, 5 aa, Mycobacterium tuberculosis
PEGLG

SEQ ID NO: 1447603 - protein, 7 aa, Mycobacterium tuberculosis
PELGGPL

SEQ ID NO: 1447604 - protein, 4 aa, Mycobacterium tuberculosis
PENV

SEQ ID NO: 1447605 - protein, 25 aa, Mycobacterium tuberculosis
PEPDPPPQAAPWPQQAPDGPGFSPP

SEQ ID NO: 1447606 - protein, 16 aa, Mycobacterium tuberculosis
PEPDVTANPGRRIDPP

SEQ ID NO: 1447607 - protein, 5 aa, Mycobacterium tuberculosis
PEPET

SEQ ID NO: 1447608 - protein, 17 aa, Mycobacterium tuberculosis
PEPNPGDCSSTSRGDPL

SEQ ID NO: 1447609 - protein, 29 aa, Mycobacterium tuberculosis
PEPPRRPRSRSRPTSSPDVGAEGTPAGRY

SEQ ID NO: 1447610 - protein, 12 aa, Mycobacterium tuberculosis
PEPRPPQQNRSV

SEQ ID NO: 1447611 - protein, 19 aa, Mycobacterium tuberculosis
PEPVGRQRPGSADSLAARG

SEQ ID NO: 1447612 - protein, 16 aa, Mycobacterium tuberculosis
PEPVPQADPGQPWPGR

SEQ ID NO: 1447613 - protein, 7 aa, Mycobacterium tuberculosis
PEPVSER

SEQ ID NO: 1447614 - protein, 5 aa, Mycobacterium tuberculosis
PEQVN

SEQ ID NO: 1447615 - protein, 19 aa, Mycobacterium tuberculosis
PERDDDADNPLRVAFRQRG

SEQ ID NO: 1447616 - protein, 4 aa, Mycobacterium tuberculosis
PERI

SEQ ID NO: 1447617 - protein, 7 aa, Mycobacterium tuberculosis
PERPSSS

SEQ ID NO: 1447618 - protein, 6 aa, Mycobacterium tuberculosis
PERQQL

SEQ ID NO: 1447619 - protein, 13 aa, Mycobacterium tuberculosis
PESGSRRGWPPQS

SEQ ID NO: 1447620 - protein, 17 aa, Mycobacterium tuberculosis
PESQPPPTAENTESGRA

SEQ ID NO: 1447621 - protein, 5 aa, Mycobacterium tuberculosis
PETDG

SEQ ID NO: 1447622 - protein, 6 aa, Mycobacterium tuberculosis
PETGER

SEQ ID NO: 1447623 - protein, 14 aa, Mycobacterium tuberculosis
PETLPLPAEIENPQ

SEQ ID NO: 1447624 - protein, 6 aa, Mycobacterium tuberculosis
PETSLT

SEQ ID NO: 1447625 - protein, 5 aa, Mycobacterium tuberculosis
PEVAA

SEQ ID NO: 1447626 - protein, 18 aa, Mycobacterium tuberculosis
PEVGAERQDLRQYPGGSL

SEQ ID NO: 1447627 - protein, 9 aa, Mycobacterium tuberculosis
PEVPGPRIE

SEQ ID NO: 1447628 - protein, 6 aa, Mycobacterium tuberculosis
PEVQAP

SEQ ID NO: 1447629 - protein, 4 aa, Mycobacterium tuberculosis
PEYG

SEQ ID NO: 1447630 - protein, 11 aa, Mycobacterium tuberculosis
PFAGASGLSTW

SEQ ID NO: 1447631 - protein, 10 aa, Mycobacterium tuberculosis
PFAPSQNTHI

SEQ ID NO: 1447632 - protein, 30 aa, Mycobacterium tuberculosis
PFGQAGGGRANSGNSGNGGNGGNGDNHATG

SEQ ID NO: 1447633 - protein, 14 aa, Mycobacterium tuberculosis
PFSGIGKPEPLQGE

SEQ ID NO: 1447634 - protein, 26 aa, Mycobacterium tuberculosis
PFSRSAPRWATPPSRARTSWCGMAAT

SEQ ID NO: 1447635 - protein, 11 aa, Mycobacterium tuberculosis
PGAAAGRGSIR

SEQ ID NO: 1447636 - protein, 16 aa, Mycobacterium tuberculosis
PGAAGEPRGLRWTQGL

SEQ ID NO: 1447637 - protein, 12 aa, Mycobacterium tuberculosis
PGAAIGAVTARR

SEQ ID NO: 1447638 - protein, 11 aa, Mycobacterium tuberculosis
PGAARPERVRG

SEQ ID NO: 1447639 - protein, 13 aa, Mycobacterium tuberculosis
PGAGPTSAAPDVI

SEQ ID NO: 1447640 - protein, 7 aa, Mycobacterium tuberculosis
PGAGPVR

SEQ ID NO: 1447641 - protein, 5 aa, Mycobacterium tuberculosis
PGAMP

SEQ ID NO: 1447642 - protein, 8 aa, Mycobacterium tuberculosis
PGANRGLP

SEQ ID NO: 1447643 - protein, 5 aa, Mycobacterium tuberculosis
PGAPE

SEQ ID NO: 1447644 - protein, 10 aa, Mycobacterium tuberculosis
PGARCDQPVK

SEQ ID NO: 1447645 - protein, 6 aa, Mycobacterium tuberculosis
PGARQH

SEQ ID NO: 1447646 - protein, 7 aa, Mycobacterium tuberculosis
PGARRGH

SEQ ID NO: 1447647 - protein, 12 aa, Mycobacterium tuberculosis
PGASLSRGPVAA

SEQ ID NO: 1447648 - protein, 32 aa, Mycobacterium tuberculosis
PGAVRTGQAGGDPPVPAPKDTTPRNVAFAGAA

SEQ ID NO: 1447649 - protein, 10 aa, Mycobacterium tuberculosis
PGCAPGPDGV

SEQ ID NO: 1447650 - protein, 15 aa, Mycobacterium tuberculosis
PGDDYRDPEAPTPAT

SEQ ID NO: 1447651 - protein, 6 aa, Mycobacterium tuberculosis
PGDGAQ

SEQ ID NO: 1447652 - protein, 30 aa, Mycobacterium tuberculosis
PGDPAGRRADGLDPGGRYHRSGRAGADRHR

SEQ ID NO: 1447653 - protein, 25 aa, Mycobacterium tuberculosis
PGDRRDRAGAAWPAQADLRGKPAGS

SEQ ID NO: 1447654 - protein, 25 aa, Mycobacterium tuberculosis
PGDTGEYQPASGDHPETGVYSSPAE

SEQ ID NO: 1447655 - protein, 7 aa, Mycobacterium tuberculosis
PGDVATA

SEQ ID NO: 1447656 - protein, 8 aa, Mycobacterium tuberculosis
PGEHPDRS

SEQ ID NO: 1447657 - protein, 15 aa, Mycobacterium tuberculosis
PGELAPKARPGRHRP

SEQ ID NO: 1447658 - protein, 9 aa, Mycobacterium tuberculosis
PGERRPHRA

SEQ ID NO: 1447659 - protein, 17 aa, Mycobacterium tuberculosis
PGESDGTCGRGEPQAGR

SEQ ID NO: 1447660 - protein, 19 aa, Mycobacterium tuberculosis
PGESGSTFDGNPFGPPRSV

SEQ ID NO: 1447661 - protein, 5 aa, Mycobacterium tuberculosis
PGFGH

SEQ ID NO: 1447662 - protein, 10 aa, Mycobacterium tuberculosis
PGFGNTTGAP

SEQ ID NO: 1447663 - protein, 6 aa, Mycobacterium tuberculosis
PGFHPR

SEQ ID NO: 1447664 - protein, 15 aa, Mycobacterium tuberculosis
PGFQGSGDGSAATLG

SEQ ID NO: 1447665 - protein, 7 aa, Mycobacterium tuberculosis
PGGATGV

SEQ ID NO: 1447666 - protein, 16 aa, Mycobacterium tuberculosis
PGGDLGTASAPVRGGC

SEQ ID NO: 1447667 - protein, 5 aa, Mycobacterium tuberculosis
PGGFA

SEQ ID NO: 1447668 - protein, 36 aa, Mycobacterium tuberculosis
PGGGHHPADERVEHEQRMNGDSAGQQHRRYRVTTAA

SEQ ID NO: 1447669 - protein, 6 aa, Mycobacterium tuberculosis
PGGGIR

SEQ ID NO: 1447670 - protein, 7 aa, Mycobacterium tuberculosis
PGGGPPE

SEQ ID NO: 1447671 - protein, 14 aa, Mycobacterium tuberculosis
PGGLGGNGGAATQI

SEQ ID NO: 1447672 - protein, 10 aa, Mycobacterium tuberculosis
PGGLSRERAG

SEQ ID NO: 1447673 - protein, 12 aa, Mycobacterium tuberculosis
PGGNPRPELPNP

SEQ ID NO: 1447674 - protein, 12 aa, Mycobacterium tuberculosis
PGGNYADIPTPA

SEQ ID NO: 1447675 - protein, 9 aa, Mycobacterium tuberculosis
PGGPASRRG

SEQ ID NO: 1447676 - protein, 11 aa, Mycobacterium tuberculosis
PGGPNGGGRRR

SEQ ID NO: 1447677 - protein, 35 aa, Mycobacterium tuberculosis; identical to SEQ ID NO: 1369878

SEQ ID NO: 1447678 - protein, 4 aa, Mycobacterium tuberculosis
PGGQ

SEQ ID NO: 1447679 - protein, 92 aa, Mycobacterium tuberculosis
PGGSGGAPTGSGTGGKGGAGGDGGDGADGGAATGVGDGGDGGNGGNGGNGGTGVGSPGGLGGAGGTGGLGGAGAGGGADGDDGDDGQPGNNG

SEQ ID NO: 1447680 - protein, 26 aa, Mycobacterium tuberculosis
PGGSGGDGGNGGNAGLIGNGGNGGNA

SEQ ID NO: 1447681 - protein, 4 aa, Mycobacterium tuberculosis
PGGY

SEQ ID NO: 1447682 - protein, 14 aa, Mycobacterium tuberculosis
PGHARGGRRVRRGP

SEQ ID NO: 1447683 - protein, 23 aa, Mycobacterium tuberculosis
PGHDTGPRHASGRTTRVQLPRAA

SEQ ID NO: 1447684 - protein, 13 aa, Mycobacterium tuberculosis
PGHGDGDRAPRVS

SEQ ID NO: 1447685 - protein, 20 aa, Mycobacterium tuberculosis
PGHPAQRSSWPRKAGQPAAW

SEQ ID NO: 1447686 - protein, 6 aa, Mycobacterium tuberculosis
PGHTEA

SEQ ID NO: 1447687 - protein, 5 aa, Mycobacterium tuberculosis
PGHVG

SEQ ID NO: 1447688 - protein, 12 aa, Mycobacterium tuberculosis
PGIEPAPPLPPC

SEQ ID NO: 1447689 - protein, 22 aa, Mycobacterium tuberculosis
PGIGGNGGDTGNAGNGGNGGSA

SEQ ID NO: 1447690 - protein, 7 aa, Mycobacterium tuberculosis
PGIGPGS

SEQ ID NO: 1447691 - protein, 6 aa, Mycobacterium tuberculosis
PGIPMS

SEQ ID NO: 1447692 - protein, 5 aa, Mycobacterium tuberculosis
PGIPR

SEQ ID NO: 1447693 - protein, 18 aa, Mycobacterium tuberculosis
PGKASQPDGQAAHRRTVG

SEQ ID NO: 1447694 - protein, 6 aa, Mycobacterium tuberculosis
PGKDAH

SEQ ID NO: 1447695 - protein, 4 aa, Mycobacterium tuberculosis
PGLA

SEQ ID NO: 1447696 - protein, 12 aa, Mycobacterium tuberculosis
PGLEPAGDHRCG

SEQ ID NO: 1447697 - protein, 11 aa, Mycobacterium tuberculosis
PGLPAGGGCPV

SEQ ID NO: 1447698 - protein, 36 aa, Mycobacterium tuberculosis
PGLPGTRCAAGRQQTEGVGRRRRCRDRTGGHRRRRR

SEQ ID NO: 1447699 - protein, 17 aa, Mycobacterium tuberculosis
PGLQAQREQLRAKLART

SEQ ID NO: 1447700 - protein, 5 aa, Mycobacterium tuberculosis
PGLRD

SEQ ID NO: 1447701 - protein, 4 aa, Mycobacterium tuberculosis
PGLT

SEQ ID NO: 1447702 - protein, 4 aa, Mycobacterium tuberculosis
PGMD

SEQ ID NO: 1447703 - protein, 6 aa, Mycobacterium tuberculosis
PGMPQG

SEQ ID NO: 1447704 - protein, 6 aa, Mycobacterium tuberculosis
PGNEFS

SEQ ID NO: 1447705 - protein, 8 aa, Mycobacterium tuberculosis
PGNEQAAA

SEQ ID NO: 1447706 - protein, 5 aa, Mycobacterium tuberculosis
PGPGA

SEQ ID NO: 1447707 - protein, 6 aa, Mycobacterium tuberculosis
PGPGAL

SEQ ID NO: 1447708 - protein, 16 aa, Mycobacterium tuberculosis
PGPGPEGWSTHSGRRA

SEQ ID NO: 1447709 - protein, 13 aa, Mycobacterium tuberculosis
PGPGPHRDGRFGP

SEQ ID NO: 1447710 - protein, 7 aa, Mycobacterium tuberculosis
PGPIQGG

SEQ ID NO: 1447711 - protein, 5 aa, Mycobacterium tuberculosis
PGPLS

SEQ ID NO: 1447712 - protein, 17 aa, Mycobacterium tuberculosis
PGPNGGGNSNGGGTAES

SEQ ID NO: 1447713 - protein, 7 aa, Mycobacterium tuberculosis
PGPNVNT

SEQ ID NO: 1447714 - protein, 28 aa, Mycobacterium tuberculosis
PGPPAPPSPPTPPAPPVPPAPPAPWPPS

SEQ ID NO: 1447715 - protein, 9 aa, Mycobacterium tuberculosis
PGPPARGAG

SEQ ID NO: 1447716 - protein, 8 aa, Mycobacterium tuberculosis
PGPPGGDA

SEQ ID NO: 1447717 - protein, 9 aa, Mycobacterium tuberculosis
PGPPPGSAI

SEQ ID NO: 1447718 - protein, 7 aa, Mycobacterium tuberculosis
PGPPVGA

SEQ ID NO: 1447719 - protein, 12 aa, Mycobacterium tuberculosis
PGPQKLQQHAPQ

SEQ ID NO: 1447720 - protein, 6 aa, Mycobacterium tuberculosis
PGPTPA

SEQ ID NO: 1447721 - protein, 6 aa, Mycobacterium tuberculosis
PGPVAT

SEQ ID NO: 1447722 - protein, 8 aa, Mycobacterium tuberculosis
PGQGGGDT

SEQ ID NO: 1447723 - protein, 11 aa, Mycobacterium tuberculosis
PGQGSYAAANS

SEQ ID NO: 1447724 - protein, 8 aa, Mycobacterium tuberculosis
PGQHGLPP

SEQ ID NO: 1447725 - protein, 7 aa, Mycobacterium tuberculosis
PGQQPIT

SEQ ID NO: 1447726 - protein, 6 aa, Mycobacterium tuberculosis
PGRCPP

SEQ ID NO: 1447727 - protein, 6 aa, Mycobacterium tuberculosis
PGRDTR

SEQ ID NO: 1447728 - protein, 14 aa, Mycobacterium tuberculosis
PGREDGQRRGRPHR

SEQ ID NO: 1447729 - protein, 9 aa, Mycobacterium tuberculosis
PGRGGQPRI

SEQ ID NO: 1447730 - protein, 21 aa, Mycobacterium tuberculosis
PGRHPDSPTPAGPRFVRRHPT

SEQ ID NO: 1447731 - protein, 28 aa, Mycobacterium tuberculosis
PGRPGASDPNPRPPAPPRPPAPPAPPLP

SEQ ID NO: 1447732 - protein, 16 aa, Mycobacterium tuberculosis
PGRPGRFGSKSENRRY

SEQ ID NO: 1447733 - protein, 18 aa, Mycobacterium tuberculosis
PGRQPKPAAGKRGTPDAA

SEQ ID NO: 1447734 - protein, 7 aa, Mycobacterium tuberculosis
PGRRPAR

SEQ ID NO: 1447735 - protein, 30 aa, Mycobacterium tuberculosis
PGRTGGGRRAERYRRGSGRAFERGYGRGLG

SEQ ID NO: 1447736 - protein, 8 aa, Mycobacterium tuberculosis
PGSAAGAG

SEQ ID NO: 1447737 - protein, 13 aa, Mycobacterium tuberculosis
PGSHSMNSSYSGG

SEQ ID NO: 1447738 - protein, 17 aa, Mycobacterium tuberculosis
PGSPSNPAAPGSVGNSW

SEQ ID NO: 1447739 - protein, 9 aa, Mycobacterium tuberculosis
PGSPSRYRR

SEQ ID NO: 1447740 - protein, 12 aa, Mycobacterium tuberculosis
PGSRIRASAPSA

SEQ ID NO: 1447741 - protein, 19 aa, Mycobacterium tuberculosis
PGSSPSAPAVGAGGPSPVG

SEQ ID NO: 1447742 - protein, 15 aa, Mycobacterium tuberculosis
PGSTFPRATRASTGW

SEQ ID NO: 1447743 - protein, 13 aa, Mycobacterium tuberculosis
PGTAAPAPESLHG

SEQ ID NO: 1447744 - protein, 5 aa, Mycobacterium tuberculosis
PGTAG

SEQ ID NO: 1447745 - protein, 109 aa, Mycobacterium tuberculosis
PGTAGGGADGANGSAIGQAGGAGGAGGDGAPGGNGGNGGSVEHTGATGSSASGGNGATGGNGGVGAPGGAGGNGGHVSGGSVNTAGAGGKGGNGGTGGAGGPGGHGGSV

SEQ ID NO: 1447746 - protein, 36 aa, Mycobacterium tuberculosis
PGTAGGGADGANGSAIGQAGGAGGDGGNASTSGGIG

SEQ ID NO: 1447747 - protein, 23 aa, Mycobacterium tuberculosis
PGTAGGVADGANGSAIGPGGRRW

SEQ ID NO: 1447748 - protein, 10 aa, Mycobacterium tuberculosis
PGTDRQRDVH

SEQ ID NO: 1447749 - protein, 9 aa, Mycobacterium tuberculosis
PGTGKTYTA

SEQ ID NO: 1447750 - protein, 125 aa, Mycobacterium tuberculosis
PGTPGTPGTPGTPITPGTPITPGTPITPGTPITPGTPITPIPGAPVTPITPTPGTPVTPVTPGKPVTPVTPVKPGTPGEPTPITPVTPPVAPATPATPATPVTPAPAPHPQPAPAPAPSPGPQPV

SEQ ID NO: 1447751 - protein, 42 aa, Mycobacterium tuberculosis
PGTPPARSAGEPTGSRCTTAKPSPSAPSRGSTLTEHSPTPMK

SEQ ID NO: 1447752 - protein, 9 aa, Mycobacterium tuberculosis
PGVESNDGD

SEQ ID NO: 1447753 - protein, 10 aa, Mycobacterium tuberculosis
PGVGKSTLGA

SEQ ID NO: 1447754 - protein, 13 aa, Mycobacterium tuberculosis
PGVGRPGFRPRQA

SEQ ID NO: 1447755 - protein, 21 aa, Mycobacterium tuberculosis
PGVGTGAPGRRSRARNASGSV

SEQ ID NO: 1447756 - protein, 31 aa, Mycobacterium tuberculosis
PGVPNAGDAGGADSARRSVSADTDHRGAPTS

SEQ ID NO: 1447757 - protein, 16 aa, Mycobacterium tuberculosis
PGVQVSSDGAAARSAA

SEQ ID NO: 1447758 - protein, 9 aa, Mycobacterium tuberculosis
PGVRPGSGA

SEQ ID NO: 1447759 - protein, 13 aa, Mycobacterium tuberculosis
PGVSARAEAGGSI

SEQ ID NO: 1447760 - protein, 13 aa, Mycobacterium tuberculosis
PGVTPGDVQDPKV

SEQ ID NO: 1447761 - protein, 4 aa, Mycobacterium tuberculosis
PGVV

SEQ ID NO: 1447762 - protein, 13 aa, Mycobacterium tuberculosis
PGWPGAPSGPNWP

SEQ ID NO: 1447763 - protein, 16 aa, Mycobacterium tuberculosis
PGYKPTLPGPCRQCVV

SEQ ID NO: 1447764 - protein, 4 aa, Mycobacterium tuberculosis
PHAA

SEQ ID NO: 1447765 - protein, 4 aa, Mycobacterium tuberculosis
PHAL

SEQ ID NO: 1447766 - protein, 10 aa, Mycobacterium tuberculosis
PHAPHAKPED

SEQ ID NO: 1447767 - protein, 8 aa, Mycobacterium tuberculosis
PHASAAST

SEQ ID NO: 1447768 - protein, 9 aa, Mycobacterium tuberculosis
PHCSGGSPV

SEQ ID NO: 1447769 - protein, 8 aa, Mycobacterium tuberculosis
PHDESPTL

SEQ ID NO: 1447770 - protein, 4 aa, Mycobacterium tuberculosis
PHDS

SEQ ID NO: 1447771 - protein, 5 aa, Mycobacterium tuberculosis
PHGQV

SEQ ID NO: 1447772 - protein, 8 aa, Mycobacterium tuberculosis
PHIAEGDP

SEQ ID NO: 1447773 - protein, 4 aa, Mycobacterium tuberculosis
PHIS

SEQ ID NO: 1447774 - protein, 25 aa, Mycobacterium tuberculosis
PHKHPGADRRGRAAIPGRSSTACTR

SEQ ID NO: 1447775 - protein, 30 aa, Mycobacterium tuberculosis; identical to SEQ ID NO: 152865

SEQ ID NO: 1447776 - protein, 23 aa, Mycobacterium tuberculosis
PHLPPPTRQVSGGSWESCTASQC

SEQ ID NO: 1447777 - protein, 7 aa, Mycobacterium tuberculosis
PHPGGPK

SEQ ID NO: 1447778 - protein, 6 aa, Mycobacterium tuberculosis
PHPPGC

SEQ ID NO: 1447779 - protein, 14 aa, Mycobacterium tuberculosis
PHRDAPGSAEPGHR

SEQ ID NO: 1447780 - protein, 4 aa, Mycobacterium tuberculosis
PHRE

SEQ ID NO: 1447781 - protein, 15 aa, Mycobacterium tuberculosis
PHREPAAEHKHSPDE

SEQ ID NO: 1447782 - protein, 6 aa, Mycobacterium tuberculosis
PHRQRR

SEQ ID NO: 1447783 - protein, 11 aa, Mycobacterium tuberculosis
PHRQRRSTRRR

SEQ ID NO: 1447784 - protein, 18 aa, Mycobacterium tuberculosis
PHRTQDPHAARPARCPEA

SEQ ID NO: 1447785 - protein, 11 aa, Mycobacterium tuberculosis
PHSDASRQGAM

SEQ ID NO: 1447786 - protein, 5 aa, Mycobacterium tuberculosis
PHSRP

SEQ ID NO: 1447787 - protein, 20 aa, Mycobacterium tuberculosis
PHTPTPNSSLVGSPRRAGVS

SEQ ID NO: 1447788 - protein, 4 aa, Mycobacterium tuberculosis
PHTS

SEQ ID NO: 1447789 - protein, 7 aa, Mycobacterium tuberculosis
PHVDGGH

SEQ ID NO: 1447790 - protein, 32 aa, Mycobacterium tuberculosis
PHVDRGAGRPRGCDRASAGPCSHRRTAGCWRM

SEQ ID NO: 1447791 - protein, 25 aa, Mycobacterium tuberculosis
PIAPTPPAPGAPALPPGPPSLLAAL

SEQ ID NO: 1447792 - protein, 4 aa, Mycobacterium tuberculosis
PIAQ

SEQ ID NO: 1447793 - protein, 5 aa, Mycobacterium tuberculosis
PIDAR

SEQ ID NO: 1447794 - protein, 24 aa, Mycobacterium tuberculosis
PIDDPMRATSEAAAATVSGATITN

SEQ ID NO: 1447795 - protein, 23 aa, Mycobacterium tuberculosis
PIDDPMRATSKAAAATVSGATIT

SEQ ID NO: 1447796 - protein, 4 aa, Mycobacterium tuberculosis
PIDP

SEQ ID NO: 1447797 - protein, 19 aa, Mycobacterium tuberculosis
PIDREPRAIGRGYGPHAGG

SEQ ID NO: 1447798 - protein, 13 aa, Mycobacterium tuberculosis
PIDTEATRTVTPA

SEQ ID NO: 1447799 - protein, 29 aa, Mycobacterium tuberculosis
PIDTGPPPCQERSKNRALPASPPLPPFTA

SEQ ID NO: 1447800 - protein, 10 aa, Mycobacterium tuberculosis
PIGQPRGGLP

SEQ ID NO: 1447801 - protein, 12 aa, Mycobacterium tuberculosis
PIPDPNTPTGSR

SEQ ID NO: 1447802 - protein, 69 aa, Mycobacterium tuberculosis
PIPEPLADDEDVDDGPDYVADDSDADDEGQLDRPANRRRRRGRRGRGRGRGEQGGSDGDPVDQQSEPRA

SEQ ID NO: 1447803 - protein, 6 aa, Mycobacterium tuberculosis
PIPPLP

SEQ ID NO: 1447804 - protein, 16 aa, Mycobacterium tuberculosis
PIPRRGRRQQRARPRT

SEQ ID NO: 1447805 - protein, 8 aa, Mycobacterium tuberculosis
PIQSITGG

SEQ ID NO: 1447806 - protein, 29 aa, Mycobacterium tuberculosis
PIRRDEGRSEGVRRPPPAGRNGQQATNYQ

SEQ ID NO: 1447807 - protein, 9 aa, Mycobacterium tuberculosis
PISGRPNSA

SEQ ID NO: 1447808 - protein, 9 aa, Mycobacterium tuberculosis
PISGRPSNS

SEQ ID NO: 1447809 - protein, 10 aa, Mycobacterium tuberculosis
PISGRPVNAS

SEQ ID NO: 1447810 - protein, 15 aa, Mycobacterium tuberculosis
PISHPDTTILAMLLA

SEQ ID NO: 1447811 - protein, 5 aa, Mycobacterium tuberculosis
PISNA

SEQ ID NO: 1447812 - protein, 13 aa, Mycobacterium tuberculosis
PITDDDATNPLTE

SEQ ID NO: 1447813 - protein, 10 aa, Mycobacterium tuberculosis
PITDVNGGGQ

SEQ ID NO: 1447814 - protein, 21 aa, Mycobacterium tuberculosis
PITGGAGGGRTHWKRHGPWRH

SEQ ID NO: 1447815 - protein, 5 aa, Mycobacterium tuberculosis
PITSG

SEQ ID NO: 1447816 - protein, 4 aa, Mycobacterium tuberculosis
PKAI

SEQ ID NO: 1447817 - protein, 6 aa, Mycobacterium tuberculosis
PKDPTI

SEQ ID NO: 1447818 - protein, 5 aa, Mycobacterium tuberculosis
PKFPV

SEQ ID NO: 1447819 - protein, 12 aa, Mycobacterium tuberculosis
PKGARHSGGGIG

SEQ ID NO: 1447820 - protein, 7 aa, Mycobacterium tuberculosis
PKGEAER

SEQ ID NO: 1447821 - protein, 19 aa, Mycobacterium tuberculosis
PKLIGNGGHGGAGRHRGAE

SEQ ID NO: 1447822 - protein, 12 aa, Mycobacterium tuberculosis
PKLPGPAGRRRR

SEQ ID NO: 1447823 - protein, 25 aa, Mycobacterium tuberculosis
PKNSCTTATKTIHEREAQPLCRGRA

SEQ ID NO: 1447824 - protein, 15 aa, Mycobacterium tuberculosis
PKPGTGPSAAARERG

SEQ ID NO: 1447825 - protein, 12 aa, Mycobacterium tuberculosis
PKPMAGTVIEPP

SEQ ID NO: 1447826 - protein, 13 aa, Mycobacterium tuberculosis
PKRDPTHNHSRIP

SEQ ID NO: 1447827 - protein, 10 aa, Mycobacterium tuberculosis
PKRGPGPARH

SEQ ID NO: 1447828 - protein, 8 aa, Mycobacterium tuberculosis
PKRLESKS

SEQ ID NO: 1447829 - protein, 4 aa, Mycobacterium tuberculosis
PKRV

SEQ ID NO: 1447830 - protein, 26 aa, Mycobacterium tuberculosis
PKSNFYPSPDRESAYASPRIGQPVGS

SEQ ID NO: 1447831 - protein, 20 aa, Mycobacterium tuberculosis
PKSTKPGTNIHRCGAGRANS

SEQ ID NO: 1447832 - protein, 18 aa, Mycobacterium tuberculosis
PKTAAPSISNATVASPAA

SEQ ID NO: 1447833 - protein, 7 aa, Mycobacterium tuberculosis
PKTNPEL

SEQ ID NO: 1447834 - protein, 10 aa, Mycobacterium tuberculosis
PKTPRGDGNI

SEQ ID NO: 1447835 - protein, 17 aa, Mycobacterium tuberculosis
PKTPRGDGNTPPMTAMS

SEQ ID NO: 1447836 - protein, 4 aa, Mycobacterium tuberculosis
PKVV

SEQ ID NO: 1447837 - protein, 5 aa, Mycobacterium tuberculosis
PKVVS

SEQ ID NO: 1447838 - protein, 21 aa, Mycobacterium tuberculosis
PLAASAAPSIPAANMPPGSVE

SEQ ID NO: 1447839 - protein, 5 aa, Mycobacterium tuberculosis
PLAGH

SEQ ID NO: 1447840 - protein, 17 aa, Mycobacterium tuberculosis
PLAGRTEGRKQSRVQHR

SEQ ID NO: 1447841 - protein, 18 aa, Mycobacterium tuberculosis
PLAKAASGGGNGYSLRTN

SEQ ID NO: 1447842 - protein, 9 aa, Mycobacterium tuberculosis
PLASTTTDL

SEQ ID NO: 1447843 - protein, 12 aa, Mycobacterium tuberculosis
PLDDGASGSLDE

SEQ ID NO: 1447844 - protein, 7 aa, Mycobacterium tuberculosis
PLDPQAQ

SEQ ID NO: 1447845 - protein, 16 aa, Mycobacterium tuberculosis
PLEDTGARAAALGPGQ

SEQ ID NO: 1447846 - protein, 31 aa, Mycobacterium tuberculosis
PLETHRPGGAHTPGRSPNSAASAPGLICTSV

SEQ ID NO: 1447847 - protein, 6 aa, Mycobacterium tuberculosis
PLGPGA

SEQ ID NO: 1447848 - protein, 6 aa, Mycobacterium tuberculosis
PLGPRS

SEQ ID NO: 1447849 - protein, 9 aa, Mycobacterium tuberculosis
PLGSATGSV

SEQ ID NO: 1447850 - protein, 7 aa, Mycobacterium tuberculosis
PLGSSGE

SEQ ID NO: 1447851 - protein, 17 aa, Mycobacterium tuberculosis
PLGTGSKALATRAASGA

SEQ ID NO: 1447852 - protein, 7 aa, Mycobacterium tuberculosis
PLNGSRA

SEQ ID NO: 1447853 - protein, 4 aa, Mycobacterium tuberculosis
PLPG

SEQ ID NO: 1447854 - protein, 9 aa, Mycobacterium tuberculosis
PLPGTRDRA

SEQ ID NO: 1447855 - protein, 14 aa, Mycobacterium tuberculosis
PLPISPTSEGTPMT

SEQ ID NO: 1447856 - protein, 33 aa, Mycobacterium tuberculosis; identical to SEQ ID NO: 1366681

SEQ ID NO: 1447857 - protein, 8 aa, Mycobacterium tuberculosis
PLPPAADD

SEQ ID NO: 1447858 - protein, 77 aa, Mycobacterium tuberculosis
PLPPAPGIPPRTPATAGPPCPPAPPSPNNIPPAPPLPPAAPAPPRPPTPPLPINSGPAPPSPPGAPSPPTPPPPPVP

SEQ ID NO: 1447859 - protein, 27 aa, Mycobacterium tuberculosis
PLPPAPPGRTDPAVPAGGTIAAARRGA

SEQ ID NO: 1447860 - protein, 21 aa, Mycobacterium tuberculosis
PLPPAPPRPPAAPEPGGCPTV

SEQ ID NO: 1447861 - protein, 11 aa, Mycobacterium tuberculosis
PLPPEATDQWQ

SEQ ID NO: 1447862 - protein, 22 aa, Mycobacterium tuberculosis
PLPPLPPSAPLPPKPPAPPDSR

SEQ ID NO: 1447863 - protein, 15 aa, Mycobacterium tuberculosis
PLPPLPPSPPLPPTT

SEQ ID NO: 1447864 - protein, 19 aa, Mycobacterium tuberculosis
PLPPLQKKKKNITSPAPKG

SEQ ID NO: 1447865 - protein, 5 aa, Mycobacterium tuberculosis
PLPPQ

SEQ ID NO: 1447866 - protein, 7 aa, Mycobacterium tuberculosis
PLPPSPP

SEQ ID NO: 1447867 - protein, 22 aa, Mycobacterium tuberculosis
PLPPSPPMPPAPPFPPAPPAPM

SEQ ID NO: 1447868 - protein, 13 aa, Mycobacterium tuberculosis
PLPPSPPSPPLDG

SEQ ID NO: 1447869 - protein, 39 aa, Mycobacterium tuberculosis
PLPPSPPTPPAPPAPPLPTNNPPRPPLPPVPPLPPSLPS

SEQ ID NO: 1447870 - protein, 24 aa, Mycobacterium tuberculosis
PLPPSPPVPPVPPAPPAPPSPPAP

SEQ ID NO: 1447871 - protein, 6 aa, Mycobacterium tuberculosis
PLPSLA

SEQ ID NO: 1447872 - protein, 15 aa, Mycobacterium tuberculosis
PLPSPNTQAFHPTGR

SEQ ID NO: 1447873 - protein, 10 aa, Mycobacterium tuberculosis
PLSAPAGRLT

SEQ ID NO: 1447874 - protein, 16 aa, Mycobacterium tuberculosis
PLSGRARRASRRAGMG

SEQ ID NO: 1447875 - protein, 8 aa, Mycobacterium tuberculosis
PLSGTSRV

SEQ ID NO: 1447876 - protein, 9 aa, Mycobacterium tuberculosis
PLSPDPGPP

SEQ ID NO: 1447877 - protein, 14 aa, Mycobacterium tuberculosis
PLSPDPGPPLVLQA

SEQ ID NO: 1447878 - protein, 29 aa, Mycobacterium tuberculosis
PLSPPTALPKDTPATPALPPAPPAPKRAF

SEQ ID NO: 1447879 - protein, 16 aa, Mycobacterium tuberculosis
PLTDDQRTQVEEVTNE

SEQ ID NO: 1447880 - protein, 22 aa, Mycobacterium tuberculosis
PLTGNGANGAPGTGQAGGDGGL

SEQ ID NO: 1447881 - protein, 7 aa, Mycobacterium tuberculosis
PLTPTSD

SEQ ID NO: 1447882 - protein, 12 aa, Mycobacterium tuberculosis
PMATPGCREGET

SEQ ID NO: 1447883 - protein, 13 aa, Mycobacterium tuberculosis
PMDAGRKGRKGIE

SEQ ID NO: 1447884 - protein, 4 aa, Mycobacterium tuberculosis
PMDE

SEQ ID NO: 1447885 - protein, 16 aa, Mycobacterium tuberculosis
PMGYQQGTGPTAGVPG

SEQ ID NO: 1447886 - protein, 10 aa, Mycobacterium tuberculosis
PMPSTPSPSL

SEQ ID NO: 1447887 - protein, 22 aa, Mycobacterium tuberculosis
PMSGSATSVTGMSGSATPGLGA

SEQ ID NO: 1447888 - protein, 11 aa, Mycobacterium tuberculosis
PMSPQAAPSWP

SEQ ID NO: 1447889 - protein, 5 aa, Mycobacterium tuberculosis
PNAAP

SEQ ID NO: 1447890 - protein, 14 aa, Mycobacterium tuberculosis
PNAPSPPRPPLPPV

SEQ ID NO: 1447891 - protein, 10 aa, Mycobacterium tuberculosis
PNATHDADKP

SEQ ID NO: 1447892 - protein, 9 aa, Mycobacterium tuberculosis
PNATPTLPI

SEQ ID NO: 1447893 - protein, 7 aa, Mycobacterium tuberculosis
PNDRNES

SEQ ID NO: 1447894 - protein, 5 aa, Mycobacterium tuberculosis
PNGSQ

SEQ ID NO: 1447895 - protein, 9 aa, Mycobacterium tuberculosis
PNLDSAPKK

SEQ ID NO: 1447896 - protein, 18 aa, Mycobacterium tuberculosis
PNLSGPVNLTGPAPVTNA

SEQ ID NO: 1447897 - protein, 12 aa, Mycobacterium tuberculosis
PNMPGPPSPPFP

SEQ ID NO: 1447898 - protein, 9 aa, Mycobacterium tuberculosis
PNNGFPGTS

SEQ ID NO: 1447899 - protein, 10 aa, Mycobacterium tuberculosis
PNPARRATNG

SEQ ID NO: 1447900 - protein, 4 aa, Mycobacterium tuberculosis
PNPG

SEQ ID NO: 1447901 - protein, 73 aa, Mycobacterium tuberculosis
PNPPAPPAPPEPKNMPALPPSPPAPPSPPALARPSPPAPPAPPAAPRESVPALPPAPPSPPVVAPPPPLPPVP

SEQ ID NO: 1447902 - protein, 17 aa, Mycobacterium tuberculosis
PNPPTVAQYENAANGYA

SEQ ID NO: 1447903 - protein, 9 aa, Mycobacterium tuberculosis
PNPTLPPPM

SEQ ID NO: 1447904 - protein, 7 aa, Mycobacterium tuberculosis
PNPVANN

SEQ ID NO: 1447905 - protein, 9 aa, Mycobacterium tuberculosis
PNQPGTDYD

SEQ ID NO: 1447906 - protein, 8 aa, Mycobacterium tuberculosis
PNQSCPTG

SEQ ID NO: 1447907 - protein, 27 aa, Mycobacterium tuberculosis
PNRPQGPSESGFRSGPGAGCGRRRVGG

SEQ ID NO: 1447908 - protein, 9 aa, Mycobacterium tuberculosis
PNRPSKLPR

SEQ ID NO: 1447909 - protein, 5 aa, Mycobacterium tuberculosis
PNSLA

SEQ ID NO: 1447910 - protein, 13 aa, Mycobacterium tuberculosis
PNTRPVSVRPGTG

SEQ ID NO: 1447911 - protein, 12 aa, Mycobacterium tuberculosis
PNTVIGGRGYRL

SEQ ID NO: 1447912 - protein, 15 aa, Mycobacterium tuberculosis
PNVLPSSTNPTRPHT

SEQ ID NO: 1447913 - protein, 14 aa, Mycobacterium tuberculosis
PPAAAGGETPTRSV

SEQ ID NO: 1447914 - protein, 19 aa, Mycobacterium tuberculosis
PPACGGRSDEVGGTARLRG

SEQ ID NO: 1447915 - protein, 6 aa, Mycobacterium tuberculosis
PPADVT

SEQ ID NO: 1447916 - protein, 10 aa, Mycobacterium tuberculosis
PPAGATTEIP

SEQ ID NO: 1447917 - protein, 7 aa, Mycobacterium tuberculosis
PPAGTLN

SEQ ID NO: 1447918 - protein, 4 aa, Mycobacterium tuberculosis
PPAL

SEQ ID NO: 1447919 - protein, 23 aa, Mycobacterium tuberculosis
PPALAGDEDPHRAGAQRRRPAEV

SEQ ID NO: 1447920 - protein, 19 aa, Mycobacterium tuberculosis
PPAPAGRGLTAGQQHRRTI

SEQ ID NO: 1447921 - protein, 23 aa, Mycobacterium tuberculosis
PPAPGPAPAPPAPGAGPGEHGGG

SEQ ID NO: 1447922 - protein, 19 aa, Mycobacterium tuberculosis
PPAPNNTAFPPVPPAPPIP

SEQ ID NO: 1447923 - protein, 24 aa, Mycobacterium tuberculosis
PPAPPAPPGTSPGPRYRPHRGPPG

SEQ ID NO: 1447924 - protein, 23 aa, Mycobacterium tuberculosis
PPAPPAPPLPTKPPSPPLPPDAP

SEQ ID NO: 1447925 - protein, 31 aa, Mycobacterium tuberculosis
PPAPPAPPSPISSPPAPPAPPAPPAPPMPPE

SEQ ID NO: 1447926 - protein, 29 aa, Mycobacterium tuberculosis
PPAPPGPPAPPAPPIPPLPPSPPLSPATI

SEQ ID NO: 1447927 - protein, 20 aa, Mycobacterium tuberculosis
PPAPPLPNSHPPVPPAPPAA

SEQ ID NO: 1447928 - protein, 21 aa, Mycobacterium tuberculosis
PPAPPNPPLPTAQHSRHCHRP

SEQ ID NO: 1447929 - protein, 29 aa, Mycobacterium tuberculosis
PPAPPSPPPPPAPPFPPAPPLPPTASPKP

SEQ ID NO: 1447930 - protein, 11 aa, Mycobacterium tuberculosis
PPAPPVPPVPP

SEQ ID NO: 1447931 - protein, 8 aa, Mycobacterium tuberculosis
PPARHGQR

SEQ ID NO: 1447932 - protein, 11 aa, Mycobacterium tuberculosis
PPASATTPRWP

SEQ ID NO: 1447933 - protein, 23 aa, Mycobacterium tuberculosis
PPASDGAPFRAAGTPGSINENHV

SEQ ID NO: 1447934 - protein, 7 aa, Mycobacterium tuberculosis
PPASDTN

SEQ ID NO: 1447935 - protein, 23 aa, Mycobacterium tuberculosis
PPASRGRPGPLSGPELADPARSV

SEQ ID NO: 1447936 - protein, 15 aa, Mycobacterium tuberculosis
PPATPRPGSRSTSSL

SEQ ID NO: 1447937 - protein, 9 aa, Mycobacterium tuberculosis
PPATVGGTG

SEQ ID NO: 1447938 - protein, 6 aa, Mycobacterium tuberculosis
PPCCAP

SEQ ID NO: 1447939 - protein, 11 aa, Mycobacterium tuberculosis
PPDGAESVDIS

SEQ ID NO: 1447940 - protein, 4 aa, Mycobacterium tuberculosis
PPDP

SEQ ID NO: 1447941 - protein, 10 aa, Mycobacterium tuberculosis
PPDPPVPPIP

SEQ ID NO: 1447942 - protein, 36 aa, Mycobacterium tuberculosis
PPEDAGAMAPSNGPPDPQTEDEPAVPPPPPGAPDGV

SEQ ID NO: 1447943 - protein, 24 aa, Mycobacterium tuberculosis
PPEGTGPPPGPAPGPQPQASGPAY

SEQ ID NO: 1447944 - protein, 6 aa, Mycobacterium tuberculosis
PPEHTR

SEQ ID NO: 1447945 - protein, 6 aa, Mycobacterium tuberculosis
PPEITS

SEQ ID NO: 1447946 - protein, 6 aa, Mycobacterium tuberculosis
PPEPAR

SEQ ID NO: 1447947 - protein, 16 aa, Mycobacterium tuberculosis
PPEPISKAAPPVPPVP

SEQ ID NO: 1447948 - protein, 13 aa, Mycobacterium tuberculosis
PPEPPAPPFADQQ

SEQ ID NO: 1447949 - protein, 42 aa, Mycobacterium tuberculosis
PPEPPAPPLPTSSAPLPPFPPLPPPGAKTPVPADPAPPAPPL

SEQ ID NO: 1447950 - protein, 6 aa, Mycobacterium tuberculosis
PPEVNS

SEQ ID NO: 1447951 - protein, 11 aa, Mycobacterium tuberculosis
PPFAAGPTGTA

SEQ ID NO: 1447952 - protein, 28 aa, Mycobacterium tuberculosis
PPFPPAPPAPPLPHSKPPLLPAPPLKPL

SEQ ID NO: 1447953 - protein, 17 aa, Mycobacterium tuberculosis
PPFPPAPPLPHISPPAP

SEQ ID NO: 1447954 - protein, 11 aa, Mycobacterium tuberculosis
PPFPPPPPLPP

SEQ ID NO: 1447955 - protein, 17 aa, Mycobacterium tuberculosis
PPFPPPPPVPPSPPVPP

SEQ ID NO: 1447956 - protein, 19 aa, Mycobacterium tuberculosis
PPFRSSDPKPREGTETPRG

SEQ ID NO: 1447957 - protein, 140 aa, Mycobacterium tuberculosis
PPGAPPSGGDPNGGGGGAGGAGGKGGDGGAQAGDGGAGGAGGKGGNGGNGATGATGLNGLGAGADGTDGGKGGNGGAGGGGGAGGQGGKALAATHQDGSMGAGGAGGNGGAGGMGGDGGNGAKGTFDNGGDGGWWQRRQR

SEQ ID NO: 1447958 - protein, 18 aa, Mycobacterium tuberculosis
PPGEDPVTSTVASDRGAG

SEQ ID NO: 1447959 - protein, 4 aa, Mycobacterium tuberculosis
PPGN

SEQ ID NO: 1447960 - protein, 8 aa, Mycobacterium tuberculosis
PPGPAAVA

SEQ ID NO: 1447961 - protein, 32 aa, Mycobacterium tuberculosis
PPGPDPGVPRDAPRAAGPMAGTGGARKHRPTR

SEQ ID NO: 1447962 - protein, 14 aa, Mycobacterium tuberculosis
PPGPNTSSPKPMPN

SEQ ID NO: 1447963 - protein, 24 aa, Mycobacterium tuberculosis
PPGPPSRPTKAPARSPPAPPAPPW

SEQ ID NO: 1447964 - protein, 5 aa, Mycobacterium tuberculosis
PPGPW

SEQ ID NO: 1447965 - protein, 6 aa, Mycobacterium tuberculosis
PPGRSA

SEQ ID NO: 1447966 - protein, 10 aa, Mycobacterium tuberculosis
PPGSARPSWP

SEQ ID NO: 1447967 - protein, 5 aa, Mycobacterium tuberculosis
PPHGR

SEQ ID NO: 1447968 - protein, 15 aa, Mycobacterium tuberculosis
PPHRPTTTSSPGFDR

SEQ ID NO: 1447969 - protein, 16 aa, Mycobacterium tuberculosis
PPHTPHPPRATSAHPH

SEQ ID NO: 1447970 - protein, 8 aa, Mycobacterium tuberculosis
PPKLRSPR

SEQ ID NO: 1447971 - protein, 33 aa, Mycobacterium tuberculosis
PPKPPLPPLPPLPPSAPLPPKPPAPPEPAVPPV

SEQ ID NO: 1447972 - protein, 46 aa, Mycobacterium tuberculosis
PPKPPLPPLPPLPPSAPLPPKPPAPPEPAVPPVPAPPALPPAPPLP

SEQ ID NO: 1447973 - protein, 60 aa, Mycobacterium tuberculosis
PPKPPLPPLPPLPPSAPLPPKPPAPPEPAVPPVPAPPALPPAPPLPPSPAVGAATGELGG

SEQ ID NO: 1447974 - protein, 60 aa, Mycobacterium tuberculosis
PPKPPRTPWAKPPVNSSANPPFPPSPPRPPGAPAPPMPPLPPAPPAPPLPINPALLPAPR

SEQ ID NO: 1447975 - protein, 32 aa, Mycobacterium tuberculosis
PPLAGYTRARRRRSGCARPPRAWPRPWIAGRP

SEQ ID NO: 1447976 - protein, 5 aa, Mycobacterium tuberculosis
PPLDE

SEQ ID NO: 1447977 - protein, 25 aa, Mycobacterium tuberculosis
PPLGEQPEPERSRVPPRTTRAGERI

SEQ ID NO: 1447978 - protein, 5 aa, Mycobacterium tuberculosis
PPLLT

SEQ ID NO: 1447979 - protein, 4 aa, Mycobacterium tuberculosis
PPLP

SEQ ID NO: 1447980 - protein, 73 aa, Mycobacterium tuberculosis
PPLPPADAAASPAPAPPPVPPSPISPPLPPSPPLPPGIPAPNPDPPAPPAPPWPNSPTALPPIPPLPADVPGP

SEQ ID NO: 1447981 - protein, 29 aa, Mycobacterium tuberculosis
PPLPPKPPSGALPPPPPAPPRPPFAAGGA

SEQ ID NO: 1447982 - protein, 22 aa, Mycobacterium tuberculosis
PPLPPLPNNHPPAPPSAPVPGV

SEQ ID NO: 1447983 - protein, 17 aa, Mycobacterium tuberculosis
PPLPPLPPSPPSPSLVP

SEQ ID NO: 1447984 - protein, 37 aa, Mycobacterium tuberculosis
PPLPPSPAAAAAADQPADPAGTADAAVPAAGAGRREA

SEQ ID NO: 1447985 - protein, 17 aa, Mycobacterium tuberculosis
PPLPPSPPEPPTPPLPP

SEQ ID NO: 1447986 - protein, 45 aa, Mycobacterium tuberculosis
PPLPRSHPPRPPLPPTPPAPPSPPSDPAKPSPPAPSSDPATPAAP

SEQ ID NO: 1447987 - protein, 6 aa, Mycobacterium tuberculosis
PPLSHK

SEQ ID NO: 1447988 - protein, 10 aa, Mycobacterium tuberculosis
PPMHPPPPVT

SEQ ID NO: 1447989 - protein, 14 aa, Mycobacterium tuberculosis
PPMPPQSPPRAHSA

SEQ ID NO: 1447990 - protein, 24 aa, Mycobacterium tuberculosis
PPNAPPGARTQPLEPFPDGTGGSN

SEQ ID NO: 1447991 - protein, 7 aa, Mycobacterium tuberculosis
PPNLVSG

SEQ ID NO: 1447992 - protein, 23 aa, Mycobacterium tuberculosis
PPNVPQRRGQRRSSTADLVSQPS

SEQ ID NO: 1447993 - protein, 42 aa, Mycobacterium tuberculosis
PPNWAGASPSLAPTVGSASAPWSAISSSNRRPVRRETCWAAC

SEQ ID NO: 1447994 - protein, 8 aa, Mycobacterium tuberculosis
PPPAEGDE

SEQ ID NO: 1447995 - protein, 8 aa, Mycobacterium tuberculosis
PPPARGGL

SEQ ID NO: 1447996 - protein, 7 aa, Mycobacterium tuberculosis
PPPDEPN

SEQ ID NO: 1447997 - protein, 16 aa, Mycobacterium tuberculosis
PPPEIAANRALLMALL

SEQ ID NO: 1447998 - protein, 10 aa, Mycobacterium tuberculosis
PPPGAGAPPW

SEQ ID NO: 1447999 - protein, 9 aa, Mycobacterium tuberculosis
PPPGGPVEG

SEQ ID NO: 1448000 - protein, 5 aa, Mycobacterium tuberculosis
PPPMA

SEQ ID NO: 1448001 - protein, 92 aa, Mycobacterium tuberculosis
PPPPAPSPPPPPPPPPPPPPPPPPPPPPPPPPPPPPPPPAPPPPPRPPPRPPRPRRAAPAAPRRPPPRSAPPAGGGGAGRGLPQPLRCARPR

SEQ ID NO: 1448002 - protein, 7 aa, Mycobacterium tuberculosis
PPPPGSF

SEQ ID NO: 1448003 - protein, 17 aa, Mycobacterium tuberculosis
PPPPVPPVPPAPPAPPL

SEQ ID NO: 1448004 - protein, 5 aa, Mycobacterium tuberculosis
PPPSL

SEQ ID NO: 1448005 - protein, 10 aa, Mycobacterium tuberculosis
PPPSLPGAAN

SEQ ID NO: 1448006 - protein, 6 aa, Mycobacterium tuberculosis
PPPSRR

SEQ ID NO: 1448007 - protein, 7 aa, Mycobacterium tuberculosis
PPPTARC

SEQ ID NO: 1448008 - protein, 54 aa, Mycobacterium tuberculosis
PPPTAVNGGQLAANGRKGRPRPQRETGAAGGKRRQRRLPASTAVTPATAATAVG

SEQ ID NO: 1448009 - protein, 5 aa, Mycobacterium tuberculosis
PPQAG

SEQ ID NO: 1448010 - protein, 5 aa, Mycobacterium tuberculosis
PPQQA

SEQ ID NO: 1448011 - protein, 24 aa, Mycobacterium tuberculosis
PPQRSNNDFKPGYSNALDGQGPGL

SEQ ID NO: 1448012 - protein, 9 aa, Mycobacterium tuberculosis
PPQTAKPAV

SEQ ID NO: 1448013 - protein, 18 aa, Mycobacterium tuberculosis
PPRAKDAFGAQKRQRQMD

SEQ ID NO: 1448014 - protein, 8 aa, Mycobacterium tuberculosis
PPRAPGRG

SEQ ID NO: 1448015 - protein, 4 aa, Mycobacterium tuberculosis
PPRC

SEQ ID NO: 1448016 - protein, 5 aa, Mycobacterium tuberculosis
PPRDA

SEQ ID NO: 1448017 - protein, 9 aa, Mycobacterium tuberculosis
PPRGGGGHG

SEQ ID NO: 1448018 - protein, 11 aa, Mycobacterium tuberculosis
PPRGPPRHRTT

SEQ ID NO: 1448019 - protein, 15 aa, Mycobacterium tuberculosis
PPRHAAGPRAPPRAR

SEQ ID NO: 1448020 - protein, 13 aa, Mycobacterium tuberculosis
PPRKNSSRGRGHE

SEQ ID NO: 1448021 - protein, 31 aa, Mycobacterium tuberculosis
PPRPAISARSAWPRGGPRAGAGSRGHRRACP

SEQ ID NO: 1448022 - protein, 8 aa, Mycobacterium tuberculosis
PPRPHHQS

SEQ ID NO: 1448023 - protein, 15 aa, Mycobacterium tuberculosis
PPRRMPSMTTTSPNT

SEQ ID NO: 1448024 - protein, 14 aa, Mycobacterium tuberculosis
PPRRPTPDCPLAPP

SEQ ID NO: 1448025 - protein, 13 aa, Mycobacterium tuberculosis
PPRVAAEPPSPGS

SEQ ID NO: 1448026 - protein, 12 aa, Mycobacterium tuberculosis
PPSGHTARPTHH

SEQ ID NO: 1448027 - protein, 8 aa, Mycobacterium tuberculosis
PPSIPTTT

SEQ ID NO: 1448028 - protein, 18 aa, Mycobacterium tuberculosis
PPSPMARSRGTSNFGVFR

SEQ ID NO: 1448029 - protein, 18 aa, Mycobacterium tuberculosis
PPSPPLTKKVSVPVAPPP

SEQ ID NO: 1448030 - protein, 16 aa, Mycobacterium tuberculosis
PPSRTKRARSRIRPPE

SEQ ID NO: 1448031 - protein, 10 aa, Mycobacterium tuberculosis
PPSSPNDTGV

SEQ ID NO: 1448032 - protein, 9 aa, Mycobacterium tuberculosis
PPSSRPVPG

SEQ ID NO: 1448033 - protein, 12 aa, Mycobacterium tuberculosis
PPTAPAPPLPPL

SEQ ID NO: 1448034 - protein, 17 aa, Mycobacterium tuberculosis
PPTGAGPPARCDYRAQR

SEQ ID NO: 1448035 - protein, 18 aa, Mycobacterium tuberculosis
PPTGRGRLSAGAAGLRLR

SEQ ID NO: 1448036 - protein, 18 aa, Mycobacterium tuberculosis
PPTPATAAARGSSARWCR

SEQ ID NO: 1448037 - protein, 9 aa, Mycobacterium tuberculosis
PPTRPRQRS

SEQ ID NO: 1448038 - protein, 15 aa, Mycobacterium tuberculosis
PPTSLSRSVWAFQGR

SEQ ID NO: 1448039 - protein, 137 aa, Mycobacterium tuberculosis
PPVAPGPPSVPAPPAPSAPPAPNSSSARPPAPPVPPPAPPTPPAPSSPQIKPPGPPAPPVPPPAPPTPPAPPTPNSHPPAPPAPPVPPPLPPAPPGPPLPHNPAGPPAPPAWPGAPAAPAPPLPNSRPPAPPAPPGV

SEQ ID NO: 1448040 - protein, 28 aa, Mycobacterium tuberculosis
PPVAPPSPLSRSEPPLPPFPPTPPVPPT

SEQ ID NO: 1448041 - protein, 14 aa, Mycobacterium tuberculosis
PPVGAGGCGSGAAR

SEQ ID NO: 1448042 - protein, 5 aa, Mycobacterium tuberculosis
PPVPD

SEQ ID NO: 1448043 - protein, 14 aa, Mycobacterium tuberculosis
PPVPPAPPLPPMPP

SEQ ID NO: 1448044 - protein, 20 aa, Mycobacterium tuberculosis
PPVPPAPPVPPLPPGPPLPI

SEQ ID NO: 1448045 - protein, 25 aa, Mycobacterium tuberculosis
PPVPPEPISKETPPAPPAPPIPPAP

SEQ ID NO: 1448046 - protein, 20 aa, Mycobacterium tuberculosis
PPVPPGGNRQPMPRARPVPP

SEQ ID NO: 1448047 - protein, 6 aa, Mycobacterium tuberculosis
PPVPPL

SEQ ID NO: 1448048 - protein, 25 aa, Mycobacterium tuberculosis
PPVPPLPPGPPESPGPPSPPSPINW

SEQ ID NO: 1448049 - protein, 10 aa, Mycobacterium tuberculosis
PPVPPLPPVR

SEQ ID NO: 1448050 - protein, 77 aa, Mycobacterium tuberculosis
PPVPPVPPVPPVPQSPGVPPGPLEPPSPASPPRPASPPRPPPPPSPGEVTRSPLAPLPPLPPLPGVPPVPPLPPAPV

SEQ ID NO: 1448051 - protein, 15 aa, Mycobacterium tuberculosis
PPYDAASSGVGNSGY

SEQ ID NO: 1448052 - protein, 13 aa, Mycobacterium tuberculosis
PPYSVGQSSVNDL

SEQ ID NO: 1448053 - protein, 4 aa, Mycobacterium tuberculosis
PQAF

SEQ ID NO: 1448054 - protein, 15 aa, Mycobacterium tuberculosis
PQDEIPEADAVEQGR

SEQ ID NO: 1448055 - protein, 16 aa, Mycobacterium tuberculosis
PQDEIPEADAVEQGRA

SEQ ID NO: 1448056 - protein, 4 aa, Mycobacterium tuberculosis
PQET

SEQ ID NO: 1448057 - protein, 7 aa, Mycobacterium tuberculosis
PQFERRQ

SEQ ID NO: 1448058 - protein, 5 aa, Mycobacterium tuberculosis
PQFGS

SEQ ID NO: 1448059 - protein, 11 aa, Mycobacterium tuberculosis
PQFSSAPTNHA

SEQ ID NO: 1448060 - protein, 10 aa, Mycobacterium tuberculosis
PQGGAHDERT

SEQ ID NO: 1448061 - protein, 14 aa, Mycobacterium tuberculosis
PQKKSPTNLFSQIS

SEQ ID NO: 1448062 - protein, 6 aa, Mycobacterium tuberculosis
PQLAPA

SEQ ID NO: 1448063 - protein, 14 aa, Mycobacterium tuberculosis
PQLPPAGQRQLGVA

SEQ ID NO: 1448064 - protein, 9 aa, Mycobacterium tuberculosis
PQMPPRGGN

SEQ ID NO: 1448065 - protein, 8 aa, Mycobacterium tuberculosis
PQMREQTQ

SEQ ID NO: 1448066 - protein, 29 aa, Mycobacterium tuberculosis
PQNLGAGPQREHRHRQGRRHGAQSQSGVL

SEQ ID NO: 1448067 - protein, 24 aa, Mycobacterium tuberculosis
PQPALPADAASLADATGGAGTPVP

SEQ ID NO: 1448068 - protein, 26 aa, Mycobacterium tuberculosis
PQPDSAAAAAAAAAVRDQTRARRRRR

SEQ ID NO: 1448069 - protein, 5 aa, Mycobacterium tuberculosis
PQPGD

SEQ ID NO: 1448070 - protein, 17 aa, Mycobacterium tuberculosis
PQPGHHGGPRQGQRQRR

SEQ ID NO: 1448071 - protein, 9 aa, Mycobacterium tuberculosis
PQPHPGRQN

SEQ ID NO: 1448072 - protein, 7 aa, Mycobacterium tuberculosis
PQPPFGN

SEQ ID NO: 1448073 - protein, 72 aa, Mycobacterium tuberculosis
PQPPRIEPPESGHPAPAPAAKPAPVPANGPLPHSPTESKPPPVDRPAEPVAPSSASAGQPRVSAATTPGTHV

SEQ ID NO: 1448074 - protein, 7 aa, Mycobacterium tuberculosis
PQPPTPV

SEQ ID NO: 1448075 - protein, 5 aa, Mycobacterium tuberculosis
PQPQR

SEQ ID NO: 1448076 - protein, 4 aa, Mycobacterium tuberculosis
PQPS

SEQ ID NO: 1448077 - protein, 7 aa, Mycobacterium tuberculosis
PQQNPLN

SEQ ID NO: 1448078 - protein, 12 aa, Mycobacterium tuberculosis
PQQPAGDGDDAG

SEQ ID NO: 1448079 - protein, 28 aa, Mycobacterium tuberculosis
PQQRNRVGYADPGAHGAPVPSAPDGRDH

SEQ ID NO: 1448080 - protein, 9 aa, Mycobacterium tuberculosis
PQRAPGYEE

SEQ ID NO: 1448081 - protein, 4 aa, Mycobacterium tuberculosis
PQRG

SEQ ID NO: 1448082 - protein, 8 aa, Mycobacterium tuberculosis
PQRGPGPM

SEQ ID NO: 1448083 - protein, 7 aa, Mycobacterium tuberculosis
PQRRRAP

SEQ ID NO: 1448084 - protein, 24 aa, Mycobacterium tuberculosis
PQRRRKGTDLEAVGEDHDCPGLAS

SEQ ID NO: 1448085 - protein, 10 aa, Mycobacterium tuberculosis
PQRSPTADGC

SEQ ID NO: 1448086 - protein, 8 aa, Mycobacterium tuberculosis
PQRTGDPL

SEQ ID NO: 1448087 - protein, 11 aa, Mycobacterium tuberculosis
PQRWSGRSSGC

SEQ ID NO: 1448088 - protein, 6 aa, Mycobacterium tuberculosis
PQSRGQ

SEQ ID NO: 1448089 - protein, 4 aa, Mycobacterium tuberculosis
PQTR

SEQ ID NO: 1448090 - protein, 19 aa, Mycobacterium tuberculosis
PQTVPDATHPGAEQVTHPG

SEQ ID NO: 1448091 - protein, 27 aa, Mycobacterium tuberculosis
PQTVPGRDAPRGRTGNPSRTRRDNRAM

SEQ ID NO: 1448092 - protein, 4 aa, Mycobacterium tuberculosis
PQVE

SEQ ID NO: 1448093 - protein, 23 aa, Mycobacterium tuberculosis
PQYSNPEPPEPPPSPGIGQTTTS

SEQ ID NO: 1448094 - protein, 5 aa, Mycobacterium tuberculosis
PRAEG

SEQ ID NO: 1448095 - protein, 10 aa, Mycobacterium tuberculosis
PRAGADPSGC

SEQ ID NO: 1448096 - protein, 9 aa, Mycobacterium tuberculosis
PRAHPPAGD

SEQ ID NO: 1448097 - protein, 5 aa, Mycobacterium tuberculosis
PRAKS

SEQ ID NO: 1448098 - protein, 13 aa, Mycobacterium tuberculosis
PRAPGRSSGTPGY

SEQ ID NO: 1448099 - protein, 23 aa, Mycobacterium tuberculosis
PRAPSAPAVDPAPPIPPAPPMPR

SEQ ID NO: 1448100 - protein, 17 aa, Mycobacterium tuberculosis
PRARPRPVWRRSAGAAN

SEQ ID NO: 1448101 - protein, 8 aa, Mycobacterium tuberculosis
PRATDGEW

SEQ ID NO: 1448102 - protein, 18 aa, Mycobacterium tuberculosis
PRCTPKSHPGCRRSANSC

SEQ ID NO: 1448103 - protein, 6 aa, Mycobacterium tuberculosis
PRDGNV

SEQ ID NO: 1448104 - protein, 10 aa, Mycobacterium tuberculosis
PREARAMDPR

SEQ ID NO: 1448105 - protein, 5 aa, Mycobacterium tuberculosis
PREGA

SEQ ID NO: 1448106 - protein, 5 aa, Mycobacterium tuberculosis
PRGDG

SEQ ID NO: 1448107 - protein, 20 aa, Mycobacterium tuberculosis
PRGHRRDDPEGRYRRAVSSP

SEQ ID NO: 1448108 - protein, 7 aa, Mycobacterium tuberculosis
PRGPHGV

SEQ ID NO: 1448109 - protein, 16 aa, Mycobacterium tuberculosis
PRGRGPSLRLPLAHGD

SEQ ID NO: 1448110 - protein, 7 aa, Mycobacterium tuberculosis
PRHTRAE

SEQ ID NO: 1448111 - protein, 12 aa, Mycobacterium tuberculosis
PRIRGGGRASVG

SEQ ID NO: 1448112 - protein, 7 aa, Mycobacterium tuberculosis
PRITRAE

SEQ ID NO: 1448113 - protein, 4 aa, Mycobacterium tuberculosis
PRIY

SEQ ID NO: 1448114 - protein, 7 aa, Mycobacterium tuberculosis
PRKIPPG

SEQ ID NO: 1448115 - protein, 9 aa, Mycobacterium tuberculosis
PRKSVSGSL

SEQ ID NO: 1448116 - protein, 14 aa, Mycobacterium tuberculosis
PRLGRGGGGQLRPG

SEQ ID NO: 1448117 - protein, 6 aa, Mycobacterium tuberculosis
PRLPRS

SEQ ID NO: 1448118 - protein, 10 aa, Mycobacterium tuberculosis
PRLPSPTLPR

SEQ ID NO: 1448119 - protein, 4 aa, Mycobacterium tuberculosis
PRLR

SEQ ID NO: 1448120 - protein, 15 aa, Mycobacterium tuberculosis
PRLRSAGDQRGRTRH

SEQ ID NO: 1448121 - protein, 5 aa, Mycobacterium tuberculosis
PRLSP

SEQ ID NO: 1448122 - protein, 7 aa, Mycobacterium tuberculosis
PRLSPAS

SEQ ID NO: 1448123 - protein, 10 aa, Mycobacterium tuberculosis
PRLSPASRHI

SEQ ID NO: 1448124 - protein, 18 aa, Mycobacterium tuberculosis
PRLTPPVPSIPGRRSKPT

SEQ ID NO: 1448125 - protein, 12 aa, Mycobacterium tuberculosis
PRLTSPTLPNPT

SEQ ID NO: 1448126 - protein, 5 aa, Mycobacterium tuberculosis
PRNEL

SEQ ID NO: 1448127 - protein, 7 aa, Mycobacterium tuberculosis
PRNPTGK

SEQ ID NO: 1448128 - protein, 5 aa, Mycobacterium tuberculosis
PRNQA

SEQ ID NO: 1448129 - protein, 5 aa, Mycobacterium tuberculosis
PRPAL

SEQ ID NO: 1448130 - protein, 12 aa, Mycobacterium tuberculosis
PRPARSTQPVQR

SEQ ID NO: 1448131 - protein, 25 aa, Mycobacterium tuberculosis
PRPAVDRHPGRRGEPRRDRNSRQLA

SEQ ID NO: 1448132 - protein, 16 aa, Mycobacterium tuberculosis
PRPETSAGVPTPSVLV

SEQ ID NO: 1448133 - protein, 24 aa, Mycobacterium tuberculosis
PRPGAAGRAARGRPPAPAAGARPA

SEQ ID NO: 1448134 - protein, 8 aa, Mycobacterium tuberculosis
PRPGARTD

SEQ ID NO: 1448135 - protein, 35 aa, Mycobacterium tuberculosis
PRPGDSGGRPGVASGRAARPGVEHPRRTAGLGARA

SEQ ID NO: 1448136 - protein, 15 aa, Mycobacterium tuberculosis
PRPGNTASSTTAPHA

SEQ ID NO: 1448137 - protein, 27 aa, Mycobacterium tuberculosis
PRPGRANRSDAVGVDGTGGGTWTPPRR

SEQ ID NO: 1448138 - protein, 12 aa, Mycobacterium tuberculosis
PRPLGGRRRPVR

SEQ ID NO: 1448139 - protein, 8 aa, Mycobacterium tuberculosis
PRPNWRSK

SEQ ID NO: 1448140 - protein, 22 aa, Mycobacterium tuberculosis
PRPPAPPRPPAPPAPPGPPTPR

SEQ ID NO: 1448141 - protein, 39 aa, Mycobacterium tuberculosis
PRPPFPPAPPVPPLPPAAPSAPLPSPPIPPSPPKASPTP

SEQ ID NO: 1448142 - protein, 14 aa, Mycobacterium tuberculosis
PRPPQQRAKALPGR

SEQ ID NO: 1448143 - protein, 21 aa, Mycobacterium tuberculosis
PRPPRPTPPNCSGSWRKTGTA

SEQ ID NO: 1448144 - protein, 23 aa, Mycobacterium tuberculosis
PRPPRPTPPNCSGSWRRPARPGC

SEQ ID NO: 1448145 - protein, 7 aa, Mycobacterium tuberculosis
PRPQRSH

SEQ ID NO: 1448146 - protein, 31 aa, Mycobacterium tuberculosis
PRPRPSRRAARWPSATPAPPARHPAPPGSAI

SEQ ID NO: 1448147 - protein, 10 aa, Mycobacterium tuberculosis
PRPSRGPVVD

SEQ ID NO: 1448148 - protein, 6 aa, Mycobacterium tuberculosis
PRPVPG

SEQ ID NO: 1448149 - protein, 15 aa, Mycobacterium tuberculosis
PRQEPRYRAGPGPVA

SEQ ID NO: 1448150 - protein, 21 aa, Mycobacterium tuberculosis
PRQESNDATGGTTESGISGSR

SEQ ID NO: 1448151 - protein, 8 aa, Mycobacterium tuberculosis
PRQQDEGD

SEQ ID NO: 1448152 - protein, 7 aa, Mycobacterium tuberculosis
PRQTPDK

SEQ ID NO: 1448153 - protein, 4 aa, Mycobacterium tuberculosis
PRQV

SEQ ID NO: 1448154 - protein, 19 aa, Mycobacterium tuberculosis
PRRCGSGGNDLCSGEMGWR

SEQ ID NO: 1448155 - protein, 13 aa, Mycobacterium tuberculosis
PRRGHTSASPTTR

SEQ ID NO: 1448156 - protein, 12 aa, Mycobacterium tuberculosis
PRRGRYARGVQG

SEQ ID NO: 1448157 - protein, 44 aa, Mycobacterium tuberculosis
PRRLGAPDTGDDCCGGRGDRVDGAAQPARLPVSADDQRIAAPTR

SEQ ID NO: 1448158 - protein, 11 aa, Mycobacterium tuberculosis
PRRPPTDAPKA

SEQ ID NO: 1448159 - protein, 6 aa, Mycobacterium tuberculosis
PRRPQV

SEQ ID NO: 1448160 - protein, 12 aa, Mycobacterium tuberculosis
PRRQDTSRRAAQ

SEQ ID NO: 1448161 - protein, 6 aa, Mycobacterium tuberculosis
PRRSPR

SEQ ID NO: 1448162 - protein, 26 aa, Mycobacterium tuberculosis
PRRTRSSAGFGAPRYGAKPIVVPKPA

SEQ ID NO: 1448163 - protein, 13 aa, Mycobacterium tuberculosis
PRSAANRPAYYFQ

SEQ ID NO: 1448164 - protein, 8 aa, Mycobacterium tuberculosis
PRSATPTH

SEQ ID NO: 1448165 - protein, 6 aa, Mycobacterium tuberculosis
PRSATV

SEQ ID NO: 1448166 - protein, 4 aa, Mycobacterium tuberculosis
PRSC

SEQ ID NO: 1448167 - protein, 19 aa, Mycobacterium tuberculosis
PRSCRPGRKRCRRQLRCHI

SEQ ID NO: 1448168 - protein, 21 aa, Mycobacterium tuberculosis
PRSGALGGDGIAGTPVPEGAG

SEQ ID NO: 1448169 - protein, 6 aa, Mycobacterium tuberculosis
PRSPLG

SEQ ID NO: 1448170 - protein, 21 aa, Mycobacterium tuberculosis
PRSPTCTRGGCAASPVTTWCC

SEQ ID NO: 1448171 - protein, 13 aa, Mycobacterium tuberculosis
PRTPGLPPMWRAV

SEQ ID NO: 1448172 - protein, 113 aa, Mycobacterium tuberculosis
PRTPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPPP

SEQ ID NO: 1448173 - protein, 28 aa, Mycobacterium tuberculosis
PRTPSAPTPPVPPVPPAPPTPPAPPSPP

SEQ ID NO: 1448174 - protein, 16 aa, Mycobacterium tuberculosis
PRTRVGAPPAEGVPPR

SEQ ID NO: 1448175 - protein, 15 aa, Mycobacterium tuberculosis
PRTSRPRRVAGRGRP

SEQ ID NO: 1448176 - protein, 49 aa, Mycobacterium tuberculosis
PRVAKAAKAAPKKAAPNDAEAIGAANAANVKGPKHTPRTPKPRGRRKTR

SEQ ID NO: 1448177 - protein, 24 aa, Mycobacterium tuberculosis
PRYGSASKDVQQQLAGRSGQRASA

SEQ ID NO: 1448178 - protein, 23 aa, Mycobacterium tuberculosis
PRYLTSSAATAVGATAVGPSLPT

SEQ ID NO: 1448179 - protein, 11 aa, Mycobacterium tuberculosis
PRYRAGPGPVA

SEQ ID NO: 1448180 - protein, 6 aa, Mycobacterium tuberculosis
PSAAAP

SEQ ID NO: 1448181 - protein, 5 aa, Mycobacterium tuberculosis
PSAAL

SEQ ID NO: 1448182 - protein, 6 aa, Mycobacterium tuberculosis
PSAEQL

SEQ ID NO: 1448183 - protein, 14 aa, Mycobacterium tuberculosis
PSAGSSRKLLPPRS

SEQ ID NO: 1448184 - protein, 13 aa, Mycobacterium tuberculosis
PSAIEANPRQPRQ

SEQ ID NO: 1448185 - protein, 5 aa, Mycobacterium tuberculosis
PSALV

SEQ ID NO: 1448186 - protein, 11 aa, Mycobacterium tuberculosis
PSAPGNPGRWG

SEQ ID NO: 1448187 - protein, 21 aa, Mycobacterium tuberculosis
PSAPLPIQRTPQQRLGGRVDQ

SEQ ID NO: 1448188 - protein, 4 aa, Mycobacterium tuberculosis
PSAQ

SEQ ID NO: 1448189 - protein, 15 aa, Mycobacterium tuberculosis
PSAQRAPQGPRSQRL

SEQ ID NO: 1448190 - protein, 8 aa, Mycobacterium tuberculosis
PSARRASR

SEQ ID NO: 1448191 - protein, 12 aa, Mycobacterium tuberculosis
PSARSPSGWPEP

SEQ ID NO: 1448192 - protein, 16 aa, Mycobacterium tuberculosis
PSASGGTVVHTTSRWR

SEQ ID NO: 1448193 - protein, 6 aa, Mycobacterium tuberculosis
PSATRR

SEQ ID NO: 1448194 - protein, 5 aa, Mycobacterium tuberculosis
PSAVE

SEQ ID NO: 1448195 - protein, 7 aa, Mycobacterium tuberculosis
PSCTSTR

SEQ ID NO: 1448196 - protein, 8 aa, Mycobacterium tuberculosis
PSDAPEYS

SEQ ID NO: 1448197 - protein, 5 aa, Mycobacterium tuberculosis
PSDID

SEQ ID NO: 1448198 - protein, 7 aa, Mycobacterium tuberculosis
PSELGSP

SEQ ID NO: 1448199 - protein, 14 aa, Mycobacterium tuberculosis
PSETTPSLPECTGA

SEQ ID NO: 1448200 - protein, 6 aa, Mycobacterium tuberculosis
PSFENL

SEQ ID NO: 1448201 - protein, 13 aa, Mycobacterium tuberculosis
PSGARCPKADGQS

SEQ ID NO: 1448202 - protein, 12 aa, Mycobacterium tuberculosis
PSGGESHSDTGI

SEQ ID NO: 1448203 - protein, 32 aa, Mycobacterium tuberculosis
PSGLSPDDGLPVGPTDHGAGIGRRPALPGGGG

SEQ ID NO: 1448204 - protein, 11 aa, Mycobacterium tuberculosis
PSGLSPDDGVA

SEQ ID NO: 1448205 - protein, 21 aa, Mycobacterium tuberculosis
PSGPELSRANASVARDTVAPG

SEQ ID NO: 1448206 - protein, 10 aa, Mycobacterium tuberculosis
PSGRALESRP

SEQ ID NO: 1448207 - protein, 18 aa, Mycobacterium tuberculosis
PSGRSERGNAYAGARPRR

SEQ ID NO: 1448208 - protein, 14 aa, Mycobacterium tuberculosis
PSGSVSTPGHFVVP

SEQ ID NO: 1448209 - protein, 18 aa, Mycobacterium tuberculosis
PSGVTAPTTPVSAGLTRR

SEQ ID NO: 1448210 - protein, 43 aa, Mycobacterium tuberculosis; identical to SEQ ID NO: 1367109

SEQ ID NO: 1448211 - protein, 36 aa, Mycobacterium tuberculosis
PSIPTPTPTPAPAPAPTAVTAPTPPPGPPPPPVTAP

SEQ ID NO: 1448212 - protein, 51 aa, Mycobacterium tuberculosis
PSIPTPTPTPAPAPAPTAVTAPTPPPGPPPPPVTAPPPVTAAGIQSFGYLV

SEQ ID NO: 1448213 - protein, 4 aa, Mycobacterium tuberculosis
PSLK

SEQ ID NO: 1448214 - protein, 24 aa, Mycobacterium tuberculosis
PSLPGAPNRVRSRTRRRPAPSMPR

SEQ ID NO: 1448215 - protein, 28 aa, Mycobacterium tuberculosis
PSLTARSRRPPESRSRAPRRPATFSSSR

SEQ ID NO: 1448216 - protein, 6 aa, Mycobacterium tuberculosis
PSPGPT

SEQ ID NO: 1448217 - protein, 47 aa, Mycobacterium tuberculosis
PSPGTPGTPGTPGTPITPGTPITPGTPITPGTPITPGTPITPIPGAP

SEQ ID NO: 1448218 - protein, 149 aa, Mycobacterium tuberculosis
PSPGTPGTPGTPITPGTPITPGTPITPGTPITPGTPITPIPGAPVTPITPTPGTPVTPVTPGKPVTPVTPVKPGTPGEPTPITPVTPPVAPATPATPATPVTPAPAPHPQPAPAPAPSPGPQPVTPATPGPSGPATPGTPGGEPAPHVK

SEQ ID NO: 1448219 - protein, 137 aa, Mycobacterium tuberculosis
PSPGTPGTPGTPITPGTPITPGTPITPIPGAPVTPMTPTPGTPVTPVTPGKPVTPVTPVKPGTPGEPTPITPVTPPVAPATPATPATPVTPAPAPHPQPAPAPAPSPGPQPVTPATPGPSGPATPGTPGGEPAPHVK

SEQ ID NO: 1448220 - protein, 11 aa, Mycobacterium tuberculosis
PSPINGRPSSA

SEQ ID NO: 1448221 - protein, 45 aa, Mycobacterium tuberculosis
PSPLPSPSLSGSISGPSAATSTAAATAAATNALRGANVGPGANKA

SEQ ID NO: 1448222 - protein, 7 aa, Mycobacterium tuberculosis
PSPLSSG

SEQ ID NO: 1448223 - protein, 7 aa, Mycobacterium tuberculosis
PSPNRQI

SEQ ID NO: 1448224 - protein, 10 aa, Mycobacterium tuberculosis
PSPPAPPVPA

SEQ ID NO: 1448225 - protein, 22 aa, Mycobacterium tuberculosis
PSPPSSAGKVGRNGAELPAGRI

SEQ ID NO: 1448226 - protein, 8 aa, Mycobacterium tuberculosis
PSPRYAPA

SEQ ID NO: 1448227 - protein, 10 aa, Mycobacterium tuberculosis
PSPSAKPESL

SEQ ID NO: 1448228 - protein, 34 aa, Mycobacterium tuberculosis
PSPSLKAMSPRPPLPPLPGAPPAPPAPPSPPTPW

SEQ ID NO: 1448229 - protein, 5 aa, Mycobacterium tuberculosis
PSPTG

SEQ ID NO: 1448230 - protein, 10 aa, Mycobacterium tuberculosis
PSPYSGQPTF

SEQ ID NO: 1448231 - protein, 11 aa, Mycobacterium tuberculosis
PSQAAAAASIG

SEQ ID NO: 1448232 - protein, 7 aa, Mycobacterium tuberculosis
PSQAMGP

SEQ ID NO: 1448233 - protein, 7 aa, Mycobacterium tuberculosis
PSQPGTH

SEQ ID NO: 1448234 - protein, 36 aa, Mycobacterium tuberculosis
PSQQPRFGRKKRARAHGDDAAGGAGDGFDPVDEGRF

SEQ ID NO: 1448235 - protein, 13 aa, Mycobacterium tuberculosis
PSREVHAGRDPGV

SEQ ID NO: 1448236 - protein, 4 aa, Mycobacterium tuberculosis
PSRP

SEQ ID NO: 1448237 - protein, 32 aa, Mycobacterium tuberculosis
PSRPAPDHGNIKRSSPAAPDAPVQRPDYSETD

SEQ ID NO: 1448238 - protein, 8 aa, Mycobacterium tuberculosis
PSRQAKER

SEQ ID NO: 1448239 - protein, 20 aa, Mycobacterium tuberculosis
PSRSGGTTSRQPRPTAPFRR

SEQ ID NO: 1448240 - protein, 6 aa, Mycobacterium tuberculosis
PSRSTF

SEQ ID NO: 1448241 - protein, 22 aa, Mycobacterium tuberculosis
PSRTSGGSKPNYWTTCGPPKKR

SEQ ID NO: 1448242 - protein, 12 aa, Mycobacterium tuberculosis
PSSGASGGYDTP

SEQ ID NO: 1448243 - protein, 16 aa, Mycobacterium tuberculosis
PSSGTAPGGKPAPKPQ

SEQ ID NO: 1448244 - protein, 14 aa, Mycobacterium tuberculosis
PSSKPGRSRTFSPR

SEQ ID NO: 1448245 - protein, 7 aa, Mycobacterium tuberculosis
PSSQVPA

SEQ ID NO: 1448246 - protein, 20 aa, Mycobacterium tuberculosis
PSSQVPAGTGRCRRSRRCRP

SEQ ID NO: 1448247 - protein, 27 aa, Mycobacterium tuberculosis
PSSRGRAATSRSSPGATVTAGTPPPRS

SEQ ID NO: 1448248 - protein, 4 aa, Mycobacterium tuberculosis
PSSS

SEQ ID NO: 1448249 - protein, 20 aa, Mycobacterium tuberculosis
PSSTAASSRFRSRSRRLTTT

SEQ ID NO: 1448250 - protein, 19 aa, Mycobacterium tuberculosis
PSTDSIDPVQHPDHPSRSA

SEQ ID NO: 1448251 - protein, 5 aa, Mycobacterium tuberculosis
PSTEA

SEQ ID NO: 1448252 - protein, 8 aa, Mycobacterium tuberculosis
PSTGLDPA

SEQ ID NO: 1448253 - protein, 4 aa, Mycobacterium tuberculosis
PSTL

SEQ ID NO: 1448254 - protein, 13 aa, Mycobacterium tuberculosis
PSTLSVGDDSMRA

SEQ ID NO: 1448255 - protein, 6 aa, Mycobacterium tuberculosis
PSTPAP

SEQ ID NO: 1448256 - protein, 5 aa, Mycobacterium tuberculosis
PSTQD

SEQ ID NO: 1448257 - protein, 16 aa, Mycobacterium tuberculosis
PSTSPSPPASPTPSTA

SEQ ID NO: 1448258 - protein, 7 aa, Mycobacterium tuberculosis
PSTSRPF

SEQ ID NO: 1448259 - protein, 15 aa, Mycobacterium tuberculosis
PSTVLGGTGGGGGVG

SEQ ID NO: 1448260 - protein, 4 aa, Mycobacterium tuberculosis
PSVA

SEQ ID NO: 1448261 - protein, 29 aa, Mycobacterium tuberculosis
PSVGARPDRLRGQPRRRTRAGGRPGSARC

SEQ ID NO: 1448262 - protein, 4 aa, Mycobacterium tuberculosis
PSVT

SEQ ID NO: 1448263 - protein, 22 aa, Mycobacterium tuberculosis
PSWATPSSTPVSALSGAGLTTL

SEQ ID NO: 1448264 - protein, 49 aa, Mycobacterium tuberculosis
PSWATPSSTPVSALSGAGLTTLDGTDVAEHGTPGLPGVPAGTDKRASGV

SEQ ID NO: 1448265 - protein, 20 aa, Mycobacterium tuberculosis
PSWPTASATTIPEPSPSGAP

SEQ ID NO: 1448266 - protein, 13 aa, Mycobacterium tuberculosis
PSYRPRKRPGRTT

SEQ ID NO: 1448267 - protein, 16 aa, Mycobacterium tuberculosis
PTADATRSVGPIAISR

SEQ ID NO: 1448268 - protein, 5 aa, Mycobacterium tuberculosis
PTADE

SEQ ID NO: 1448269 - protein, 21 aa, Mycobacterium tuberculosis
PTAKAKARQAPISEVPPSYQQ

SEQ ID NO: 1448270 - protein, 9 aa, Mycobacterium tuberculosis
PTARPQEPL

SEQ ID NO: 1448271 - protein, 12 aa, Mycobacterium tuberculosis
PTATGKPVTSAA

SEQ ID NO: 1448272 - protein, 14 aa, Mycobacterium tuberculosis
PTATPTPLIPTAES

SEQ ID NO: 1448273 - protein, 30 aa, Mycobacterium tuberculosis
PTAWPAAASGGRLRSDAEKSSMHRRQRPSA

SEQ ID NO: 1448274 - protein, 6 aa, Mycobacterium tuberculosis
PTCERG

SEQ ID NO: 1448275 - protein, 40 aa, Mycobacterium tuberculosis
PTCRGATESYAATTGRSSRKRAARISTRHRKSLGRRPRGR

SEQ ID NO: 1448276 - protein, 6 aa, Mycobacterium tuberculosis
PTDHDT

SEQ ID NO: 1448277 - protein, 18 aa, Mycobacterium tuberculosis
PTDTGITNAPAGSAQGRI

SEQ ID NO: 1448278 - protein, 12 aa, Mycobacterium tuberculosis
PTEDGVRPEGAR

SEQ ID NO: 1448279 - protein, 7 aa, Mycobacterium tuberculosis
PTEGPAI

SEQ ID NO: 1448280 - protein, 8 aa, Mycobacterium tuberculosis
PTETKNNE

SEQ ID NO: 1448281 - protein, 5 aa, Mycobacterium tuberculosis
PTFPL

SEQ ID NO: 1448282 - protein, 4 aa, Mycobacterium tuberculosis
PTGE

SEQ ID NO: 1448283 - protein, 4 aa, Mycobacterium tuberculosis
PTGK

SEQ ID NO: 1448284 - protein, 14 aa, Mycobacterium tuberculosis
PTGNGGAGGNGGDA

SEQ ID NO: 1448285 - protein, 16 aa, Mycobacterium tuberculosis
PTGPGHWNSEKNARVL

SEQ ID NO: 1448286 - protein, 15 aa, Mycobacterium tuberculosis
PTGPPSGSGSGDRAG

SEQ ID NO: 1448287 - protein, 4 aa, Mycobacterium tuberculosis
PTGR

SEQ ID NO: 1448288 - protein, 17 aa, Mycobacterium tuberculosis
PTGRPPSGRFRRIAEAP

SEQ ID NO: 1448289 - protein, 14 aa, Mycobacterium tuberculosis
PTGRPTENGPRRSL

SEQ ID NO: 1448290 - protein, 8 aa, Mycobacterium tuberculosis
PTGSAAEQ

SEQ ID NO: 1448291 - protein, 41 aa, Mycobacterium tuberculosis
PTGSAATPGPAVAASASGAAAGTPRAAGSAVTPGSAGAPQQ

SEQ ID NO: 1448292 - protein, 9 aa, Mycobacterium tuberculosis
PTGSIKDRP

SEQ ID NO: 1448293 - protein, 27 aa, Mycobacterium tuberculosis
PTGSSPRAYYEKGPARRHQVSRVDDVE

SEQ ID NO: 1448294 - protein, 4 aa, Mycobacterium tuberculosis
PTGW

SEQ ID NO: 1448295 - protein, 7 aa, Mycobacterium tuberculosis
PTITGTA

SEQ ID NO: 1448296 - protein, 16 aa, Mycobacterium tuberculosis
PTKHNDTRRSGEHQSF

SEQ ID NO: 1448297 - protein, 27 aa, Mycobacterium tuberculosis
PTLAPPAPPAPPAPGLPPLPPVPPAPR

SEQ ID NO: 1448298 - protein, 24 aa, Mycobacterium tuberculosis
PTLPAPELNNPRLPAPEFRPPMPV

SEQ ID NO: 1448299 - protein, 6 aa, Mycobacterium tuberculosis
PTMYGG

SEQ ID NO: 1448300 - protein, 7 aa, Mycobacterium tuberculosis
PTNQNDA

SEQ ID NO: 1448301 - protein, 10 aa, Mycobacterium tuberculosis
PTPAAPAVRP

SEQ ID NO: 1448302 - protein, 74 aa, Mycobacterium tuberculosis
PTPALPPLPPSPNSPATPPAPPLPPGVVPSSPAPPAPPAPPSPNSPALPPSPPAPPGDDGTAEFAQPAGTTGDA

SEQ ID NO: 1448303 - protein, 5 aa, Mycobacterium tuberculosis
PTPAT

SEQ ID NO: 1448304 - protein, 18 aa, Mycobacterium tuberculosis
PTPATTTSASGCPATTSR

SEQ ID NO: 1448305 - protein, 10 aa, Mycobacterium tuberculosis
PTPEPAPNSA

SEQ ID NO: 1448306 - protein, 7 aa, Mycobacterium tuberculosis
PTPGDGN

SEQ ID NO: 1448307 - protein, 6 aa, Mycobacterium tuberculosis
PTPNQL

SEQ ID NO: 1448308 - protein, 79 aa, Mycobacterium tuberculosis
PTPPGPPAPPEPNSSPPAPPAAPLPGPSPPAPPAPPLPNSPAAPPGPPAWPGAPDPPAPPLPYSSPPAPPACPVPGAPL

SEQ ID NO: 1448309 - protein, 47 aa, Mycobacterium tuberculosis
PTPPGPPAPPEPNSSPPAPPAAPLPGPSPPAPPAPPLPNSPAAPPWA

SEQ ID NO: 1448310 - protein, 18 aa, Mycobacterium tuberculosis
PTPRRQRRRSGRPGHCGT

SEQ ID NO: 1448311 - protein, 6 aa, Mycobacterium tuberculosis
PTPSLD

SEQ ID NO: 1448312 - protein, 5 aa, Mycobacterium tuberculosis
PTPTG

SEQ ID NO: 1448313 - protein, 5 aa, Mycobacterium tuberculosis
PTPTL

SEQ ID NO: 1448314 - protein, 5 aa, Mycobacterium tuberculosis
PTPTW

SEQ ID NO: 1448315 - protein, 9 aa, Mycobacterium tuberculosis
PTPVGGNAL

SEQ ID NO: 1448316 - protein, 4 aa, Mycobacterium tuberculosis
PTQA

SEQ ID NO: 1448317 - protein, 9 aa, Mycobacterium tuberculosis
PTRAAATTG

SEQ ID NO: 1448318 - protein, 17 aa, Mycobacterium tuberculosis
PTRAARTEIPEARHPTV

SEQ ID NO: 1448319 - protein, 9 aa, Mycobacterium tuberculosis
PTRGRRRPR

SEQ ID NO: 1448320 - protein, 6 aa, Mycobacterium tuberculosis
PTRHRR

SEQ ID NO: 1448321 - protein, 12 aa, Mycobacterium tuberculosis
PTRPCRAGRHCA

SEQ ID NO: 1448322 - protein, 17 aa, Mycobacterium tuberculosis
PTRPRFGDTHPPASKPL

SEQ ID NO: 1448323 - protein, 16 aa, Mycobacterium tuberculosis
PTRQAPPPSTALRWAA

SEQ ID NO: 1448324 - protein, 5 aa, Mycobacterium tuberculosis
PTRRF

SEQ ID NO: 1448325 - protein, 7 aa, Mycobacterium tuberculosis
PTRTAPS

SEQ ID NO: 1448326 - protein, 16 aa, Mycobacterium tuberculosis
PTRTRTGSTPASSEAV

SEQ ID NO: 1448327 - protein, 7 aa, Mycobacterium tuberculosis
PTRTSET

SEQ ID NO: 1448328 - protein, 17 aa, Mycobacterium tuberculosis
PTSASRISGHIRAALAA

SEQ ID NO: 1448329 - protein, 10 aa, Mycobacterium tuberculosis
PTSDARLTQA

SEQ ID NO: 1448330 - protein, 5 aa, Mycobacterium tuberculosis
PTSID

SEQ ID NO: 1448331 - protein, 8 aa, Mycobacterium tuberculosis
PTSRPGSL

SEQ ID NO: 1448332 - protein, 20 aa, Mycobacterium tuberculosis
PTSRRPTVPTTPRSRPTAER

SEQ ID NO: 1448333 - protein, 10 aa, Mycobacterium tuberculosis
PTSTSAQPAV

SEQ ID NO: 1448334 - protein, 11 aa, Mycobacterium tuberculosis
PTSVADDFTRP

SEQ ID NO: 1448335 - protein, 8 aa, Mycobacterium tuberculosis
PTTDCTRR

SEQ ID NO: 1448336 - protein, 7 aa, Mycobacterium tuberculosis
PTTGSTG

SEQ ID NO: 1448337 - protein, 6 aa, Mycobacterium tuberculosis
PTTPIG

SEQ ID NO: 1448338 - protein, 19 aa, Mycobacterium tuberculosis
PTTPTTSGAADTATASPTA

SEQ ID NO: 1448339 - protein, 13 aa, Mycobacterium tuberculosis
PTTRKTNRRRWKP

SEQ ID NO: 1448340 - protein, 11 aa, Mycobacterium tuberculosis
PTTVRDKDGIS

SEQ ID NO: 1448341 - protein, 6 aa, Mycobacterium tuberculosis
PTTVRG

SEQ ID NO: 1448342 - protein, 42 aa, Mycobacterium tuberculosis
PTVGGRGGIKAPAATVPAAAAAAATRGQSRARRRRRSELRDY

SEQ ID NO: 1448343 - protein, 17 aa, Mycobacterium tuberculosis
PTVTGKPSGDDLKSGKR

SEQ ID NO: 1448344 - protein, 15 aa, Mycobacterium tuberculosis
PTVTTSGPERSPDSL

SEQ ID NO: 1448345 - protein, 4 aa, Mycobacterium tuberculosis
PTWP

SEQ ID NO: 1448346 - protein, 9 aa, Mycobacterium tuberculosis
PTYSAARSA

SEQ ID NO: 1448347 - protein, 21 aa, Mycobacterium tuberculosis
PVAEPTTAGATAWRTGPNSTP

SEQ ID NO: 1448348 - protein, 4 aa, Mycobacterium tuberculosis
PVAG

SEQ ID NO: 1448349 - protein, 9 aa, Mycobacterium tuberculosis
PVAGRSEAN

SEQ ID NO: 1448350 - protein, 10 aa, Mycobacterium tuberculosis
PVAPASAAAR

SEQ ID NO: 1448351 - protein, 7 aa, Mycobacterium tuberculosis
PVAPGPG

SEQ ID NO: 1448352 - protein, 17 aa, Mycobacterium tuberculosis
PVAPTVPNPAPQNPPPT

SEQ ID NO: 1448353 - protein, 5 aa, Mycobacterium tuberculosis
PVATP

SEQ ID NO: 1448354 - protein, 12 aa, Mycobacterium tuberculosis
PVDPKRRPLITK

SEQ ID NO: 1448355 - protein, 35 aa, Mycobacterium tuberculosis
PVDSAAATGRKSEPGARRGKRSKKSRSEESSDRSM

SEQ ID NO: 1448356 - protein, 10 aa, Mycobacterium tuberculosis
PVERGESPTW

SEQ ID NO: 1448357 - protein, 8 aa, Mycobacterium tuberculosis
PVGAATSS

SEQ ID NO: 1448358 - protein, 18 aa, Mycobacterium tuberculosis
PVGDSSDCGTIRVGSFRG

SEQ ID NO: 1448359 - protein, 10 aa, Mycobacterium tuberculosis
PVGLGSPAEG

SEQ ID NO: 1448360 - protein, 8 aa, Mycobacterium tuberculosis
PVGPAATP

SEQ ID NO: 1448361 - protein, 6 aa, Mycobacterium tuberculosis
PVGPEH

SEQ ID NO: 1448362 - protein, 13 aa, Mycobacterium tuberculosis
PVGPPGTTPGMRR

SEQ ID NO: 1448363 - protein, 5 aa, Mycobacterium tuberculosis
PVGPS

SEQ ID NO: 1448364 - protein, 43 aa, Mycobacterium tuberculosis
PVGSAGPVEPPSGCSGHGGAGGAGGLGKAGFAGGAGGTGGTGG

SEQ ID NO: 1448365 - protein, 11 aa, Mycobacterium tuberculosis
PVGSPGAGRVG

SEQ ID NO: 1448366 - protein, 14 aa, Mycobacterium tuberculosis
PVGTSQRRRQSGWH

SEQ ID NO: 1448367 - protein, 12 aa, Mycobacterium tuberculosis
PVGVKSGSRSLG

SEQ ID NO: 1448368 - protein, 18 aa, Mycobacterium tuberculosis
PVHSPSRRSRPAPLRTTS

SEQ ID NO: 1448369 - protein, 7 aa, Mycobacterium tuberculosis
PVKPGRG

SEQ ID NO: 1448370 - protein, 4 aa, Mycobacterium tuberculosis
PVNE

SEQ ID NO: 1448371 - protein, 4 aa, Mycobacterium tuberculosis
PVNQ

SEQ ID NO: 1448372 - protein, 30 aa, Mycobacterium tuberculosis
PVPAEPSISLRGDDGTAPGVDSGWPELSDP

SEQ ID NO: 1448373 - protein, 22 aa, Mycobacterium tuberculosis
PVPAPAEAPVEASESTGGPRPS

SEQ ID NO: 1448374 - protein, 12 aa, Mycobacterium tuberculosis
PVPATTGRQPVW

SEQ ID NO: 1448375 - protein, 5 aa, Mycobacterium tuberculosis
PVPDK

SEQ ID NO: 1448376 - protein, 5 aa, Mycobacterium tuberculosis
PVPGE

SEQ ID NO: 1448377 - protein, 4 aa, Mycobacterium tuberculosis
PVPP

SEQ ID NO: 1448378 - protein, 18 aa, Mycobacterium tuberculosis
PVPPAGALPPSPAPPPLP

SEQ ID NO: 1448379 - protein, 19 aa, Mycobacterium tuberculosis
PVPPAGALPPSPAPPPLPV

SEQ ID NO: 1448380 - protein, 16 aa, Mycobacterium tuberculosis
PVPPAPPTPPAPPSPP

SEQ ID NO: 1448381 - protein, 21 aa, Mycobacterium tuberculosis
PVPPLPPAPPDPPLPPLPICP

SEQ ID NO: 1448382 - protein, 21 aa, Mycobacterium tuberculosis
PVPPLPPVPNKIPPAPPAPPV

SEQ ID NO: 1448383 - protein, 14 aa, Mycobacterium tuberculosis
PVPPVRRPRRVQPQ

SEQ ID NO: 1448384 - protein, 21 aa, Mycobacterium tuberculosis
PVPTCTGTRRPSTPRPGSGPS

SEQ ID NO: 1448385 - protein, 9 aa, Mycobacterium tuberculosis
PVPTPDSPT

SEQ ID NO: 1448386 - protein, 5 aa, Mycobacterium tuberculosis
PVQER

SEQ ID NO: 1448387 - protein, 30 aa, Mycobacterium tuberculosis
PVQPRGRSAGWRPPAAATTWGRSSRGVSEP

SEQ ID NO: 1448388 - protein, 11 aa, Mycobacterium tuberculosis
PVRGARAGRAA

SEQ ID NO: 1448389 - protein, 13 aa, Mycobacterium tuberculosis
PVRPAGPADKAGC

SEQ ID NO: 1448390 - protein, 13 aa, Mycobacterium tuberculosis
PVRPSPSKPPLPR

SEQ ID NO: 1448391 - protein, 13 aa, Mycobacterium tuberculosis
PVRPYGFPVDLPC

SEQ ID NO: 1448392 - protein, 7 aa, Mycobacterium tuberculosis
PVRRAPG

SEQ ID NO: 1448393 - protein, 22 aa, Mycobacterium tuberculosis
PVRTPQRRGAPVPDHTRTHGTG

SEQ ID NO: 1448394 - protein, 12 aa, Mycobacterium tuberculosis
PVSAVSSSPQAV

SEQ ID NO: 1448395 - protein, 17 aa, Mycobacterium tuberculosis
PVSEPAASGPELTPEAG

SEQ ID NO: 1448396 - protein, 8 aa, Mycobacterium tuberculosis
PVSGANNR

SEQ ID NO: 1448397 - protein, 11 aa, Mycobacterium tuberculosis
PVSGGVKGAAA

SEQ ID NO: 1448398 - protein, 16 aa, Mycobacterium tuberculosis
PVSPTTVKSTELDQFP

SEQ ID NO: 1448399 - protein, 10 aa, Mycobacterium tuberculosis
PVSTAAAGRY

SEQ ID NO: 1448400 - protein, 11 aa, Mycobacterium tuberculosis
PVTQDTSATCP

SEQ ID NO: 1448401 - protein, 7 aa, Mycobacterium tuberculosis
PVVPGAN

SEQ ID NO: 1448402 - protein, 6 aa, Mycobacterium tuberculosis
PWPGSA

SEQ ID NO: 1448403 - protein, 17 aa, Mycobacterium tuberculosis
PWPPTPPAPPANPVPPV

SEQ ID NO: 1448404 - protein, 7 aa, Mycobacterium tuberculosis
PWQDNEG

SEQ ID NO: 1448405 - protein, 19 aa, Mycobacterium tuberculosis
PWSGSLSKNRHQTRKQVKQ

SEQ ID NO: 1448406 - protein, 6 aa, Mycobacterium tuberculosis
PWTTAG

SEQ ID NO: 1448407 - protein, 40 aa, Mycobacterium tuberculosis
PYATSSPTHNGANMPGPMRSTPPHERGRSPRPCRPRRSGP

SEQ ID NO: 1448408 - protein, 6 aa, Mycobacterium tuberculosis
PYGAPQ

SEQ ID NO: 1448409 - protein, 16 aa, Mycobacterium tuberculosis
PYSASPNPPNSTAPLS

SEQ ID NO: 1448410 - protein, 21 aa, Mycobacterium tuberculosis
QAAAATPKGQDSGPVSTPDPA

SEQ ID NO: 1448411 - protein, 12 aa, Mycobacterium tuberculosis
QAADAPQAGRNG

SEQ ID NO: 1448412 - protein, 8 aa, Mycobacterium tuberculosis
QAADPRSN

SEQ ID NO: 1448413 - protein, 7 aa, Mycobacterium tuberculosis
QAADREI

SEQ ID NO: 1448414 - protein, 6 aa, Mycobacterium tuberculosis
QAAEQA

SEQ ID NO: 1448415 - protein, 9 aa, Mycobacterium tuberculosis
QAAGAAGGG

SEQ ID NO: 1448416 - protein, 7 aa, Mycobacterium tuberculosis
QAAGPRR

SEQ ID NO: 1448417 - protein, 4 aa, Mycobacterium tuberculosis
QAAP

SEQ ID NO: 1448418 - protein, 10 aa, Mycobacterium tuberculosis
QAAPGGTGGY

SEQ ID NO: 1448419 - protein, 15 aa, Mycobacterium tuberculosis
QAARPERLAPTTRRA

SEQ ID NO: 1448420 - protein, 15 aa, Mycobacterium tuberculosis
QAASAEASRDVYVAG

SEQ ID NO: 1448421 - protein, 11 aa, Mycobacterium tuberculosis
QAASGSAINGG

SEQ ID NO: 1448422 - protein, 10 aa, Mycobacterium tuberculosis
QAATGGTGGY

SEQ ID NO: 1448423 - protein, 5 aa, Mycobacterium tuberculosis
QAAYP

SEQ ID NO: 1448424 - protein, 12 aa, Mycobacterium tuberculosis
QADGGGGGASAV

SEQ ID NO: 1448425 - protein, 17 aa, Mycobacterium tuberculosis
QADGNQSDAIKRLRLRK

SEQ ID NO: 1448426 - protein, 9 aa, Mycobacterium tuberculosis
QADGRGPAL

SEQ ID NO: 1448427 - protein, 23 aa, Mycobacterium tuberculosis
QADPGRETKNSISPRDALASAGK

SEQ ID NO: 1448428 - protein, 6 aa, Mycobacterium tuberculosis
QADSSG

SEQ ID NO: 1448429 - protein, 10 aa, Mycobacterium tuberculosis
QADTAAARQA

SEQ ID NO: 1448430 - protein, 8 aa, Mycobacterium tuberculosis
QAEQAPMS

SEQ ID NO: 1448431 - protein, 5 aa, Mycobacterium tuberculosis
QAEQI

SEQ ID NO: 1448432 - protein, 6 aa, Mycobacterium tuberculosis
QAERDR

SEQ ID NO: 1448433 - protein, 6 aa, Mycobacterium tuberculosis
QAFGDN

SEQ ID NO: 1448434 - protein, 11 aa, Mycobacterium tuberculosis
QAFSPANLPTT

SEQ ID NO: 1448435 - protein, 4 aa, Mycobacterium tuberculosis
QAGG

SEQ ID NO: 1448436 - protein, 19 aa, Mycobacterium tuberculosis
QAGGHQVDATDPCCAERRQ

SEQ ID NO: 1448437 - protein, 6 aa, Mycobacterium tuberculosis
QAGIPA

SEQ ID NO: 1448438 - protein, 12 aa, Mycobacterium tuberculosis
QAGPAGPAGATV

SEQ ID NO: 1448439 - protein, 37 aa, Mycobacterium tuberculosis
QAGRNQVLPENDVKPAGRITAPASRSGTIGGCPPRDD

SEQ ID NO: 1448440 - protein, 24 aa, Mycobacterium tuberculosis
QAGTGGGQLNDSAGKSGTGGNGGV

SEQ ID NO: 1448441 - protein, 6 aa, Mycobacterium tuberculosis
QAHTDD

SEQ ID NO: 1448442 - protein, 15 aa, Mycobacterium tuberculosis
QALADASADRASQIR

SEQ ID NO: 1448443 - protein, 5 aa, Mycobacterium tuberculosis
QALAP

SEQ ID NO: 1448444 - protein, 19 aa, Mycobacterium tuberculosis
QALATEHKAATALLNGPRY

SEQ ID NO: 1448445 - protein, 7 aa, Mycobacterium tuberculosis
QALGGED

SEQ ID NO: 1448446 - protein, 15 aa, Mycobacterium tuberculosis
QALTTGGRPAGLGGA

SEQ ID NO: 1448447 - protein, 9 aa, Mycobacterium tuberculosis
QANAAPPGH

SEQ ID NO: 1448448 - protein, 17 aa, Mycobacterium tuberculosis
QANGGRGRVQWGRPVFR

SEQ ID NO: 1448449 - protein, 4 aa, Mycobacterium tuberculosis
QANP

SEQ ID NO: 1448450 - protein, 11 aa, Mycobacterium tuberculosis
QANPTNPGDSL

SEQ ID NO: 1448451 - protein, 37 aa, Mycobacterium tuberculosis
QAPAPGGLRNPRRARLPTDTATQRPRPAIRGDVSVGG

SEQ ID NO: 1448452 - protein, 37 aa, Mycobacterium tuberculosis
QAPERPLAPVPPQAGAGAAARGAGGAGGGPGTATGWA

SEQ ID NO: 1448453 - protein, 23 aa, Mycobacterium tuberculosis
QAPERPLAPVPPRPAPERRRAAQ

SEQ ID NO: 1448454 - protein, 6 aa, Mycobacterium tuberculosis
QAPGID

SEQ ID NO: 1448455 - protein, 29 aa, Mycobacterium tuberculosis
QAPPDPPAPPFPPVPPSRPGLPSLPRPGR

SEQ ID NO: 1448456 - protein, 11 aa, Mycobacterium tuberculosis
QAPRVDEGRAE

SEQ ID NO: 1448457 - protein, 5 aa, Mycobacterium tuberculosis
QARAG

SEQ ID NO: 1448458 - protein, 15 aa, Mycobacterium tuberculosis
QARLANDPTAPAPDK

SEQ ID NO: 1448459 - protein, 7 aa, Mycobacterium tuberculosis
QARNEGY

SEQ ID NO: 1448460 - protein, 7 aa, Mycobacterium tuberculosis
QARPEAR

SEQ ID NO: 1448461 - protein, 16 aa, Mycobacterium tuberculosis
QARQAARAVLPNATET

SEQ ID NO: 1448462 - protein, 7 aa, Mycobacterium tuberculosis
QARQQLE

SEQ ID NO: 1448463 - protein, 6 aa, Mycobacterium tuberculosis
QARQRA

SEQ ID NO: 1448464 - protein, 11 aa, Mycobacterium tuberculosis
QARRGNVRRSQ

SEQ ID NO: 1448465 - protein, 14 aa, Mycobacterium tuberculosis
QARRLSPGAAGRPR

SEQ ID NO: 1448466 - protein, 9 aa, Mycobacterium tuberculosis
QASGGWTDG

SEQ ID NO: 1448467 - protein, 16 aa, Mycobacterium tuberculosis
QASGNTDQAALESAQA

SEQ ID NO: 1448468 - protein, 13 aa, Mycobacterium tuberculosis
QASSSDGQAIPAH

SEQ ID NO: 1448469 - protein, 9 aa, Mycobacterium tuberculosis
QATGRQVAD

SEQ ID NO: 1448470 - protein, 18 aa, Mycobacterium tuberculosis
QATQQECEKRLGEAKIEA

SEQ ID NO: 1448471 - protein, 16 aa, Mycobacterium tuberculosis
QATSTQPSTAPPTSRV

SEQ ID NO: 1448472 - protein, 9 aa, Mycobacterium tuberculosis
QAVAAASPR

SEQ ID NO: 1448473 - protein, 7 aa, Mycobacterium tuberculosis
QAVAGRQ

SEQ ID NO: 1448474 - protein, 10 aa, Mycobacterium tuberculosis
QAVDQRAGGP

SEQ ID NO: 1448475 - protein, 9 aa, Mycobacterium tuberculosis
QAVKNSLSR

SEQ ID NO: 1448476 - protein, 8 aa, Mycobacterium tuberculosis
QAVPAGPV

SEQ ID NO: 1448477 - protein, 8 aa, Mycobacterium tuberculosis
QAVSAGQR

SEQ ID NO: 1448478 - protein, 13 aa, Mycobacterium tuberculosis
QAVSGSQHRCGDR

SEQ ID NO: 1448479 - protein, 11 aa, Mycobacterium tuberculosis
QAVTASATDHP

SEQ ID NO: 1448480 - protein, 8 aa, Mycobacterium tuberculosis
QAYQDGGA

SEQ ID NO: 1448481 - protein, 18 aa, Mycobacterium tuberculosis
QCDRRGPAGAAAGKRRAR

SEQ ID NO: 1448482 - protein, 29 aa, Mycobacterium tuberculosis
QCGPRSSWNRDPTRTRISAGSAALDHQER

SEQ ID NO: 1448483 - protein, 32 aa, Mycobacterium tuberculosis
QCRDRTPCPRESPGPPATPRRWPRSAASSSPR

SEQ ID NO: 1448484 - protein, 35 aa, Mycobacterium tuberculosis
QDDSRVNAGRRGAAGGLARPGRGMPGRDRGPAGDH

SEQ ID NO: 1448485 - protein, 6 aa, Mycobacterium tuberculosis
QDDTRL

SEQ ID NO: 1448486 - protein, 4 aa, Mycobacterium tuberculosis
QDEG

SEQ ID NO: 1448487 - protein, 5 aa, Mycobacterium tuberculosis
QDELA

SEQ ID NO: 1448488 - protein, 28 aa, Mycobacterium tuberculosis
QDEQLRKRAQLQKGATQPATSGASASVH

SEQ ID NO: 1448489 - protein, 5 aa, Mycobacterium tuberculosis
QDEVS

SEQ ID NO: 1448490 - protein, 10 aa, Mycobacterium tuberculosis
QDGDPGYKAT

SEQ ID NO: 1448491 - protein, 10 aa, Mycobacterium tuberculosis
QDGGEQQGMP

SEQ ID NO: 1448492 - protein, 9 aa, Mycobacterium tuberculosis
QDGGLTRPA

SEQ ID NO: 1448493 - protein, 7 aa, Mycobacterium tuberculosis
QDGGNAV

SEQ ID NO: 1448494 - protein, 5 aa, Mycobacterium tuberculosis
QDGPD

SEQ ID NO: 1448495 - protein, 12 aa, Mycobacterium tuberculosis
QDHISHGRHHHM

SEQ ID NO: 1448496 - protein, 11 aa, Mycobacterium tuberculosis
QDKAKQTPCPG

SEQ ID NO: 1448497 - protein, 24 aa, Mycobacterium tuberculosis
QDKGYAVPDYPADPNTDQEKAIKE

SEQ ID NO: 1448498 - protein, 15 aa, Mycobacterium tuberculosis
QDRDRGAGGVQGGPR

SEQ ID NO: 1448499 - protein, 5 aa, Mycobacterium tuberculosis
QDRRT

SEQ ID NO: 1448500 - protein, 15 aa, Mycobacterium tuberculosis
QDRSPHRDRWATATR

SEQ ID NO: 1448501 - protein, 6 aa, Mycobacterium tuberculosis
QDRTGG

SEQ ID NO: 1448502 - protein, 19 aa, Mycobacterium tuberculosis
QDRVAARRDGAATRHAAVV

SEQ ID NO: 1448503 - protein, 6 aa, Mycobacterium tuberculosis
QDSPFN

SEQ ID NO: 1448504 - protein, 16 aa, Mycobacterium tuberculosis
QDTAHGGFGGAPKFPA

SEQ ID NO: 1448505 - protein, 23 aa, Mycobacterium tuberculosis
QDVRPAPPPERTAPILISGSVWS

SEQ ID NO: 1448506 - protein, 6 aa, Mycobacterium tuberculosis
QDVRSG

SEQ ID NO: 1448507 - protein, 5 aa, Mycobacterium tuberculosis
QEAGQ

SEQ ID NO: 1448508 - protein, 4 aa, Mycobacterium tuberculosis
QEAI

SEQ ID NO: 1448509 - protein, 9 aa, Mycobacterium tuberculosis
QEANTQDFP

SEQ ID NO: 1448510 - protein, 9 aa, Mycobacterium tuberculosis
QEATAGLAD

SEQ ID NO: 1448511 - protein, 9 aa, Mycobacterium tuberculosis
QEGNSPTRL

SEQ ID NO: 1448512 - protein, 5 aa, Mycobacterium tuberculosis
QEGRG

SEQ ID NO: 1448513 - protein, 14 aa, Mycobacterium tuberculosis
QELADAAGKSGKPT

SEQ ID NO: 1448514 - protein, 6 aa, Mycobacterium tuberculosis
QEPGAG

SEQ ID NO: 1448515 - protein, 14 aa, Mycobacterium tuberculosis
QEPTPRSPSAASWA

SEQ ID NO: 1448516 - protein, 8 aa, Mycobacterium tuberculosis
QEQRNPTH

SEQ ID NO: 1448517 - protein, 9 aa, Mycobacterium tuberculosis
QEQTSAASA

SEQ ID NO: 1448518 - protein, 7 aa, Mycobacterium tuberculosis
QERDDLG

SEQ ID NO: 1448519 - protein, 5 aa, Mycobacterium tuberculosis
QERPV

SEQ ID NO: 1448520 - protein, 23 aa, Mycobacterium tuberculosis
QETERGHAGYTTEGTTGLPAGGE

SEQ ID NO: 1448521 - protein, 11 aa, Mycobacterium tuberculosis
QETRSNRRAAL

SEQ ID NO: 1448522 - protein, 23 aa, Mycobacterium tuberculosis
QFAEPDDAEYPTDDAAERAQREH

SEQ ID NO: 1448523 - protein, 11 aa, Mycobacterium tuberculosis
QFRPGEHGHRQ

SEQ ID NO: 1448524 - protein, 24 aa, Mycobacterium tuberculosis
QFRTSGDTIARQPRSRAAARPRAG

SEQ ID NO: 1448525 - protein, 5 aa, Mycobacterium tuberculosis
QGAAR

SEQ ID NO: 1448526 - protein, 10 aa, Mycobacterium tuberculosis
QGAAWTPADE

SEQ ID NO: 1448527 - protein, 12 aa, Mycobacterium tuberculosis
QGAISKGQRGGN

SEQ ID NO: 1448528 - protein, 4 aa, Mycobacterium tuberculosis
QGAT

SEQ ID NO: 1448529 - protein, 18 aa, Mycobacterium tuberculosis
QGATRDDAGDTGQPDPLP

SEQ ID NO: 1448530 - protein, 6 aa, Mycobacterium tuberculosis
QGDPPY

SEQ ID NO: 1448531 - protein, 17 aa, Mycobacterium tuberculosis
QGDRTDRGQDGATEDAY

SEQ ID NO: 1448532 - protein, 15 aa, Mycobacterium tuberculosis
QGDSAAAARHRRCLH

SEQ ID NO: 1448533 - protein, 13 aa, Mycobacterium tuberculosis
QGDTGAAAKPHYL

SEQ ID NO: 1448534 - protein, 5 aa, Mycobacterium tuberculosis
QGEHN

SEQ ID NO: 1448535 - protein, 9 aa, Mycobacterium tuberculosis
QGERRAAYN

SEQ ID NO: 1448536 - protein, 6 aa, Mycobacterium tuberculosis
QGESMD

SEQ ID NO: 1448537 - protein, 13 aa, Mycobacterium tuberculosis
QGGAGGAGGSGFG

SEQ ID NO: 1448538 - protein, 6 aa, Mycobacterium tuberculosis
QGGQSD

SEQ ID NO: 1448539 - protein, 8 aa, Mycobacterium tuberculosis
QGGRRSAV

SEQ ID NO: 1448540 - protein, 6 aa, Mycobacterium tuberculosis
QGGSRR

SEQ ID NO: 1448541 - protein, 5 aa, Mycobacterium tuberculosis
QGGTT

SEQ ID NO: 1448542 - protein, 7 aa, Mycobacterium tuberculosis
QGHGNSV

SEQ ID NO: 1448543 - protein, 45 aa, Mycobacterium tuberculosis
QGHNTGVGDAFGGDGGIGGDGNGALGAAGGNGGTGGAGGNGGRGG

SEQ ID NO: 1448544 - protein, 5 aa, Mycobacterium tuberculosis
QGHPA

SEQ ID NO: 1448545 - protein, 10 aa, Mycobacterium tuberculosis
QGHPQRKDYP

SEQ ID NO: 1448546 - protein, 9 aa, Mycobacterium tuberculosis
QGHRGGRSV

SEQ ID NO: 1448547 - protein, 10 aa, Mycobacterium tuberculosis
QGIANTGNNN

SEQ ID NO: 1448548 - protein, 5 aa, Mycobacterium tuberculosis
QGKDL

SEQ ID NO: 1448549 - protein, 10 aa, Mycobacterium tuberculosis
QGKHGCRSGR

SEQ ID NO: 1448550 - protein, 4 aa, Mycobacterium tuberculosis
QGKP

SEQ ID NO: 1448551 - protein, 7 aa, Mycobacterium tuberculosis
QGNPDGG

SEQ ID NO: 1448552 - protein, 8 aa, Mycobacterium tuberculosis
QGNRGAAG

SEQ ID NO: 1448553 - protein, 8 aa, Mycobacterium tuberculosis
QGNRSTAG

SEQ ID NO: 1448554 - protein, 12 aa, Mycobacterium tuberculosis
QGNSPTGPPREE

SEQ ID NO: 1448555 - protein, 7 aa, Mycobacterium tuberculosis
QGPELAP

SEQ ID NO: 1448556 - protein, 12 aa, Mycobacterium tuberculosis
QGPFGGPDFPAP

SEQ ID NO: 1448557 - protein, 7 aa, Mycobacterium tuberculosis
QGPGEVT

SEQ ID NO: 1448558 - protein, 12 aa, Mycobacterium tuberculosis
QGPGGGQRAARR

SEQ ID NO: 1448559 - protein, 9 aa, Mycobacterium tuberculosis
QGPGPRCGR

SEQ ID NO: 1448560 - protein, 14 aa, Mycobacterium tuberculosis
QGPLGARARRRGLS

SEQ ID NO: 1448561 - protein, 6 aa, Mycobacterium tuberculosis
QGPRAA

SEQ ID NO: 1448562 - protein, 16 aa, Mycobacterium tuberculosis
QGRAGPRPPRPNTAEL

SEQ ID NO: 1448563 - protein, 8 aa, Mycobacterium tuberculosis
QGREEFDT

SEQ ID NO: 1448564 - protein, 4 aa, Mycobacterium tuberculosis
QGRI

SEQ ID NO: 1448565 - protein, 9 aa, Mycobacterium tuberculosis
QGRNLNDAV

SEQ ID NO: 1448566 - protein, 12 aa, Mycobacterium tuberculosis
QGRRHPPFPPRN

SEQ ID NO: 1448567 - protein, 6 aa, Mycobacterium tuberculosis
QGRTEL

SEQ ID NO: 1448568 - protein, 7 aa, Mycobacterium tuberculosis
QGRTPED

SEQ ID NO: 1448569 - protein, 9 aa, Mycobacterium tuberculosis
QGRTTGNSC

SEQ ID NO: 1448570 - protein, 7 aa, Mycobacterium tuberculosis
QGSEAQR

SEQ ID NO: 1448571 - protein, 6 aa, Mycobacterium tuberculosis
QGSGLG

SEQ ID NO: 1448572 - protein, 4 aa, Mycobacterium tuberculosis
QGSP

SEQ ID NO: 1448573 - protein, 10 aa, Mycobacterium tuberculosis
QGSPLRDQPY

SEQ ID NO: 1448574 - protein, 30 aa, Mycobacterium tuberculosis
QGSSRAAFDAEARTASEKGRQEAAVARRPG

SEQ ID NO: 1448575 - protein, 5 aa, Mycobacterium tuberculosis
QGTEF

SEQ ID NO: 1448576 - protein, 5 aa, Mycobacterium tuberculosis
QGTNT

SEQ ID NO: 1448577 - protein, 17 aa, Mycobacterium tuberculosis
QGVAGDGPGPKPSASIG

SEQ ID NO: 1448578 - protein, 21 aa, Mycobacterium tuberculosis
QGVTGAPARRRRRRRGDSDAI

SEQ ID NO: 1448579 - protein, 6 aa, Mycobacterium tuberculosis
QGYASG

SEQ ID NO: 1448580 - protein, 9 aa, Mycobacterium tuberculosis
QGYSDSQGI

SEQ ID NO: 1448581 - protein, 68 aa, Mycobacterium tuberculosis
QHANSGNGGGGGTGGAGGTHGTPGSGNAGGTGTGNADSTNGGPGSDGLGGDAFNGSRGTPTATPANYQ

SEQ ID NO: 1448582 - protein, 23 aa, Mycobacterium tuberculosis
QHAPPQQVRQRTGIGQVGSDVDP

SEQ ID NO: 1448583 - protein, 7 aa, Mycobacterium tuberculosis
QHDDNDT

SEQ ID NO: 1448584 - protein, 9 aa, Mycobacterium tuberculosis
QHDPAPSVA

SEQ ID NO: 1448585 - protein, 12 aa, Mycobacterium tuberculosis
QHEGDGGQVSKP

SEQ ID NO: 1448586 - protein, 16 aa, Mycobacterium tuberculosis
QHESRQARCGEAEPSN

SEQ ID NO: 1448587 - protein, 8 aa, Mycobacterium tuberculosis
QHGGAQRV

SEQ ID NO: 1448588 - protein, 21 aa, Mycobacterium tuberculosis
QHGPTGGAGIADQQPAERGNG

SEQ ID NO: 1448589 - protein, 5 aa, Mycobacterium tuberculosis
QHGVA

SEQ ID NO: 1448590 - protein, 19 aa, Mycobacterium tuberculosis
QHGVAGAGGAAAVDGGEAA

SEQ ID NO: 1448591 - protein, 7 aa, Mycobacterium tuberculosis
QHHRDPG

SEQ ID NO: 1448592 - protein, 5 aa, Mycobacterium tuberculosis
QHPRP

SEQ ID NO: 1448593 - protein, 4 aa, Mycobacterium tuberculosis
QHQC

SEQ ID NO: 1448594 - protein, 9 aa, Mycobacterium tuberculosis
QHQRPGPLH

SEQ ID NO: 1448595 - protein, 5 aa, Mycobacterium tuberculosis
QHRAT

SEQ ID NO: 1448596 - protein, 15 aa, Mycobacterium tuberculosis
QHRVDASGDRRSTRN

SEQ ID NO: 1448597 - protein, 39 aa, Mycobacterium tuberculosis
QHSAGACSDTLATGALSDYKKSADEPDDHAIGRSRGGLT

SEQ ID NO: 1448598 - protein, 4 aa, Mycobacterium tuberculosis
QHSS

SEQ ID NO: 1448599 - protein, 5 aa, Mycobacterium tuberculosis
QHSSN

SEQ ID NO: 1448600 - protein, 13 aa, Mycobacterium tuberculosis
QHTGARREIDRAA

SEQ ID NO: 1448601 - protein, 4 aa, Mycobacterium tuberculosis
QIGE

SEQ ID NO: 1448602 - protein, 16 aa, Mycobacterium tuberculosis
QIGGNGGNGGHGGNAG

SEQ ID NO: 1448603 - protein, 20 aa, Mycobacterium tuberculosis
QIGHGADEAPGTGQAGGAGG

SEQ ID NO: 1448604 - protein, 51 aa, Mycobacterium tuberculosis
QIPAGGIGHAPQQRQQQRGRRGGQPEHRAPAVRSGQQVADQVTDDDAAKRR

SEQ ID NO: 1448605 - protein, 16 aa, Mycobacterium tuberculosis
QIPEPEVGQAHAEGRL

SEQ ID NO: 1448606 - protein, 12 aa, Mycobacterium tuberculosis
QIPGPVHAGTGI

SEQ ID NO: 1448607 - protein, 21 aa, Mycobacterium tuberculosis
QIRSPSDPGYVPTAPPAMSSA

SEQ ID NO: 1448608 - protein, 7 aa, Mycobacterium tuberculosis
QKEKIPD

SEQ ID NO: 1448609 - protein, 29 aa, Mycobacterium tuberculosis
QKGRAGKLGAKKTALNPRGNGEDRNRWAS

SEQ ID NO: 1448610 - protein, 9 aa, Mycobacterium tuberculosis
QKPAVNGNR

SEQ ID NO: 1448611 - protein, 29 aa, Mycobacterium tuberculosis
QKRGRPQTSRRRRARRPRPAMPRSRRQPR

SEQ ID NO: 1448612 - protein, 23 aa, Mycobacterium tuberculosis
QKSETEAPREPAPVSDEKQTDVA

SEQ ID NO: 1448613 - protein, 4 aa, Mycobacterium tuberculosis
QKSI

SEQ ID NO: 1448614 - protein, 14 aa, Mycobacterium tuberculosis
QKSQSSSKSPFSRT

SEQ ID NO: 1448615 - protein, 28 aa, Mycobacterium tuberculosis
QKSRGLGGDPAGQRIPGTAGPVRVGAQQ

SEQ ID NO: 1448616 - protein, 10 aa, Mycobacterium tuberculosis
QKSSAPPRRA

SEQ ID NO: 1448617 - protein, 9 aa, Mycobacterium tuberculosis
QLADNPGKT

SEQ ID NO: 1448618 - protein, 20 aa, Mycobacterium tuberculosis
QLADPDTGGVQQLDDQPVPQ

SEQ ID NO: 1448619 - protein, 5 aa, Mycobacterium tuberculosis
QLADT

SEQ ID NO: 1448620 - protein, 12 aa, Mycobacterium tuberculosis
QLAGPPGQPLSH

SEQ ID NO: 1448621 - protein, 6 aa, Mycobacterium tuberculosis
QLAGPT

SEQ ID NO: 1448622 - protein, 8 aa, Mycobacterium tuberculosis
QLAKADGA

SEQ ID NO: 1448623 - protein, 21 aa, Mycobacterium tuberculosis
QLDNAAPDDVEITDSSAAAEY

SEQ ID NO: 1448624 - protein, 15 aa, Mycobacterium tuberculosis
QLEDNSQNSSCGPET

SEQ ID NO: 1448625 - protein, 11 aa, Mycobacterium tuberculosis
QLGGTDKVPTV

SEQ ID NO: 1448626 - protein, 45 aa, Mycobacterium tuberculosis
QLGRAKPRRGGHRDREAPPPRSAGGRALRDESAGECSGPGDRGVG

SEQ ID NO: 1448627 - protein, 18 aa, Mycobacterium tuberculosis
QLKPGGTIVEPTSGNTGV

SEQ ID NO: 1448628 - protein, 16 aa, Mycobacterium tuberculosis
QLPGAGPGAHLTGQQR

SEQ ID NO: 1448629 - protein, 17 aa, Mycobacterium tuberculosis
QLPNEPVPATLSRTPGT

SEQ ID NO: 1448630 - protein, 9 aa, Mycobacterium tuberculosis
QLPNRADAA

SEQ ID NO: 1448631 - protein, 26 aa, Mycobacterium tuberculosis
QLPPATTRIPAAPPSGPQPRYPTGGQ

SEQ ID NO: 1448632 - protein, 8 aa, Mycobacterium tuberculosis
QLPPGFDS

SEQ ID NO: 1448633 - protein, 7 aa, Mycobacterium tuberculosis
QLQRGQH

SEQ ID NO: 1448634 - protein, 13 aa, Mycobacterium tuberculosis
QLRDPAVGAWRAA

SEQ ID NO: 1448635 - protein, 26 aa, Mycobacterium tuberculosis
QLRGPPEPARTTASRCPAVDQSEAVD

SEQ ID NO: 1448636 - protein, 21 aa, Mycobacterium tuberculosis
QLRPGSRSCGTSASTSARTAR

SEQ ID NO: 1448637 - protein, 6 aa, Mycobacterium tuberculosis
QLSPEH

SEQ ID NO: 1448638 - protein, 7 aa, Mycobacterium tuberculosis
QLSPTEN

SEQ ID NO: 1448639 - protein, 8 aa, Mycobacterium tuberculosis
QLSQGGQG

SEQ ID NO: 1448640 - protein, 5 aa, Mycobacterium tuberculosis
QLTEQ

SEQ ID NO: 1448641 - protein, 16 aa, Mycobacterium tuberculosis
QLTERGRRWDRRPQGA

SEQ ID NO: 1448642 - protein, 4 aa, Mycobacterium tuberculosis
QLTP

SEQ ID NO: 1448643 - protein, 5 aa, Mycobacterium tuberculosis
QLVET

SEQ ID NO: 1448644 - protein, 11 aa, Mycobacterium tuberculosis
QMAEGSRRAAA

SEQ ID NO: 1448645 - protein, 8 aa, Mycobacterium tuberculosis
QNADPENA

SEQ ID NO: 1448646 - protein, 8 aa, Mycobacterium tuberculosis
QNAPAIAA

SEQ ID NO: 1448647 - protein, 9 aa, Mycobacterium tuberculosis
QNDPRSTYK

SEQ ID NO: 1448648 - protein, 8 aa, Mycobacterium tuberculosis
QNEPSAKT

SEQ ID NO: 1448649 - protein, 7 aa, Mycobacterium tuberculosis
QNEVSEQ

SEQ ID NO: 1448650 - protein, 9 aa, Mycobacterium tuberculosis
QNGNAGSRV

SEQ ID NO: 1448651 - protein, 8 aa, Mycobacterium tuberculosis
QNLPFPDQ

SEQ ID NO: 1448652 - protein, 15 aa, Mycobacterium tuberculosis
QNPERGRKLDAESHR

SEQ ID NO: 1448653 - protein, 20 aa, Mycobacterium tuberculosis
QNPERGRKPSAPPSSGASAQ

SEQ ID NO: 1448654 - protein, 9 aa, Mycobacterium tuberculosis
QNPSRARLS

SEQ ID NO: 1448655 - protein, 12 aa, Mycobacterium tuberculosis
QNPTGPGSVAGM

SEQ ID NO: 1448656 - protein, 17 aa, Mycobacterium tuberculosis
QNSVDQHDHSDRARTHA

SEQ ID NO: 1448657 - protein, 4 aa, Mycobacterium tuberculosis
QNTP

SEQ ID NO: 1448658 - protein, 13 aa, Mycobacterium tuberculosis
QNTPAIAAAEFDY

SEQ ID NO: 1448659 - protein, 14 aa, Mycobacterium tuberculosis
QNTPAIAATEFDYV

SEQ ID NO: 1448660 - protein, 12 aa, Mycobacterium tuberculosis
QNTPAIATSETH

SEQ ID NO: 1448661 - protein, 8 aa, Mycobacterium tuberculosis
QNTSTDAN

SEQ ID NO: 1448662 - protein, 29 aa, Mycobacterium tuberculosis
QPAAAAAGATGRAGTARPASTAVADQSGV

SEQ ID NO: 1448663 - protein, 63 aa, Mycobacterium tuberculosis
QPAAYPGARPRRGGPADIAGGRDGPDHGRAGRGGCVGSRAGVRAGGQHGGQRHAGTAAGTRRR

SEQ ID NO: 1448664 - protein, 12 aa, Mycobacterium tuberculosis
QPADDATARATI

SEQ ID NO: 1448665 - protein, 6 aa, Mycobacterium tuberculosis
QPADLR

SEQ ID NO: 1448666 - protein, 10 aa, Mycobacterium tuberculosis
QPADPNDPPT

SEQ ID NO: 1448667 - protein, 10 aa, Mycobacterium tuberculosis
QPAELGRPPI

SEQ ID NO: 1448668 - protein, 8 aa, Mycobacterium tuberculosis
QPAGLGRP

SEQ ID NO: 1448669 - protein, 14 aa, Mycobacterium tuberculosis
QPAGRFARSSAKKM

SEQ ID NO: 1448670 - protein, 17 aa, Mycobacterium tuberculosis
QPAHKASQSMITPTTQI

SEQ ID NO: 1448671 - protein, 9 aa, Mycobacterium tuberculosis
QPAHPTASR

SEQ ID NO: 1448672 - protein, 6 aa, Mycobacterium tuberculosis
QPALSS

SEQ ID NO: 1448673 - protein, 7 aa, Mycobacterium tuberculosis
QPAQPED

SEQ ID NO: 1448674 - protein, 12 aa, Mycobacterium tuberculosis
QPARTQQLLGWY

SEQ ID NO: 1448675 - protein, 19 aa, Mycobacterium tuberculosis
QPAVAAGRAGAAGPRIGKG

SEQ ID NO: 1448676 - protein, 6 aa, Mycobacterium tuberculosis
QPCGKT

SEQ ID NO: 1448677 - protein, 13 aa, Mycobacterium tuberculosis
QPDIDKDDAAAVG

SEQ ID NO: 1448678 - protein, 8 aa, Mycobacterium tuberculosis
QPDVEDGD

SEQ ID NO: 1448679 - protein, 5 aa, Mycobacterium tuberculosis
QPEID

SEQ ID NO: 1448680 - protein, 4 aa, Mycobacterium tuberculosis
QPEL

SEQ ID NO: 1448681 - protein, 20 aa, Mycobacterium tuberculosis
QPEPRWPKSPPAGPARVRAR

SEQ ID NO: 1448682 - protein, 8 aa, Mycobacterium tuberculosis
QPEPTEAW

SEQ ID NO: 1448683 - protein, 19 aa, Mycobacterium tuberculosis
QPEPTFTTSPQDADRFSDA

SEQ ID NO: 1448684 - protein, 32 aa, Mycobacterium tuberculosis
QPETITTEHKERRDRSVRRDANRRCHSGPADR

SEQ ID NO: 1448685 - protein, 9 aa, Mycobacterium tuberculosis
QPEVGEQQL

SEQ ID NO: 1448686 - protein, 4 aa, Mycobacterium tuberculosis
QPGA

SEQ ID NO: 1448687 - protein, 15 aa, Mycobacterium tuberculosis
QPGAPRSQPSNRWQR

SEQ ID NO: 1448688 - protein, 14 aa, Mycobacterium tuberculosis
QPGDASTPTLCPGP

SEQ ID NO: 1448689 - protein, 4 aa, Mycobacterium tuberculosis
QPGL

SEQ ID NO: 1448690 - protein, 5 aa, Mycobacterium tuberculosis
QPGRA

SEQ ID NO: 1448691 - protein, 21 aa, Mycobacterium tuberculosis
QPGRPIQRADGPQPSGPDGGA

SEQ ID NO: 1448692 - protein, 54 aa, Mycobacterium tuberculosis
QPGTEFGQTGGTGGTGGTGLSVGGTGGTGGNGGPGAPGGTGGTGGAGGSGGRGG

SEQ ID NO: 1448693 - protein, 45 aa, Mycobacterium tuberculosis
QPGTEFGQTGGTGGTGGTGLSVGGTGGTGGTGGTGGAGGSGGRGG

SEQ ID NO: 1448694 - protein, 9 aa, Mycobacterium tuberculosis
QPGTYTDFG

SEQ ID NO: 1448695 - protein, 5 aa, Mycobacterium tuberculosis
QPGVT

SEQ ID NO: 1448696 - protein, 10 aa, Mycobacterium tuberculosis
QPHRDQRHAQ

SEQ ID NO: 1448697 - protein, 8 aa, Mycobacterium tuberculosis
QPKPGRYK

SEQ ID NO: 1448698 - protein, 4 aa, Mycobacterium tuberculosis
QPMV

SEQ ID NO: 1448699 - protein, 7 aa, Mycobacterium tuberculosis
QPNGEVL

SEQ ID NO: 1448700 - protein, 17 aa, Mycobacterium tuberculosis
QPNRGLASADAERRSHR

SEQ ID NO: 1448701 - protein, 39 aa, Mycobacterium tuberculosis
QPPARTAGPSGTPSRTESSIHSASAPAAVPTKPEQPGIA

SEQ ID NO: 1448702 - protein, 14 aa, Mycobacterium tuberculosis
QPPERCVSLGYTDP

SEQ ID NO: 1448703 - protein, 24 aa, Mycobacterium tuberculosis
QPPGAGLGDPGRSHGSRLFADDEG

SEQ ID NO: 1448704 - protein, 4 aa, Mycobacterium tuberculosis
QPPL

SEQ ID NO: 1448705 - protein, 10 aa, Mycobacterium tuberculosis
QPPRRGAGAV

SEQ ID NO: 1448706 - protein, 13 aa, Mycobacterium tuberculosis
QPPSQVGADVEQA

SEQ ID NO: 1448707 - protein, 11 aa, Mycobacterium tuberculosis
QPQIPDRPHTP

SEQ ID NO: 1448708 - protein, 22 aa, Mycobacterium tuberculosis
QPQPGRQVPAGSAGIDMDDDER

SEQ ID NO: 1448709 - protein, 6 aa, Mycobacterium tuberculosis
QPQRGQ

SEQ ID NO: 1448710 - protein, 11 aa, Mycobacterium tuberculosis
QPQTPNGSINP

SEQ ID NO: 1448711 - protein, 23 aa, Mycobacterium tuberculosis
QPRAAPADAGVRVPSTSPPRWGG

SEQ ID NO: 1448712 - protein, 6 aa, Mycobacterium tuberculosis
QPRHTR

SEQ ID NO: 1448713 - protein, 12 aa, Mycobacterium tuberculosis
QPRLAEQPEHGG

SEQ ID NO: 1448714 - protein, 20 aa, Mycobacterium tuberculosis
QPRPRGAARKRSRGAGRPGL

SEQ ID NO: 1448715 - protein, 4 aa, Mycobacterium tuberculosis
QPRR

SEQ ID NO: 1448716 - protein, 11 aa, Mycobacterium tuberculosis
QPRRSRRRAPR

SEQ ID NO: 1448717 - protein, 6 aa, Mycobacterium tuberculosis
QPRRTL

SEQ ID NO: 1448718 - protein, 9 aa, Mycobacterium tuberculosis
QPRRTRHRR

SEQ ID NO: 1448719 - protein, 21 aa, Mycobacterium tuberculosis
QPRSPRCRPPFSSSPPPRISG

SEQ ID NO: 1448720 - protein, 7 aa, Mycobacterium tuberculosis
QPRTTSL

SEQ ID NO: 1448721 - protein, 38 aa, Mycobacterium tuberculosis
QPSSDPKPREGTETGSRQTGSRRSSPVVRPKTPRGDGN

SEQ ID NO: 1448722 - protein, 13 aa, Mycobacterium tuberculosis
QPSTSPRMTRLFL

SEQ ID NO: 1448723 - protein, 6 aa, Mycobacterium tuberculosis
QPTDLV

SEQ ID NO: 1448724 - protein, 10 aa, Mycobacterium tuberculosis
QPTGNGRAAI

SEQ ID NO: 1448725 - protein, 60 aa, Mycobacterium tuberculosis
QPTPVQQAPVQPAPVQQAPVQQAPVQQAPVQQAPVQQAPVQQAPVQQAPVQPPPFGTARS

SEQ ID NO: 1448726 - protein, 5 aa, Mycobacterium tuberculosis
QPTQL

SEQ ID NO: 1448727 - protein, 18 aa, Mycobacterium tuberculosis
QPTRARPSRCNPRKSTSG

SEQ ID NO: 1448728 - protein, 8 aa, Mycobacterium tuberculosis
QPVADTSL

SEQ ID NO: 1448729 - protein, 12 aa, Mycobacterium tuberculosis
QPVDVPAATGRT

SEQ ID NO: 1448730 - protein, 11 aa, Mycobacterium tuberculosis
QPVNPPAQRGH

SEQ ID NO: 1448731 - protein, 21 aa, Mycobacterium tuberculosis
QPVPGHRRRQHRRRTCTREHP

SEQ ID NO: 1448732 - protein, 5 aa, Mycobacterium tuberculosis
QPVSG

SEQ ID NO: 1448733 - protein, 6 aa, Mycobacterium tuberculosis
QPVSGR

SEQ ID NO: 1448734 - protein, 5 aa, Mycobacterium tuberculosis
QPWPN

SEQ ID NO: 1448735 - protein, 10 aa, Mycobacterium tuberculosis
QPWRPGKPNY

SEQ ID NO: 1448736 - protein, 31 aa, Mycobacterium tuberculosis; identical to SEQ ID NO: 153271

SEQ ID NO: 1448737 - protein, 13 aa, Mycobacterium tuberculosis
QQAGLPDRGPQSW

SEQ ID NO: 1448738 - protein, 10 aa, Mycobacterium tuberculosis
QQAKNLSGAH

SEQ ID NO: 1448739 - protein, 6 aa, Mycobacterium tuberculosis
QQASAR

SEQ ID NO: 1448740 - protein, 23 aa, Mycobacterium tuberculosis
QQATPAVTTTTASGALMPPDQNV

SEQ ID NO: 1448741 - protein, 9 aa, Mycobacterium tuberculosis
QQDLGSAVD

SEQ ID NO: 1448742 - protein, 10 aa, Mycobacterium tuberculosis
QQDLGSAVDA

SEQ ID NO: 1448743 - protein, 4 aa, Mycobacterium tuberculosis
QQGG

SEQ ID NO: 1448744 - protein, 12 aa, Mycobacterium tuberculosis
QQGGARRANAYP

SEQ ID NO: 1448745 - protein, 9 aa, Mycobacterium tuberculosis
QQGPGGLGG

SEQ ID NO: 1448746 - protein, 12 aa, Mycobacterium tuberculosis
QQGSAGSASSPP

SEQ ID NO: 1448747 - protein, 13 aa, Mycobacterium tuberculosis
QQKSIEGNDAMTS

SEQ ID NO: 1448748 - protein, 23 aa, Mycobacterium tuberculosis
QQKSIEGNDAMTSSHLIDNRAAS

SEQ ID NO: 1448749 - protein, 5 aa, Mycobacterium tuberculosis
QQLRP

SEQ ID NO: 1448750 - protein, 8 aa, Mycobacterium tuberculosis
QQLTAEEQ

SEQ ID NO: 1448751 - protein, 6 aa, Mycobacterium tuberculosis
QQNEAT

SEQ ID NO: 1448752 - protein, 13 aa, Mycobacterium tuberculosis
QQPAGPAGLPGPR

SEQ ID NO: 1448753 - protein, 19 aa, Mycobacterium tuberculosis
QQPAGPPPCPGVDPSAPLP

SEQ ID NO: 1448754 - protein, 9 aa, Mycobacterium tuberculosis
QQPPGPGRR

SEQ ID NO: 1448755 - protein, 24 aa, Mycobacterium tuberculosis
QQPPGTPQPRGTTPNRRRGHLPRP

SEQ ID NO: 1448756 - protein, 8 aa, Mycobacterium tuberculosis
QQRPAQRT

SEQ ID NO: 1448757 - protein, 7 aa, Mycobacterium tuberculosis
QQRPFGN

SEQ ID NO: 1448758 - protein, 10 aa, Mycobacterium tuberculosis
QQRTRDGGKV

SEQ ID NO: 1448759 - protein, 9 aa, Mycobacterium tuberculosis
QQRTSAVSE

SEQ ID NO: 1448760 - protein, 20 aa, Mycobacterium tuberculosis
QQSSSCDATSTGSYRRSRGW

SEQ ID NO: 1448761 - protein, 13 aa, Mycobacterium tuberculosis
QQTVQGGVAGPQR

SEQ ID NO: 1448762 - protein, 4 aa, Mycobacterium tuberculosis
QRAA

SEQ ID NO: 1448763 - protein, 34 aa, Mycobacterium tuberculosis
QRAAEEAGIKQGPPTQNIGAGRAGGGQSSRAPAL

SEQ ID NO: 1448764 - protein, 13 aa, Mycobacterium tuberculosis
QRAAQDRGGIRSN

SEQ ID NO: 1448765 - protein, 5 aa, Mycobacterium tuberculosis
QRAAT

SEQ ID NO: 1448766 - protein, 14 aa, Mycobacterium tuberculosis
QRAGSQGPDTVSTA

SEQ ID NO: 1448767 - protein, 15 aa, Mycobacterium tuberculosis
QRARDRAEANRGARR

SEQ ID NO: 1448768 - protein, 24 aa, Mycobacterium tuberculosis
QRATAAGRARCRRSPDRGGAGDHL

SEQ ID NO: 1448769 - protein, 9 aa, Mycobacterium tuberculosis
QRAVPGDHG

SEQ ID NO: 1448770 - protein, 8 aa, Mycobacterium tuberculosis
QRCDGPRW

SEQ ID NO: 1448771 - protein, 20 aa, Mycobacterium tuberculosis
QRDASPPLATGAGRLLALGR

SEQ ID NO: 1448772 - protein, 17 aa, Mycobacterium tuberculosis
QRDDAVGRQPRQQPRPA

SEQ ID NO: 1448773 - protein, 8 aa, Mycobacterium tuberculosis
QRDRNSRA

SEQ ID NO: 1448774 - protein, 6 aa, Mycobacterium tuberculosis
QRDTLR

SEQ ID NO: 1448775 - protein, 11 aa, Mycobacterium tuberculosis
QREPQRGGPGF

SEQ ID NO: 1448776 - protein, 6 aa, Mycobacterium tuberculosis
QRESFG

SEQ ID NO: 1448777 - protein, 9 aa, Mycobacterium tuberculosis
QRGAARHRR

SEQ ID NO: 1448778 - protein, 9 aa, Mycobacterium tuberculosis
QRGGGGRRR

SEQ ID NO: 1448779 - protein, 6 aa, Mycobacterium tuberculosis
QRGGLV

SEQ ID NO: 1448780 - protein, 17 aa, Mycobacterium tuberculosis
QRGLNQRREGAQDPVGV

SEQ ID NO: 1448781 - protein, 17 aa, Mycobacterium tuberculosis
QRHDTDPSQYPARTPGH

SEQ ID NO: 1448782 - protein, 16 aa, Mycobacterium tuberculosis
QRHPGGTTTQTDAAAG

SEQ ID NO: 1448783 - protein, 6 aa, Mycobacterium tuberculosis
QRHPQD

SEQ ID NO: 1448784 - protein, 10 aa, Mycobacterium tuberculosis
QRHQPRPVGR

SEQ ID NO: 1448785 - protein, 48 aa, Mycobacterium tuberculosis
QRHRQDRRRGRRGGRRCRTGTHRKPGRRGRTGRGAEQSGADHRLLRRV

SEQ ID NO: 1448786 - protein, 12 aa, Mycobacterium tuberculosis
QRLGDRRSARRC

SEQ ID NO: 1448787 - protein, 4 aa, Mycobacterium tuberculosis
QRMA

SEQ ID NO: 1448788 - protein, 20 aa, Mycobacterium tuberculosis
QRNPEPSRHNPHRYSQGEAS

SEQ ID NO: 1448789 - protein, 11 aa, Mycobacterium tuberculosis
QRNRDKSSLKC

SEQ ID NO: 1448790 - protein, 18 aa, Mycobacterium tuberculosis
QRNSKTAGASVGDLATDP

SEQ ID NO: 1448791 - protein, 15 aa, Mycobacterium tuberculosis
QRPAARGPGQTARSR

SEQ ID NO: 1448792 - protein, 9 aa, Mycobacterium tuberculosis
QRPAERSAE

SEQ ID NO: 1448793 - protein, 8 aa, Mycobacterium tuberculosis
QRPARTAL

SEQ ID NO: 1448794 - protein, 5 aa, Mycobacterium tuberculosis
QRPGR

SEQ ID NO: 1448795 - protein, 19 aa, Mycobacterium tuberculosis
QRPGTGWPPNYSPTAADYG

SEQ ID NO: 1448796 - protein, 5 aa, Mycobacterium tuberculosis
QRPGV

SEQ ID NO: 1448797 - protein, 6 aa, Mycobacterium tuberculosis
QRPHDA

SEQ ID NO: 1448798 - protein, 9 aa, Mycobacterium tuberculosis
QRPHYSETD

SEQ ID NO: 1448799 - protein, 14 aa, Mycobacterium tuberculosis
QRPPRMTRSGRRGP

SEQ ID NO: 1448800 - protein, 15 aa, Mycobacterium tuberculosis
QRPQPTDPAGTPCPH

SEQ ID NO: 1448801 - protein, 18 aa, Mycobacterium tuberculosis
QRPRGPGEAVADRRGRHR

SEQ ID NO: 1448802 - protein, 7 aa, Mycobacterium tuberculosis
QRPRPPV

SEQ ID NO: 1448803 - protein, 14 aa, Mycobacterium tuberculosis
QRPSANTDLFTYPL

SEQ ID NO: 1448804 - protein, 10 aa, Mycobacterium tuberculosis
QRPSPTAELG

SEQ ID NO: 1448805 - protein, 4 aa, Mycobacterium tuberculosis
QRPT

SEQ ID NO: 1448806 - protein, 8 aa, Mycobacterium tuberculosis
QRPTHRRR

SEQ ID NO: 1448807 - protein, 5 aa, Mycobacterium tuberculosis
QRPVS

SEQ ID NO: 1448808 - protein, 13 aa, Mycobacterium tuberculosis
QRQRPAAGEQSSL

SEQ ID NO: 1448809 - protein, 26 aa, Mycobacterium tuberculosis
QRQRRSGNGEARDRESQRADRRAGQQ

SEQ ID NO: 1448810 - protein, 18 aa, Mycobacterium tuberculosis
QRQSGAESQPGSAGDRRG

SEQ ID NO: 1448811 - protein, 66 aa, Mycobacterium tuberculosis
QRRADRQRRQRRQRRESRRHAGRGRHQRAADRRERAQRPAIASEPALRTPAGQPWSAGPDTPASAC

SEQ ID NO: 1448812 - protein, 24 aa, Mycobacterium tuberculosis
QRRADRRRRDRRGRGHRRRRALRG

SEQ ID NO: 1448813 - protein, 8 aa, Mycobacterium tuberculosis
QRRDRPRG

SEQ ID NO: 1448814 - protein, 25 aa, Mycobacterium tuberculosis
QRRGGGRPTAGRVGPSSPKRTCRPN

SEQ ID NO: 1448815 - protein, 7 aa, Mycobacterium tuberculosis
QRRGPAA

SEQ ID NO: 1448816 - protein, 22 aa, Mycobacterium tuberculosis
QRRHRRRRRPGRPRRQRSIRPG

SEQ ID NO: 1448817 - protein, 17 aa, Mycobacterium tuberculosis
QRRKRADRPLTSVVASA

SEQ ID NO: 1448818 - protein, 20 aa, Mycobacterium tuberculosis
QRRNTNTGSFNPGDYNTGGF

SEQ ID NO: 1448819 - protein, 9 aa, Mycobacterium tuberculosis
QRRPGDRGA

SEQ ID NO: 1448820 - protein, 23 aa, Mycobacterium tuberculosis
QRRPRAGPAAPGCRTGSGGAGGL

SEQ ID NO: 1448821 - protein, 32 aa, Mycobacterium tuberculosis; identical to SEQ ID NO: 184410

SEQ ID NO: 1448822 - protein, 12 aa, Mycobacterium tuberculosis
QRRRDAYIRRVV

SEQ ID NO: 1448823 - protein, 10 aa, Mycobacterium tuberculosis
QRRRGGGLSA

SEQ ID NO: 1448824 - protein, 14 aa, Mycobacterium tuberculosis
QRRRHASLASRRRI

SEQ ID NO: 1448825 - protein, 10 aa, Mycobacterium tuberculosis
QRRRPPNQRC

SEQ ID NO: 1448826 - protein, 18 aa, Mycobacterium tuberculosis
QRRRPREPPGSERKKKKK

SEQ ID NO: 1448827 - protein, 30 aa, Mycobacterium tuberculosis
QRRRRRRQREGPAQGSGAPAVVGGAVCNAV

SEQ ID NO: 1448828 - protein, 5 aa, Mycobacterium tuberculosis
QRRRT

SEQ ID NO: 1448829 - protein, 13 aa, Mycobacterium tuberculosis
QRRRTRPRYGPPR

SEQ ID NO: 1448830 - protein, 13 aa, Mycobacterium tuberculosis
QRSGGNGDLRRDH

SEQ ID NO: 1448831 - protein, 6 aa, Mycobacterium tuberculosis
QRSGQH

SEQ ID NO: 1448832 - protein, 7 aa, Mycobacterium tuberculosis
QRSGSRV

SEQ ID NO: 1448833 - protein, 25 aa, Mycobacterium tuberculosis
QRSKRIAAQRKAAEEPVEVPERSDV

SEQ ID NO: 1448834 - protein, 4 aa, Mycobacterium tuberculosis
QRSQ

SEQ ID NO: 1448835 - protein, 5 aa, Mycobacterium tuberculosis
QRSSI

SEQ ID NO: 1448836 - protein, 5 aa, Mycobacterium tuberculosis
QRSSR

SEQ ID NO: 1448837 - protein, 25 aa, Mycobacterium tuberculosis
QRTATGAADLPATHGRTAAGGCPRR

SEQ ID NO: 1448838 - protein, 5 aa, Mycobacterium tuberculosis
QRTEG

SEQ ID NO: 1448839 - protein, 14 aa, Mycobacterium tuberculosis
QRTPYPGGWFGYRR

SEQ ID NO: 1448840 - protein, 22 aa, Mycobacterium tuberculosis
QRTSGSRRRRARIPDRPGSGHQ

SEQ ID NO: 1448841 - protein, 30 aa, Mycobacterium tuberculosis
QRTTRTATNPLEPDASTRDRDCPLHLTSDF

SEQ ID NO: 1448842 - protein, 6 aa, Mycobacterium tuberculosis
QSAENA

SEQ ID NO: 1448843 - protein, 56 aa, Mycobacterium tuberculosis
QSAGPAGPTGPAVATNKAGSTGPAGPTGAPQPTDPASTSGAAEYGAGSADPAGPAV

SEQ ID NO: 1448844 - protein, 25 aa, Mycobacterium tuberculosis
QSALAATRVGGYGKLPADTHPSGGC

SEQ ID NO: 1448845 - protein, 6 aa, Mycobacterium tuberculosis
QSALGQ

SEQ ID NO: 1448846 - protein, 9 aa, Mycobacterium tuberculosis
QSARAGANE

SEQ ID NO: 1448847 - protein, 4 aa, Mycobacterium tuberculosis
QSDE

SEQ ID NO: 1448848 - protein, 9 aa, Mycobacterium tuberculosis
QSDGSQPEA

SEQ ID NO: 1448849 - protein, 13 aa, Mycobacterium tuberculosis
QSDSRTKPVPPPI

SEQ ID NO: 1448850 - protein, 7 aa, Mycobacterium tuberculosis
QSEASRL

SEQ ID NO: 1448851 - protein, 7 aa, Mycobacterium tuberculosis
QSENLGS

SEQ ID NO: 1448852 - protein, 12 aa, Mycobacterium tuberculosis
QSGAAPGAGKTR

SEQ ID NO: 1448853 - protein, 9 aa, Mycobacterium tuberculosis
QSGGANSPA

SEQ ID NO: 1448854 - protein, 9 aa, Mycobacterium tuberculosis
QSGNAGPAV

SEQ ID NO: 1448855 - protein, 10 aa, Mycobacterium tuberculosis
QSGPSYRQGR

SEQ ID NO: 1448856 - protein, 8 aa, Mycobacterium tuberculosis
QSGRDPAC

SEQ ID NO: 1448857 - protein, 11 aa, Mycobacterium tuberculosis
QSHSKNYSTRA

SEQ ID NO: 1448858 - protein, 10 aa, Mycobacterium tuberculosis
QSIPGPSNLG

SEQ ID NO: 1448859 - protein, 27 aa, Mycobacterium tuberculosis
QSKDAEARGPRPPRPVAAHGRKEAPRE

SEQ ID NO: 1448860 - protein, 26 aa, Mycobacterium tuberculosis
QSKPGAAGGARGVGGFRESRPDCGEQ

SEQ ID NO: 1448861 - protein, 22 aa, Mycobacterium tuberculosis
QSKPPTPSACSPASTNPTSRPT

SEQ ID NO: 1448862 - protein, 8 aa, Mycobacterium tuberculosis
QSLADTAN

SEQ ID NO: 1448863 - protein, 10 aa, Mycobacterium tuberculosis
QSLSDAENTL

SEQ ID NO: 1448864 - protein, 14 aa, Mycobacterium tuberculosis
QSPAAAGEHRGPAR

SEQ ID NO: 1448865 - protein, 6 aa, Mycobacterium tuberculosis
QSPDVS

SEQ ID NO: 1448866 - protein, 13 aa, Mycobacterium tuberculosis
QSPGSRRGWPPQS

SEQ ID NO: 1448867 - protein, 9 aa, Mycobacterium tuberculosis
QSPVADPPR

SEQ ID NO: 1448868 - protein, 7 aa, Mycobacterium tuberculosis
QSQETDI

SEQ ID NO: 1448869 - protein, 14 aa, Mycobacterium tuberculosis
QSQVPDRCTPRVTD

SEQ ID NO: 1448870 - protein, 8 aa, Mycobacterium tuberculosis
QSRGREAD

SEQ ID NO: 1448871 - protein, 9 aa, Mycobacterium tuberculosis
QSRGTGSLE

SEQ ID NO: 1448872 - protein, 13 aa, Mycobacterium tuberculosis
QSRGVGKDRTYRQ

SEQ ID NO: 1448873 - protein, 9 aa, Mycobacterium tuberculosis
QSRRGAEEV

SEQ ID NO: 1448874 - protein, 28 aa, Mycobacterium tuberculosis
QSRSTARGSRNGFRRPPRPPKCARSATA

SEQ ID NO: 1448875 - protein, 6 aa, Mycobacterium tuberculosis
QSSNGP

SEQ ID NO: 1448876 - protein, 17 aa, Mycobacterium tuberculosis
QSSSAITPGQTAELYPG

SEQ ID NO: 1448877 - protein, 10 aa, Mycobacterium tuberculosis
QSTPTGIDGY

SEQ ID NO: 1448878 - protein, 4 aa, Mycobacterium tuberculosis
QSTR

SEQ ID NO: 1448879 - protein, 8 aa, Mycobacterium tuberculosis
QSTVATQR

SEQ ID NO: 1448880 - protein, 5 aa, Mycobacterium tuberculosis
QSVAE

SEQ ID NO: 1448881 - protein, 16 aa, Mycobacterium tuberculosis
QTAGTGERSRRRSQVG

SEQ ID NO: 1448882 - protein, 4 aa, Mycobacterium tuberculosis
QTDD

SEQ ID NO: 1448883 - protein, 18 aa, Mycobacterium tuberculosis
QTDYNVGSRMQGQLDTEL

SEQ ID NO: 1448884 - protein, 4 aa, Mycobacterium tuberculosis
QTEL

SEQ ID NO: 1448885 - protein, 9 aa, Mycobacterium tuberculosis
QTENTPLSA

SEQ ID NO: 1448886 - protein, 5 aa, Mycobacterium tuberculosis
QTFGE

SEQ ID NO: 1448887 - protein, 16 aa, Mycobacterium tuberculosis
QTGDPNICDTFSAADL

SEQ ID NO: 1448888 - protein, 4 aa, Mycobacterium tuberculosis
QTGR

SEQ ID NO: 1448889 - protein, 25 aa, Mycobacterium tuberculosis
QTIGPRASTGAARRPPGSASPTQAR

SEQ ID NO: 1448890 - protein, 27 aa, Mycobacterium tuberculosis
QTPGGRAPGNRCARPGIAAGPTRMPAP

SEQ ID NO: 1448891 - protein, 9 aa, Mycobacterium tuberculosis
QTPGRTTRA

SEQ ID NO: 1448892 - protein, 10 aa, Mycobacterium tuberculosis
QTQNPERGRK

SEQ ID NO: 1448893 - protein, 9 aa, Mycobacterium tuberculosis
QTRASRDAL

SEQ ID NO: 1448894 - protein, 15 aa, Mycobacterium tuberculosis
QTREATYYSRSRAEQ

SEQ ID NO: 1448895 - protein, 25 aa, Mycobacterium tuberculosis
QTRKSARSRGKSDPIRCAGGGAGGD

SEQ ID NO: 1448896 - protein, 8 aa, Mycobacterium tuberculosis
QTSAPVTG

SEQ ID NO: 1448897 - protein, 8 aa, Mycobacterium tuberculosis
QTSDEVTV

SEQ ID NO: 1448898 - protein, 6 aa, Mycobacterium tuberculosis
QTSESL

SEQ ID NO: 1448899 - protein, 10 aa, Mycobacterium tuberculosis
QTSGNSGQHP

SEQ ID NO: 1448900 - protein, 17 aa, Mycobacterium tuberculosis
QTSGQVAGVGGAQRGVR

SEQ ID NO: 1448901 - protein, 5 aa, Mycobacterium tuberculosis
QTSKT

SEQ ID NO: 1448902 - protein, 12 aa, Mycobacterium tuberculosis
QTSNAGEADPVP

SEQ ID NO: 1448903 - protein, 5 aa, Mycobacterium tuberculosis
QTTAG

SEQ ID NO: 1448904 - protein, 13 aa, Mycobacterium tuberculosis
QTYGAEGLDVADG

SEQ ID NO: 1448905 - protein, 9 aa, Mycobacterium tuberculosis
QVATTLTGT

SEQ ID NO: 1448906 - protein, 15 aa, Mycobacterium tuberculosis
QVDAGARPGTTTEES

SEQ ID NO: 1448907 - protein, 6 aa, Mycobacterium tuberculosis
QVETDS

SEQ ID NO: 1448908 - protein, 16 aa, Mycobacterium tuberculosis
QVGASRNSFKHYVATA

SEQ ID NO: 1448909 - protein, 26 aa, Mycobacterium tuberculosis
QVGHREGDHRQQDHHRRGEVQRTPYP

SEQ ID NO: 1448910 - protein, 23 aa, Mycobacterium tuberculosis
QVGTNSPSNAEAGNGGSGGNGFD

SEQ ID NO: 1448911 - protein, 5 aa, Mycobacterium tuberculosis
QVHNE

SEQ ID NO: 1448912 - protein, 5 aa, Mycobacterium tuberculosis
QVHPR

SEQ ID NO: 1448913 - protein, 5 aa, Mycobacterium tuberculosis
QVPAG

SEQ ID NO: 1448914 - protein, 8 aa, Mycobacterium tuberculosis
QVPATATA

SEQ ID NO: 1448915 - protein, 17 aa, Mycobacterium tuberculosis
QVPGQRGAAHRPLPQGQ

SEQ ID NO: 1448916 - protein, 6 aa, Mycobacterium tuberculosis
QVPPDR

SEQ ID NO: 1448917 - protein, 11 aa, Mycobacterium tuberculosis
QVPSEPLPTGD

SEQ ID NO: 1448918 - protein, 5 aa, Mycobacterium tuberculosis
QVPTE

SEQ ID NO: 1448919 - protein, 5 aa, Mycobacterium tuberculosis
QVQPG

SEQ ID NO: 1448920 - protein, 8 aa, Mycobacterium tuberculosis
QVRPGERL

SEQ ID NO: 1448921 - protein, 5 aa, Mycobacterium tuberculosis
QVSGI

SEQ ID NO: 1448922 - protein, 13 aa, Mycobacterium tuberculosis
QVTTESNGDYGRI

SEQ ID NO: 1448923 - protein, 11 aa, Mycobacterium tuberculosis
QVTTTSPKEVT

SEQ ID NO: 1448924 - protein, 4 aa, Mycobacterium tuberculosis
QVYA

SEQ ID NO: 1448925 - protein, 14 aa, Mycobacterium tuberculosis
QWTRSAKPKPPARC

SEQ ID NO: 1448926 - protein, 11 aa, Mycobacterium tuberculosis
QYEHGRDTAPV

SEQ ID NO: 1448927 - protein, 62 aa, Mycobacterium tuberculosis; identical to SEQ ID NO: 153363

SEQ ID NO: 1448928 - protein, 72 aa, Mycobacterium tuberculosis; identical to SEQ ID NO: 1370319

SEQ ID NO: 1448929 - protein, 4 aa, Mycobacterium tuberculosis
QYPI

SEQ ID NO: 1448930 - protein, 11 aa, Mycobacterium tuberculosis
QYPPSPDKAVK

SEQ ID NO: 1448931 - protein, 10 aa, Mycobacterium tuberculosis
QYSPGRTRSG

SEQ ID NO: 1448932 - protein, 20 aa, Mycobacterium tuberculosis
QYTDGSGYSPNLPQGAPPFG

SEQ ID NO: 1448933 - protein, 15 aa, Mycobacterium tuberculosis
RAAAARGWAGTSGLG

SEQ ID NO: 1448934 - protein, 9 aa, Mycobacterium tuberculosis
RAAAARTGH

SEQ ID NO: 1448935 - protein, 18 aa, Mycobacterium tuberculosis
RAAAGAGQRGEHPLPDDQ

SEQ ID NO: 1448936 - protein, 11 aa, Mycobacterium tuberculosis
RAAAGPGGGIP

SEQ ID NO: 1448937 - protein, 23 aa, Mycobacterium tuberculosis
RAAAGQGGCCGRAEPRFRFCYLV

SEQ ID NO: 1448938 - protein, 7 aa, Mycobacterium tuberculosis
RAAAMTA

SEQ ID NO: 1448939 - protein, 16 aa, Mycobacterium tuberculosis
RAAARARGQDAGRGRV

SEQ ID NO: 1448940 - protein, 10 aa, Mycobacterium tuberculosis
RAAARRERTQ

SEQ ID NO: 1448941 - protein, 18 aa, Mycobacterium tuberculosis
RAAENRTQARIGGRCWRG

SEQ ID NO: 1448942 - protein, 14 aa, Mycobacterium tuberculosis
RAAEPSASRPYSSC

SEQ ID NO: 1448943 - protein, 9 aa, Mycobacterium tuberculosis
RAAESRYSK

SEQ ID NO: 1448944 - protein, 8 aa, Mycobacterium tuberculosis
RAAGPDDL

SEQ ID NO: 1448945 - protein, 8 aa, Mycobacterium tuberculosis
RAAGPRCQ

SEQ ID NO: 1448946 - protein, 12 aa, Mycobacterium tuberculosis
RAAGRGEEDEES

SEQ ID NO: 1448947 - protein, 11 aa, Mycobacterium tuberculosis
RAAGRGGRDKP

SEQ ID NO: 1448948 - protein, 12 aa, Mycobacterium tuberculosis
RAAGRTRHDAPL

SEQ ID NO: 1448949 - protein, 9 aa, Mycobacterium tuberculosis
RAAGSRPRL

SEQ ID NO: 1448950 - protein, 7 aa, Mycobacterium tuberculosis
RAAGTHK

SEQ ID NO: 1448951 - protein, 8 aa, Mycobacterium tuberculosis
RAAKAEPL

SEQ ID NO: 1448952 - protein, 16 aa, Mycobacterium tuberculosis
RAAKAGLAVGDNRRQP

SEQ ID NO: 1448953 - protein, 9 aa, Mycobacterium tuberculosis
RAAMGPPER

SEQ ID NO: 1448954 - protein, 28 aa, Mycobacterium tuberculosis
RAANGGLRGRPANLGGPGGNGGLGGKRR

SEQ ID NO: 1448955 - protein, 8 aa, Mycobacterium tuberculosis
RAAPGLGR

SEQ ID NO: 1448956 - protein, 7 aa, Mycobacterium tuberculosis
RAAQTDW

SEQ ID NO: 1448957 - protein, 13 aa, Mycobacterium tuberculosis
RAARGSGQQDRRC

SEQ ID NO: 1448958 - protein, 7 aa, Mycobacterium tuberculosis
RAARPRH

SEQ ID NO: 1448959 - protein, 10 aa, Mycobacterium tuberculosis
RAARRRASST

SEQ ID NO: 1448960 - protein, 7 aa, Mycobacterium tuberculosis
RAASESA

SEQ ID NO: 1448961 - protein, 40 aa, Mycobacterium tuberculosis
RAASRDAQGRYQRGRQPHPGQGRQEQVPRRGHSDLRSGHR

SEQ ID NO: 1448962 - protein, 8 aa, Mycobacterium tuberculosis
RAASRQLR

SEQ ID NO: 1448963 - protein, 12 aa, Mycobacterium tuberculosis
RAATAATAASAA

SEQ ID NO: 1448964 - protein, 10 aa, Mycobacterium tuberculosis
RAATARGSRV

SEQ ID NO: 1448965 - protein, 20 aa, Mycobacterium tuberculosis
RAATGRDHVPARRTRPGCGT

SEQ ID NO: 1448966 - protein, 7 aa, Mycobacterium tuberculosis
RADAESP

SEQ ID NO: 1448967 - protein, 4 aa, Mycobacterium tuberculosis
RADD

SEQ ID NO: 1448968 - protein, 5 aa, Mycobacterium tuberculosis
RADGT

SEQ ID NO: 1448969 - protein, 16 aa, Mycobacterium tuberculosis
RADKSAPAARSNGSRW

SEQ ID NO: 1448970 - protein, 8 aa, Mycobacterium tuberculosis
RADPLTAA

SEQ ID NO: 1448971 - protein, 9 aa, Mycobacterium tuberculosis
RADPPVPAV

SEQ ID NO: 1448972 - protein, 6 aa, Mycobacterium tuberculosis
RADPRR

SEQ ID NO: 1448973 - protein, 7 aa, Mycobacterium tuberculosis
RADRAAD

SEQ ID NO: 1448974 - protein, 9 aa, Mycobacterium tuberculosis
RADRPGHRC

SEQ ID NO: 1448975 - protein, 7 aa, Mycobacterium tuberculosis
RADRRGG

SEQ ID NO: 1448976 - protein, 17 aa, Mycobacterium tuberculosis
RADRSRRGRRSGWHRRV

SEQ ID NO: 1448977 - protein, 13 aa, Mycobacterium tuberculosis
RADTARGGRGSGL

SEQ ID NO: 1448978 - protein, 5 aa, Mycobacterium tuberculosis
RADTF

SEQ ID NO: 1448979 - protein, 39 aa, Mycobacterium tuberculosis
RADTGRNRRGGESARTDTNRGDGGHEPASSDLASLPSGH

SEQ ID NO: 1448980 - protein, 11 aa, Mycobacterium tuberculosis
RADTNGPQSGA

SEQ ID NO: 1448981 - protein, 4 aa, Mycobacterium tuberculosis
RADV

SEQ ID NO: 1448982 - protein, 6 aa, Mycobacterium tuberculosis
RADVAG

SEQ ID NO: 1448983 - protein, 12 aa, Mycobacterium tuberculosis
RAEAAQAHTGDL

SEQ ID NO: 1448984 - protein, 19 aa, Mycobacterium tuberculosis
RAEAGAGAAVRDVDGRTYA

SEQ ID NO: 1448985 - protein, 20 aa, Mycobacterium tuberculosis
RAEASGGGCRRDRRRGRPTT

SEQ ID NO: 1448986 - protein, 4 aa, Mycobacterium tuberculosis
RAEL

SEQ ID NO: 1448987 - protein, 4 aa, Mycobacterium tuberculosis
RAEP

SEQ ID NO: 1448988 - protein, 16 aa, Mycobacterium tuberculosis
RAEQAGAQAEGAAAAY

SEQ ID NO: 1448989 - protein, 7 aa, Mycobacterium tuberculosis
RAERGHF

SEQ ID NO: 1448990 - protein, 10 aa, Mycobacterium tuberculosis
RAETVGSSAA

SEQ ID NO: 1448991 - protein, 7 aa, Mycobacterium tuberculosis
RAFSGGY

SEQ ID NO: 1448992 - protein, 4 aa, Mycobacterium tuberculosis
RAGA

SEQ ID NO: 1448993 - protein, 5 aa, Mycobacterium tuberculosis
RAGAA

SEQ ID NO: 1448994 - protein, 11 aa, Mycobacterium tuberculosis
RAGAAAAAALP

SEQ ID NO: 1448995 - protein, 7 aa, Mycobacterium tuberculosis
RAGAADD

SEQ ID NO: 1448996 - protein, 14 aa, Mycobacterium tuberculosis
RAGAGDRPLPPTRP

SEQ ID NO: 1448997 - protein, 12 aa, Mycobacterium tuberculosis
RAGAGVDRNSGV

SEQ ID NO: 1448998 - protein, 9 aa, Mycobacterium tuberculosis
RAGAPGCRE

SEQ ID NO: 1448999 - protein, 8 aa, Mycobacterium tuberculosis
RAGCADRP

SEQ ID NO: 1449000 - protein, 19 aa, Mycobacterium tuberculosis
RAGDGAGAVRAKSSPTDPV

SEQ ID NO: 1449001 - protein, 9 aa, Mycobacterium tuberculosis
RAGDGDRFD

SEQ ID NO: 1449002 - protein, 6 aa, Mycobacterium tuberculosis
RAGDGV

SEQ ID NO: 1449003 - protein, 12 aa, Mycobacterium tuberculosis
RAGDRPGRHHRN

SEQ ID NO: 1449004 - protein, 19 aa, Mycobacterium tuberculosis
RAGDVADAGDGNRRRKTGH

SEQ ID NO: 1449005 - protein, 6 aa, Mycobacterium tuberculosis
RAGERL

SEQ ID NO: 1449006 - protein, 92 aa, Mycobacterium tuberculosis
RAGGAGGAGGISETDGSAGGVATGGEGGDGATGGVDGGVGGAGGKGGQGHNTGVGDAFGGDGGIGGDGNGALGAAGGNGGTGGAGGNGGRGG

SEQ ID NO: 1449007 - protein, 9 aa, Mycobacterium tuberculosis
RAGGGGGHR

SEQ ID NO: 1449008 - protein, 9 aa, Mycobacterium tuberculosis
RAGGGHRRS

SEQ ID NO: 1449009 - protein, 8 aa, Mycobacterium tuberculosis
RAGGLGAR

SEQ ID NO: 1449010 - protein, 20 aa, Mycobacterium tuberculosis
RAGGSRCRRDAVPESRPGVH

SEQ ID NO: 1449011 - protein, 12 aa, Mycobacterium tuberculosis
RAGIGAGADPAV

SEQ ID NO: 1449012 - protein, 11 aa, Mycobacterium tuberculosis
RAGKRAGKTVG

SEQ ID NO: 1449013 - protein, 8 aa, Mycobacterium tuberculosis
RAGNTRGG

SEQ ID NO: 1449014 - protein, 5 aa, Mycobacterium tuberculosis
RAGPA

SEQ ID NO: 1449015 - protein, 25 aa, Mycobacterium tuberculosis
RAGPAGTARPNKRERRRPEETAAPV

SEQ ID NO: 1449016 - protein, 9 aa, Mycobacterium tuberculosis
RAGPHGGLQ

SEQ ID NO: 1449017 - protein, 15 aa, Mycobacterium tuberculosis
RAGPHRPPIAATPSA

SEQ ID NO: 1449018 - protein, 8 aa, Mycobacterium tuberculosis
RAGPRPHL

SEQ ID NO: 1449019 - protein, 4 aa, Mycobacterium tuberculosis
RAGR

SEQ ID NO: 1449020 - protein, 22 aa, Mycobacterium tuberculosis
RAGRAERRDSRDDIAADEQVTG

SEQ ID NO: 1449021 - protein, 37 aa, Mycobacterium tuberculosis
RAGRDGGLVDPGRGSGGRRGPGRAAAAAAGRERGGGV

SEQ ID NO: 1449022 - protein, 25 aa, Mycobacterium tuberculosis
RAGRNRDFSERTRGPADRANHRGPA

SEQ ID NO: 1449023 - protein, 8 aa, Mycobacterium tuberculosis
RAGSLDKR

SEQ ID NO: 1449024 - protein, 33 aa, Mycobacterium tuberculosis
RAGTAGGADRGPVGGIGGAGGVGGAGGAAGAVT

SEQ ID NO: 1449025 - protein, 33 aa, Mycobacterium tuberculosis
RAGTAGGAGGGPAGGIGGTGGVGGAGGAAGAVT

SEQ ID NO: 1449026 - protein, 32 aa, Mycobacterium tuberculosis
RAGTAGGAGGGPVGGIGGAGGVGGAGGAAGAV

SEQ ID NO: 1449027 - protein, 32 aa, Mycobacterium tuberculosis; identical to SEQ ID NO: 193102

SEQ ID NO: 1449028 - protein, 27 aa, Mycobacterium tuberculosis
RAGTAGPAVAKQSGSSSVTALLAGAGQ

SEQ ID NO: 1449029 - protein, 10 aa, Mycobacterium tuberculosis
RAGTGASPRI

SEQ ID NO: 1449030 - protein, 17 aa, Mycobacterium tuberculosis
RAGTPPSGQPVWAQVRH

SEQ ID NO: 1449031 - protein, 33 aa, Mycobacterium tuberculosis
RAGTSGGAGRGPVGGIGGAGGVGGAGGAAGAVT

SEQ ID NO: 1449032 - protein, 14 aa, Mycobacterium tuberculosis
RAGVPRRSPTAVDR

SEQ ID NO: 1449033 - protein, 5 aa, Mycobacterium tuberculosis
RAHGY

SEQ ID NO: 1449034 - protein, 12 aa, Mycobacterium tuberculosis
RAHRATAPTPRC

SEQ ID NO: 1449035 - protein, 8 aa, Mycobacterium tuberculosis
RAHRPRRQ

SEQ ID NO: 1449036 - protein, 5 aa, Mycobacterium tuberculosis
RAHSP

SEQ ID NO: 1449037 - protein, 12 aa, Mycobacterium tuberculosis
RAIKQGTELAAR

SEQ ID NO: 1449038 - protein, 17 aa, Mycobacterium tuberculosis
RAISASADYFQTRGIEL

SEQ ID NO: 1449039 - protein, 4 aa, Mycobacterium tuberculosis
RAIT

SEQ ID NO: 1449040 - protein, 10 aa, Mycobacterium tuberculosis
RAKAERSETR

SEQ ID NO: 1449041 - protein, 4 aa, Mycobacterium tuberculosis
RAKR

SEQ ID NO: 1449042 - protein, 9 aa, Mycobacterium tuberculosis
RAKRSGTGI

SEQ ID NO: 1449043 - protein, 9 aa, Mycobacterium tuberculosis
RAKTLSESV

SEQ ID NO: 1449044 - protein, 16 aa, Mycobacterium tuberculosis
RALGSNKSYPASQTAE

SEQ ID NO: 1449045 - protein, 7 aa, Mycobacterium tuberculosis
RALPGSG

SEQ ID NO: 1449046 - protein, 13 aa, Mycobacterium tuberculosis
RALRSRRSRFGGG

SEQ ID NO: 1449047 - protein, 13 aa, Mycobacterium tuberculosis
RANCDRASRDGTC

SEQ ID NO: 1449048 - protein, 14 aa, Mycobacterium tuberculosis
RANDPALKGRPALS

SEQ ID NO: 1449049 - protein, 7 aa, Mycobacterium tuberculosis
RANGTYG

SEQ ID NO: 1449050 - protein, 8 aa, Mycobacterium tuberculosis
RANGTYGD

SEQ ID NO: 1449051 - protein, 5 aa, Mycobacterium tuberculosis
RANPC

SEQ ID NO: 1449052 - protein, 10 aa, Mycobacterium tuberculosis
RANTERDAHP

SEQ ID NO: 1449053 - protein, 16 aa, Mycobacterium tuberculosis
RAPADPSRVRNRAGPH

SEQ ID NO: 1449054 - protein, 18 aa, Mycobacterium tuberculosis
RAPAGPPFTAPTGWTSSR

SEQ ID NO: 1449055 - protein, 26 aa, Mycobacterium tuberculosis
RAPAGTAGRPESGCRSSASNGRTQTG

SEQ ID NO: 1449056 - protein, 15 aa, Mycobacterium tuberculosis
RAPARPVAGTGPVYT

SEQ ID NO: 1449057 - protein, 7 aa, Mycobacterium tuberculosis
RAPARTY

SEQ ID NO: 1449058 - protein, 5 aa, Mycobacterium tuberculosis
RAPAV

SEQ ID NO: 1449059 - protein, 13 aa, Mycobacterium tuberculosis
RAPDAPGLRAGGR

SEQ ID NO: 1449060 - protein, 22 aa, Mycobacterium tuberculosis
RAPGAPAAFAGQGFPAAGVASP

SEQ ID NO: 1449061 - protein, 8 aa, Mycobacterium tuberculosis
RAPIPRRT

SEQ ID NO: 1449062 - protein, 8 aa, Mycobacterium tuberculosis
RAPPPSTR

SEQ ID NO: 1449063 - protein, 15 aa, Mycobacterium tuberculosis
RAPPQVGRVGRVGRP

SEQ ID NO: 1449064 - protein, 42 aa, Mycobacterium tuberculosis
RAPPTPPAPPLPNSHPPAPPAPPFAPASKGRPLPPTPPGPTL

SEQ ID NO: 1449065 - protein, 15 aa, Mycobacterium tuberculosis
RAPRHCTPCSKMCSM

SEQ ID NO: 1449066 - protein, 41 aa, Mycobacterium tuberculosis
RAPRPPRRLAPRRGHRSRRVHGGRPRQRVHESDGGAQSAHR

SEQ ID NO: 1449067 - protein, 18 aa, Mycobacterium tuberculosis
RAPSRDAPGLTQHPLGQR

SEQ ID NO: 1449068 - protein, 14 aa, Mycobacterium tuberculosis
RAPTAAGTLDRRRA

SEQ ID NO: 1449069 - protein, 16 aa, Mycobacterium tuberculosis
RAPTALAAGSTQVPPF

SEQ ID NO: 1449070 - protein, 15 aa, Mycobacterium tuberculosis
RAPTANRDAAGGGIK

SEQ ID NO: 1449071 - protein, 35 aa, Mycobacterium tuberculosis
RAPTANRDAAGGGIKMPPPAAPDAPVQRPDYSETD

SEQ ID NO: 1449072 - protein, 61 aa, Mycobacterium tuberculosis
RAPTPRPTAGWTPSPTGGEPKTYQPPPSPGAPGARSAARSPLPNKPATPSPPRKAPTPSRP

SEQ ID NO: 1449073 - protein, 39 aa, Mycobacterium tuberculosis
RAPTSSSPRWTSCPGSRRPSSSCATARSTTPTAPAPSCP

SEQ ID NO: 1449074 - protein, 7 aa, Mycobacterium tuberculosis
RAPVGPV

SEQ ID NO: 1449075 - protein, 12 aa, Mycobacterium tuberculosis
RAPVSEQSGSAQ

SEQ ID NO: 1449076 - protein, 21 aa, Mycobacterium tuberculosis
RAQGGRNHDPATARPRPTAAD

SEQ ID NO: 1449077 - protein, 8 aa, Mycobacterium tuberculosis
RAQRGQSD

SEQ ID NO: 1449078 - protein, 15 aa, Mycobacterium tuberculosis
RAQRPERALGTSSRG

SEQ ID NO: 1449079 - protein, 30 aa, Mycobacterium tuberculosis
RAQSDGGRIGSRSRSRQKSSKPRGNQAAAG

SEQ ID NO: 1449080 - protein, 8 aa, Mycobacterium tuberculosis
RAQSQAGL

SEQ ID NO: 1449081 - protein, 8 aa, Mycobacterium tuberculosis
RAREAGRI

SEQ ID NO: 1449082 - protein, 23 aa, Mycobacterium tuberculosis
RARGAEVSSALNPAHRSSRSSTR

SEQ ID NO: 1449083 - protein, 26 aa, Mycobacterium tuberculosis
RARGDRAQGSPPASPGRAVAGRPGRA

SEQ ID NO: 1449084 - protein, 15 aa, Mycobacterium tuberculosis
RARGEHGPAADRHPR

SEQ ID NO: 1449085 - protein, 8 aa, Mycobacterium tuberculosis
RARGPRCQ

SEQ ID NO: 1449086 - protein, 6 aa, Mycobacterium tuberculosis
RARPAS

SEQ ID NO: 1449087 - protein, 14 aa, Mycobacterium tuberculosis
RARPASTLITRFIA

SEQ ID NO: 1449088 - protein, 14 aa, Mycobacterium tuberculosis
RARQATLGLFFDAW

SEQ ID NO: 1449089 - protein, 13 aa, Mycobacterium tuberculosis
RARRATLAAAGAS

SEQ ID NO: 1449090 - protein, 17 aa, Mycobacterium tuberculosis
RARRPRSSCARPPPECT

SEQ ID NO: 1449091 - protein, 12 aa, Mycobacterium tuberculosis
RARRSGSDGTWR

SEQ ID NO: 1449092 - protein, 10 aa, Mycobacterium tuberculosis
RARSGGAHRG

SEQ ID NO: 1449093 - protein, 19 aa, Mycobacterium tuberculosis
RARSRSTGRCPAPPPTWPP

SEQ ID NO: 1449094 - protein, 22 aa, Mycobacterium tuberculosis
RARSSSDLTARRRSTPSTSPAS

SEQ ID NO: 1449095 - protein, 10 aa, Mycobacterium tuberculosis
RARTAETGRP

SEQ ID NO: 1449096 - protein, 13 aa, Mycobacterium tuberculosis
RARTANDGRICAH

SEQ ID NO: 1449097 - protein, 42 aa, Mycobacterium tuberculosis
RARTRGPVSAGAAVPEGPDREHPGAALASNGGLHPGRAPRHA

SEQ ID NO: 1449098 - protein, 28 aa, Mycobacterium tuberculosis
RARTTDGPAPSHNAMASNTAAALTTLAD

SEQ ID NO: 1449099 - protein, 15 aa, Mycobacterium tuberculosis
RARVPSRAGSRAAAP

SEQ ID NO: 1449100 - protein, 13 aa, Mycobacterium tuberculosis
RASARESPRTPKR

SEQ ID NO: 1449101 - protein, 6 aa, Mycobacterium tuberculosis
RASGDE

SEQ ID NO: 1449102 - protein, 16 aa, Mycobacterium tuberculosis
RASGPQDYANIPPTRF

SEQ ID NO: 1449103 - protein, 29 aa, Mycobacterium tuberculosis
RASKAPTRRYKPRRPTTASTTSPTPRICT

SEQ ID NO: 1449104 - protein, 25 aa, Mycobacterium tuberculosis
RASPINRPAQKFPPKAPGGRVGGDP

SEQ ID NO: 1449105 - protein, 8 aa, Mycobacterium tuberculosis
RASQTSRE

SEQ ID NO: 1449106 - protein, 11 aa, Mycobacterium tuberculosis
RASRPAVGQRG

SEQ ID NO: 1449107 - protein, 31 aa, Mycobacterium tuberculosis
RASSAPIASGSDAAAGRDDGRGRTMSQSDDP

SEQ ID NO: 1449108 - protein, 28 aa, Mycobacterium tuberculosis
RATAARRPAHTTLEGPEPGRRPGCWRPG

SEQ ID NO: 1449109 - protein, 18 aa, Mycobacterium tuberculosis
RATAGRCTDPGQCPAGQL

SEQ ID NO: 1449110 - protein, 12 aa, Mycobacterium tuberculosis
RATATSERRLLH

SEQ ID NO: 1449111 - protein, 13 aa, Mycobacterium tuberculosis
RATDGETVDLSVL

SEQ ID NO: 1449112 - protein, 6 aa, Mycobacterium tuberculosis
RATERV

SEQ ID NO: 1449113 - protein, 9 aa, Mycobacterium tuberculosis
RATGAAEAI

SEQ ID NO: 1449114 - protein, 12 aa, Mycobacterium tuberculosis
RATGAQTAKPSL

SEQ ID NO: 1449115 - protein, 5 aa, Mycobacterium tuberculosis
RATGR

SEQ ID NO: 1449116 - protein, 15 aa, Mycobacterium tuberculosis
RATHIPAADRVCRRL

SEQ ID NO: 1449117 - protein, 9 aa, Mycobacterium tuberculosis
RATHRTQDL

SEQ ID NO: 1449118 - protein, 4 aa, Mycobacterium tuberculosis
RATN

SEQ ID NO: 1449119 - protein, 35 aa, Mycobacterium tuberculosis
RATPTKPTCASGKAACASSTIPNPARNTGTSRGGL

SEQ ID NO: 1449120 - protein, 16 aa, Mycobacterium tuberculosis
RATRPPRFSRPTCRGA

SEQ ID NO: 1449121 - protein, 14 aa, Mycobacterium tuberculosis
RAVGSDLGQREAGV

SEQ ID NO: 1449122 - protein, 8 aa, Mycobacterium tuberculosis
RAVPPYES

SEQ ID NO: 1449123 - protein, 20 aa, Mycobacterium tuberculosis
RAVQGSMGDQTADQSLRRRD

SEQ ID NO: 1449124 - protein, 6 aa, Mycobacterium tuberculosis
RAVQPD

SEQ ID NO: 1449125 - protein, 4 aa, Mycobacterium tuberculosis
RAVT

SEQ ID NO: 1449126 - protein, 12 aa, Mycobacterium tuberculosis
RAYQAASAEPAA

SEQ ID NO: 1449127 - protein, 8 aa, Mycobacterium tuberculosis
RAYRGSTQ

SEQ ID NO: 1449128 - protein, 24 aa, Mycobacterium tuberculosis
RCAGTSSDRHRSIPRRGPRTRCGT

SEQ ID NO: 1449129 - protein, 9 aa, Mycobacterium tuberculosis
RCDGPRLGQ

SEQ ID NO: 1449130 - protein, 15 aa, Mycobacterium tuberculosis
RCDPGQGLSQPGLAR

SEQ ID NO: 1449131 - protein, 9 aa, Mycobacterium tuberculosis
RCDRGSPGC

SEQ ID NO: 1449132 - protein, 5 aa, Mycobacterium tuberculosis
RCENS

SEQ ID NO: 1449133 - protein, 23 aa, Mycobacterium tuberculosis
RCETPGCRARTPAGGCWKSPTCW

SEQ ID NO: 1449134 - protein, 13 aa, Mycobacterium tuberculosis
RCGPSSRAISAPS

SEQ ID NO: 1449135 - protein, 6 aa, Mycobacterium tuberculosis
RCGSPA

SEQ ID NO: 1449136 - protein, 18 aa, Mycobacterium tuberculosis
RCGTEGRRWRSSSRACTR

SEQ ID NO: 1449137 - protein, 5 aa, Mycobacterium tuberculosis
RCPDI

SEQ ID NO: 1449138 - protein, 15 aa, Mycobacterium tuberculosis
RCPESPNARTAGSGR

SEQ ID NO: 1449139 - protein, 18 aa, Mycobacterium tuberculosis
RCPPGPPPGGGTSGRRLP

SEQ ID NO: 1449140 - protein, 8 aa, Mycobacterium tuberculosis
RCQPPNPV

SEQ ID NO: 1449141 - protein, 14 aa, Mycobacterium tuberculosis
RCRAAATADPGKPD

SEQ ID NO: 1449142 - protein, 29 aa, Mycobacterium tuberculosis
RCRDDAGKLAGTRRCNGGCARQGQAKSMA

SEQ ID NO: 1449143 - protein, 11 aa, Mycobacterium tuberculosis
RCSPASPSCQA

SEQ ID NO: 1449144 - protein, 11 aa, Mycobacterium tuberculosis
RCSPPRSRKQE

SEQ ID NO: 1449145 - protein, 8 aa, Mycobacterium tuberculosis
RCSPSDVV

SEQ ID NO: 1449146 - protein, 12 aa, Mycobacterium tuberculosis
RCSPTRRHRLAS

SEQ ID NO: 1449147 - protein, 8 aa, Mycobacterium tuberculosis
RCSTRSRG

SEQ ID NO: 1449148 - protein, 15 aa, Mycobacterium tuberculosis
RCTGADTRRGPPPYV

SEQ ID NO: 1449149 - protein, 39 aa, Mycobacterium tuberculosis
RCTPRSPNHATTTGQSPRAPTPPTKPPASTAAEDPSPTL

SEQ ID NO: 1449150 - protein, 19 aa, Mycobacterium tuberculosis
RCTPTRRTRSIGLVPVTST

SEQ ID NO: 1449151 - protein, 16 aa, Mycobacterium tuberculosis
RDAASDTWQPPTPRRL

SEQ ID NO: 1449152 - protein, 11 aa, Mycobacterium tuberculosis
RDADAGELESW

SEQ ID NO: 1449153 - protein, 11 aa, Mycobacterium tuberculosis
RDADARQARNQ

SEQ ID NO: 1449154 - protein, 14 aa, Mycobacterium tuberculosis
RDARQDARHGRDRP

SEQ ID NO: 1449155 - protein, 4 aa, Mycobacterium tuberculosis
RDAV

SEQ ID NO: 1449156 - protein, 9 aa, Mycobacterium tuberculosis
RDDDRPRRV

SEQ ID NO: 1449157 - protein, 6 aa, Mycobacterium tuberculosis
RDDFGD

SEQ ID NO: 1449158 - protein, 17 aa, Mycobacterium tuberculosis
RDDNSEREQAKDDGSSA

SEQ ID NO: 1449159 - protein, 10 aa, Mycobacterium tuberculosis
RDDPGQRGHN

SEQ ID NO: 1449160 - protein, 25 aa, Mycobacterium tuberculosis
RDDRRGDPRRFRGEASRAENVDHPR

SEQ ID NO: 1449161 - protein, 5 aa, Mycobacterium tuberculosis
RDDSP

SEQ ID NO: 1449162 - protein, 4 aa, Mycobacterium tuberculosis
RDEA

SEQ ID NO: 1449163 - protein, 11 aa, Mycobacterium tuberculosis
RDEHDDATPDV

SEQ ID NO: 1449164 - protein, 12 aa, Mycobacterium tuberculosis
RDEHDDATPDVV

SEQ ID NO: 1449165 - protein, 47 aa, Mycobacterium tuberculosis
RDEKAPARRGGVAGRRPGRRRDRRAPAGRAANGAVRGSHGRAAQPWG

SEQ ID NO: 1449166 - protein, 7 aa, Mycobacterium tuberculosis
RDERAGV

SEQ ID NO: 1449167 - protein, 9 aa, Mycobacterium tuberculosis
RDERTDNAG

SEQ ID NO: 1449168 - protein, 12 aa, Mycobacterium tuberculosis
RDESDRHGDGPL

SEQ ID NO: 1449169 - protein, 34 aa, Mycobacterium tuberculosis
RDGDNGNAGSGATGGTGGNGGTGGDGGAAGLGGV

SEQ ID NO: 1449170 - protein, 5 aa, Mycobacterium tuberculosis
RDGIT

SEQ ID NO: 1449171 - protein, 4 aa, Mycobacterium tuberculosis
RDGN

SEQ ID NO: 1449172 - protein, 8 aa, Mycobacterium tuberculosis
RDGPHGAA

SEQ ID NO: 1449173 - protein, 14 aa, Mycobacterium tuberculosis
RDGPRRNPRDAASR

SEQ ID NO: 1449174 - protein, 11 aa, Mycobacterium tuberculosis
RDGRSTFRYPG

SEQ ID NO: 1449175 - protein, 19 aa, Mycobacterium tuberculosis
RDGRTREPWAGPRRRAGRL

SEQ ID NO: 1449176 - protein, 7 aa, Mycobacterium tuberculosis
RDGSADL

SEQ ID NO: 1449177 - protein, 8 aa, Mycobacterium tuberculosis
RDGWVGGK

SEQ ID NO: 1449178 - protein, 7 aa, Mycobacterium tuberculosis
RDHGPTV

SEQ ID NO: 1449179 - protein, 8 aa, Mycobacterium tuberculosis
RDHGRGQL

SEQ ID NO: 1449180 - protein, 16 aa, Mycobacterium tuberculosis
RDHQRREQCPVGRDDR

SEQ ID NO: 1449181 - protein, 62 aa, Mycobacterium tuberculosis
RDHRSRIGASNGARGHRRRQGCRRPRRHRDPAIAGGQHESRSRSNGRASDTDVPIVMRRRWG

SEQ ID NO: 1449182 - protein, 4 aa, Mycobacterium tuberculosis
RDHT

SEQ ID NO: 1449183 - protein, 12 aa, Mycobacterium tuberculosis
RDLDREDGDLGG

SEQ ID NO: 1449184 - protein, 14 aa, Mycobacterium tuberculosis
RDNSGLQRGNKAND

SEQ ID NO: 1449185 - protein, 11 aa, Mycobacterium tuberculosis
RDNTPSGSTVA

SEQ ID NO: 1449186 - protein, 13 aa, Mycobacterium tuberculosis
RDPAQGGGQFGGR

SEQ ID NO: 1449187 - protein, 21 aa, Mycobacterium tuberculosis
RDPAQHHRRAGARSAPGGQGM

SEQ ID NO: 1449188 - protein, 6 aa, Mycobacterium tuberculosis
RDPDDF

SEQ ID NO: 1449189 - protein, 14 aa, Mycobacterium tuberculosis
RDPEDVDDPDRHAA

SEQ ID NO: 1449190 - protein, 15 aa, Mycobacterium tuberculosis
RDPHAAGGPAWPGRT

SEQ ID NO: 1449191 - protein, 5 aa, Mycobacterium tuberculosis
RDPKG

SEQ ID NO: 1449192 - protein, 14 aa, Mycobacterium tuberculosis
RDPQLRDPQPQRRA

SEQ ID NO: 1449193 - protein, 34 aa, Mycobacterium tuberculosis
RDRAPREEKSNRHHDTTDSEDQQMPPTFGRTKEA

SEQ ID NO: 1449194 - protein, 7 aa, Mycobacterium tuberculosis
RDRGDGA

SEQ ID NO: 1449195 - protein, 23 aa, Mycobacterium tuberculosis
RDRGRTPGSGQPRRELAQPNRTL

SEQ ID NO: 1449196 - protein, 10 aa, Mycobacterium tuberculosis
RDRGTRRQPL

SEQ ID NO: 1449197 - protein, 28 aa, Mycobacterium tuberculosis
RDRGVDSTAARRSGARAHDSAPRHAARP

SEQ ID NO: 1449198 - protein, 10 aa, Mycobacterium tuberculosis
RDRPDRGPQC

SEQ ID NO: 1449199 - protein, 16 aa, Mycobacterium tuberculosis
RDRPGYLDKTTNGPGC

SEQ ID NO: 1449200 - protein, 9 aa, Mycobacterium tuberculosis
RDRQQGPDI

SEQ ID NO: 1449201 - protein, 9 aa, Mycobacterium tuberculosis
RDRRRPGRT

SEQ ID NO: 1449202 - protein, 4 aa, Mycobacterium tuberculosis
RDSR

SEQ ID NO: 1449203 - protein, 25 aa, Mycobacterium tuberculosis
RDSRAAASRHRDDQLPGCSGSYSRF

SEQ ID NO: 1449204 - protein, 9 aa, Mycobacterium tuberculosis
RDSRITPTE

SEQ ID NO: 1449205 - protein, 5 aa, Mycobacterium tuberculosis
RDSRQ

SEQ ID NO: 1449206 - protein, 10 aa, Mycobacterium tuberculosis
RDSTSTSSAC

SEQ ID NO: 1449207 - protein, 6 aa, Mycobacterium tuberculosis
RDTDGN

SEQ ID NO: 1449208 - protein, 5 aa, Mycobacterium tuberculosis
RDTED

SEQ ID NO: 1449209 - protein, 26 aa, Mycobacterium tuberculosis
RDTGGGVGHRQPGPAAVGGVGGGNHA

SEQ ID NO: 1449210 - protein, 12 aa, Mycobacterium tuberculosis
RDTGGSLGGGRR

SEQ ID NO: 1449211 - protein, 15 aa, Mycobacterium tuberculosis
RDTGPEAGAELPDGE

SEQ ID NO: 1449212 - protein, 14 aa, Mycobacterium tuberculosis
RDTGRDRRAAQVHP

SEQ ID NO: 1449213 - protein, 10 aa, Mycobacterium tuberculosis
RDTGSPRRVR

SEQ ID NO: 1449214 - protein, 14 aa, Mycobacterium tuberculosis
RDTNGDPVTGRGAK

SEQ ID NO: 1449215 - protein, 11 aa, Mycobacterium tuberculosis
RDTNTGAETTL

SEQ ID NO: 1449216 - protein, 9 aa, Mycobacterium tuberculosis
RDTTTTPGI

SEQ ID NO: 1449217 - protein, 48 aa, Mycobacterium tuberculosis
RDVASGADLSGRDPRSLQASAASGAAGAVRRPGVSREPDLRRRGHAAG

SEQ ID NO: 1449218 - protein, 4 aa, Mycobacterium tuberculosis
RDVK

SEQ ID NO: 1449219 - protein, 8 aa, Mycobacterium tuberculosis
RDVRDNQP

SEQ ID NO: 1449220 - protein, 9 aa, Mycobacterium tuberculosis
RDVSRSPGA

SEQ ID NO: 1449221 - protein, 11 aa, Mycobacterium tuberculosis
RDWGSPKIPEE

SEQ ID NO: 1449222 - protein, 5 aa, Mycobacterium tuberculosis
RDYPA

SEQ ID NO: 1449223 - protein, 9 aa, Mycobacterium tuberculosis
REAGERESR

SEQ ID NO: 1449224 - protein, 14 aa, Mycobacterium tuberculosis
REAPPPATDSTSPE

SEQ ID NO: 1449225 - protein, 10 aa, Mycobacterium tuberculosis
REARTAGRLQ

SEQ ID NO: 1449226 - protein, 30 aa, Mycobacterium tuberculosis
REASHDKSGGARGATVAERASGPGARARPC

SEQ ID NO: 1449227 - protein, 8 aa, Mycobacterium tuberculosis
REATAIDP

SEQ ID NO: 1449228 - protein, 4 aa, Mycobacterium tuberculosis
REDD

SEQ ID NO: 1449229 - protein, 10 aa, Mycobacterium tuberculosis
REDGAGELTD

SEQ ID NO: 1449230 - protein, 9 aa, Mycobacterium tuberculosis
REDPTRRAR

SEQ ID NO: 1449231 - protein, 13 aa, Mycobacterium tuberculosis
REDVERGQVSPSR

SEQ ID NO: 1449232 - protein, 12 aa, Mycobacterium tuberculosis
REEAGKTSPFEI

SEQ ID NO: 1449233 - protein, 4 aa, Mycobacterium tuberculosis
REEE

SEQ ID NO: 1449234 - protein, 29 aa, Mycobacterium tuberculosis
REGDAEAVDPLGQQQLDQSGAVGVSPSAV

SEQ ID NO: 1449235 - protein, 14 aa, Mycobacterium tuberculosis
REGIGDRRRQTGCD

SEQ ID NO: 1449236 - protein, 15 aa, Mycobacterium tuberculosis
REGREQIVQRRNTNG

SEQ ID NO: 1449237 - protein, 7 aa, Mycobacterium tuberculosis
REGRRPA

SEQ ID NO: 1449238 - protein, 8 aa, Mycobacterium tuberculosis
REGSYRDT

SEQ ID NO: 1449239 - protein, 5 aa, Mycobacterium tuberculosis
REHNL

SEQ ID NO: 1449240 - protein, 7 aa, Mycobacterium tuberculosis
REHQREY

SEQ ID NO: 1449241 - protein, 36 aa, Mycobacterium tuberculosis
REKSTPQKDSSSQRMPRGGSSRPSPAEWPTRAAPSA

SEQ ID NO: 1449242 - protein, 7 aa, Mycobacterium tuberculosis
RELAGDS

SEQ ID NO: 1449243 - protein, 26 aa, Mycobacterium tuberculosis
RELGQQQGVGAAEQKAARVGLANTGN

SEQ ID NO: 1449244 - protein, 9 aa, Mycobacterium tuberculosis
REPAEPVDD

SEQ ID NO: 1449245 - protein, 9 aa, Mycobacterium tuberculosis
REPGLRRTK

SEQ ID NO: 1449246 - protein, 9 aa, Mycobacterium tuberculosis
REPGLTDPR

SEQ ID NO: 1449247 - protein, 12 aa, Mycobacterium tuberculosis
REPNRRELRDGE

SEQ ID NO: 1449248 - protein, 14 aa, Mycobacterium tuberculosis
REPQNAAGGPGRDV

SEQ ID NO: 1449249 - protein, 23 aa, Mycobacterium tuberculosis
REPSRRGAARWRTQGAHQPRPRR

SEQ ID NO: 1449250 - protein, 4 aa, Mycobacterium tuberculosis
REPV

SEQ ID NO: 1449251 - protein, 13 aa, Mycobacterium tuberculosis
REQPLAGVSGASV

SEQ ID NO: 1449252 - protein, 13 aa, Mycobacterium tuberculosis
RERANSTQRGGHS

SEQ ID NO: 1449253 - protein, 9 aa, Mycobacterium tuberculosis
RERGRSQHR

SEQ ID NO: 1449254 - protein, 13 aa, Mycobacterium tuberculosis
RERRGMSTVAVRA

SEQ ID NO: 1449255 - protein, 4 aa, Mycobacterium tuberculosis
RETE

SEQ ID NO: 1449256 - protein, 38 aa, Mycobacterium tuberculosis
RETPAAAVAPETVGKAPSGGTGGAGGDGGAGGKGGSGG

SEQ ID NO: 1449257 - protein, 5 aa, Mycobacterium tuberculosis
REVGR

SEQ ID NO: 1449258 - protein, 9 aa, Mycobacterium tuberculosis
REVSDSARV

SEQ ID NO: 1449259 - protein, 10 aa, Mycobacterium tuberculosis
REVSGSDNLK

SEQ ID NO: 1449260 - protein, 5 aa, Mycobacterium tuberculosis
REYPG

SEQ ID NO: 1449261 - protein, 13 aa, Mycobacterium tuberculosis
RFGDEPTTQHRGL

SEQ ID NO: 1449262 - protein, 8 aa, Mycobacterium tuberculosis
RFGSSRPW

SEQ ID NO: 1449263 - protein, 10 aa, Mycobacterium tuberculosis
RGAAAEPGQC

SEQ ID NO: 1449264 - protein, 5 aa, Mycobacterium tuberculosis
RGAAV

SEQ ID NO: 1449265 - protein, 19 aa, Mycobacterium tuberculosis
RGADAGAEIARRSRGTPRI

SEQ ID NO: 1449266 - protein, 25 aa, Mycobacterium tuberculosis
RGADAGSSGQRIGSRRTPGLVVAVW

SEQ ID NO: 1449267 - protein, 10 aa, Mycobacterium tuberculosis
RGADGGNRHL

SEQ ID NO: 1449268 - protein, 23 aa, Mycobacterium tuberculosis
RGADGLRTAGERAVRSPAAVVAL

SEQ ID NO: 1449269 - protein, 7 aa, Mycobacterium tuberculosis
RGAGDFS

SEQ ID NO: 1449270 - protein, 14 aa, Mycobacterium tuberculosis
RGAGDYRGGATDLA

SEQ ID NO: 1449271 - protein, 44 aa, Mycobacterium tuberculosis
RGAGGAGGAGGTCGEGGTGGDGKTTDGNPGMGGSPGSAGQPGQP

SEQ ID NO: 1449272 - protein, 28 aa, Mycobacterium tuberculosis
RGAGHAAAGGAAGARRCPRPRAQTRQRR

SEQ ID NO: 1449273 - protein, 8 aa, Mycobacterium tuberculosis
RGAGRGPR

SEQ ID NO: 1449274 - protein, 20 aa, Mycobacterium tuberculosis
RGAQKQADEIRRARETKSVR

SEQ ID NO: 1449275 - protein, 13 aa, Mycobacterium tuberculosis
RGASADRGLGSAG

SEQ ID NO: 1449276 - protein, 10 aa, Mycobacterium tuberculosis
RGASPGGDLA

SEQ ID NO: 1449277 - protein, 19 aa, Mycobacterium tuberculosis
RGASPRPAAAPTSRATATS

SEQ ID NO: 1449278 - protein, 24 aa, Mycobacterium tuberculosis
RGATAPRPADAASPSCGSSPSADS

SEQ ID NO: 1449279 - protein, 32 aa, Mycobacterium tuberculosis
RGATAPRPADAASPSCGSSPSADSVSDALFRR

SEQ ID NO: 1449280 - protein, 7 aa, Mycobacterium tuberculosis
RGATGEP

SEQ ID NO: 1449281 - protein, 6 aa, Mycobacterium tuberculosis
RGATYG

SEQ ID NO: 1449282 - protein, 36 aa, Mycobacterium tuberculosis
RGCAPSRSTSTPAAQHRAGAEGPDPAGRGETAAGSR

SEQ ID NO: 1449283 - protein, 14 aa, Mycobacterium tuberculosis
RGCGPRGVAAARDG

SEQ ID NO: 1449284 - protein, 23 aa, Mycobacterium tuberculosis
RGCRRRSSIGSARRLGPKTEAAA

SEQ ID NO: 1449285 - protein, 12 aa, Mycobacterium tuberculosis
RGCSPATRSRRR

SEQ ID NO: 1449286 - protein, 7 aa, Mycobacterium tuberculosis
RGDCPDD

SEQ ID NO: 1449287 - protein, 10 aa, Mycobacterium tuberculosis
RGDGGGEYRF

SEQ ID NO: 1449288 - protein, 5 aa, Mycobacterium tuberculosis
RGDGR

SEQ ID NO: 1449289 - protein, 14 aa, Mycobacterium tuberculosis
RGDLGNHRPLRREA

SEQ ID NO: 1449290 - protein, 8 aa, Mycobacterium tuberculosis
RGDRRHGR

SEQ ID NO: 1449291 - protein, 4 aa, Mycobacterium tuberculosis
RGEF

SEQ ID NO: 1449292 - protein, 39 aa, Mycobacterium tuberculosis
RGEGQTNQAPQAGQTGDRRPSPGQRSGLPPAPRPNSQSD

SEQ ID NO: 1449293 - protein, 16 aa, Mycobacterium tuberculosis
RGEPGRRQDRHVIGSR

SEQ ID NO: 1449294 - protein, 5 aa, Mycobacterium tuberculosis
RGEPP

SEQ ID NO: 1449295 - protein, 11 aa, Mycobacterium tuberculosis
RGERKRPSNGW

SEQ ID NO: 1449296 - protein, 6 aa, Mycobacterium tuberculosis
RGFAPS

SEQ ID NO: 1449297 - protein, 27 aa, Mycobacterium tuberculosis
RGGAGGDGASGGGGRQPRRIRAAGDDE

SEQ ID NO: 1449298 - protein, 51 aa, Mycobacterium tuberculosis
RGGAGGLGFGSEAPGRPGGAGGTGGAGGNGGTQAGDGGTGGAGGAGGDGGS

SEQ ID NO: 1449299 - protein, 58 aa, Mycobacterium tuberculosis
RGGAGGLGFGSEAPGRPGGAGGTGGAGGNGGTQAGDGGTGGAGGAGGDGGSGGAGSIG

SEQ ID NO: 1449300 - protein, 10 aa, Mycobacterium tuberculosis
RGGDGTCRGR

SEQ ID NO: 1449301 - protein, 8 aa, Mycobacterium tuberculosis
RGGDHQPL

SEQ ID NO: 1449302 - protein, 7 aa, Mycobacterium tuberculosis
RGGDNRA

SEQ ID NO: 1449303 - protein, 12 aa, Mycobacterium tuberculosis
RGGERDSRTRTS

SEQ ID NO: 1449304 - protein, 8 aa, Mycobacterium tuberculosis
RGGGDVTE

SEQ ID NO: 1449305 - protein, 21 aa, Mycobacterium tuberculosis
RGGGEQSQKPPKPVGFGGWYV

SEQ ID NO: 1449306 - protein, 20 aa, Mycobacterium tuberculosis
RGGGGSSTTPRGTSSPPTLR

SEQ ID NO: 1449307 - protein, 11 aa, Mycobacterium tuberculosis
RGGGQFGPRSA

SEQ ID NO: 1449308 - protein, 17 aa, Mycobacterium tuberculosis
RGGGRGGRPDRRRPAGI

SEQ ID NO: 1449309 - protein, 26 aa, Mycobacterium tuberculosis
RGGGRRRSSAVARGGGCTAAPHRTLS

SEQ ID NO: 1449310 - protein, 16 aa, Mycobacterium tuberculosis
RGGPAPGCTAPNRLAS

SEQ ID NO: 1449311 - protein, 7 aa, Mycobacterium tuberculosis
RGGPGRR

SEQ ID NO: 1449312 - protein, 6 aa, Mycobacterium tuberculosis
RGGPYL

SEQ ID NO: 1449313 - protein, 6 aa, Mycobacterium tuberculosis
RGGSGR

SEQ ID NO: 1449314 - protein, 11 aa, Mycobacterium tuberculosis
RGGSSRSTAAR

SEQ ID NO: 1449315 - protein, 4 aa, Mycobacterium tuberculosis
RGGV

SEQ ID NO: 1449316 - protein, 5 aa, Mycobacterium tuberculosis
RGGVD

SEQ ID NO: 1449317 - protein, 6 aa, Mycobacterium tuberculosis
RGGVRG

SEQ ID NO: 1449318 - protein, 26 aa, Mycobacterium tuberculosis
RGGWPAPFTAAPDAGAPSVPRDPRRR

SEQ ID NO: 1449319 - protein, 4 aa, Mycobacterium tuberculosis
RGGY

SEQ ID NO: 1449320 - protein, 8 aa, Mycobacterium tuberculosis
RGGYYTPP

SEQ ID NO: 1449321 - protein, 39 aa, Mycobacterium tuberculosis
RGHGPAARRRWRGGSGGAAGQLHRGGSRPAGRTTGPLRT

SEQ ID NO: 1449322 - protein, 12 aa, Mycobacterium tuberculosis
RGHHGQSRPRPV

SEQ ID NO: 1449323 - protein, 5 aa, Mycobacterium tuberculosis
RGHRR

SEQ ID NO: 1449324 - protein, 6 aa, Mycobacterium tuberculosis
RGHRRR

SEQ ID NO: 1449325 - protein, 17 aa, Mycobacterium tuberculosis
RGHRRRAGRSPGGRDDP

SEQ ID NO: 1449326 - protein, 6 aa, Mycobacterium tuberculosis
RGIDDG

SEQ ID NO: 1449327 - protein, 16 aa, Mycobacterium tuberculosis
RGIPRPAATGSTRWPS

SEQ ID NO: 1449328 - protein, 4 aa, Mycobacterium tuberculosis
RGIS

SEQ ID NO: 1449329 - protein, 12 aa, Mycobacterium tuberculosis
RGISRRRTEVAT

SEQ ID NO: 1449330 - protein, 13 aa, Mycobacterium tuberculosis
RGISRRRTEVATQ

SEQ ID NO: 1449331 - protein, 7 aa, Mycobacterium tuberculosis
RGKSTID

SEQ ID NO: 1449332 - protein, 13 aa, Mycobacterium tuberculosis
RGLAAGNAATMPT

SEQ ID NO: 1449333 - protein, 6 aa, Mycobacterium tuberculosis
RGLASG

SEQ ID NO: 1449334 - protein, 14 aa, Mycobacterium tuberculosis
RGLDRGGRSPPRRT

SEQ ID NO: 1449335 - protein, 15 aa, Mycobacterium tuberculosis
RGLGGDDRAARGRPR

SEQ ID NO: 1449336 - protein, 26 aa, Mycobacterium tuberculosis
RGLRPDPLPPRHRGAEEVGGPSRRTR

SEQ ID NO: 1449337 - protein, 13 aa, Mycobacterium tuberculosis
RGNDQVEITERDG

SEQ ID NO: 1449338 - protein, 8 aa, Mycobacterium tuberculosis
RGNSCPPA

SEQ ID NO: 1449339 - protein, 6 aa, Mycobacterium tuberculosis
RGPAEA

SEQ ID NO: 1449340 - protein, 6 aa, Mycobacterium tuberculosis
RGPAPI

SEQ ID NO: 1449341 - protein, 6 aa, Mycobacterium tuberculosis
RGPART

SEQ ID NO: 1449342 - protein, 9 aa, Mycobacterium tuberculosis
RGPCSTPAV

SEQ ID NO: 1449343 - protein, 13 aa, Mycobacterium tuberculosis
RGPDDTGVEIGRA

SEQ ID NO: 1449344 - protein, 11 aa, Mycobacterium tuberculosis
RGPEGADPASV

SEQ ID NO: 1449345 - protein, 15 aa, Mycobacterium tuberculosis
RGPFARQGFGYEADL

SEQ ID NO: 1449346 - protein, 26 aa, Mycobacterium tuberculosis
RGPHPTDSQWRSAGNRPCPTKSAIPN

SEQ ID NO: 1449347 - protein, 5 aa, Mycobacterium tuberculosis
RGPIG

SEQ ID NO: 1449348 - protein, 5 aa, Mycobacterium tuberculosis
RGPLR

SEQ ID NO: 1449349 - protein, 9 aa, Mycobacterium tuberculosis
RGPNGQDVI

SEQ ID NO: 1449350 - protein, 14 aa, Mycobacterium tuberculosis
RGPQPVCGGPGQVG

SEQ ID NO: 1449351 - protein, 5 aa, Mycobacterium tuberculosis
RGPRA

SEQ ID NO: 1449352 - protein, 7 aa, Mycobacterium tuberculosis
RGPRGGK

SEQ ID NO: 1449353 - protein, 10 aa, Mycobacterium tuberculosis
RGPRRATGAA

SEQ ID NO: 1449354 - protein, 11 aa, Mycobacterium tuberculosis
RGPSDDPGDGD

SEQ ID NO: 1449355 - protein, 16 aa, Mycobacterium tuberculosis
RGPTLDARSSSKTSGW

SEQ ID NO: 1449356 - protein, 16 aa, Mycobacterium tuberculosis
RGQEAAQVGAAAAYAK

SEQ ID NO: 1449357 - protein, 5 aa, Mycobacterium tuberculosis
RGQPI

SEQ ID NO: 1449358 - protein, 11 aa, Mycobacterium tuberculosis
RGQPSRLPPQR

SEQ ID NO: 1449359 - protein, 11 aa, Mycobacterium tuberculosis
RGQSHRGGPRY

SEQ ID NO: 1449360 - protein, 17 aa, Mycobacterium tuberculosis
RGQTGDRRRQATHPAAV

SEQ ID NO: 1449361 - protein, 11 aa, Mycobacterium tuberculosis
RGRARSVAQPR

SEQ ID NO: 1449362 - protein, 14 aa, Mycobacterium tuberculosis
RGRDDRTFQSRRRT

SEQ ID NO: 1449363 - protein, 16 aa, Mycobacterium tuberculosis
RGRDRRRLDPETEARS

SEQ ID NO: 1449364 - protein, 7 aa, Mycobacterium tuberculosis
RGRGQQA

SEQ ID NO: 1449365 - protein, 8 aa, Mycobacterium tuberculosis
RGRHRRRR

SEQ ID NO: 1449366 - protein, 12 aa, Mycobacterium tuberculosis
RGRHRTQPPRIR

SEQ ID NO: 1449367 - protein, 6 aa, Mycobacterium tuberculosis
RGRHRV

SEQ ID NO: 1449368 - protein, 23 aa, Mycobacterium tuberculosis
RGRIDKSTAELADERSAVTEIGL

SEQ ID NO: 1449369 - protein, 13 aa, Mycobacterium tuberculosis
RGRIDRQSPGVGG

SEQ ID NO: 1449370 - protein, 12 aa, Mycobacterium tuberculosis
RGRKPGLEVVVG

SEQ ID NO: 1449371 - protein, 9 aa, Mycobacterium tuberculosis
RGRPADRPA

SEQ ID NO: 1449372 - protein, 21 aa, Mycobacterium tuberculosis
RGRPAKRYRADRGRPGQARPL

SEQ ID NO: 1449373 - protein, 6 aa, Mycobacterium tuberculosis
RGRPGI

SEQ ID NO: 1449374 - protein, 5 aa, Mycobacterium tuberculosis
RGRPL

SEQ ID NO: 1449375 - protein, 39 aa, Mycobacterium tuberculosis
RGRPVKSVGPAARPGCSATAGPAGPAGPALPAVSADPAG

SEQ ID NO: 1449376 - protein, 6 aa, Mycobacterium tuberculosis
RGRPVT

SEQ ID NO: 1449377 - protein, 8 aa, Mycobacterium tuberculosis
RGRQPGCG

SEQ ID NO: 1449378 - protein, 43 aa, Mycobacterium tuberculosis
RGRRDGSGAAQAHRSLPGAGRPDRRGARAAAARTGRRPDHRRH

SEQ ID NO: 1449379 - protein, 9 aa, Mycobacterium tuberculosis
RGRRDRRRA

SEQ ID NO: 1449380 - protein, 13 aa, Mycobacterium tuberculosis
RGRRGDFGGLKGK

SEQ ID NO: 1449381 - protein, 7 aa, Mycobacterium tuberculosis
RGRRGRR

SEQ ID NO: 1449382 - protein, 9 aa, Mycobacterium tuberculosis
RGRRGRRRR

SEQ ID NO: 1449383 - protein, 9 aa, Mycobacterium tuberculosis
RGRRNRRCP

SEQ ID NO: 1449384 - protein, 9 aa, Mycobacterium tuberculosis
RGRRPGPSC

SEQ ID NO: 1449385 - protein, 25 aa, Mycobacterium tuberculosis
RGRRPPSGSPDERCADPGSKGGSRR

SEQ ID NO: 1449386 - protein, 248 aa, Mycobacterium tuberculosis
RGRRQRRQTGDAGTNASDSGAVGGKGNSGGNGGQGGAGGDGGTLAGNGGAGGTGGRGADGGLGGSGAEGANATTAGERGQDGGKGGNGGVGGTGGNAVAPGANGGHGGNGGNPGFSGAGGLGGLSGDGVTRAAQGATPDFADTGGKGGNGGNGANAVAPGGTGASGGAGGNAGAGGKGGENIIGDGGGGGNGGAGGQGGDGTAGAGGDGGAGGKGGDGGDGGSDPTEGRGFGGLGGAGGAGGKGGAGT

SEQ ID NO: 1449387 - protein, 6 aa, Mycobacterium tuberculosis
RGRRRA

SEQ ID NO: 1449388 - protein, 7 aa, Mycobacterium tuberculosis
RGRRRGL

SEQ ID NO: 1449389 - protein, 11 aa, Mycobacterium tuberculosis
RGRRRRQPRQQ

SEQ ID NO: 1449390 - protein, 12 aa, Mycobacterium tuberculosis
RGRRVRGARPGR

SEQ ID NO: 1449391 - protein, 5 aa, Mycobacterium tuberculosis
RGRSL

SEQ ID NO: 1449392 - protein, 6 aa, Mycobacterium tuberculosis
RGRSRS

SEQ ID NO: 1449393 - protein, 10 aa, Mycobacterium tuberculosis
RGRSTGVDPA

SEQ ID NO: 1449394 - protein, 8 aa, Mycobacterium tuberculosis
RGSAGPHL

SEQ ID NO: 1449395 - protein, 15 aa, Mycobacterium tuberculosis
RGSAHGDGPPTRGRV

SEQ ID NO: 1449396 - protein, 19 aa, Mycobacterium tuberculosis
RGSASARGPNQRRPSSPMT

SEQ ID NO: 1449397 - protein, 7 aa, Mycobacterium tuberculosis
RGSDGQW

SEQ ID NO: 1449398 - protein, 8 aa, Mycobacterium tuberculosis
RGSEARDH

SEQ ID NO: 1449399 - protein, 18 aa, Mycobacterium tuberculosis
RGSGVASGRSVGAVAGQD

SEQ ID NO: 1449400 - protein, 7 aa, Mycobacterium tuberculosis
RGSMRSK

SEQ ID NO: 1449401 - protein, 14 aa, Mycobacterium tuberculosis
RGSMRSKIPDRQRA

SEQ ID NO: 1449402 - protein, 6 aa, Mycobacterium tuberculosis
RGSPIS

SEQ ID NO: 1449403 - protein, 6 aa, Mycobacterium tuberculosis
RGSQPL

SEQ ID NO: 1449404 - protein, 8 aa, Mycobacterium tuberculosis
RGSRDWPA

SEQ ID NO: 1449405 - protein, 11 aa, Mycobacterium tuberculosis
RGSRGSALRTR

SEQ ID NO: 1449406 - protein, 8 aa, Mycobacterium tuberculosis
RGSRMEAS

SEQ ID NO: 1449407 - protein, 15 aa, Mycobacterium tuberculosis
RGSTAAGRPAAARRT

SEQ ID NO: 1449408 - protein, 13 aa, Mycobacterium tuberculosis
RGSTATSSSETIT

SEQ ID NO: 1449409 - protein, 7 aa, Mycobacterium tuberculosis
RGSTRET

SEQ ID NO: 1449410 - protein, 11 aa, Mycobacterium tuberculosis
RGTAAPIPGTE

SEQ ID NO: 1449411 - protein, 36 aa, Mycobacterium tuberculosis
RGTAETVNRTPRPRSVAPTRVATKGVTSRLRAVRLT

SEQ ID NO: 1449412 - protein, 4 aa, Mycobacterium tuberculosis
RGTE

SEQ ID NO: 1449413 - protein, 15 aa, Mycobacterium tuberculosis
RGTEAGRDVARGQCA

SEQ ID NO: 1449414 - protein, 25 aa, Mycobacterium tuberculosis
RGTGPASRSTRSRRSCARSRTPATR

SEQ ID NO: 1449415 - protein, 12 aa, Mycobacterium tuberculosis
RGTPRDRQRHCR

SEQ ID NO: 1449416 - protein, 11 aa, Mycobacterium tuberculosis
RGTVNPDVETH

SEQ ID NO: 1449417 - protein, 6 aa, Mycobacterium tuberculosis
RGVADG

SEQ ID NO: 1449418 - protein, 4 aa, Mycobacterium tuberculosis
RGVD

SEQ ID NO: 1449419 - protein, 12 aa, Mycobacterium tuberculosis
RGVGGPQRRPDV

SEQ ID NO: 1449420 - protein, 4 aa, Mycobacterium tuberculosis
RGVK

SEQ ID NO: 1449421 - protein, 48 aa, Mycobacterium tuberculosis
RGVRPDRQRAARRGPSGGPGKAPLKPEETQSTWGAPVKGTTPPASVRG

SEQ ID NO: 1449422 - protein, 13 aa, Mycobacterium tuberculosis
RGVTAQEAAAMRI

SEQ ID NO: 1449423 - protein, 8 aa, Mycobacterium tuberculosis
RGVTTGDQ

SEQ ID NO: 1449424 - protein, 8 aa, Mycobacterium tuberculosis
RGWGQRDE

SEQ ID NO: 1449425 - protein, 11 aa, Mycobacterium tuberculosis
RGWPGSPPPWP

SEQ ID NO: 1449426 - protein, 53 aa, Mycobacterium tuberculosis
RGWPGSPPPWPTTPNINGSSQRRRTRPDDAATAPDPSRRAGPPHQRRTRPQRR

SEQ ID NO: 1449427 - protein, 17 aa, Mycobacterium tuberculosis
RGWPPGLSGATPWSPQQ

SEQ ID NO: 1449428 - protein, 12 aa, Mycobacterium tuberculosis
RGYQPDPQDRRQ

SEQ ID NO: 1449429 - protein, 60 aa, Mycobacterium tuberculosis
RHAGAQAGRRRPPRRRRDPGRDRRQRGQPRRPVQRPDRTQPGRAGRRAAPGLQGRRHRSA

SEQ ID NO: 1449430 - protein, 12 aa, Mycobacterium tuberculosis
RHAGPARAADAG

SEQ ID NO: 1449431 - protein, 12 aa, Mycobacterium tuberculosis
RHAGPATGADAG

SEQ ID NO: 1449432 - protein, 12 aa, Mycobacterium tuberculosis
RHATPDGHGVGE

SEQ ID NO: 1449433 - protein, 6 aa, Mycobacterium tuberculosis
RHEQTA

SEQ ID NO: 1449434 - protein, 8 aa, Mycobacterium tuberculosis
RHGGEPVG

SEQ ID NO: 1449435 - protein, 5 aa, Mycobacterium tuberculosis
RHGGT

SEQ ID NO: 1449436 - protein, 4 aa, Mycobacterium tuberculosis
RHGR

SEQ ID NO: 1449437 - protein, 13 aa, Mycobacterium tuberculosis
RHGTDQRQQRPTS

SEQ ID NO: 1449438 - protein, 17 aa, Mycobacterium tuberculosis
RHPADRPATAADVGEEL

SEQ ID NO: 1449439 - protein, 44 aa, Mycobacterium tuberculosis
RHPATHGRCDPHDQARPTTTPPQAGGTPRRSSTTAHPWRCITPN

SEQ ID NO: 1449440 - protein, 34 aa, Mycobacterium tuberculosis
RHPDRDRGRHPRRRELGPGTRDAGPPRHRGGQRA

SEQ ID NO: 1449441 - protein, 16 aa, Mycobacterium tuberculosis
RHPGDLRSEPHYRPSA

SEQ ID NO: 1449442 - protein, 7 aa, Mycobacterium tuberculosis
RHPGGAS

SEQ ID NO: 1449443 - protein, 9 aa, Mycobacterium tuberculosis
RHPGHTRYR

SEQ ID NO: 1449444 - protein, 9 aa, Mycobacterium tuberculosis
RHPGPAEAI

SEQ ID NO: 1449445 - protein, 6 aa, Mycobacterium tuberculosis
RHPGTS

SEQ ID NO: 1449446 - protein, 16 aa, Mycobacterium tuberculosis
RHPQTRAVGDERREEL

SEQ ID NO: 1449447 - protein, 15 aa, Mycobacterium tuberculosis
RHPRPSTGRRCPPAR

SEQ ID NO: 1449448 - protein, 6 aa, Mycobacterium tuberculosis
RHPTQA

SEQ ID NO: 1449449 - protein, 5 aa, Mycobacterium tuberculosis
RHQAG

SEQ ID NO: 1449450 - protein, 15 aa, Mycobacterium tuberculosis
RHQHPDYPYSSDSRL

SEQ ID NO: 1449451 - protein, 38 aa, Mycobacterium tuberculosis
RHQPQAQGGGLTDAGDDSDHQSGRSQRSQQRAGDRTGP

SEQ ID NO: 1449452 - protein, 5 aa, Mycobacterium tuberculosis
RHQPR

SEQ ID NO: 1449453 - protein, 20 aa, Mycobacterium tuberculosis
RHQRTCDSGRGTGSGTGWRG

SEQ ID NO: 1449454 - protein, 18 aa, Mycobacterium tuberculosis
RHRGDGADAQRLSRAARA

SEQ ID NO: 1449455 - protein, 15 aa, Mycobacterium tuberculosis
RHRGDPQGRRRDPEV

SEQ ID NO: 1449456 - protein, 10 aa, Mycobacterium tuberculosis
RHRGGAAAGG

SEQ ID NO: 1449457 - protein, 6 aa, Mycobacterium tuberculosis
RHRPDQ

SEQ ID NO: 1449458 - protein, 21 aa, Mycobacterium tuberculosis
RHRPDSAGPGGFGGTRGVPGL

SEQ ID NO: 1449459 - protein, 24 aa, Mycobacterium tuberculosis
RHRPPGGWRPPRAPRAETVRSRHR

SEQ ID NO: 1449460 - protein, 15 aa, Mycobacterium tuberculosis
RHRPRRPLPPPPTTH

SEQ ID NO: 1449461 - protein, 25 aa, Mycobacterium tuberculosis
RHRPTPGPDRRGAHQSDSRPFSPTC

SEQ ID NO: 1449462 - protein, 14 aa, Mycobacterium tuberculosis
RHRRELENALAVLR

SEQ ID NO: 1449463 - protein, 18 aa, Mycobacterium tuberculosis
RHRRGRRGRRQVRSVRSR

SEQ ID NO: 1449464 - protein, 15 aa, Mycobacterium tuberculosis
RHRRQKPAPAGDRRR

SEQ ID NO: 1449465 - protein, 28 aa, Mycobacterium tuberculosis
RHSGQGRQDNDGQLPGAAGAVPGPGGFR

SEQ ID NO: 1449466 - protein, 6 aa, Mycobacterium tuberculosis
RHSPGF

SEQ ID NO: 1449467 - protein, 10 aa, Mycobacterium tuberculosis
RHSRRGQTAV

SEQ ID NO: 1449468 - protein, 8 aa, Mycobacterium tuberculosis
RHTPSTSL

SEQ ID NO: 1449469 - protein, 6 aa, Mycobacterium tuberculosis
RHTSGT

SEQ ID NO: 1449470 - protein, 17 aa, Mycobacterium tuberculosis
RIAAETAPVHGEERRAE

SEQ ID NO: 1449471 - protein, 15 aa, Mycobacterium tuberculosis
RIAAPGGAGFAAGQQ

SEQ ID NO: 1449472 - protein, 16 aa, Mycobacterium tuberculosis
RIAGSPKNGEQVPPAC

SEQ ID NO: 1449473 - protein, 27 aa, Mycobacterium tuberculosis
RIAPPRPSACDSASARHRKVSTNEGSL

SEQ ID NO: 1449474 - protein, 8 aa, Mycobacterium tuberculosis
RIASKSSA

SEQ ID NO: 1449475 - protein, 7 aa, Mycobacterium tuberculosis
RIDRSQP

SEQ ID NO: 1449476 - protein, 9 aa, Mycobacterium tuberculosis
RIESDTGSV

SEQ ID NO: 1449477 - protein, 19 aa, Mycobacterium tuberculosis
RIGGSGARHRPVSGLAWSP

SEQ ID NO: 1449478 - protein, 7 aa, Mycobacterium tuberculosis
RIGNAHN

SEQ ID NO: 1449479 - protein, 10 aa, Mycobacterium tuberculosis
RIGPERVGRP

SEQ ID NO: 1449480 - protein, 13 aa, Mycobacterium tuberculosis
RIGTGSQGASRVA

SEQ ID NO: 1449481 - protein, 5 aa, Mycobacterium tuberculosis
RIPET

SEQ ID NO: 1449482 - protein, 64 aa, Mycobacterium tuberculosis
RIPGGRGFGGVGGRRRDRPIGAGRGRPPVPDRRRGGCARADHGSRSRGLTPASRPPLAESSRNL

SEQ ID NO: 1449483 - protein, 6 aa, Mycobacterium tuberculosis
RIPGNG

SEQ ID NO: 1449484 - protein, 19 aa, Mycobacterium tuberculosis
RIPPAPPDPPSPPSAPVAP

SEQ ID NO: 1449485 - protein, 5 aa, Mycobacterium tuberculosis
RIPRQ

SEQ ID NO: 1449486 - protein, 10 aa, Mycobacterium tuberculosis
RISGTSSETR

SEQ ID NO: 1449487 - protein, 5 aa, Mycobacterium tuberculosis
RITGS

SEQ ID NO: 1449488 - protein, 7 aa, Mycobacterium tuberculosis
RITPPRA

SEQ ID NO: 1449489 - protein, 7 aa, Mycobacterium tuberculosis
RKAAAGS

SEQ ID NO: 1449490 - protein, 15 aa, Mycobacterium tuberculosis
RKAAPTRTPESYVQN

SEQ ID NO: 1449491 - protein, 15 aa, Mycobacterium tuberculosis
RKAATTRTPESYVQN

SEQ ID NO: 1449492 - protein, 15 aa, Mycobacterium tuberculosis
RKAPPSSPAGSGSGW

SEQ ID NO: 1449493 - protein, 41 aa, Mycobacterium tuberculosis
RKAVGTGVRKKTPEPDSAEAPAAAAAPEEQVQPQRRRRPKI

SEQ ID NO: 1449494 - protein, 5 aa, Mycobacterium tuberculosis
RKERV

SEQ ID NO: 1449495 - protein, 6 aa, Mycobacterium tuberculosis
RKEYRA

SEQ ID NO: 1449496 - protein, 9 aa, Mycobacterium tuberculosis
RKGDADAYS

SEQ ID NO: 1449497 - protein, 4 aa, Mycobacterium tuberculosis
RKGF

SEQ ID NO: 1449498 - protein, 10 aa, Mycobacterium tuberculosis
RKHAAGPHDA

SEQ ID NO: 1449499 - protein, 4 aa, Mycobacterium tuberculosis
RKNK

SEQ ID NO: 1449500 - protein, 10 aa, Mycobacterium tuberculosis
RKNTKGDTEW

SEQ ID NO: 1449501 - protein, 4 aa, Mycobacterium tuberculosis
RKPA

SEQ ID NO: 1449502 - protein, 12 aa, Mycobacterium tuberculosis
RKPGETGGTFSA

SEQ ID NO: 1449503 - protein, 13 aa, Mycobacterium tuberculosis
RKPKDLSGGQRQR

SEQ ID NO: 1449504 - protein, 11 aa, Mycobacterium tuberculosis
RKPKPRKRGAH

SEQ ID NO: 1449505 - protein, 14 aa, Mycobacterium tuberculosis
RKQGKARGDTTGAH

SEQ ID NO: 1449506 - protein, 9 aa, Mycobacterium tuberculosis
RKQSGRLDR

SEQ ID NO: 1449507 - protein, 12 aa, Mycobacterium tuberculosis
RKRAERALTSVV

SEQ ID NO: 1449508 - protein, 8 aa, Mycobacterium tuberculosis
RKRDPMAA

SEQ ID NO: 1449509 - protein, 4 aa, Mycobacterium tuberculosis
RKRG

SEQ ID NO: 1449510 - protein, 4 aa, Mycobacterium tuberculosis
RKRP

SEQ ID NO: 1449511 - protein, 19 aa, Mycobacterium tuberculosis
RKSDREALTRAGSEPPSDD

SEQ ID NO: 1449512 - protein, 33 aa, Mycobacterium tuberculosis
RKSNPPGPGRLAPGPPLAPSPIRGQPQTTPGGA

SEQ ID NO: 1449513 - protein, 8 aa, Mycobacterium tuberculosis
RKSPGKGL

SEQ ID NO: 1449514 - protein, 12 aa, Mycobacterium tuberculosis
RKSVRRGATDEV

SEQ ID NO: 1449515 - protein, 10 aa, Mycobacterium tuberculosis
RKTAAESNIP

SEQ ID NO: 1449516 - protein, 6 aa, Mycobacterium tuberculosis
RKTDIS

SEQ ID NO: 1449517 - protein, 16 aa, Mycobacterium tuberculosis
RKTGRGGARQSPQSRV

SEQ ID NO: 1449518 - protein, 31 aa, Mycobacterium tuberculosis
RKTSASEIEATPTSASGISATETSALGTPAI

SEQ ID NO: 1449519 - protein, 12 aa, Mycobacterium tuberculosis
RLAATSPQVGRD

SEQ ID NO: 1449520 - protein, 15 aa, Mycobacterium tuberculosis
RLADPGGAAEHAGAD

SEQ ID NO: 1449521 - protein, 11 aa, Mycobacterium tuberculosis
RLAGPAGPAGC

SEQ ID NO: 1449522 - protein, 10 aa, Mycobacterium tuberculosis
RLAPGGASAL

SEQ ID NO: 1449523 - protein, 5 aa, Mycobacterium tuberculosis
RLAQR

SEQ ID NO: 1449524 - protein, 22 aa, Mycobacterium tuberculosis
RLASGSPLARKTPSAGPNAASI

SEQ ID NO: 1449525 - protein, 6 aa, Mycobacterium tuberculosis
RLATSS

SEQ ID NO: 1449526 - protein, 6 aa, Mycobacterium tuberculosis
RLDPDN

SEQ ID NO: 1449527 - protein, 5 aa, Mycobacterium tuberculosis
RLDQG

SEQ ID NO: 1449528 - protein, 22 aa, Mycobacterium tuberculosis
RLDTHRTQKLRSQTNGGKDRHQ

SEQ ID NO: 1449529 - protein, 8 aa, Mycobacterium tuberculosis
RLEEGIER

SEQ ID NO: 1449530 - protein, 44 aa, Mycobacterium tuberculosis
RLEPTTPHLEPPATPPRPGPQPPRIEPPESGHPAPAPAAKPAPV

SEQ ID NO: 1449531 - protein, 99 aa, Mycobacterium tuberculosis
RLEPTTPHLEPPATPPRPGPQPPRIEPPESGHPAPAPAAKPAPVPAAKPAPVPANGPLPHSPTESKPPPVDRPAEPVAPSSASAGQPRVSAATTPGTHV

SEQ ID NO: 1449532 - protein, 65 aa, Mycobacterium tuberculosis
RLEPTTPHLEPPATPPRPGPQPPRIEPPESGHPAPAPAAKPGARARQRSTAAQPHRIQTAARRQT

SEQ ID NO: 1449533 - protein, 7 aa, Mycobacterium tuberculosis
RLGAPRY

SEQ ID NO: 1449534 - protein, 12 aa, Mycobacterium tuberculosis
RLGARTTGYDVR

SEQ ID NO: 1449535 - protein, 12 aa, Mycobacterium tuberculosis
RLGGSDEADHDR

SEQ ID NO: 1449536 - protein, 9 aa, Mycobacterium tuberculosis
RLGPTDALP

SEQ ID NO: 1449537 - protein, 34 aa, Mycobacterium tuberculosis
RLGQQPGQPLRADQRTTGAAGTGAARGRAGPPVA

SEQ ID NO: 1449538 - protein, 4 aa, Mycobacterium tuberculosis
RLGR

SEQ ID NO: 1449539 - protein, 15 aa, Mycobacterium tuberculosis
RLGSASRVPARRGDP

SEQ ID NO: 1449540 - protein, 6 aa, Mycobacterium tuberculosis
RLGSGR

SEQ ID NO: 1449541 - protein, 7 aa, Mycobacterium tuberculosis
RLGSTSK

SEQ ID NO: 1449542 - protein, 12 aa, Mycobacterium tuberculosis
RLGTSPEKDVGF

SEQ ID NO: 1449543 - protein, 9 aa, Mycobacterium tuberculosis
RLKRGGTNL

SEQ ID NO: 1449544 - protein, 16 aa, Mycobacterium tuberculosis
RLNRPGMSGDSSSWKG

SEQ ID NO: 1449545 - protein, 6 aa, Mycobacterium tuberculosis
RLPGGK

SEQ ID NO: 1449546 - protein, 19 aa, Mycobacterium tuberculosis
RLPGGNRGRGRIDPPDTGI

SEQ ID NO: 1449547 - protein, 12 aa, Mycobacterium tuberculosis
RLPGPRGPHRAR

SEQ ID NO: 1449548 - protein, 8 aa, Mycobacterium tuberculosis
RLPGTQRR

SEQ ID NO: 1449549 - protein, 7 aa, Mycobacterium tuberculosis
RLPPTGT

SEQ ID NO: 1449550 - protein, 6 aa, Mycobacterium tuberculosis
RLRAES

SEQ ID NO: 1449551 - protein, 8 aa, Mycobacterium tuberculosis
RLRGGRTT

SEQ ID NO: 1449552 - protein, 12 aa, Mycobacterium tuberculosis
RLRGRRDRTGAC

SEQ ID NO: 1449553 - protein, 8 aa, Mycobacterium tuberculosis
RLRPPTAR

SEQ ID NO: 1449554 - protein, 5 aa, Mycobacterium tuberculosis
RLRTD

SEQ ID NO: 1449555 - protein, 7 aa, Mycobacterium tuberculosis
RLSDSPF

SEQ ID NO: 1449556 - protein, 8 aa, Mycobacterium tuberculosis
RLSEPSPY

SEQ ID NO: 1449557 - protein, 6 aa, Mycobacterium tuberculosis
RLSGGQ

SEQ ID NO: 1449558 - protein, 9 aa, Mycobacterium tuberculosis
RLSPASRHI

SEQ ID NO: 1449559 - protein, 50 aa, Mycobacterium tuberculosis
RLSSDPKPREGTETPSDAGTEVDDKPSSDPKPREGTETSTPSVPHTGPVP

SEQ ID NO: 1449560 - protein, 11 aa, Mycobacterium tuberculosis
RLSSSAPEAAT

SEQ ID NO: 1449561 - protein, 8 aa, Mycobacterium tuberculosis
RLSTPSKS

SEQ ID NO: 1449562 - protein, 13 aa, Mycobacterium tuberculosis
RLTAAAEAKRQNV

SEQ ID NO: 1449563 - protein, 7 aa, Mycobacterium tuberculosis
RLTADGQ

SEQ ID NO: 1449564 - protein, 15 aa, Mycobacterium tuberculosis
RLTDGHGRTVDFRNT

SEQ ID NO: 1449565 - protein, 6 aa, Mycobacterium tuberculosis
RLTDTR

SEQ ID NO: 1449566 - protein, 29 aa, Mycobacterium tuberculosis
RLTGGGRLGRPGRANRPPRRTTVDGPGDA

SEQ ID NO: 1449567 - protein, 10 aa, Mycobacterium tuberculosis
RLTMPNTPEM

SEQ ID NO: 1449568 - protein, 18 aa, Mycobacterium tuberculosis
RLTPRRNRQTGSAWRRKS

SEQ ID NO: 1449569 - protein, 5 aa, Mycobacterium tuberculosis
RLTPT

SEQ ID NO: 1449570 - protein, 9 aa, Mycobacterium tuberculosis
RLTSPTLPK

SEQ ID NO: 1449571 - protein, 17 aa, Mycobacterium tuberculosis
RLTSRESMRSLEMSRRR

SEQ ID NO: 1449572 - protein, 10 aa, Mycobacterium tuberculosis
RMESTDSVGQ

SEQ ID NO: 1449573 - protein, 12 aa, Mycobacterium tuberculosis
RMPAPPASRSKY

SEQ ID NO: 1449574 - protein, 8 aa, Mycobacterium tuberculosis
RMSQGRTL

SEQ ID NO: 1449575 - protein, 9 aa, Mycobacterium tuberculosis
RMTRPTAAV

SEQ ID NO: 1449576 - protein, 22 aa, Mycobacterium tuberculosis
RNAPGQASASRVPATRPPYGRM

SEQ ID NO: 1449577 - protein, 30 aa, Mycobacterium tuberculosis
RNAQARGQRPHRVGQPGGVQATGVGDDAHP

SEQ ID NO: 1449578 - protein, 31 aa, Mycobacterium tuberculosis
RNAQARGQRPHRVGQPGGVQATGVGDDAHPA

SEQ ID NO: 1449579 - protein, 10 aa, Mycobacterium tuberculosis
RNATDEERAE

SEQ ID NO: 1449580 - protein, 8 aa, Mycobacterium tuberculosis
RNATGRQR

SEQ ID NO: 1449581 - protein, 10 aa, Mycobacterium tuberculosis
RNAVGAPAEV

SEQ ID NO: 1449582 - protein, 13 aa, Mycobacterium tuberculosis
RNCATRRPRNVSS

SEQ ID NO: 1449583 - protein, 12 aa, Mycobacterium tuberculosis
RNDQGMDPEDPE

SEQ ID NO: 1449584 - protein, 24 aa, Mycobacterium tuberculosis
RNERTTPVRKTSRNGRSSAPRSTR

SEQ ID NO: 1449585 - protein, 13 aa, Mycobacterium tuberculosis
RNETSLQHTHKGD

SEQ ID NO: 1449586 - protein, 11 aa, Mycobacterium tuberculosis
RNGAPTAGRRA

SEQ ID NO: 1449587 - protein, 9 aa, Mycobacterium tuberculosis
RNGDGKSSL

SEQ ID NO: 1449588 - protein, 78 aa, Mycobacterium tuberculosis
RNGGAGGAADPSRTAVPAATAGGYTATVGSAATVGGHPRSGAMAATEATAATPGYGATGGRVEPERQERPAPTGKTRC

SEQ ID NO: 1449589 - protein, 15 aa, Mycobacterium tuberculosis
RNGHHGGDQCVARAH

SEQ ID NO: 1449590 - protein, 6 aa, Mycobacterium tuberculosis
RNGNEV

SEQ ID NO: 1449591 - protein, 12 aa, Mycobacterium tuberculosis
RNGNEVAVTTET

SEQ ID NO: 1449592 - protein, 4 aa, Mycobacterium tuberculosis
RNGR

SEQ ID NO: 1449593 - protein, 10 aa, Mycobacterium tuberculosis
RNGVAPPDTT

SEQ ID NO: 1449594 - protein, 8 aa, Mycobacterium tuberculosis
RNITRRGR

SEQ ID NO: 1449595 - protein, 8 aa, Mycobacterium tuberculosis
RNKPTTAA

SEQ ID NO: 1449596 - protein, 5 aa, Mycobacterium tuberculosis
RNKSH

SEQ ID NO: 1449597 - protein, 22 aa, Mycobacterium tuberculosis
RNLPGRRRDGRPTGSPRPPAAG

SEQ ID NO: 1449598 - protein, 20 aa, Mycobacterium tuberculosis
RNPHRATRASVRHGRVTRRA

SEQ ID NO: 1449599 - protein, 6 aa, Mycobacterium tuberculosis
RNPRDD

SEQ ID NO: 1449600 - protein, 16 aa, Mycobacterium tuberculosis
RNPVARKQAQTKSRRG

SEQ ID NO: 1449601 - protein, 11 aa, Mycobacterium tuberculosis
RNQGGEPAVNA

SEQ ID NO: 1449602 - protein, 4 aa, Mycobacterium tuberculosis
RNRA

SEQ ID NO: 1449603 - protein, 6 aa, Mycobacterium tuberculosis
RNRKKL

SEQ ID NO: 1449604 - protein, 21 aa, Mycobacterium tuberculosis
RNRQGRRLRQHPAGAVPVPSR

SEQ ID NO: 1449605 - protein, 19 aa, Mycobacterium tuberculosis
RNRTNERARLRNKAVKFLD

SEQ ID NO: 1449606 - protein, 14 aa, Mycobacterium tuberculosis
RNRTTAGRCGSPPR

SEQ ID NO: 1449607 - protein, 4 aa, Mycobacterium tuberculosis
RNTG

SEQ ID NO: 1449608 - protein, 11 aa, Mycobacterium tuberculosis
RNTGSDPRELG

SEQ ID NO: 1449609 - protein, 6 aa, Mycobacterium tuberculosis
RNTPGV

SEQ ID NO: 1449610 - protein, 9 aa, Mycobacterium tuberculosis
RPAAGRRDR

SEQ ID NO: 1449611 - protein, 19 aa, Mycobacterium tuberculosis
RPAARGHRRGDRLTLIRTP

SEQ ID NO: 1449612 - protein, 13 aa, Mycobacterium tuberculosis
RPADTVVRRSATS

SEQ ID NO: 1449613 - protein, 6 aa, Mycobacterium tuberculosis
RPAEDT

SEQ ID NO: 1449614 - protein, 37 aa, Mycobacterium tuberculosis
RPAGASPPAPPAPPSPPRPPAPPSPPLPPSDTSTALK

SEQ ID NO: 1449615 - protein, 5 aa, Mycobacterium tuberculosis
RPAGH

SEQ ID NO: 1449616 - protein, 26 aa, Mycobacterium tuberculosis
RPAGPRLPPDRPTETSGGAIAEQPYG

SEQ ID NO: 1449617 - protein, 16 aa, Mycobacterium tuberculosis
RPAGRSARASESGCAV

SEQ ID NO: 1449618 - protein, 10 aa, Mycobacterium tuberculosis
RPAGSMPPLT

SEQ ID NO: 1449619 - protein, 20 aa, Mycobacterium tuberculosis
RPAGVGAGGCRAGAAGAGLA

SEQ ID NO: 1449620 - protein, 5 aa, Mycobacterium tuberculosis
RPAHG

SEQ ID NO: 1449621 - protein, 8 aa, Mycobacterium tuberculosis
RPANDPDV

SEQ ID NO: 1449622 - protein, 11 aa, Mycobacterium tuberculosis
RPAQGRPSTPM

SEQ ID NO: 1449623 - protein, 10 aa, Mycobacterium tuberculosis
RPAQNPHPRR

SEQ ID NO: 1449624 - protein, 11 aa, Mycobacterium tuberculosis
RPAQPATRNWA

SEQ ID NO: 1449625 - protein, 9 aa, Mycobacterium tuberculosis
RPARPSSRA

SEQ ID NO: 1449626 - protein, 7 aa, Mycobacterium tuberculosis
RPARTAD

SEQ ID NO: 1449627 - protein, 5 aa, Mycobacterium tuberculosis
RPASF

SEQ ID NO: 1449628 - protein, 6 aa, Mycobacterium tuberculosis
RPASRR

SEQ ID NO: 1449629 - protein, 4 aa, Mycobacterium tuberculosis
RPAT

SEQ ID NO: 1449630 - protein, 6 aa, Mycobacterium tuberculosis
RPATGL

SEQ ID NO: 1449631 - protein, 6 aa, Mycobacterium tuberculosis
RPATLG

SEQ ID NO: 1449632 - protein, 18 aa, Mycobacterium tuberculosis
RPATPNPAGSRRPRHRTA

SEQ ID NO: 1449633 - protein, 22 aa, Mycobacterium tuberculosis
RPATSNPGRRRQPGDQPGLESG

SEQ ID NO: 1449634 - protein, 18 aa, Mycobacterium tuberculosis
RPDAGTHRGAVSGHRRGR

SEQ ID NO: 1449635 - protein, 11 aa, Mycobacterium tuberculosis
RPDDERRNRSL

SEQ ID NO: 1449636 - protein, 10 aa, Mycobacterium tuberculosis
RPDGSHGDTS

SEQ ID NO: 1449637 - protein, 6 aa, Mycobacterium tuberculosis
RPDGTE

SEQ ID NO: 1449638 - protein, 49 aa, Mycobacterium tuberculosis
RPDPAPLSTPATSHMPTPRSTGGCTSSSATPTCPRPPPCSRWAPRRSCW

SEQ ID NO: 1449639 - protein, 8 aa, Mycobacterium tuberculosis
RPDPARDA

SEQ ID NO: 1449640 - protein, 5 aa, Mycobacterium tuberculosis
RPDQL

SEQ ID NO: 1449641 - protein, 28 aa, Mycobacterium tuberculosis
RPDRPDGPPPGGPMGRRPAVRGGRAHPT

SEQ ID NO: 1449642 - protein, 7 aa, Mycobacterium tuberculosis
RPDSQRM

SEQ ID NO: 1449643 - protein, 15 aa, Mycobacterium tuberculosis
RPDSSRTPSARSPDV

SEQ ID NO: 1449644 - protein, 9 aa, Mycobacterium tuberculosis
RPDSWPSSA

SEQ ID NO: 1449645 - protein, 6 aa, Mycobacterium tuberculosis
RPEEVA

SEQ ID NO: 1449646 - protein, 9 aa, Mycobacterium tuberculosis
RPEGGWTPN

SEQ ID NO: 1449647 - protein, 9 aa, Mycobacterium tuberculosis
RPEIESAPT

SEQ ID NO: 1449648 - protein, 27 aa, Mycobacterium tuberculosis
RPEKVAARRGFADRGRRPGRDAEGASE

SEQ ID NO: 1449649 - protein, 7 aa, Mycobacterium tuberculosis
RPEPGQH

SEQ ID NO: 1449650 - protein, 8 aa, Mycobacterium tuberculosis
RPEPKLNA

SEQ ID NO: 1449651 - protein, 14 aa, Mycobacterium tuberculosis
RPERDQWGRRHQPV

SEQ ID NO: 1449652 - protein, 12 aa, Mycobacterium tuberculosis
RPETGLRAPRPG

SEQ ID NO: 1449653 - protein, 5 aa, Mycobacterium tuberculosis
RPGAQ

SEQ ID NO: 1449654 - protein, 4 aa, Mycobacterium tuberculosis
RPGD

SEQ ID NO: 1449655 - protein, 15 aa, Mycobacterium tuberculosis
RPGEFGSVGADDHRA

SEQ ID NO: 1449656 - protein, 36 aa, Mycobacterium tuberculosis
RPGEPPTKESAQRCPYERSTRRRPRSWPASSAVKRS

SEQ ID NO: 1449657 - protein, 13 aa, Mycobacterium tuberculosis
RPGERPSNGGFRG

SEQ ID NO: 1449658 - protein, 17 aa, Mycobacterium tuberculosis
RPGPRPTRQSPRRRGRC

SEQ ID NO: 1449659 - protein, 4 aa, Mycobacterium tuberculosis
RPGQ

SEQ ID NO: 1449660 - protein, 19 aa, Mycobacterium tuberculosis
RPGRRRPTRHRPRTCPGGS

SEQ ID NO: 1449661 - protein, 10 aa, Mycobacterium tuberculosis
RPGSTTISTG

SEQ ID NO: 1449662 - protein, 6 aa, Mycobacterium tuberculosis
RPGTVL

SEQ ID NO: 1449663 - protein, 14 aa, Mycobacterium tuberculosis
RPGVGEGDSPRRAN

SEQ ID NO: 1449664 - protein, 5 aa, Mycobacterium tuberculosis
RPGWP

SEQ ID NO: 1449665 - protein, 15 aa, Mycobacterium tuberculosis
RPGWPRGDRRHEPPV

SEQ ID NO: 1449666 - protein, 4 aa, Mycobacterium tuberculosis
RPHG

SEQ ID NO: 1449667 - protein, 14 aa, Mycobacterium tuberculosis
RPKNPERGRKPDDG

SEQ ID NO: 1449668 - protein, 16 aa, Mycobacterium tuberculosis
RPKTPRGDGNARNRPT

SEQ ID NO: 1449669 - protein, 44 aa, Mycobacterium tuberculosis
RPKTPRGDGNLHPESPYARNASNVSSDPKPREGTETRNPAPHPQ

SEQ ID NO: 1449670 - protein, 15 aa, Mycobacterium tuberculosis
RPKTPRGDGNPSTPD

SEQ ID NO: 1449671 - protein, 15 aa, Mycobacterium tuberculosis
RPKTPRGDGNPTMAS

SEQ ID NO: 1449672 - protein, 11 aa, Mycobacterium tuberculosis
RPKTPRGDGNS

SEQ ID NO: 1449673 - protein, 8 aa, Mycobacterium tuberculosis
RPKVSRRP

SEQ ID NO: 1449674 - protein, 20 aa, Mycobacterium tuberculosis
RPLATELDNRKAEVNNDIEQ

SEQ ID NO: 1449675 - protein, 22 aa, Mycobacterium tuberculosis
RPLGETQIGQADGAEPAGEPGL

SEQ ID NO: 1449676 - protein, 12 aa, Mycobacterium tuberculosis
RPLGPGYDGSGS

SEQ ID NO: 1449677 - protein, 4 aa, Mycobacterium tuberculosis
RPLI

SEQ ID NO: 1449678 - protein, 22 aa, Mycobacterium tuberculosis
RPLIGNGTNGAPGTGADGAPGG

SEQ ID NO: 1449679 - protein, 6 aa, Mycobacterium tuberculosis
RPLPAA

SEQ ID NO: 1449680 - protein, 27 aa, Mycobacterium tuberculosis
RPLQGHPSARRPPGGRGRRKAPHTHRP

SEQ ID NO: 1449681 - protein, 17 aa, Mycobacterium tuberculosis
RPLRRRTAGPHRPRNGL

SEQ ID NO: 1449682 - protein, 10 aa, Mycobacterium tuberculosis
RPLSRSDSRS

SEQ ID NO: 1449683 - protein, 4 aa, Mycobacterium tuberculosis
RPLT

SEQ ID NO: 1449684 - protein, 8 aa, Mycobacterium tuberculosis
RPNGARAA

SEQ ID NO: 1449685 - protein, 6 aa, Mycobacterium tuberculosis
RPNPGI

SEQ ID NO: 1449686 - protein, 4 aa, Mycobacterium tuberculosis
RPNR

SEQ ID NO: 1449687 - protein, 9 aa, Mycobacterium tuberculosis
RPNRSPTDA

SEQ ID NO: 1449688 - protein, 5 aa, Mycobacterium tuberculosis
RPNVG

SEQ ID NO: 1449689 - protein, 20 aa, Mycobacterium tuberculosis
RPPAAPQALGQDRRVGRFSP

SEQ ID NO: 1449690 - protein, 21 aa, Mycobacterium tuberculosis
RPPAPAALPGTPQARGGIDSP

SEQ ID NO: 1449691 - protein, 49 aa, Mycobacterium tuberculosis
RPPGDRVHPRRSGVRHRRSGLGSVPDPLRRQTPPKHPEQTRRLAPADVA

SEQ ID NO: 1449692 - protein, 6 aa, Mycobacterium tuberculosis
RPPGGL

SEQ ID NO: 1449693 - protein, 30 aa, Mycobacterium tuberculosis
RPPGPSRADRCTPTSGGATASTRSSTSTRR

SEQ ID NO: 1449694 - protein, 7 aa, Mycobacterium tuberculosis
RPPGSNN

SEQ ID NO: 1449695 - protein, 4 aa, Mycobacterium tuberculosis
RPPL

SEQ ID NO: 1449696 - protein, 7 aa, Mycobacterium tuberculosis
RPPNVGR

SEQ ID NO: 1449697 - protein, 14 aa, Mycobacterium tuberculosis
RPPRPLPFSAVSET

SEQ ID NO: 1449698 - protein, 11 aa, Mycobacterium tuberculosis
RPPRPRSSSSC

SEQ ID NO: 1449699 - protein, 14 aa, Mycobacterium tuberculosis
RPPRTAQRRRIAPQ

SEQ ID NO: 1449700 - protein, 22 aa, Mycobacterium tuberculosis
RPPRTRSGAALPRSSDPVPISP

SEQ ID NO: 1449701 - protein, 20 aa, Mycobacterium tuberculosis
RPPRTRSGAALPRSSDRARP

SEQ ID NO: 1449702 - protein, 5 aa, Mycobacterium tuberculosis
RPPVL

SEQ ID NO: 1449703 - protein, 7 aa, Mycobacterium tuberculosis
RPPWSNN

SEQ ID NO: 1449704 - protein, 22 aa, Mycobacterium tuberculosis
RPQGELDESSRAAGAGGPGRPA

SEQ ID NO: 1449705 - protein, 17 aa, Mycobacterium tuberculosis
RPQKYQDQSDFTPNDQL

SEQ ID NO: 1449706 - protein, 33 aa, Mycobacterium tuberculosis
RPQKYQDQSDFTPNDQLADPGASGGVRSSVRGR

SEQ ID NO: 1449707 - protein, 28 aa, Mycobacterium tuberculosis
RPQLRGPPEPARTTASRCPAVDQSEAVD

SEQ ID NO: 1449708 - protein, 9 aa, Mycobacterium tuberculosis
RPQPGDRDV

SEQ ID NO: 1449709 - protein, 5 aa, Mycobacterium tuberculosis
RPQRS

SEQ ID NO: 1449710 - protein, 7 aa, Mycobacterium tuberculosis
RPQSNHA

SEQ ID NO: 1449711 - protein, 6 aa, Mycobacterium tuberculosis
RPRANG

SEQ ID NO: 1449712 - protein, 10 aa, Mycobacterium tuberculosis
RPRDFEQSRR

SEQ ID NO: 1449713 - protein, 13 aa, Mycobacterium tuberculosis
RPRGDSGAGGRRR

SEQ ID NO: 1449714 - protein, 7 aa, Mycobacterium tuberculosis
RPRGEDS

SEQ ID NO: 1449715 - protein, 9 aa, Mycobacterium tuberculosis
RPRHPGGVA

SEQ ID NO: 1449716 - protein, 19 aa, Mycobacterium tuberculosis
RPRNPGPRGRRRQRRHPAG

SEQ ID NO: 1449717 - protein, 18 aa, Mycobacterium tuberculosis
RPRPVTPARSSPSMSRLA

SEQ ID NO: 1449718 - protein, 8 aa, Mycobacterium tuberculosis
RPRQLGPG

SEQ ID NO: 1449719 - protein, 5 aa, Mycobacterium tuberculosis
RPRRA

SEQ ID NO: 1449720 - protein, 7 aa, Mycobacterium tuberculosis
RPRRATQ

SEQ ID NO: 1449721 - protein, 16 aa, Mycobacterium tuberculosis
RPRRGRHARARSTVST

SEQ ID NO: 1449722 - protein, 10 aa, Mycobacterium tuberculosis
RPRRHRNEKR

SEQ ID NO: 1449723 - protein, 77 aa, Mycobacterium tuberculosis
RPRRHRSPASVPAHPSATAAITPAAALPPPDPVPAVTSRPVTPSDFGSAPGDGSATPAGVGSAGGFGDAGGTGGLGG

SEQ ID NO: 1449724 - protein, 5 aa, Mycobacterium tuberculosis
RPRRP

SEQ ID NO: 1449725 - protein, 24 aa, Mycobacterium tuberculosis
RPRRPSSTSPGNTPGCASSTRPRC

SEQ ID NO: 1449726 - protein, 12 aa, Mycobacterium tuberculosis
RPRRRRASAATF

SEQ ID NO: 1449727 - protein, 18 aa, Mycobacterium tuberculosis
RPRRRRASAATFGPLWLP

SEQ ID NO: 1449728 - protein, 10 aa, Mycobacterium tuberculosis
RPRRSRHGRQ

SEQ ID NO: 1449729 - protein, 9 aa, Mycobacterium tuberculosis
RPRRVPARR

SEQ ID NO: 1449730 - protein, 9 aa, Mycobacterium tuberculosis
RPRSPVRYD

SEQ ID NO: 1449731 - protein, 8 aa, Mycobacterium tuberculosis
RPRSTDDV

SEQ ID NO: 1449732 - protein, 13 aa, Mycobacterium tuberculosis
RPRTDKGSDGTRH

SEQ ID NO: 1449733 - protein, 8 aa, Mycobacterium tuberculosis
RPRTEPER

SEQ ID NO: 1449734 - protein, 12 aa, Mycobacterium tuberculosis
RPRTLDPSTLDN

SEQ ID NO: 1449735 - protein, 6 aa, Mycobacterium tuberculosis
RPSEAP

SEQ ID NO: 1449736 - protein, 5 aa, Mycobacterium tuberculosis
RPSEG

SEQ ID NO: 1449737 - protein, 5 aa, Mycobacterium tuberculosis
RPSGA

SEQ ID NO: 1449738 - protein, 22 aa, Mycobacterium tuberculosis
RPSGDTWSWGPSDAAQRVTGSA

SEQ ID NO: 1449739 - protein, 8 aa, Mycobacterium tuberculosis
RPSGGGAT

SEQ ID NO: 1449740 - protein, 13 aa, Mycobacterium tuberculosis
RPSGTEDVYKIYA

SEQ ID NO: 1449741 - protein, 6 aa, Mycobacterium tuberculosis
RPSIGR

SEQ ID NO: 1449742 - protein, 22 aa, Mycobacterium tuberculosis
RPSNGAAAAASALAYSPSPAVK

SEQ ID NO: 1449743 - protein, 11 aa, Mycobacterium tuberculosis
RPSNHPKASKV

SEQ ID NO: 1449744 - protein, 6 aa, Mycobacterium tuberculosis
RPSNPT

SEQ ID NO: 1449745 - protein, 73 aa, Mycobacterium tuberculosis
RPSRSTRKPGLRSRRRKTASSQTRQGPRSTSTCRRGTLPSGSPSPPGRSSPASPRAASSTSCPGWTTRPRPRL

SEQ ID NO: 1449746 - protein, 12 aa, Mycobacterium tuberculosis
RPSSSVTSTAAG

SEQ ID NO: 1449747 - protein, 10 aa, Mycobacterium tuberculosis
RPSTSRPPAV

SEQ ID NO: 1449748 - protein, 18 aa, Mycobacterium tuberculosis
RPTAPSPSHTNTLGTAPN

SEQ ID NO: 1449749 - protein, 15 aa, Mycobacterium tuberculosis
RPTATARRPRLSGLK

SEQ ID NO: 1449750 - protein, 17 aa, Mycobacterium tuberculosis
RPTDSCSPMPTRSAGAK

SEQ ID NO: 1449751 - protein, 13 aa, Mycobacterium tuberculosis
RPTGISDRAPPIA

SEQ ID NO: 1449752 - protein, 5 aa, Mycobacterium tuberculosis
RPTGV

SEQ ID NO: 1449753 - protein, 5 aa, Mycobacterium tuberculosis
RPTPV

SEQ ID NO: 1449754 - protein, 29 aa, Mycobacterium tuberculosis
RPTPVAGTADHRDAGRKTAARRGSPGIAG

SEQ ID NO: 1449755 - protein, 22 aa, Mycobacterium tuberculosis
RPTVPEAHTRQGARRIQPHLHR

SEQ ID NO: 1449756 - protein, 55 aa, Mycobacterium tuberculosis
RPTYPRTGHINPGAPHQHRPGQRCQSANPRPLRPDRLRPRPNHRPGLPPNTPDVR

SEQ ID NO: 1449757 - protein, 20 aa, Mycobacterium tuberculosis
RPVEPAGCGRANASRRPGGI

SEQ ID NO: 1449758 - protein, 35 aa, Mycobacterium tuberculosis
RPVPATPFPPAPPAPPLPTDPPWPPLPPAPPFSPA

SEQ ID NO: 1449759 - protein, 13 aa, Mycobacterium tuberculosis
RPVPGTPTGDYGI

SEQ ID NO: 1449760 - protein, 6 aa, Mycobacterium tuberculosis
RPVRSR

SEQ ID NO: 1449761 - protein, 19 aa, Mycobacterium tuberculosis
RPVSSRRMSRRAGLGRADV

SEQ ID NO: 1449762 - protein, 14 aa, Mycobacterium tuberculosis
RPVSTTGEAGNQNT

SEQ ID NO: 1449763 - protein, 34 aa, Mycobacterium tuberculosis
RPWCGGQSGDRSTRVSSSMPAKSCSPATPNPNTI

SEQ ID NO: 1449764 - protein, 6 aa, Mycobacterium tuberculosis
RPWPPH

SEQ ID NO: 1449765 - protein, 8 aa, Mycobacterium tuberculosis
RQAAAAAS

SEQ ID NO: 1449766 - protein, 9 aa, Mycobacterium tuberculosis
RQAALNPPP

SEQ ID NO: 1449767 - protein, 14 aa, Mycobacterium tuberculosis
RQAEQARKAADEPP

SEQ ID NO: 1449768 - protein, 6 aa, Mycobacterium tuberculosis
RQAGHS

SEQ ID NO: 1449769 - protein, 6 aa, Mycobacterium tuberculosis
RQAGMT

SEQ ID NO: 1449770 - protein, 5 aa, Mycobacterium tuberculosis
RQAGR

SEQ ID NO: 1449771 - protein, 17 aa, Mycobacterium tuberculosis
RQALADRRAANCCVLRG

SEQ ID NO: 1449772 - protein, 81 aa, Mycobacterium tuberculosis
RQANGAPAVDRSAQEHDKGDRPPSSEAPATQGEQTPTEQIDEERGTDAGGDQGGDQQASGGQQARGDEDGEARQGRRGRRF

SEQ ID NO: 1449773 - protein, 21 aa, Mycobacterium tuberculosis
RQAQRRRLGAGGRGGPAIPTE

SEQ ID NO: 1449774 - protein, 8 aa, Mycobacterium tuberculosis
RQARRDRT

SEQ ID NO: 1449775 - protein, 12 aa, Mycobacterium tuberculosis
RQATPGGSRRVA

SEQ ID NO: 1449776 - protein, 14 aa, Mycobacterium tuberculosis
RQDADDKAVGVRRT

SEQ ID NO: 1449777 - protein, 9 aa, Mycobacterium tuberculosis
RQDRPRGGW

SEQ ID NO: 1449778 - protein, 7 aa, Mycobacterium tuberculosis
RQEDADA

SEQ ID NO: 1449779 - protein, 14 aa, Mycobacterium tuberculosis
RQEPGTGRSPHGAC

SEQ ID NO: 1449780 - protein, 16 aa, Mycobacterium tuberculosis
RQEPNGGERSAIAAPT

SEQ ID NO: 1449781 - protein, 7 aa, Mycobacterium tuberculosis
RQGGGIR

SEQ ID NO: 1449782 - protein, 5 aa, Mycobacterium tuberculosis
RQGPA

SEQ ID NO: 1449783 - protein, 12 aa, Mycobacterium tuberculosis
RQGPAKSSKSVS

SEQ ID NO: 1449784 - protein, 6 aa, Mycobacterium tuberculosis
RQGPKL

SEQ ID NO: 1449785 - protein, 94 aa, Mycobacterium tuberculosis
RQGRPAAPETGGVGGSGGLGSAFGPGGTGGMGGAGGTSTVSAGGDGGRGGFGGDGLDASSGGNGGDGGHGGDGFRTAGAGGRGGDGGKGADPGG

SEQ ID NO: 1449786 - protein, 12 aa, Mycobacterium tuberculosis
RQGRPAAPETVA

SEQ ID NO: 1449787 - protein, 9 aa, Mycobacterium tuberculosis
RQHASQYGE

SEQ ID NO: 1449788 - protein, 9 aa, Mycobacterium tuberculosis
RQKRRHRQR

SEQ ID NO: 1449789 - protein, 8 aa, Mycobacterium tuberculosis
RQLPGEGV

SEQ ID NO: 1449790 - protein, 9 aa, Mycobacterium tuberculosis
RQLPGEGVT

SEQ ID NO: 1449791 - protein, 16 aa, Mycobacterium tuberculosis
RQLRPDAPDCNSGADE

SEQ ID NO: 1449792 - protein, 31 aa, Mycobacterium tuberculosis
RQPAATVAAAESVGAGGVGGAGGDGGNGRLP

SEQ ID NO: 1449793 - protein, 8 aa, Mycobacterium tuberculosis
RQPDRSGI

SEQ ID NO: 1449794 - protein, 40 aa, Mycobacterium tuberculosis
RQPGRGAASHRRRRLPKRRRRARPGADVGPAGRGRQFRHC

SEQ ID NO: 1449795 - protein, 11 aa, Mycobacterium tuberculosis
RQPHAGTEDHH

SEQ ID NO: 1449796 - protein, 13 aa, Mycobacterium tuberculosis
RQPIVSPRPGRNR

SEQ ID NO: 1449797 - protein, 12 aa, Mycobacterium tuberculosis
RQPKQHQYAQPV

SEQ ID NO: 1449798 - protein, 18 aa, Mycobacterium tuberculosis
RQPPAGPAGSPGPRGPVD

SEQ ID NO: 1449799 - protein, 18 aa, Mycobacterium tuberculosis
RQPPCRRRDPKAVSPTSM

SEQ ID NO: 1449800 - protein, 6 aa, Mycobacterium tuberculosis
RQPPER

SEQ ID NO: 1449801 - protein, 6 aa, Mycobacterium tuberculosis
RQPRGL

SEQ ID NO: 1449802 - protein, 30 aa, Mycobacterium tuberculosis
RQPRNASGGDSRHGPDNRLRPAGHGYLNLN

SEQ ID NO: 1449803 - protein, 8 aa, Mycobacterium tuberculosis
RQQPGGQH

SEQ ID NO: 1449804 - protein, 5 aa, Mycobacterium tuberculosis
RQQSD

SEQ ID NO: 1449805 - protein, 11 aa, Mycobacterium tuberculosis
RQQTNKSIGTY

SEQ ID NO: 1449806 - protein, 8 aa, Mycobacterium tuberculosis
RQRAPRAG

SEQ ID NO: 1449807 - protein, 13 aa, Mycobacterium tuberculosis
RQRERFSRRQPAA

SEQ ID NO: 1449808 - protein, 5 aa, Mycobacterium tuberculosis
RQRQH

SEQ ID NO: 1449809 - protein, 4 aa, Mycobacterium tuberculosis
RQRR

SEQ ID NO: 1449810 - protein, 16 aa, Mycobacterium tuberculosis
RQRRCPADSGTRTRRA

SEQ ID NO: 1449811 - protein, 13 aa, Mycobacterium tuberculosis
RQRRGRRTRRRGR

SEQ ID NO: 1449812 - protein, 15 aa, Mycobacterium tuberculosis
RQRRPRQRRIGQHSR

SEQ ID NO: 1449813 - protein, 15 aa, Mycobacterium tuberculosis
RQRRQRAAHRQRWCR

SEQ ID NO: 1449814 - protein, 17 aa, Mycobacterium tuberculosis
RQRRVGGTRAGRRGRRC

SEQ ID NO: 1449815 - protein, 14 aa, Mycobacterium tuberculosis
RQRTGAGLTICDAP

SEQ ID NO: 1449816 - protein, 23 aa, Mycobacterium tuberculosis
RQSARTAGPAVSADATGPAGPAV

SEQ ID NO: 1449817 - protein, 12 aa, Mycobacterium tuberculosis
RQSDSDRSSSPP

SEQ ID NO: 1449818 - protein, 8 aa, Mycobacterium tuberculosis
RQSGGMDV

SEQ ID NO: 1449819 - protein, 8 aa, Mycobacterium tuberculosis
RQSGWRGG

SEQ ID NO: 1449820 - protein, 4 aa, Mycobacterium tuberculosis
RQTG

SEQ ID NO: 1449821 - protein, 16 aa, Mycobacterium tuberculosis
RQTGSTTMIDPDGAGV

SEQ ID NO: 1449822 - protein, 12 aa, Mycobacterium tuberculosis
RQTQNPERGRKL

SEQ ID NO: 1449823 - protein, 7 aa, Mycobacterium tuberculosis
RQTREHH

SEQ ID NO: 1449824 - protein, 4 aa, Mycobacterium tuberculosis
RRAA

SEQ ID NO: 1449825 - protein, 5 aa, Mycobacterium tuberculosis
RRAAR

SEQ ID NO: 1449826 - protein, 8 aa, Mycobacterium tuberculosis
RRAARRRR

SEQ ID NO: 1449827 - protein, 5 aa, Mycobacterium tuberculosis
RRADA

SEQ ID NO: 1449828 - protein, 6 aa, Mycobacterium tuberculosis
RRAEDV

SEQ ID NO: 1449829 - protein, 15 aa, Mycobacterium tuberculosis
RRAGAGDRPLPPTRP

SEQ ID NO: 1449830 - protein, 5 aa, Mycobacterium tuberculosis
RRAGD

SEQ ID NO: 1449831 - protein, 6 aa, Mycobacterium tuberculosis
RRAGDE

SEQ ID NO: 1449832 - protein, 7 aa, Mycobacterium tuberculosis
RRAGDEV

SEQ ID NO: 1449833 - protein, 15 aa, Mycobacterium tuberculosis
RRAGEADLKTPRNWQ

SEQ ID NO: 1449834 - protein, 18 aa, Mycobacterium tuberculosis
RRAGEQGGKERADTSPQR

SEQ ID NO: 1449835 - protein, 11 aa, Mycobacterium tuberculosis
RRAGGDPGPPF

SEQ ID NO: 1449836 - protein, 13 aa, Mycobacterium tuberculosis
RRAGGERVGSAPL

SEQ ID NO: 1449837 - protein, 7 aa, Mycobacterium tuberculosis
RRAGGMS

SEQ ID NO: 1449838 - protein, 8 aa, Mycobacterium tuberculosis
RRAGNGTR

SEQ ID NO: 1449839 - protein, 13 aa, Mycobacterium tuberculosis
RRAGSGPDESGWT

SEQ ID NO: 1449840 - protein, 20 aa, Mycobacterium tuberculosis
RRAGVDPGRIPGPWSGAGLS

SEQ ID NO: 1449841 - protein, 5 aa, Mycobacterium tuberculosis
RRALS

SEQ ID NO: 1449842 - protein, 4 aa, Mycobacterium tuberculosis
RRAP

SEQ ID NO: 1449843 - protein, 22 aa, Mycobacterium tuberculosis
RRAPESPRSTSAPPSWRCTPRE

SEQ ID NO: 1449844 - protein, 7 aa, Mycobacterium tuberculosis
RRAPPGT

SEQ ID NO: 1449845 - protein, 13 aa, Mycobacterium tuberculosis
RRAPPRRVSPGGA

SEQ ID NO: 1449846 - protein, 24 aa, Mycobacterium tuberculosis
RRAPRRTGRPGRSTRSAKPPRPDA

SEQ ID NO: 1449847 - protein, 12 aa, Mycobacterium tuberculosis
RRARRSGSRGPR

SEQ ID NO: 1449848 - protein, 4 aa, Mycobacterium tuberculosis
RRAS

SEQ ID NO: 1449849 - protein, 12 aa, Mycobacterium tuberculosis
RRASAGSGRNDR

SEQ ID NO: 1449850 - protein, 21 aa, Mycobacterium tuberculosis
RRASQRSRWSASTAATPTGTV

SEQ ID NO: 1449851 - protein, 14 aa, Mycobacterium tuberculosis
RRASSAASPRTGFR

SEQ ID NO: 1449852 - protein, 17 aa, Mycobacterium tuberculosis
RRASVTSASSSSGSSAR

SEQ ID NO: 1449853 - protein, 13 aa, Mycobacterium tuberculosis
RRCARSSSGFMTP

SEQ ID NO: 1449854 - protein, 9 aa, Mycobacterium tuberculosis
RRCGGASPS

SEQ ID NO: 1449855 - protein, 27 aa, Mycobacterium tuberculosis
RRCPATEDRAPATVATSSSADPTASRA

SEQ ID NO: 1449856 - protein, 13 aa, Mycobacterium tuberculosis
RRCQPGGPGSPES

SEQ ID NO: 1449857 - protein, 12 aa, Mycobacterium tuberculosis
RRCRERPPPIWA

SEQ ID NO: 1449858 - protein, 9 aa, Mycobacterium tuberculosis
RRCSTRSRG

SEQ ID NO: 1449859 - protein, 9 aa, Mycobacterium tuberculosis
RRCTGSDDA

SEQ ID NO: 1449860 - protein, 26 aa, Mycobacterium tuberculosis
RRDAAPSRCRTDAHRDARRISGLWRR

SEQ ID NO: 1449861 - protein, 13 aa, Mycobacterium tuberculosis
RRDDAADDAFLFA

SEQ ID NO: 1449862 - protein, 65 aa, Mycobacterium tuberculosis
RRDDGACADRDQPQPGSGGAGALPGGIAGGRGRGRRRGAATGIHEGPAAASRTAGTRGSSTATAI

SEQ ID NO: 1449863 - protein, 9 aa, Mycobacterium tuberculosis
RRDGGSGHH

SEQ ID NO: 1449864 - protein, 4 aa, Mycobacterium tuberculosis
RRDH

SEQ ID NO: 1449865 - protein, 20 aa, Mycobacterium tuberculosis
RRDPASTRRGSGAGRRRLER

SEQ ID NO: 1449866 - protein, 20 aa, Mycobacterium tuberculosis
RRDPDRSPRCVSSRSPKPPG

SEQ ID NO: 1449867 - protein, 22 aa, Mycobacterium tuberculosis
RRDREGASGDLQQPAAGARGWP

SEQ ID NO: 1449868 - protein, 26 aa, Mycobacterium tuberculosis
RRDRPSAIGSQLPDADTLDTRQPPLQ

SEQ ID NO: 1449869 - protein, 7 aa, Mycobacterium tuberculosis
RRDRRRK

SEQ ID NO: 1449870 - protein, 9 aa, Mycobacterium tuberculosis
RRDRTTDRR

SEQ ID NO: 1449871 - protein, 17 aa, Mycobacterium tuberculosis
RRDSCPSYPVRGTVYAP

SEQ ID NO: 1449872 - protein, 5 aa, Mycobacterium tuberculosis
RRDWR

SEQ ID NO: 1449873 - protein, 8 aa, Mycobacterium tuberculosis
RRELPGGV

SEQ ID NO: 1449874 - protein, 21 aa, Mycobacterium tuberculosis
RREPGGAGGAGAVGGVGRQTG

SEQ ID NO: 1449875 - protein, 19 aa, Mycobacterium tuberculosis
RREQRQRRDRPSGRAGGDA

SEQ ID NO: 1449876 - protein, 25 aa, Mycobacterium tuberculosis
RREQTSKRKKKKNLLKKKKKKKKKK

SEQ ID NO: 1449877 - protein, 15 aa, Mycobacterium tuberculosis
RRERQTTGEQGDRVD

SEQ ID NO: 1449878 - protein, 22 aa, Mycobacterium tuberculosis
RRETSVSGDQRSNHAGGAAADH

SEQ ID NO: 1449879 - protein, 7 aa, Mycobacterium tuberculosis
RRGAATD

SEQ ID NO: 1449880 - protein, 25 aa, Mycobacterium tuberculosis
RRGAGLAEGQAGAHTRLGGARGGME

SEQ ID NO: 1449881 - protein, 8 aa, Mycobacterium tuberculosis
RRGARFST

SEQ ID NO: 1449882 - protein, 12 aa, Mycobacterium tuberculosis
RRGARRSSSRMV

SEQ ID NO: 1449883 - protein, 13 aa, Mycobacterium tuberculosis
RRGASQQLSATRR

SEQ ID NO: 1449884 - protein, 21 aa, Mycobacterium tuberculosis
RRGATRRTRSRGRRPGGRRAG

SEQ ID NO: 1449885 - protein, 56 aa, Mycobacterium tuberculosis
RRGCAADAAEHPLPAGRGGHRDPGDGRGRAHRQAHPRRPPRRAQQRGASPRTGSGF

SEQ ID NO: 1449886 - protein, 6 aa, Mycobacterium tuberculosis
RRGCEE

SEQ ID NO: 1449887 - protein, 13 aa, Mycobacterium tuberculosis
RRGDEARMATWHW

SEQ ID NO: 1449888 - protein, 20 aa, Mycobacterium tuberculosis
RRGDRAEGAAELAADLTEAG

SEQ ID NO: 1449889 - protein, 6 aa, Mycobacterium tuberculosis
RRGDRV

SEQ ID NO: 1449890 - protein, 24 aa, Mycobacterium tuberculosis
RRGDTPAVNSVTGNLPARATSATS

SEQ ID NO: 1449891 - protein, 6 aa, Mycobacterium tuberculosis
RRGEAY

SEQ ID NO: 1449892 - protein, 5 aa, Mycobacterium tuberculosis
RRGEM

SEQ ID NO: 1449893 - protein, 7 aa, Mycobacterium tuberculosis
RRGEPRV

SEQ ID NO: 1449894 - protein, 27 aa, Mycobacterium tuberculosis
RRGEPTEPATNPDASPGLRPADGPASL

SEQ ID NO: 1449895 - protein, 20 aa, Mycobacterium tuberculosis
RRGGAAGGQRGNLDTHSRPR

SEQ ID NO: 1449896 - protein, 13 aa, Mycobacterium tuberculosis
RRGGAGGRPGYRA

SEQ ID NO: 1449897 - protein, 20 aa, Mycobacterium tuberculosis
RRGGAGRAPEGAGRSGRGRI

SEQ ID NO: 1449898 - protein, 17 aa, Mycobacterium tuberculosis
RRGGGRPIAKNSPPGLP

SEQ ID NO: 1449899 - protein, 6 aa, Mycobacterium tuberculosis
RRGGHG

SEQ ID NO: 1449900 - protein, 24 aa, Mycobacterium tuberculosis
RRGGPRVGGEAPGGGSTTAGAGPG

SEQ ID NO: 1449901 - protein, 13 aa, Mycobacterium tuberculosis
RRGGRPFSCHTHF

SEQ ID NO: 1449902 - protein, 16 aa, Mycobacterium tuberculosis
RRGGSSCWPRTRLRFI

SEQ ID NO: 1449903 - protein, 27 aa, Mycobacterium tuberculosis
RRGGTVAADATGRRSGGAMSAVPPSPP

SEQ ID NO: 1449904 - protein, 13 aa, Mycobacterium tuberculosis
RRGHPQRHSRKHH

SEQ ID NO: 1449905 - protein, 26 aa, Mycobacterium tuberculosis
RRGHRRPTRHAPTNAAAALGCRGPPV

SEQ ID NO: 1449906 - protein, 4 aa, Mycobacterium tuberculosis
RRGP

SEQ ID NO: 1449907 - protein, 7 aa, Mycobacterium tuberculosis
RRGPAAV

SEQ ID NO: 1449908 - protein, 15 aa, Mycobacterium tuberculosis
RRGPASPSSGSRPPT

SEQ ID NO: 1449909 - protein, 11 aa, Mycobacterium tuberculosis
RRGPEAPADAP

SEQ ID NO: 1449910 - protein, 9 aa, Mycobacterium tuberculosis
RRGPGGGRI

SEQ ID NO: 1449911 - protein, 18 aa, Mycobacterium tuberculosis
RRGPGGSDTSLRDTAKTK

SEQ ID NO: 1449912 - protein, 19 aa, Mycobacterium tuberculosis
RRGRAGTDGAAAPAWERVG

SEQ ID NO: 1449913 - protein, 7 aa, Mycobacterium tuberculosis
RRGRGDD

SEQ ID NO: 1449914 - protein, 12 aa, Mycobacterium tuberculosis
RRGRPKIASSPF

SEQ ID NO: 1449915 - protein, 66 aa, Mycobacterium tuberculosis
RRGRQGPERTAAPAAPPAGSSASAATAGPAGSVLPASTAVSAAPAVTAATPPRVGASGSRKPGAPA

SEQ ID NO: 1449916 - protein, 8 aa, Mycobacterium tuberculosis
RRGRRGRR

SEQ ID NO: 1449917 - protein, 9 aa, Mycobacterium tuberculosis
RRGRRGRRA

SEQ ID NO: 1449918 - protein, 26 aa, Mycobacterium tuberculosis
RRGRRRDAAAQLDQRARPGRYRPSAD

SEQ ID NO: 1449919 - protein, 11 aa, Mycobacterium tuberculosis
RRGRRTARIRG

SEQ ID NO: 1449920 - protein, 20 aa, Mycobacterium tuberculosis
RRGRRTGGTGGAVSLARAGT

SEQ ID NO: 1449921 - protein, 4 aa, Mycobacterium tuberculosis
RRGS

SEQ ID NO: 1449922 - protein, 12 aa, Mycobacterium tuberculosis
RRGSHRRSATAA

SEQ ID NO: 1449923 - protein, 14 aa, Mycobacterium tuberculosis
RRGSRRARRERRCR

SEQ ID NO: 1449924 - protein, 30 aa, Mycobacterium tuberculosis
RRGVEEQRSTRQTTDTWSRQTRSAYPARSA

SEQ ID NO: 1449925 - protein, 14 aa, Mycobacterium tuberculosis
RRGVGGQPGGTLGR

SEQ ID NO: 1449926 - protein, 9 aa, Mycobacterium tuberculosis
RRGWGSGGA

SEQ ID NO: 1449927 - protein, 4 aa, Mycobacterium tuberculosis
RRHE

SEQ ID NO: 1449928 - protein, 8 aa, Mycobacterium tuberculosis
RRHPGRRS

SEQ ID NO: 1449929 - protein, 40 aa, Mycobacterium tuberculosis
RRHPRTTRLSGPERVKAGATCTPSTTRNSASELPTVTTHR

SEQ ID NO: 1449930 - protein, 12 aa, Mycobacterium tuberculosis
RRHRARGRPRRG

SEQ ID NO: 1449931 - protein, 7 aa, Mycobacterium tuberculosis
RRHRDGV

SEQ ID NO: 1449932 - protein, 19 aa, Mycobacterium tuberculosis
RRHRPRRYPTVPRTRQPRH

SEQ ID NO: 1449933 - protein, 18 aa, Mycobacterium tuberculosis
RRHRSSRTPVFPGRQADR

SEQ ID NO: 1449934 - protein, 16 aa, Mycobacterium tuberculosis
RRIRGRGQRIRRRRAV

SEQ ID NO: 1449935 - protein, 14 aa, Mycobacterium tuberculosis
RRISPDGRQHRQAG

SEQ ID NO: 1449936 - protein, 19 aa, Mycobacterium tuberculosis
RRKDTAKSDPSQGGSAGLR

SEQ ID NO: 1449937 - protein, 16 aa, Mycobacterium tuberculosis
RRKKYGRKSATDCPPN

SEQ ID NO: 1449938 - protein, 4 aa, Mycobacterium tuberculosis
RRLP

SEQ ID NO: 1449939 - protein, 13 aa, Mycobacterium tuberculosis
RRLPPTSGPTLKR

SEQ ID NO: 1449940 - protein, 9 aa, Mycobacterium tuberculosis
RRLSPQDRR

SEQ ID NO: 1449941 - protein, 22 aa, Mycobacterium tuberculosis
RRLTRAPSERSRNPALTARPRR

SEQ ID NO: 1449942 - protein, 7 aa, Mycobacterium tuberculosis
RRNAELD

SEQ ID NO: 1449943 - protein, 5 aa, Mycobacterium tuberculosis
RRNDP

SEQ ID NO: 1449944 - protein, 9 aa, Mycobacterium tuberculosis
RRNHRGHRA

SEQ ID NO: 1449945 - protein, 37 aa, Mycobacterium tuberculosis
RRNSAFADGGQGGPGGNAGTVFGSGGAGGNGGVGQGF

SEQ ID NO: 1449946 - protein, 4 aa, Mycobacterium tuberculosis
RRPA

SEQ ID NO: 1449947 - protein, 25 aa, Mycobacterium tuberculosis
RRPAEPKRGPTAPPDRGPKGPPRGF

SEQ ID NO: 1449948 - protein, 11 aa, Mycobacterium tuberculosis
RRPDSTSATCS

SEQ ID NO: 1449949 - protein, 19 aa, Mycobacterium tuberculosis
RRPDTGLGDRTAGACPTDP

SEQ ID NO: 1449950 - protein, 9 aa, Mycobacterium tuberculosis
RRPERSPCT

SEQ ID NO: 1449951 - protein, 10 aa, Mycobacterium tuberculosis
RRPGEHEAAA

SEQ ID NO: 1449952 - protein, 15 aa, Mycobacterium tuberculosis
RRPGGSHLSPGGYRS

SEQ ID NO: 1449953 - protein, 26 aa, Mycobacterium tuberculosis
RRPGRHDGGPADMRADRAGPPAQRSP

SEQ ID NO: 1449954 - protein, 14 aa, Mycobacterium tuberculosis
RRPGRPRCTSGGGR

SEQ ID NO: 1449955 - protein, 10 aa, Mycobacterium tuberculosis
RRPGSGARGR

SEQ ID NO: 1449956 - protein, 9 aa, Mycobacterium tuberculosis
RRPKLYGAG

SEQ ID NO: 1449957 - protein, 5 aa, Mycobacterium tuberculosis
RRPLE

SEQ ID NO: 1449958 - protein, 50 aa, Mycobacterium tuberculosis
RRPPRRRLPTAPAGGVDGNGGNGGNGGKGGDAQLVGDGGNGGNGGKGGAG

SEQ ID NO: 1449959 - protein, 15 aa, Mycobacterium tuberculosis
RRPQNKRSRTWTSTT

SEQ ID NO: 1449960 - protein, 14 aa, Mycobacterium tuberculosis
RRPQYGQRLTGKCR

SEQ ID NO: 1449961 - protein, 11 aa, Mycobacterium tuberculosis
RRPRDFEQSRR

SEQ ID NO: 1449962 - protein, 15 aa, Mycobacterium tuberculosis
RRPRGPGRRSAQPSR

SEQ ID NO: 1449963 - protein, 57 aa, Mycobacterium tuberculosis
RRPRHGGNGGAGGNGGDGGPSQGGGNPGFGGDGGTGGPGGVGVPDGIGGANGAQGKH

SEQ ID NO: 1449964 - protein, 8 aa, Mycobacterium tuberculosis
RRPRNHRR

SEQ ID NO: 1449965 - protein, 10 aa, Mycobacterium tuberculosis
RRPRPAAPGA

SEQ ID NO: 1449966 - protein, 12 aa, Mycobacterium tuberculosis
RRPRPARAVPTG

SEQ ID NO: 1449967 - protein, 15 aa, Mycobacterium tuberculosis
RRPRRARRTRPRRRC

SEQ ID NO: 1449968 - protein, 9 aa, Mycobacterium tuberculosis
RRPSGEADA

SEQ ID NO: 1449969 - protein, 9 aa, Mycobacterium tuberculosis
RRPSGRSTD

SEQ ID NO: 1449970 - protein, 22 aa, Mycobacterium tuberculosis
RRPTADRGAPGARPGGAAGCPP

SEQ ID NO: 1449971 - protein, 15 aa, Mycobacterium tuberculosis
RRPTGLDRRPRANWG

SEQ ID NO: 1449972 - protein, 16 aa, Mycobacterium tuberculosis
RRPTSRASRCRSPSTT

SEQ ID NO: 1449973 - protein, 21 aa, Mycobacterium tuberculosis
RRPVAPAATVPPRRQARARPP

SEQ ID NO: 1449974 - protein, 6 aa, Mycobacterium tuberculosis
RRPVSV

SEQ ID NO: 1449975 - protein, 9 aa, Mycobacterium tuberculosis
RRQDRRGVA

SEQ ID NO: 1449976 - protein, 15 aa, Mycobacterium tuberculosis
RRQGDRAGQPRRRGD

SEQ ID NO: 1449977 - protein, 12 aa, Mycobacterium tuberculosis
RRQGTYGDFGVG

SEQ ID NO: 1449978 - protein, 244 aa, Mycobacterium tuberculosis
RRQKAGPAAAPAPAAPNGFGGRPAGPADKGGAGGAGISFSNGSNGGTGGTGGVGGTGGDGGNAGTGAGDPGKGGTGGTGGTGGSGGAGGSGGANFNGGTGGTGGTGGTGGKGGMGGIAGDGGPGGDGGNAGVGGKGGTNGNGGSGGTGGTGGPGGSGGAPTGGGTGGKGGAGGDGGDGADGGAATGVGDGGDGGNGGNGGNGGTGVGSPGGLGGAGGTGGLGGAGAGGGADGDDGDDGQPGNNG

SEQ ID NO: 1449979 - protein, 18 aa, Mycobacterium tuberculosis
RRQPEGSGRRPHRELFGR

SEQ ID NO: 1449980 - protein, 13 aa, Mycobacterium tuberculosis
RRQPTHANDARNL

SEQ ID NO: 1449981 - protein, 8 aa, Mycobacterium tuberculosis
RRQQQRGT

SEQ ID NO: 1449982 - protein, 17 aa, Mycobacterium tuberculosis
RRQQQRTPSAAGDVRGG

SEQ ID NO: 1449983 - protein, 4 aa, Mycobacterium tuberculosis
RRQR

SEQ ID NO: 1449984 - protein, 12 aa, Mycobacterium tuberculosis
RRQRRGSSRRAG

SEQ ID NO: 1449985 - protein, 28 aa, Mycobacterium tuberculosis
RRQSRRQQRTDHPGQHVTGPGGGRPGLA

SEQ ID NO: 1449986 - protein, 14 aa, Mycobacterium tuberculosis
RRQTAGPGGNGGGC

SEQ ID NO: 1449987 - protein, 6 aa, Mycobacterium tuberculosis
RRQTRA

SEQ ID NO: 1449988 - protein, 4 aa, Mycobacterium tuberculosis
RRRA

SEQ ID NO: 1449989 - protein, 9 aa, Mycobacterium tuberculosis
RRRAAARAS

SEQ ID NO: 1449990 - protein, 16 aa, Mycobacterium tuberculosis
RRRADDLGRPTTAPTS

SEQ ID NO: 1449991 - protein, 9 aa, Mycobacterium tuberculosis
RRRAGPQSQ

SEQ ID NO: 1449992 - protein, 9 aa, Mycobacterium tuberculosis
RRRAGRSRR

SEQ ID NO: 1449993 - protein, 9 aa, Mycobacterium tuberculosis
RRRARAAHP

SEQ ID NO: 1449994 - protein, 13 aa, Mycobacterium tuberculosis
RRRCSAPRRHRRT

SEQ ID NO: 1449995 - protein, 6 aa, Mycobacterium tuberculosis
RRRDGQ

SEQ ID NO: 1449996 - protein, 9 aa, Mycobacterium tuberculosis
RRRDPNTDR

SEQ ID NO: 1449997 - protein, 32 aa, Mycobacterium tuberculosis
RRRDRRGPGAPAAGEPSAGASGGNGGNGGNGG

SEQ ID NO: 1449998 - protein, 12 aa, Mycobacterium tuberculosis
RRRDRRRRCRCW

SEQ ID NO: 1449999 - protein, 7 aa, Mycobacterium tuberculosis
RRREAAA

SEQ ID NO: 1450000 - protein, 6 aa, Mycobacterium tuberculosis
RRRERR

SEQ ID NO: 1450001 - protein, 11 aa, Mycobacterium tuberculosis
RRRETGGNSGH

SEQ ID NO: 1450002 - protein, 5 aa, Mycobacterium tuberculosis
RRRGA

SEQ ID NO: 1450003 - protein, 17 aa, Mycobacterium tuberculosis
RRRGCPGGHQFSQQRGS

SEQ ID NO: 1450004 - protein, 10 aa, Mycobacterium tuberculosis
RRRGFGEKPS

SEQ ID NO: 1450005 - protein, 5 aa, Mycobacterium tuberculosis
RRRGG

SEQ ID NO: 1450006 - protein, 17 aa, Mycobacterium tuberculosis
RRRGGERGGVRQGRRRV

SEQ ID NO: 1450007 - protein, 40 aa, Mycobacterium tuberculosis
RRRGGSGARRPPAPAAQPDTPPWPGRPGGHSVGYDSQGRG

SEQ ID NO: 1450008 - protein, 18 aa, Mycobacterium tuberculosis
RRRGPAAPGGRAGGWGGR

SEQ ID NO: 1450009 - protein, 6 aa, Mycobacterium tuberculosis
RRRGPG

SEQ ID NO: 1450010 - protein, 17 aa, Mycobacterium tuberculosis
RRRGRDSGHLGQPGPWG

SEQ ID NO: 1450011 - protein, 31 aa, Mycobacterium tuberculosis
RRRGSSERGIDNQRRQQGGSGCDHAGAGRGR

SEQ ID NO: 1450012 - protein, 36 aa, Mycobacterium tuberculosis
RRRGTGGAVAAGTSGAAIADQPAGPAGPAVTAGFAA

SEQ ID NO: 1450013 - protein, 4 aa, Mycobacterium tuberculosis
RRRN

SEQ ID NO: 1450014 - protein, 8 aa, Mycobacterium tuberculosis
RRRNGSAM

SEQ ID NO: 1450015 - protein, 4 aa, Mycobacterium tuberculosis
RRRP

SEQ ID NO: 1450016 - protein, 14 aa, Mycobacterium tuberculosis
RRRPEKQRRWRRGM

SEQ ID NO: 1450017 - protein, 8 aa, Mycobacterium tuberculosis
RRRPGAEN

SEQ ID NO: 1450018 - protein, 9 aa, Mycobacterium tuberculosis
RRRPGGLPH

SEQ ID NO: 1450019 - protein, 7 aa, Mycobacterium tuberculosis
RRRPGGR

SEQ ID NO: 1450020 - protein, 9 aa, Mycobacterium tuberculosis
RRRPGQHAG

SEQ ID NO: 1450021 - protein, 10 aa, Mycobacterium tuberculosis
RRRPKPSGSC

SEQ ID NO: 1450022 - protein, 11 aa, Mycobacterium tuberculosis
RRRPRRRAEDV

SEQ ID NO: 1450023 - protein, 8 aa, Mycobacterium tuberculosis
RRRPRRRV

SEQ ID NO: 1450024 - protein, 17 aa, Mycobacterium tuberculosis
RRRQRRDLEPPVRRRPR

SEQ ID NO: 1450025 - protein, 35 aa, Mycobacterium tuberculosis
RRRQRRGATTAAAAARHRRRDRRDHAGRSSAGFAG

SEQ ID NO: 1450026 - protein, 4 aa, Mycobacterium tuberculosis
RRRR

SEQ ID NO: 1450027 - protein, 5 aa, Mycobacterium tuberculosis
RRRRA

SEQ ID NO: 1450028 - protein, 17 aa, Mycobacterium tuberculosis
RRRRENPEPGRYGGEVA

SEQ ID NO: 1450029 - protein, 7 aa, Mycobacterium tuberculosis
RRRRGGQ

SEQ ID NO: 1450030 - protein, 13 aa, Mycobacterium tuberculosis
RRRRGPGVAQNPT

SEQ ID NO: 1450031 - protein, 23 aa, Mycobacterium tuberculosis
RRRRGQRRHRPATGLRAEGRTRR

SEQ ID NO: 1450032 - protein, 16 aa, Mycobacterium tuberculosis
RRRRNGSALNTSAIPA

SEQ ID NO: 1450033 - protein, 40 aa, Mycobacterium tuberculosis
RRRRPGPPSPPRPGSEPMSPCPPSPPSLPAPPSPPVPPVP

SEQ ID NO: 1450034 - protein, 17 aa, Mycobacterium tuberculosis
RRRRPPPASLTAPRPAT

SEQ ID NO: 1450035 - protein, 8 aa, Mycobacterium tuberculosis
RRRRPRRV

SEQ ID NO: 1450036 - protein, 21 aa, Mycobacterium tuberculosis
RRRRQRRPRRRRPILRSRRLR

SEQ ID NO: 1450037 - protein, 13 aa, Mycobacterium tuberculosis
RRRRRTPAAGLTA

SEQ ID NO: 1450038 - protein, 5 aa, Mycobacterium tuberculosis
RRRRT

SEQ ID NO: 1450039 - protein, 9 aa, Mycobacterium tuberculosis
RRRSGGPGE

SEQ ID NO: 1450040 - protein, 13 aa, Mycobacterium tuberculosis
RRRSPNHRPSGAP

SEQ ID NO: 1450041 - protein, 19 aa, Mycobacterium tuberculosis
RRRSRDHSRADRCGDQLPQ

SEQ ID NO: 1450042 - protein, 18 aa, Mycobacterium tuberculosis
RRRSRKRSTPASCNPSRR

SEQ ID NO: 1450043 - protein, 11 aa, Mycobacterium tuberculosis
RRRSRNAPARG

SEQ ID NO: 1450044 - protein, 57 aa, Mycobacterium tuberculosis
RRRSRRRSGGGPRDAASAQRTGSQPEPGQRAEKSMGASPQPTVRQTDDGHPAPRTDD

SEQ ID NO: 1450045 - protein, 18 aa, Mycobacterium tuberculosis
RRRTGRRRAVTERGVSRA

SEQ ID NO: 1450046 - protein, 5 aa, Mycobacterium tuberculosis
RRSAA

SEQ ID NO: 1450047 - protein, 11 aa, Mycobacterium tuberculosis
RRSAAASSRLS

SEQ ID NO: 1450048 - protein, 5 aa, Mycobacterium tuberculosis
RRSDG

SEQ ID NO: 1450049 - protein, 9 aa, Mycobacterium tuberculosis
RRSEARHPP

SEQ ID NO: 1450050 - protein, 19 aa, Mycobacterium tuberculosis
RRSGETSGGAVDFLGIKRW

SEQ ID NO: 1450051 - protein, 5 aa, Mycobacterium tuberculosis
RRSGV

SEQ ID NO: 1450052 - protein, 14 aa, Mycobacterium tuberculosis
RRSPPTKRASTRSE

SEQ ID NO: 1450053 - protein, 5 aa, Mycobacterium tuberculosis
RRSPS

SEQ ID NO: 1450054 - protein, 10 aa, Mycobacterium tuberculosis
RRSPSWKRAP

SEQ ID NO: 1450055 - protein, 33 aa, Mycobacterium tuberculosis
RRSPTTGDSTATATSMTSSPGRAAASPAKPSPW

SEQ ID NO: 1450056 - protein, 10 aa, Mycobacterium tuberculosis
RRSRASGGAY

SEQ ID NO: 1450057 - protein, 34 aa, Mycobacterium tuberculosis
RRSRPAPAVHPTPTHRAATGHQRAPPAPPACPAS

SEQ ID NO: 1450058 - protein, 44 aa, Mycobacterium tuberculosis
RRSRRADRASAAVGQPARRRRQRGRGGHARKHRGACGLPGWTGT

SEQ ID NO: 1450059 - protein, 5 aa, Mycobacterium tuberculosis
RRSRS

SEQ ID NO: 1450060 - protein, 6 aa, Mycobacterium tuberculosis
RRSSKS

SEQ ID NO: 1450061 - protein, 14 aa, Mycobacterium tuberculosis
RRSSRGFNSMPDNT

SEQ ID NO: 1450062 - protein, 31 aa, Mycobacterium tuberculosis
RRSSSSLRSASSPAVVNGAAPPHRCALHRRR

SEQ ID NO: 1450063 - protein, 11 aa, Mycobacterium tuberculosis
RRSSSTPRSPT

SEQ ID NO: 1450064 - protein, 11 aa, Mycobacterium tuberculosis
RRSTKTDTAIG

SEQ ID NO: 1450065 - protein, 17 aa, Mycobacterium tuberculosis
RRSTTGTESSPSFRRTR

SEQ ID NO: 1450066 - protein, 18 aa, Mycobacterium tuberculosis
RRSWRGRQRSRDRRRRRR

SEQ ID NO: 1450067 - protein, 5 aa, Mycobacterium tuberculosis
RRTAR

SEQ ID NO: 1450068 - protein, 21 aa, Mycobacterium tuberculosis
RRTARRQADRRGAAPGAAARR

SEQ ID NO: 1450069 - protein, 14 aa, Mycobacterium tuberculosis
RRTARSASANRAAD

SEQ ID NO: 1450070 - protein, 26 aa, Mycobacterium tuberculosis
RRTGGSGDHGTPAAVPGGAGGAGGNA

SEQ ID NO: 1450071 - protein, 23 aa, Mycobacterium tuberculosis
RRTKASRVSADQRPRTSAARAAG

SEQ ID NO: 1450072 - protein, 20 aa, Mycobacterium tuberculosis
RRTPASQEEGGEGGEDTVTI

SEQ ID NO: 1450073 - protein, 10 aa, Mycobacterium tuberculosis
RRTPGSRGIA

SEQ ID NO: 1450074 - protein, 22 aa, Mycobacterium tuberculosis
RRTPGSSGIADVPAQPMQQRRR

SEQ ID NO: 1450075 - protein, 38 aa, Mycobacterium tuberculosis
RRTPPQPPSPPDCPSGRHRHRDPRPTTRSRRRPAAFLM

SEQ ID NO: 1450076 - protein, 10 aa, Mycobacterium tuberculosis
RRTPPTPRAV

SEQ ID NO: 1450077 - protein, 8 aa, Mycobacterium tuberculosis
RRTPRPIA

SEQ ID NO: 1450078 - protein, 9 aa, Mycobacterium tuberculosis
RRTPRRRRR

SEQ ID NO: 1450079 - protein, 10 aa, Mycobacterium tuberculosis
RRTQPTSQRG

SEQ ID NO: 1450080 - protein, 26 aa, Mycobacterium tuberculosis
RRTRPGPAGVAATGPLPRPSGMDRRR

SEQ ID NO: 1450081 - protein, 9 aa, Mycobacterium tuberculosis
RRTRRRWPP

SEQ ID NO: 1450082 - protein, 8 aa, Mycobacterium tuberculosis
RRTSPGNV

SEQ ID NO: 1450083 - protein, 45 aa, Mycobacterium tuberculosis
RRTSTSRGGRRTDRQAAERRPRRASAATTQLASSTAANAFTRSSC

SEQ ID NO: 1450084 - protein, 9 aa, Mycobacterium tuberculosis
RRTTPLGAR

SEQ ID NO: 1450085 - protein, 6 aa, Mycobacterium tuberculosis
RRTTTV

SEQ ID NO: 1450086 - protein, 13 aa, Mycobacterium tuberculosis
RRVAQPARGAQEA

SEQ ID NO: 1450087 - protein, 9 aa, Mycobacterium tuberculosis
RRVARTAPN

SEQ ID NO: 1450088 - protein, 7 aa, Mycobacterium tuberculosis
RRVEGDQ

SEQ ID NO: 1450089 - protein, 34 aa, Mycobacterium tuberculosis
RRVGGRRRGRSGSGRGRGAIDREQRRGRSRKRAS

SEQ ID NO: 1450090 - protein, 23 aa, Mycobacterium tuberculosis
RRVGKQPTAGRPGHRRPAGGECC

SEQ ID NO: 1450091 - protein, 22 aa, Mycobacterium tuberculosis
RRVGTNPRPPAAAGSAGKVATS

SEQ ID NO: 1450092 - protein, 23 aa, Mycobacterium tuberculosis
RRVPAQPGQAVGAGGAAGEFIVE

SEQ ID NO: 1450093 - protein, 12 aa, Mycobacterium tuberculosis
RRVPPENSARSP

SEQ ID NO: 1450094 - protein, 9 aa, Mycobacterium tuberculosis
RRVPTSSAA

SEQ ID NO: 1450095 - protein, 15 aa, Mycobacterium tuberculosis
RRVSNRRHHRRDATP

SEQ ID NO: 1450096 - protein, 10 aa, Mycobacterium tuberculosis
RRVSRGASKS

SEQ ID NO: 1450097 - protein, 6 aa, Mycobacterium tuberculosis
RRVTGT

SEQ ID NO: 1450098 - protein, 4 aa, Mycobacterium tuberculosis
RRWE

SEQ ID NO: 1450099 - protein, 18 aa, Mycobacterium tuberculosis
RRWPPTRGCRRRRSQETT

SEQ ID NO: 1450100 - protein, 19 aa, Mycobacterium tuberculosis
RRWPPTRGCRRRRSRRPLA

SEQ ID NO: 1450101 - protein, 20 aa, Mycobacterium tuberculosis
RRWPPTRGCRRRRSRRPTRV

SEQ ID NO: 1450102 - protein, 11 aa, Mycobacterium tuberculosis
RRYPDRKTARR

SEQ ID NO: 1450103 - protein, 7 aa, Mycobacterium tuberculosis
RRYPSEP

SEQ ID NO: 1450104 - protein, 7 aa, Mycobacterium tuberculosis
RSAAGDI

SEQ ID NO: 1450105 - protein, 38 aa, Mycobacterium tuberculosis
RSAATPSSSATAATAVAGGNGGTGATPGTGGRRRRRRH

SEQ ID NO: 1450106 - protein, 5 aa, Mycobacterium tuberculosis
RSAAV

SEQ ID NO: 1450107 - protein, 5 aa, Mycobacterium tuberculosis
RSAGF

SEQ ID NO: 1450108 - protein, 8 aa, Mycobacterium tuberculosis
RSAGTVTA

SEQ ID NO: 1450109 - protein, 13 aa, Mycobacterium tuberculosis
RSAPGWRSTRGGN

SEQ ID NO: 1450110 - protein, 9 aa, Mycobacterium tuberculosis
RSAPRDSPE

SEQ ID NO: 1450111 - protein, 6 aa, Mycobacterium tuberculosis
RSAPRR

SEQ ID NO: 1450112 - protein, 24 aa, Mycobacterium tuberculosis
RSAPRSRMSSTPTGHRVFRGSPWP

SEQ ID NO: 1450113 - protein, 8 aa, Mycobacterium tuberculosis
RSAPSPTI

SEQ ID NO: 1450114 - protein, 19 aa, Mycobacterium tuberculosis
RSARSARSTASVSNSGRAA

SEQ ID NO: 1450115 - protein, 13 aa, Mycobacterium tuberculosis
RSARSVRSSRCSR

SEQ ID NO: 1450116 - protein, 5 aa, Mycobacterium tuberculosis
RSASG

SEQ ID NO: 1450117 - protein, 12 aa, Mycobacterium tuberculosis
RSASGAGRVAGL

SEQ ID NO: 1450118 - protein, 14 aa, Mycobacterium tuberculosis
RSATDYDTNKRHCA

SEQ ID NO: 1450119 - protein, 36 aa, Mycobacterium tuberculosis
RSCRPGEPPIPGDYNTSTRPADAESASAASNVTNRP

SEQ ID NO: 1450120 - protein, 21 aa, Mycobacterium tuberculosis
RSCTGNDGGDGGNGGRGGDAQ

SEQ ID NO: 1450121 - protein, 4 aa, Mycobacterium tuberculosis
RSDA

SEQ ID NO: 1450122 - protein, 14 aa, Mycobacterium tuberculosis
RSDADIAAGRPSIG

SEQ ID NO: 1450123 - protein, 11 aa, Mycobacterium tuberculosis
RSDGERSRRPR

SEQ ID NO: 1450124 - protein, 13 aa, Mycobacterium tuberculosis
RSDIGLGSVQLPA

SEQ ID NO: 1450125 - protein, 12 aa, Mycobacterium tuberculosis
RSDPAEDRRRRY

SEQ ID NO: 1450126 - protein, 16 aa, Mycobacterium tuberculosis
RSDPEFAYSDRERDGL

SEQ ID NO: 1450127 - protein, 5 aa, Mycobacterium tuberculosis
RSDTT

SEQ ID NO: 1450128 - protein, 6 aa, Mycobacterium tuberculosis
RSEARN

SEQ ID NO: 1450129 - protein, 19 aa, Mycobacterium tuberculosis
RSEQDEYAAASHQKAAAAW

SEQ ID NO: 1450130 - protein, 13 aa, Mycobacterium tuberculosis
RSFAHGPAEPRSD

SEQ ID NO: 1450131 - protein, 10 aa, Mycobacterium tuberculosis
RSFETREGEK

SEQ ID NO: 1450132 - protein, 19 aa, Mycobacterium tuberculosis
RSFGTARGDLGPGQGRHRD

SEQ ID NO: 1450133 - protein, 22 aa, Mycobacterium tuberculosis
RSGAGGRRHAGSDAVWNPPSRL

SEQ ID NO: 1450134 - protein, 7 aa, Mycobacterium tuberculosis
RSGEGRT

SEQ ID NO: 1450135 - protein, 14 aa, Mycobacterium tuberculosis
RSGFGTAAGAVGRQ

SEQ ID NO: 1450136 - protein, 12 aa, Mycobacterium tuberculosis
RSGGAAGEALSV

SEQ ID NO: 1450137 - protein, 5 aa, Mycobacterium tuberculosis
RSGGC

SEQ ID NO: 1450138 - protein, 7 aa, Mycobacterium tuberculosis
RSGGPFA

SEQ ID NO: 1450139 - protein, 21 aa, Mycobacterium tuberculosis
RSGGSDEATSTGRDARAPDIS

SEQ ID NO: 1450140 - protein, 12 aa, Mycobacterium tuberculosis
RSGGTGRSHCSQ

SEQ ID NO: 1450141 - protein, 31 aa, Mycobacterium tuberculosis
RSGHFSPDEIRNRRSRKRSQSHMPPRTPPRG

SEQ ID NO: 1450142 - protein, 8 aa, Mycobacterium tuberculosis
RSGLPDHA

SEQ ID NO: 1450143 - protein, 5 aa, Mycobacterium tuberculosis
RSGPL

SEQ ID NO: 1450144 - protein, 8 aa, Mycobacterium tuberculosis
RSGPTDGV

SEQ ID NO: 1450145 - protein, 9 aa, Mycobacterium tuberculosis
RSGQASTIE

SEQ ID NO: 1450146 - protein, 50 aa, Mycobacterium tuberculosis
RSGQRAPRTGVAARSAAPDSGSSPADRSPPPTAASRRSWTRSRAKPACSP

SEQ ID NO: 1450147 - protein, 19 aa, Mycobacterium tuberculosis
RSGRGARGSADRGNQRRRG

SEQ ID NO: 1450148 - protein, 16 aa, Mycobacterium tuberculosis
RSGRGRVARRSLGGIS

SEQ ID NO: 1450149 - protein, 6 aa, Mycobacterium tuberculosis
RSGRQL

SEQ ID NO: 1450150 - protein, 8 aa, Mycobacterium tuberculosis
RSGRVPED

SEQ ID NO: 1450151 - protein, 22 aa, Mycobacterium tuberculosis
RSGSTANTESPPMPPRRSCRRN

SEQ ID NO: 1450152 - protein, 4 aa, Mycobacterium tuberculosis
RSGT

SEQ ID NO: 1450153 - protein, 4 aa, Mycobacterium tuberculosis
RSGV

SEQ ID NO: 1450154 - protein, 8 aa, Mycobacterium tuberculosis
RSGVTPSM

SEQ ID NO: 1450155 - protein, 5 aa, Mycobacterium tuberculosis
RSGWS

SEQ ID NO: 1450156 - protein, 19 aa, Mycobacterium tuberculosis
RSHDRPRGRDRHRPGATDP

SEQ ID NO: 1450157 - protein, 20 aa, Mycobacterium tuberculosis
RSHQRSNPDDVTTRAPECRG

SEQ ID NO: 1450158 - protein, 13 aa, Mycobacterium tuberculosis
RSHRSDGDSWKGR

SEQ ID NO: 1450159 - protein, 5 aa, Mycobacterium tuberculosis
RSIAP

SEQ ID NO: 1450160 - protein, 14 aa, Mycobacterium tuberculosis
RSKAAAPGYRSRQM

SEQ ID NO: 1450161 - protein, 7 aa, Mycobacterium tuberculosis
RSKAARK

SEQ ID NO: 1450162 - protein, 7 aa, Mycobacterium tuberculosis
RSKALGE

SEQ ID NO: 1450163 - protein, 5 aa, Mycobacterium tuberculosis
RSKGF

SEQ ID NO: 1450164 - protein, 5 aa, Mycobacterium tuberculosis
RSKLA

SEQ ID NO: 1450165 - protein, 16 aa, Mycobacterium tuberculosis
RSKRPGRGKSYTLTGT

SEQ ID NO: 1450166 - protein, 28 aa, Mycobacterium tuberculosis
RSLGGGRGAGGRGGDRQHRRGHGDGHGP

SEQ ID NO: 1450167 - protein, 7 aa, Mycobacterium tuberculosis
RSLPGDG

SEQ ID NO: 1450168 - protein, 20 aa, Mycobacterium tuberculosis
RSLSSAGRVSPPVSSPVTPH

SEQ ID NO: 1450169 - protein, 18 aa, Mycobacterium tuberculosis
RSMAATDPSIPVAAYPLA

SEQ ID NO: 1450170 - protein, 4 aa, Mycobacterium tuberculosis
RSMH

SEQ ID NO: 1450171 - protein, 10 aa, Mycobacterium tuberculosis
RSNAGPERPG

SEQ ID NO: 1450172 - protein, 11 aa, Mycobacterium tuberculosis
RSNKGSNMPSK

SEQ ID NO: 1450173 - protein, 9 aa, Mycobacterium tuberculosis
RSNPEDDRA

SEQ ID NO: 1450174 - protein, 10 aa, Mycobacterium tuberculosis
RSNVQAPQSI

SEQ ID NO: 1450175 - protein, 37 aa, Mycobacterium tuberculosis
RSPASGASWSTSPPSTSTPTNASSPRVTRRSQRCPTC

SEQ ID NO: 1450176 - protein, 22 aa, Mycobacterium tuberculosis
RSPASRSPSSASGASVWQRCSP

SEQ ID NO: 1450177 - protein, 14 aa, Mycobacterium tuberculosis
RSPAVPAGSAVTAS

SEQ ID NO: 1450178 - protein, 12 aa, Mycobacterium tuberculosis
RSPDPAANPRSA

SEQ ID NO: 1450179 - protein, 14 aa, Mycobacterium tuberculosis
RSPDRDRAGQASID

SEQ ID NO: 1450180 - protein, 10 aa, Mycobacterium tuberculosis
RSPGPRRGNR

SEQ ID NO: 1450181 - protein, 19 aa, Mycobacterium tuberculosis
RSPGRSQRRVNGRSESPWP

SEQ ID NO: 1450182 - protein, 5 aa, Mycobacterium tuberculosis
RSPID

SEQ ID NO: 1450183 - protein, 5 aa, Mycobacterium tuberculosis
RSPKA

SEQ ID NO: 1450184 - protein, 9 aa, Mycobacterium tuberculosis
RSPPRTAHA

SEQ ID NO: 1450185 - protein, 23 aa, Mycobacterium tuberculosis
RSPQGEPPSPEPAASKPPTPPMP

SEQ ID NO: 1450186 - protein, 14 aa, Mycobacterium tuberculosis
RSPRCAREQTHKRP

SEQ ID NO: 1450187 - protein, 6 aa, Mycobacterium tuberculosis
RSPRRV

SEQ ID NO: 1450188 - protein, 8 aa, Mycobacterium tuberculosis
RSPRTPYH

SEQ ID NO: 1450189 - protein, 13 aa, Mycobacterium tuberculosis
RSPSLSPQSGCSE

SEQ ID NO: 1450190 - protein, 5 aa, Mycobacterium tuberculosis
RSPVR

SEQ ID NO: 1450191 - protein, 4 aa, Mycobacterium tuberculosis
RSQC

SEQ ID NO: 1450192 - protein, 12 aa, Mycobacterium tuberculosis
RSQQGLYASTRP

SEQ ID NO: 1450193 - protein, 9 aa, Mycobacterium tuberculosis
RSQRAIPRR

SEQ ID NO: 1450194 - protein, 9 aa, Mycobacterium tuberculosis
RSQTRRSRV

SEQ ID NO: 1450195 - protein, 32 aa, Mycobacterium tuberculosis; identical to SEQ ID NO: 153756

SEQ ID NO: 1450196 - protein, 15 aa, Mycobacterium tuberculosis
RSRAAGANDGPCGKS

SEQ ID NO: 1450197 - protein, 21 aa, Mycobacterium tuberculosis
RSRAGRPRARVPARPSIQART

SEQ ID NO: 1450198 - protein, 11 aa, Mycobacterium tuberculosis
RSRDRRSDDQW

SEQ ID NO: 1450199 - protein, 5 aa, Mycobacterium tuberculosis
RSREM

SEQ ID NO: 1450200 - protein, 21 aa, Mycobacterium tuberculosis
RSRFPGGSRSPPTPARTWPEP

SEQ ID NO: 1450201 - protein, 7 aa, Mycobacterium tuberculosis
RSRGGDL

SEQ ID NO: 1450202 - protein, 7 aa, Mycobacterium tuberculosis
RSRLPRK

SEQ ID NO: 1450203 - protein, 52 aa, Mycobacterium tuberculosis
RSRNGLPRPSRGRRRWRSGQRGGAAGAFGRPGGAPRRGRKSKRQKRQEYDSM

SEQ ID NO: 1450204 - protein, 19 aa, Mycobacterium tuberculosis
RSRPGVDVGEPSGCGPRTV

SEQ ID NO: 1450205 - protein, 16 aa, Mycobacterium tuberculosis
RSRPLPAAGSDRRRVC

SEQ ID NO: 1450206 - protein, 9 aa, Mycobacterium tuberculosis
RSRRGAPAL

SEQ ID NO: 1450207 - protein, 13 aa, Mycobacterium tuberculosis
RSRRSQWKAAKTE

SEQ ID NO: 1450208 - protein, 12 aa, Mycobacterium tuberculosis
RSRTGTLTGPPA

SEQ ID NO: 1450209 - protein, 6 aa, Mycobacterium tuberculosis
RSRTIA

SEQ ID NO: 1450210 - protein, 8 aa, Mycobacterium tuberculosis
RSRVSSDV

SEQ ID NO: 1450211 - protein, 6 aa, Mycobacterium tuberculosis
RSSADA

SEQ ID NO: 1450212 - protein, 14 aa, Mycobacterium tuberculosis
RSSADQRPSPDGSG

SEQ ID NO: 1450213 - protein, 7 aa, Mycobacterium tuberculosis
RSSEASV

SEQ ID NO: 1450214 - protein, 11 aa, Mycobacterium tuberculosis
RSSGHREGPDG

SEQ ID NO: 1450215 - protein, 49 aa, Mycobacterium tuberculosis
RSSKARGAWRASRATAGYSSAARRAGDRAGRQARLGNNPELPGARAALG

SEQ ID NO: 1450216 - protein, 14 aa, Mycobacterium tuberculosis
RSSPTTMQSAQRDE

SEQ ID NO: 1450217 - protein, 10 aa, Mycobacterium tuberculosis
RSSQQPLPPS

SEQ ID NO: 1450218 - protein, 17 aa, Mycobacterium tuberculosis
RSSQTSGMLRRRRAGWA

SEQ ID NO: 1450219 - protein, 9 aa, Mycobacterium tuberculosis
RSSSPIGQV

SEQ ID NO: 1450220 - protein, 16 aa, Mycobacterium tuberculosis
RSSSQCGPASTTTRKS

SEQ ID NO: 1450221 - protein, 14 aa, Mycobacterium tuberculosis
RSSSSLRSASSPAV

SEQ ID NO: 1450222 - protein, 11 aa, Mycobacterium tuberculosis
RSSSTTPTPRR

SEQ ID NO: 1450223 - protein, 8 aa, Mycobacterium tuberculosis
RSSTRPPA

SEQ ID NO: 1450224 - protein, 13 aa, Mycobacterium tuberculosis
RSSTSTASRTKTT

SEQ ID NO: 1450225 - protein, 18 aa, Mycobacterium tuberculosis
RSTCAGRASRCKPRVHRR

SEQ ID NO: 1450226 - protein, 12 aa, Mycobacterium tuberculosis
RSTCDEKENVDL

SEQ ID NO: 1450227 - protein, 13 aa, Mycobacterium tuberculosis
RSTCGRTARTVRR

SEQ ID NO: 1450228 - protein, 12 aa, Mycobacterium tuberculosis
RSTGGRTTPETA

SEQ ID NO: 1450229 - protein, 8 aa, Mycobacterium tuberculosis
RSTKPGGR

SEQ ID NO: 1450230 - protein, 17 aa, Mycobacterium tuberculosis
RSTLGHRNPASTATAHA

SEQ ID NO: 1450231 - protein, 9 aa, Mycobacterium tuberculosis
RSTNGQAKA

SEQ ID NO: 1450232 - protein, 10 aa, Mycobacterium tuberculosis
RSTNGQAKAE

SEQ ID NO: 1450233 - protein, 12 aa, Mycobacterium tuberculosis
RSTTAMDTPHGQ

SEQ ID NO: 1450234 - protein, 7 aa, Mycobacterium tuberculosis
RSVDPSR

SEQ ID NO: 1450235 - protein, 14 aa, Mycobacterium tuberculosis
RSVGRTATRSPRPC

SEQ ID NO: 1450236 - protein, 14 aa, Mycobacterium tuberculosis
RSVQGRSREDLTRK

SEQ ID NO: 1450237 - protein, 5 aa, Mycobacterium tuberculosis
RSVRS

SEQ ID NO: 1450238 - protein, 8 aa, Mycobacterium tuberculosis
RSWGPPGP

SEQ ID NO: 1450239 - protein, 19 aa, Mycobacterium tuberculosis
RSWTPRPARSRRIAASRWA

SEQ ID NO: 1450240 - protein, 7 aa, Mycobacterium tuberculosis
RSYPNRM

SEQ ID NO: 1450241 - protein, 19 aa, Mycobacterium tuberculosis
RSYRPSTSARSGSRWKAPK

SEQ ID NO: 1450242 - protein, 10 aa, Mycobacterium tuberculosis
RTAAGHQQGA

SEQ ID NO: 1450243 - protein, 4 aa, Mycobacterium tuberculosis
RTAG

SEQ ID NO: 1450244 - protein, 13 aa, Mycobacterium tuberculosis
RTAGAAQAAGVPN

SEQ ID NO: 1450245 - protein, 11 aa, Mycobacterium tuberculosis
RTAGGDGRHHR

SEQ ID NO: 1450246 - protein, 32 aa, Mycobacterium tuberculosis
RTAGTAAPAGRAGPGGSAKPGGPAGPAGPAVT

SEQ ID NO: 1450247 - protein, 12 aa, Mycobacterium tuberculosis
RTAHGDEDYSGP

SEQ ID NO: 1450248 - protein, 13 aa, Mycobacterium tuberculosis
RTAISPAAAYAPS

SEQ ID NO: 1450249 - protein, 18 aa, Mycobacterium tuberculosis
RTAPPPRTGRFAGHRRRQ

SEQ ID NO: 1450250 - protein, 8 aa, Mycobacterium tuberculosis
RTAPSRSA

SEQ ID NO: 1450251 - protein, 32 aa, Mycobacterium tuberculosis
RTAPTTARSSKSRSPMTPRSPAPGCAATAWKA

SEQ ID NO: 1450252 - protein, 26 aa, Mycobacterium tuberculosis
RTARPASAPPAVTEATAGTAVTVGTA

SEQ ID NO: 1450253 - protein, 16 aa, Mycobacterium tuberculosis
RTASGSSAGSLEKGPV

SEQ ID NO: 1450254 - protein, 15 aa, Mycobacterium tuberculosis
RTATPPGTETGAGHG

SEQ ID NO: 1450255 - protein, 17 aa, Mycobacterium tuberculosis
RTATPPGTETGAGHGSN

SEQ ID NO: 1450256 - protein, 6 aa, Mycobacterium tuberculosis
RTCEQR

SEQ ID NO: 1450257 - protein, 7 aa, Mycobacterium tuberculosis
RTDDAHR

SEQ ID NO: 1450258 - protein, 12 aa, Mycobacterium tuberculosis
RTDRANHRAQPA

SEQ ID NO: 1450259 - protein, 17 aa, Mycobacterium tuberculosis
RTDSRESGKKSQEPDQR

SEQ ID NO: 1450260 - protein, 5 aa, Mycobacterium tuberculosis
RTGAE

SEQ ID NO: 1450261 - protein, 9 aa, Mycobacterium tuberculosis
RTGDTHEVH

SEQ ID NO: 1450262 - protein, 13 aa, Mycobacterium tuberculosis
RTGFSREEQQRLA

SEQ ID NO: 1450263 - protein, 26 aa, Mycobacterium tuberculosis
RTGGHPVRSRRATGGHRAAAAHGFRP

SEQ ID NO: 1450264 - protein, 10 aa, Mycobacterium tuberculosis
RTGGQYPDEI

SEQ ID NO: 1450265 - protein, 6 aa, Mycobacterium tuberculosis
RTGKLG

SEQ ID NO: 1450266 - protein, 11 aa, Mycobacterium tuberculosis
RTGRAAQAAQL

SEQ ID NO: 1450267 - protein, 21 aa, Mycobacterium tuberculosis
RTGRRHTHQPSAASFGSDSPG

SEQ ID NO: 1450268 - protein, 4 aa, Mycobacterium tuberculosis
RTGV

SEQ ID NO: 1450269 - protein, 19 aa, Mycobacterium tuberculosis
RTGVGRNRSRTDRVGGSLG

SEQ ID NO: 1450270 - protein, 6 aa, Mycobacterium tuberculosis
RTHEAN

SEQ ID NO: 1450271 - protein, 19 aa, Mycobacterium tuberculosis
RTHPHNRAHTDTMQNSNPA

SEQ ID NO: 1450272 - protein, 19 aa, Mycobacterium tuberculosis
RTHPHNRAHTNTMQNSKPA

SEQ ID NO: 1450273 - protein, 31 aa, Mycobacterium tuberculosis
RTIARRSDRWDASTAKSRDQLDDDNAAQRRG

SEQ ID NO: 1450274 - protein, 7 aa, Mycobacterium tuberculosis
RTIASRS

SEQ ID NO: 1450275 - protein, 7 aa, Mycobacterium tuberculosis
RTKDAAN

SEQ ID NO: 1450276 - protein, 6 aa, Mycobacterium tuberculosis
RTLTPT

SEQ ID NO: 1450277 - protein, 9 aa, Mycobacterium tuberculosis
RTNERARLR

SEQ ID NO: 1450278 - protein, 27 aa, Mycobacterium tuberculosis
RTNNPWDAARTSGGSAGGGAAATAAGL

SEQ ID NO: 1450279 - protein, 6 aa, Mycobacterium tuberculosis
RTNPAV

SEQ ID NO: 1450280 - protein, 11 aa, Mycobacterium tuberculosis
RTPAGGGDAHN

SEQ ID NO: 1450281 - protein, 12 aa, Mycobacterium tuberculosis
RTPCRGSALPTA

SEQ ID NO: 1450282 - protein, 7 aa, Mycobacterium tuberculosis
RTPPPCS

SEQ ID NO: 1450283 - protein, 17 aa, Mycobacterium tuberculosis
RTPPRSPPPRPPPGSAV

SEQ ID NO: 1450284 - protein, 8 aa, Mycobacterium tuberculosis
RTPPYPTA

SEQ ID NO: 1450285 - protein, 25 aa, Mycobacterium tuberculosis
RTPRSKPTKPGAPGSMGDEPAGPGF

SEQ ID NO: 1450286 - protein, 10 aa, Mycobacterium tuberculosis
RTPYKGAATT

SEQ ID NO: 1450287 - protein, 7 aa, Mycobacterium tuberculosis
RTQDAAN

SEQ ID NO: 1450288 - protein, 5 aa, Mycobacterium tuberculosis
RTRAA

SEQ ID NO: 1450289 - protein, 15 aa, Mycobacterium tuberculosis
RTRAGIERGIAGELD

SEQ ID NO: 1450290 - protein, 5 aa, Mycobacterium tuberculosis
RTRDE

SEQ ID NO: 1450291 - protein, 6 aa, Mycobacterium tuberculosis
RTRDRR

SEQ ID NO: 1450292 - protein, 5 aa, Mycobacterium tuberculosis
RTREP

SEQ ID NO: 1450293 - protein, 6 aa, Mycobacterium tuberculosis
RTRGQG

SEQ ID NO: 1450294 - protein, 36 aa, Mycobacterium tuberculosis
RTRPMAPTALPDPMATGPTPARAATQSTPAWAVVQA

SEQ ID NO: 1450295 - protein, 25 aa, Mycobacterium tuberculosis
RTRPPAGAAPGAAPSPAAPRPGPQR

SEQ ID NO: 1450296 - protein, 15 aa, Mycobacterium tuberculosis
RTRPPRSSRTSSSTT

SEQ ID NO: 1450297 - protein, 7 aa, Mycobacterium tuberculosis
RTRRPPV

SEQ ID NO: 1450298 - protein, 13 aa, Mycobacterium tuberculosis
RTRRRRDRQRRTD

SEQ ID NO: 1450299 - protein, 17 aa, Mycobacterium tuberculosis
RTRRRRTTLTPNDRGIA

SEQ ID NO: 1450300 - protein, 7 aa, Mycobacterium tuberculosis
RTRSDGN

SEQ ID NO: 1450301 - protein, 6 aa, Mycobacterium tuberculosis
RTRTEP

SEQ ID NO: 1450302 - protein, 9 aa, Mycobacterium tuberculosis
RTSARAAAR

SEQ ID NO: 1450303 - protein, 7 aa, Mycobacterium tuberculosis
RTSGEQR

SEQ ID NO: 1450304 - protein, 8 aa, Mycobacterium tuberculosis
RTSGRADT

SEQ ID NO: 1450305 - protein, 13 aa, Mycobacterium tuberculosis
RTSRRRPGTSRRD

SEQ ID NO: 1450306 - protein, 13 aa, Mycobacterium tuberculosis
RTSSASRAQGSAQ

SEQ ID NO: 1450307 - protein, 8 aa, Mycobacterium tuberculosis
RTSTGARL

SEQ ID NO: 1450308 - protein, 19 aa, Mycobacterium tuberculosis
RTSWGSTHRQSWRPKPSMP

SEQ ID NO: 1450309 - protein, 13 aa, Mycobacterium tuberculosis
RTSYRAGAAGTSN

SEQ ID NO: 1450310 - protein, 9 aa, Mycobacterium tuberculosis
RTTKGCQLT

SEQ ID NO: 1450311 - protein, 5 aa, Mycobacterium tuberculosis
RTTRG

SEQ ID NO: 1450312 - protein, 10 aa, Mycobacterium tuberculosis
RTTRQRPPHI

SEQ ID NO: 1450313 - protein, 26 aa, Mycobacterium tuberculosis
RTTTPTVGAATTATGWRPDPTGRHEG

SEQ ID NO: 1450314 - protein, 17 aa, Mycobacterium tuberculosis
RTTVPSRHHQDGISHPA

SEQ ID NO: 1450315 - protein, 4 aa, Mycobacterium tuberculosis
RTWP

SEQ ID NO: 1450316 - protein, 12 aa, Mycobacterium tuberculosis
RVADGQSLSDTE

SEQ ID NO: 1450317 - protein, 5 aa, Mycobacterium tuberculosis
RVADP

SEQ ID NO: 1450318 - protein, 7 aa, Mycobacterium tuberculosis
RVAHGRN

SEQ ID NO: 1450319 - protein, 16 aa, Mycobacterium tuberculosis
RVATSKSGFVGLPKTL

SEQ ID NO: 1450320 - protein, 9 aa, Mycobacterium tuberculosis
RVDESRRRR

SEQ ID NO: 1450321 - protein, 4 aa, Mycobacterium tuberculosis
RVDP

SEQ ID NO: 1450322 - protein, 5 aa, Mycobacterium tuberculosis
RVDQS

SEQ ID NO: 1450323 - protein, 14 aa, Mycobacterium tuberculosis
RVEDPVGSQPQVGH

SEQ ID NO: 1450324 - protein, 8 aa, Mycobacterium tuberculosis
RVERRSRR

SEQ ID NO: 1450325 - protein, 19 aa, Mycobacterium tuberculosis
RVGARADERLRSGVPLGGS

SEQ ID NO: 1450326 - protein, 34 aa, Mycobacterium tuberculosis
RVGASGLVDGQRRATGGNGGTGGSGGVGGNGRHR

SEQ ID NO: 1450327 - protein, 6 aa, Mycobacterium tuberculosis
RVGDAG

SEQ ID NO: 1450328 - protein, 5 aa, Mycobacterium tuberculosis
RVGDD

SEQ ID NO: 1450329 - protein, 22 aa, Mycobacterium tuberculosis
RVGEDAAAKRPGDLAEHRRGGQ

SEQ ID NO: 1450330 - protein, 17 aa, Mycobacterium tuberculosis
RVGGGAAASQERRRPQR

SEQ ID NO: 1450331 - protein, 9 aa, Mycobacterium tuberculosis
RVGKRAGKR

SEQ ID NO: 1450332 - protein, 31 aa, Mycobacterium tuberculosis
RVGPPDAAGGAGARTARRSRHEAAICPCRRT

SEQ ID NO: 1450333 - protein, 11 aa, Mycobacterium tuberculosis
RVGRSPGSAVG

SEQ ID NO: 1450334 - protein, 20 aa, Mycobacterium tuberculosis
RVGTPQPGCSDGANPGDRRR

SEQ ID NO: 1450335 - protein, 9 aa, Mycobacterium tuberculosis
RVKESAPWS

SEQ ID NO: 1450336 - protein, 20 aa, Mycobacterium tuberculosis
RVNASQGAAAAPTANGPGGV

SEQ ID NO: 1450337 - protein, 5 aa, Mycobacterium tuberculosis
RVPRE

SEQ ID NO: 1450338 - protein, 18 aa, Mycobacterium tuberculosis
RVPTRENRDRIQRAGRID

SEQ ID NO: 1450339 - protein, 14 aa, Mycobacterium tuberculosis
RVQPSGKGGMRPGV

SEQ ID NO: 1450340 - protein, 13 aa, Mycobacterium tuberculosis
RVRGSSSHTPWPS

SEQ ID NO: 1450341 - protein, 6 aa, Mycobacterium tuberculosis
RVRPGQ

SEQ ID NO: 1450342 - protein, 8 aa, Mycobacterium tuberculosis
RVRPGSDS

SEQ ID NO: 1450343 - protein, 26 aa, Mycobacterium tuberculosis
RVSRSAGASVCPSSRRVDRGSKAVRA

SEQ ID NO: 1450344 - protein, 62 aa, Mycobacterium tuberculosis
RVTAGDGRAREGDGGRGAGGLTSGGVGSSGESGGSGNGRGDPGSGGSGGEGGEGGPSISVNV

SEQ ID NO: 1450345 - protein, 6 aa, Mycobacterium tuberculosis
RVTDRY

SEQ ID NO: 1450346 - protein, 30 aa, Mycobacterium tuberculosis
RVTSTSPTRCDSRSHTWASASARRTCHGST

SEQ ID NO: 1450347 - protein, 10 aa, Mycobacterium tuberculosis
RWGRQADRAR

SEQ ID NO: 1450348 - protein, 9 aa, Mycobacterium tuberculosis
RWPADSGGR

SEQ ID NO: 1450349 - protein, 16 aa, Mycobacterium tuberculosis
RWPGPGAGRQKAARPH

SEQ ID NO: 1450350 - protein, 16 aa, Mycobacterium tuberculosis
RWPGQDTAPASACRAA

SEQ ID NO: 1450351 - protein, 24 aa, Mycobacterium tuberculosis
RWPPPWSSTRSSKPSGPANKKAYS

SEQ ID NO: 1450352 - protein, 6 aa, Mycobacterium tuberculosis
RWPTGS

SEQ ID NO: 1450353 - protein, 10 aa, Mycobacterium tuberculosis
RWTPSRPATG

SEQ ID NO: 1450354 - protein, 22 aa, Mycobacterium tuberculosis
RYEEPGSGLNRAARRASGAHGR

SEQ ID NO: 1450355 - protein, 20 aa, Mycobacterium tuberculosis
RYGRPGGWQQAQQPDASGAA

SEQ ID NO: 1450356 - protein, 19 aa, Mycobacterium tuberculosis
RYPDPSGATGGIGGPGGAA

SEQ ID NO: 1450357 - protein, 8 aa, Mycobacterium tuberculosis
RYPERPDI

SEQ ID NO: 1450358 - protein, 9 aa, Mycobacterium tuberculosis
RYPGDAARR

SEQ ID NO: 1450359 - protein, 6 aa, Mycobacterium tuberculosis
RYQPTG

SEQ ID NO: 1450360 - protein, 21 aa, Mycobacterium tuberculosis
RYSGSSGNRPRDGLSPTNPLQ

SEQ ID NO: 1450361 - protein, 14 aa, Mycobacterium tuberculosis
RYSPRRSTGRSGCG

SEQ ID NO: 1450362 - protein, 11 aa, Mycobacterium tuberculosis
RYTAEANAAFE

SEQ ID NO: 1450363 - protein, 18 aa, Mycobacterium tuberculosis
RYTSSGQQPVEDQRSARC

SEQ ID NO: 1450364 - protein, 24 aa, Mycobacterium tuberculosis
SAAAAADPGPGDAPRRRRASAATF

SEQ ID NO: 1450365 - protein, 28 aa, Mycobacterium tuberculosis
SAAAAGQARAAAAVDAARRAAERSCRGA

SEQ ID NO: 1450366 - protein, 12 aa, Mycobacterium tuberculosis
SAAARPGTTSPE

SEQ ID NO: 1450367 - protein, 5 aa, Mycobacterium tuberculosis
SAADH

SEQ ID NO: 1450368 - protein, 19 aa, Mycobacterium tuberculosis
SAADSRETQISRCWRLVAR

SEQ ID NO: 1450369 - protein, 12 aa, Mycobacterium tuberculosis
SAAELATALGVP

SEQ ID NO: 1450370 - protein, 7 aa, Mycobacterium tuberculosis
SAAGAAS

SEQ ID NO: 1450371 - protein, 15 aa, Mycobacterium tuberculosis
SAAGSSVGKGESLRD

SEQ ID NO: 1450372 - protein, 9 aa, Mycobacterium tuberculosis
SAAGSYAAA

SEQ ID NO: 1450373 - protein, 6 aa, Mycobacterium tuberculosis
SAAKAL

SEQ ID NO: 1450374 - protein, 14 aa, Mycobacterium tuberculosis
SAAKGTGAYAGPRY

SEQ ID NO: 1450375 - protein, 9 aa, Mycobacterium tuberculosis
SAAKTGADR

SEQ ID NO: 1450376 - protein, 12 aa, Mycobacterium tuberculosis
SAARSPARGSPA

SEQ ID NO: 1450377 - protein, 21 aa, Mycobacterium tuberculosis
SAARSSPSSPPRSRRRPSLSP

SEQ ID NO: 1450378 - protein, 13 aa, Mycobacterium tuberculosis
SAASPSPEIPPAA

SEQ ID NO: 1450379 - protein, 15 aa, Mycobacterium tuberculosis
SAASRSRRPARREPR

SEQ ID NO: 1450380 - protein, 15 aa, Mycobacterium tuberculosis
SAASSAASSSFPDPT

SEQ ID NO: 1450381 - protein, 10 aa, Mycobacterium tuberculosis
SAASSPGQWP

SEQ ID NO: 1450382 - protein, 7 aa, Mycobacterium tuberculosis
SAASVSW

SEQ ID NO: 1450383 - protein, 12 aa, Mycobacterium tuberculosis
SAATAGAGHRCP

SEQ ID NO: 1450384 - protein, 11 aa, Mycobacterium tuberculosis
SAATAPPVPNG

SEQ ID NO: 1450385 - protein, 6 aa, Mycobacterium tuberculosis
SAATDL

SEQ ID NO: 1450386 - protein, 21 aa, Mycobacterium tuberculosis
SAATHADGRVSNPVRVKSDEL

SEQ ID NO: 1450387 - protein, 28 aa, Mycobacterium tuberculosis
SAATRSPRRAAARKPARAAQVVGYQGEV

SEQ ID NO: 1450388 - protein, 17 aa, Mycobacterium tuberculosis
SACPRTQSEARRELGGV

SEQ ID NO: 1450389 - protein, 26 aa, Mycobacterium tuberculosis
SADATAMPDVAPASAPAAAVDGDPAT

SEQ ID NO: 1450390 - protein, 9 aa, Mycobacterium tuberculosis
SADDSETVR

SEQ ID NO: 1450391 - protein, 4 aa, Mycobacterium tuberculosis
SADI

SEQ ID NO: 1450392 - protein, 41 aa, Mycobacterium tuberculosis
SADPAAPFPPLPPAPPLPTRPASPPLPAIPAEPPEAPFMTP

SEQ ID NO: 1450393 - protein, 8 aa, Mycobacterium tuberculosis
SADPAKPI

SEQ ID NO: 1450394 - protein, 12 aa, Mycobacterium tuberculosis
SADRVPRWADRT

SEQ ID NO: 1450395 - protein, 16 aa, Mycobacterium tuberculosis
SADSYAATEAANIIAV

SEQ ID NO: 1450396 - protein, 10 aa, Mycobacterium tuberculosis
SAEANNAAPL

SEQ ID NO: 1450397 - protein, 14 aa, Mycobacterium tuberculosis
SAEAPSTGTGPNAA

SEQ ID NO: 1450398 - protein, 19 aa, Mycobacterium tuberculosis
SAEATNAAPLATLEHNVLN

SEQ ID NO: 1450399 - protein, 7 aa, Mycobacterium tuberculosis
SAEGDDD

SEQ ID NO: 1450400 - protein, 9 aa, Mycobacterium tuberculosis
SAEIRRGGA

SEQ ID NO: 1450401 - protein, 21 aa, Mycobacterium tuberculosis
SAELANASSAASRVDHALGLI

SEQ ID NO: 1450402 - protein, 4 aa, Mycobacterium tuberculosis
SAEQ

SEQ ID NO: 1450403 - protein, 12 aa, Mycobacterium tuberculosis
SAERTPAGCTDG

SEQ ID NO: 1450404 - protein, 6 aa, Mycobacterium tuberculosis
SAFPPA

SEQ ID NO: 1450405 - protein, 15 aa, Mycobacterium tuberculosis
SAGAGAYANAEAANV

SEQ ID NO: 1450406 - protein, 19 aa, Mycobacterium tuberculosis
SAGAGAYANARGRQRSAEF

SEQ ID NO: 1450407 - protein, 30 aa, Mycobacterium tuberculosis
SAGAGGAAGTADPTGPTTCAAGAASAAGAA

SEQ ID NO: 1450408 - protein, 6 aa, Mycobacterium tuberculosis
SAGEAM

SEQ ID NO: 1450409 - protein, 11 aa, Mycobacterium tuberculosis
SAGGAPQDEGA

SEQ ID NO: 1450410 - protein, 23 aa, Mycobacterium tuberculosis
SAGGPGAVARPRSDPGGPQQRSR

SEQ ID NO: 1450411 - protein, 18 aa, Mycobacterium tuberculosis
SAGGVEHGEVDGGAGGVE

SEQ ID NO: 1450412 - protein, 9 aa, Mycobacterium tuberculosis
SAGHHDPAS

SEQ ID NO: 1450413 - protein, 6 aa, Mycobacterium tuberculosis
SAGKVG

SEQ ID NO: 1450414 - protein, 18 aa, Mycobacterium tuberculosis
SAGLNRPGMSGDSSSWKG

SEQ ID NO: 1450415 - protein, 62 aa, Mycobacterium tuberculosis
SAGMLSGSGGSGGAGGSGGPAGTAAGGAGGAGGAPGLIGNGGNGGNGGESGGTGGVGGAGGN

SEQ ID NO: 1450416 - protein, 5 aa, Mycobacterium tuberculosis
SAGNL

SEQ ID NO: 1450417 - protein, 21 aa, Mycobacterium tuberculosis
SAGPADLSTATAAPAGSAASE

SEQ ID NO: 1450418 - protein, 16 aa, Mycobacterium tuberculosis
SAGPGPGSLQAAAAGW

SEQ ID NO: 1450419 - protein, 19 aa, Mycobacterium tuberculosis
SAGPHRQGTGRQDPGQARR

SEQ ID NO: 1450420 - protein, 16 aa, Mycobacterium tuberculosis
SAGPVGPEATASPVSR

SEQ ID NO: 1450421 - protein, 22 aa, Mycobacterium tuberculosis
SAGPVGPEATASPVSRVRRPAH

SEQ ID NO: 1450422 - protein, 8 aa, Mycobacterium tuberculosis
SAGQGADE

SEQ ID NO: 1450423 - protein, 17 aa, Mycobacterium tuberculosis
SAGRPSRRRLDRLAAVL

SEQ ID NO: 1450424 - protein, 7 aa, Mycobacterium tuberculosis
SAGRRGA

SEQ ID NO: 1450425 - protein, 15 aa, Mycobacterium tuberculosis
SAGSHSNCTAGGLVN

SEQ ID NO: 1450426 - protein, 19 aa, Mycobacterium tuberculosis
SAGSPSPEIPPGGNLRRVI

SEQ ID NO: 1450427 - protein, 8 aa, Mycobacterium tuberculosis
SAGTSGTA

SEQ ID NO: 1450428 - protein, 19 aa, Mycobacterium tuberculosis
SAGTYAATEAANSSAAALP

SEQ ID NO: 1450429 - protein, 13 aa, Mycobacterium tuberculosis
SAGVDDAKEYNSV

SEQ ID NO: 1450430 - protein, 17 aa, Mycobacterium tuberculosis
SAGVQARNPKYSSYLPT

SEQ ID NO: 1450431 - protein, 7 aa, Mycobacterium tuberculosis
SAGYDDV

SEQ ID NO: 1450432 - protein, 6 aa, Mycobacterium tuberculosis
SAHAYP

SEQ ID NO: 1450433 - protein, 5 aa, Mycobacterium tuberculosis
SAHGA

SEQ ID NO: 1450434 - protein, 7 aa, Mycobacterium tuberculosis
SAISASD

SEQ ID NO: 1450435 - protein, 7 aa, Mycobacterium tuberculosis
SAKERPR

SEQ ID NO: 1450436 - protein, 7 aa, Mycobacterium tuberculosis
SAKPSPS

SEQ ID NO: 1450437 - protein, 10 aa, Mycobacterium tuberculosis
SALAAQAGRL

SEQ ID NO: 1450438 - protein, 5 aa, Mycobacterium tuberculosis
SALAD

SEQ ID NO: 1450439 - protein, 9 aa, Mycobacterium tuberculosis
SALAGGAGS

SEQ ID NO: 1450440 - protein, 26 aa, Mycobacterium tuberculosis
SALARRADRRAARHGGADARRAGIPQ

SEQ ID NO: 1450441 - protein, 23 aa, Mycobacterium tuberculosis
SALDDDDAAKSSLVRAPALLTTP

SEQ ID NO: 1450442 - protein, 28 aa, Mycobacterium tuberculosis
SALPPAPPLPPPPPAPPVPPTPPVPPLP

SEQ ID NO: 1450443 - protein, 15 aa, Mycobacterium tuberculosis
SALPPGRAAGQDANH

SEQ ID NO: 1450444 - protein, 31 aa, Mycobacterium tuberculosis
SALPPLASKAGSGRQAVPGRSSIPPSRGGPS

SEQ ID NO: 1450445 - protein, 9 aa, Mycobacterium tuberculosis
SALSPPDRH

SEQ ID NO: 1450446 - protein, 8 aa, Mycobacterium tuberculosis
SALSREEV

SEQ ID NO: 1450447 - protein, 16 aa, Mycobacterium tuberculosis
SALTSNGGAVGSGGDA

SEQ ID NO: 1450448 - protein, 57 aa, Mycobacterium tuberculosis
SANATNPGENGPNGNPGGNGGAGGAGGAGLNGGNGGAGGNGGLGGFGGNGAAGANGV

SEQ ID NO: 1450449 - protein, 11 aa, Mycobacterium tuberculosis
SANEADAAQQF

SEQ ID NO: 1450450 - protein, 9 aa, Mycobacterium tuberculosis
SANHGSPNV

SEQ ID NO: 1450451 - protein, 5 aa, Mycobacterium tuberculosis
SANPR

SEQ ID NO: 1450452 - protein, 7 aa, Mycobacterium tuberculosis
SANRPTT

SEQ ID NO: 1450453 - protein, 22 aa, Mycobacterium tuberculosis
SANSAAWPPGKKPRPPPTAPPW

SEQ ID NO: 1450454 - protein, 27 aa, Mycobacterium tuberculosis
SANSSTVPLSGRQTQNPERGRKRPVDG

SEQ ID NO: 1450455 - protein, 8 aa, Mycobacterium tuberculosis
SAPAAQAA

SEQ ID NO: 1450456 - protein, 43 aa, Mycobacterium tuberculosis
SAPAARSASPTPARPAVPGRDPVGGIGGAGGVGGAGGAAGAVT

SEQ ID NO: 1450457 - protein, 10 aa, Mycobacterium tuberculosis
SAPAASLGIS

SEQ ID NO: 1450458 - protein, 28 aa, Mycobacterium tuberculosis
SAPAGPAASADSRPTPVTAGPAETAGCS

SEQ ID NO: 1450459 - protein, 21 aa, Mycobacterium tuberculosis
SAPAPPAPPAPPFPPVPPVPP

SEQ ID NO: 1450460 - protein, 29 aa, Mycobacterium tuberculosis
SAPATRRRGVQARSDRRRIGDGGGRRRLP

SEQ ID NO: 1450461 - protein, 29 aa, Mycobacterium tuberculosis
SAPATSGSSIPGPATSASGTPAASTPGSV

SEQ ID NO: 1450462 - protein, 8 aa, Mycobacterium tuberculosis
SAPATVSE

SEQ ID NO: 1450463 - protein, 6 aa, Mycobacterium tuberculosis
SAPATW

SEQ ID NO: 1450464 - protein, 5 aa, Mycobacterium tuberculosis
SAPEH

SEQ ID NO: 1450465 - protein, 10 aa, Mycobacterium tuberculosis
SAPGATGPTT

SEQ ID NO: 1450466 - protein, 14 aa, Mycobacterium tuberculosis
SAPLDSQAAAQVAS

SEQ ID NO: 1450467 - protein, 6 aa, Mycobacterium tuberculosis
SAPLPI

SEQ ID NO: 1450468 - protein, 28 aa, Mycobacterium tuberculosis
SAPMGTDDDPTSRRRPEVSGPRHRKPMG

SEQ ID NO: 1450469 - protein, 13 aa, Mycobacterium tuberculosis
SAPPSRPSTGCIG

SEQ ID NO: 1450470 - protein, 6 aa, Mycobacterium tuberculosis
SAPRTA

SEQ ID NO: 1450471 - protein, 7 aa, Mycobacterium tuberculosis
SAPSASV

SEQ ID NO: 1450472 - protein, 7 aa, Mycobacterium tuberculosis
SAPSLNR

SEQ ID NO: 1450473 - protein, 7 aa, Mycobacterium tuberculosis
SAPSSLA

SEQ ID NO: 1450474 - protein, 5 aa, Mycobacterium tuberculosis
SAPTG

SEQ ID NO: 1450475 - protein, 22 aa, Mycobacterium tuberculosis
SAPTPPAPPAPPAPPVPPCPPE

SEQ ID NO: 1450476 - protein, 22 aa, Mycobacterium tuberculosis
SAPTPSPAPIAPPTTDNASAMT

SEQ ID NO: 1450477 - protein, 36 aa, Mycobacterium tuberculosis
SAPTRRPGRSRSTRLSRSAPPCSSRSVTRPGPTRTY

SEQ ID NO: 1450478 - protein, 6 aa, Mycobacterium tuberculosis
SAPTSI

SEQ ID NO: 1450479 - protein, 21 aa, Mycobacterium tuberculosis
SAPYEGPPPRAEDLPAIDASP

SEQ ID NO: 1450480 - protein, 5 aa, Mycobacterium tuberculosis
SAQAA

SEQ ID NO: 1450481 - protein, 8 aa, Mycobacterium tuberculosis
SAQALTNQ

SEQ ID NO: 1450482 - protein, 10 aa, Mycobacterium tuberculosis
SAQPGARYTS

SEQ ID NO: 1450483 - protein, 6 aa, Mycobacterium tuberculosis
SAQPSA

SEQ ID NO: 1450484 - protein, 4 aa, Mycobacterium tuberculosis
SAQQ

SEQ ID NO: 1450485 - protein, 14 aa, Mycobacterium tuberculosis
SAQVGAWRGCRVLI

SEQ ID NO: 1450486 - protein, 8 aa, Mycobacterium tuberculosis
SARADPGP

SEQ ID NO: 1450487 - protein, 20 aa, Mycobacterium tuberculosis
SARAERRAIPSKGLTGTGYD

SEQ ID NO: 1450488 - protein, 13 aa, Mycobacterium tuberculosis
SARASRARLRLAA

SEQ ID NO: 1450489 - protein, 13 aa, Mycobacterium tuberculosis
SARGERVAQPEPI

SEQ ID NO: 1450490 - protein, 4 aa, Mycobacterium tuberculosis
SARN

SEQ ID NO: 1450491 - protein, 5 aa, Mycobacterium tuberculosis
SARPD

SEQ ID NO: 1450492 - protein, 18 aa, Mycobacterium tuberculosis
SARPPKLPRPKGRSAARM

SEQ ID NO: 1450493 - protein, 5 aa, Mycobacterium tuberculosis
SARRG

SEQ ID NO: 1450494 - protein, 9 aa, Mycobacterium tuberculosis
SARRGHRPL

SEQ ID NO: 1450495 - protein, 17 aa, Mycobacterium tuberculosis
SARRGPAEGAGRRPHSY

SEQ ID NO: 1450496 - protein, 9 aa, Mycobacterium tuberculosis
SARRRASSR

SEQ ID NO: 1450497 - protein, 9 aa, Mycobacterium tuberculosis
SARSAGRRG

SEQ ID NO: 1450498 - protein, 10 aa, Mycobacterium tuberculosis
SARSARHGPL

SEQ ID NO: 1450499 - protein, 22 aa, Mycobacterium tuberculosis
SARSTSPRANSSTAQPDTRHRC

SEQ ID NO: 1450500 - protein, 8 aa, Mycobacterium tuberculosis
SARTARRG

SEQ ID NO: 1450501 - protein, 6 aa, Mycobacterium tuberculosis
SARTGM

SEQ ID NO: 1450502 - protein, 12 aa, Mycobacterium tuberculosis
SARTPSPNTVRP

SEQ ID NO: 1450503 - protein, 13 aa, Mycobacterium tuberculosis
SASASAQRKAPQP

SEQ ID NO: 1450504 - protein, 6 aa, Mycobacterium tuberculosis
SASGPL

SEQ ID NO: 1450505 - protein, 13 aa, Mycobacterium tuberculosis
SASHQRDDCAAIN

SEQ ID NO: 1450506 - protein, 17 aa, Mycobacterium tuberculosis
SASKGIAGTSPGTSTRL

SEQ ID NO: 1450507 - protein, 10 aa, Mycobacterium tuberculosis
SASPPTGGSY

SEQ ID NO: 1450508 - protein, 7 aa, Mycobacterium tuberculosis
SASPRRQ

SEQ ID NO: 1450509 - protein, 5 aa, Mycobacterium tuberculosis
SASQT

SEQ ID NO: 1450510 - protein, 11 aa, Mycobacterium tuberculosis
SASRPAAPIPL

SEQ ID NO: 1450511 - protein, 10 aa, Mycobacterium tuberculosis
SASRPIGPRT

SEQ ID NO: 1450512 - protein, 20 aa, Mycobacterium tuberculosis
SASRRASPRRTPSRASSVRR

SEQ ID NO: 1450513 - protein, 5 aa, Mycobacterium tuberculosis
SASSF

SEQ ID NO: 1450514 - protein, 6 aa, Mycobacterium tuberculosis
SASSGT

SEQ ID NO: 1450515 - protein, 7 aa, Mycobacterium tuberculosis
SATASSY

SEQ ID NO: 1450516 - protein, 19 aa, Mycobacterium tuberculosis
SATATGTAEATVSTADDVG

SEQ ID NO: 1450517 - protein, 7 aa, Mycobacterium tuberculosis
SATDPHA

SEQ ID NO: 1450518 - protein, 5 aa, Mycobacterium tuberculosis
SATEQ

SEQ ID NO: 1450519 - protein, 28 aa, Mycobacterium tuberculosis
SATGKAKEVPGRDRQGRRRGAQKLLPGY

SEQ ID NO: 1450520 - protein, 57 aa, Mycobacterium tuberculosis
SATGLGGDGGDGGDGGNGGNSGTKAGGAGGKGQAGQPNSGTEPGFGGDGGLGGAGAT

SEQ ID NO: 1450521 - protein, 4 aa, Mycobacterium tuberculosis
SATI

SEQ ID NO: 1450522 - protein, 15 aa, Mycobacterium tuberculosis
SATISNAGPLNWPGH

SEQ ID NO: 1450523 - protein, 12 aa, Mycobacterium tuberculosis
SATLGNADTIGG

SEQ ID NO: 1450524 - protein, 7 aa, Mycobacterium tuberculosis
SATPANI

SEQ ID NO: 1450525 - protein, 9 aa, Mycobacterium tuberculosis
SATPRSPDF

SEQ ID NO: 1450526 - protein, 19 aa, Mycobacterium tuberculosis
SATRNGRLRRRGRHPRPRA

SEQ ID NO: 1450527 - protein, 7 aa, Mycobacterium tuberculosis
SATSARS

SEQ ID NO: 1450528 - protein, 5 aa, Mycobacterium tuberculosis
SATTA

SEQ ID NO: 1450529 - protein, 10 aa, Mycobacterium tuberculosis
SATTDEKLTQ

SEQ ID NO: 1450530 - protein, 13 aa, Mycobacterium tuberculosis
SATTDEKLTQLGN

SEQ ID NO: 1450531 - protein, 19 aa, Mycobacterium tuberculosis
SATTRTRRRTRTASKHVPE

SEQ ID NO: 1450532 - protein, 8 aa, Mycobacterium tuberculosis
SAVAETAP

SEQ ID NO: 1450533 - protein, 15 aa, Mycobacterium tuberculosis
SAVTGVGSTKTPTFV

SEQ ID NO: 1450534 - protein, 19 aa, Mycobacterium tuberculosis
SAWTPRRSCSSTSAWTPRR

SEQ ID NO: 1450535 - protein, 23 aa, Mycobacterium tuberculosis
SAYGISSKKPNTVVSTDFNILAE

SEQ ID NO: 1450536 - protein, 5 aa, Mycobacterium tuberculosis
SAYGR

SEQ ID NO: 1450537 - protein, 13 aa, Mycobacterium tuberculosis
SCAPATTPDPDTR

SEQ ID NO: 1450538 - protein, 22 aa, Mycobacterium tuberculosis
SCAQPDRGVPGLDGGAESASPL

SEQ ID NO: 1450539 - protein, 8 aa, Mycobacterium tuberculosis
SCDGGLGK

SEQ ID NO: 1450540 - protein, 13 aa, Mycobacterium tuberculosis
SCGAGGDGGNAGF

SEQ ID NO: 1450541 - protein, 5 aa, Mycobacterium tuberculosis
SCGRD

SEQ ID NO: 1450542 - protein, 20 aa, Mycobacterium tuberculosis
SCPDPTRVDYTSRAAAPLAA

SEQ ID NO: 1450543 - protein, 19 aa, Mycobacterium tuberculosis
SCPPQVSQPPPLGPPSARR

SEQ ID NO: 1450544 - protein, 5 aa, Mycobacterium tuberculosis
SCPRG

SEQ ID NO: 1450545 - protein, 17 aa, Mycobacterium tuberculosis
SCPSPVSATPTKAPMSN

SEQ ID NO: 1450546 - protein, 27 aa, Mycobacterium tuberculosis
SCQRRGGNTNRSTLANSANGVFTTPGT

SEQ ID NO: 1450547 - protein, 10 aa, Mycobacterium tuberculosis
SCRPPTGEVG

SEQ ID NO: 1450548 - protein, 8 aa, Mycobacterium tuberculosis
SCRTNNDI

SEQ ID NO: 1450549 - protein, 6 aa, Mycobacterium tuberculosis
SCSTRR

SEQ ID NO: 1450550 - protein, 17 aa, Mycobacterium tuberculosis
SCTTTSRSRLDRDNRTL

SEQ ID NO: 1450551 - protein, 21 aa, Mycobacterium tuberculosis
SDAAVSTKGLEPGDAGAGPHR

SEQ ID NO: 1450552 - protein, 13 aa, Mycobacterium tuberculosis
SDAGATAQERERA

SEQ ID NO: 1450553 - protein, 8 aa, Mycobacterium tuberculosis
SDAPVTGL

SEQ ID NO: 1450554 - protein, 8 aa, Mycobacterium tuberculosis
SDCGAGPI

SEQ ID NO: 1450555 - protein, 9 aa, Mycobacterium tuberculosis
SDDHRGTFA

SEQ ID NO: 1450556 - protein, 8 aa, Mycobacterium tuberculosis
SDDTNARV

SEQ ID NO: 1450557 - protein, 4 aa, Mycobacterium tuberculosis
SDEE

SEQ ID NO: 1450558 - protein, 6 aa, Mycobacterium tuberculosis
SDEGIQ

SEQ ID NO: 1450559 - protein, 6 aa, Mycobacterium tuberculosis
SDEPYL

SEQ ID NO: 1450560 - protein, 32 aa, Mycobacterium tuberculosis
SDGASRRRRADQTVGPGSRGFGQQTLDPDPVG

SEQ ID NO: 1450561 - protein, 4 aa, Mycobacterium tuberculosis
SDGD

SEQ ID NO: 1450562 - protein, 8 aa, Mycobacterium tuberculosis
SDGDFGGD

SEQ ID NO: 1450563 - protein, 8 aa, Mycobacterium tuberculosis
SDGEPATE

SEQ ID NO: 1450564 - protein, 4 aa, Mycobacterium tuberculosis
SDGF

SEQ ID NO: 1450565 - protein, 61 aa, Mycobacterium tuberculosis
SDGGNGGDGGAGGRGGDGGAGGAGGDAPAGRAGSQGVGGDGGAGGAGGAPGNGGSGGRGDM

SEQ ID NO: 1450566 - protein, 10 aa, Mycobacterium tuberculosis
SDGGTSSSRL

SEQ ID NO: 1450567 - protein, 185 aa, Mycobacterium tuberculosis
SDGGVGGAGGSANGGTAGSQGTGGVGGDGGAGGNGGGGKAGTGNSGNFGVDGEAGFSGGAGGNGGVGGAAGANGGTGGSGGNGGDGGAGGIGGAGGNGIPGTGTEPAGGTGAKGGDGGDGGAGGAGGNAGGAGGNGGAGGQGGNAGQGGAGGAGGNAVIPGDGVGKAPHGDAGGSGGDGGKRRPG

SEQ ID NO: 1450568 - protein, 8 aa, Mycobacterium tuberculosis
SDGPERKV

SEQ ID NO: 1450569 - protein, 26 aa, Mycobacterium tuberculosis
SDGPRRSSTRSECHSSGAQSAPPNTS

SEQ ID NO: 1450570 - protein, 4 aa, Mycobacterium tuberculosis
SDGQ

SEQ ID NO: 1450571 - protein, 16 aa, Mycobacterium tuberculosis
SDGQRRPELRRRNPSQ

SEQ ID NO: 1450572 - protein, 6 aa, Mycobacterium tuberculosis
SDGRPH

SEQ ID NO: 1450573 - protein, 27 aa, Mycobacterium tuberculosis
SDGSTSPARQLPAPWPGDAGAAAEGRA

SEQ ID NO: 1450574 - protein, 16 aa, Mycobacterium tuberculosis
SDGTPTAGPPGQPLSH

SEQ ID NO: 1450575 - protein, 22 aa, Mycobacterium tuberculosis
SDHDIPGKSMPGACASSYHHRQ

SEQ ID NO: 1450576 - protein, 4 aa, Mycobacterium tuberculosis
SDHG

SEQ ID NO: 1450577 - protein, 6 aa, Mycobacterium tuberculosis
SDHGRW

SEQ ID NO: 1450578 - protein, 14 aa, Mycobacterium tuberculosis
SDHGSDAAVARGRQ

SEQ ID NO: 1450579 - protein, 19 aa, Mycobacterium tuberculosis
SDHTAGRAAVGAAPPADAL

SEQ ID NO: 1450580 - protein, 4 aa, Mycobacterium tuberculosis
SDHV

SEQ ID NO: 1450581 - protein, 12 aa, Mycobacterium tuberculosis
SDIGNGRGPVDE

SEQ ID NO: 1450582 - protein, 9 aa, Mycobacterium tuberculosis
SDITAGRAA

SEQ ID NO: 1450583 - protein, 20 aa, Mycobacterium tuberculosis
SDKATTSPGRRSHRPRRAIW

SEQ ID NO: 1450584 - protein, 13 aa, Mycobacterium tuberculosis
SDLASQAWQGPAA

SEQ ID NO: 1450585 - protein, 5 aa, Mycobacterium tuberculosis
SDLDR

SEQ ID NO: 1450586 - protein, 6 aa, Mycobacterium tuberculosis
SDLRPK

SEQ ID NO: 1450587 - protein, 8 aa, Mycobacterium tuberculosis
SDMPTTCG

SEQ ID NO: 1450588 - protein, 8 aa, Mycobacterium tuberculosis
SDNGGSTT

SEQ ID NO: 1450589 - protein, 4 aa, Mycobacterium tuberculosis
SDNM

SEQ ID NO: 1450590 - protein, 5 aa, Mycobacterium tuberculosis
SDPAL

SEQ ID NO: 1450591 - protein, 13 aa, Mycobacterium tuberculosis
SDPANPAFRDGAA

SEQ ID NO: 1450592 - protein, 9 aa, Mycobacterium tuberculosis
SDPDEAVEE

SEQ ID NO: 1450593 - protein, 5 aa, Mycobacterium tuberculosis
SDPEG

SEQ ID NO: 1450594 - protein, 13 aa, Mycobacterium tuberculosis
SDPGVGARRHRPR

SEQ ID NO: 1450595 - protein, 19 aa, Mycobacterium tuberculosis
SDPLDGGDTVGRFRRSPRC

SEQ ID NO: 1450596 - protein, 13 aa, Mycobacterium tuberculosis
SDPPGLTPLPEEA

SEQ ID NO: 1450597 - protein, 5 aa, Mycobacterium tuberculosis
SDPRE

SEQ ID NO: 1450598 - protein, 44 aa, Mycobacterium tuberculosis
SDPTVRRSARRRPVRSDRARRDSPRAGGRQPGTRCRRPRRGLAK

SEQ ID NO: 1450599 - protein, 7 aa, Mycobacterium tuberculosis
SDQSENI

SEQ ID NO: 1450600 - protein, 19 aa, Mycobacterium tuberculosis
SDRATTSPAVAPMTAANAT

SEQ ID NO: 1450601 - protein, 10 aa, Mycobacterium tuberculosis
SDRERQPRHR

SEQ ID NO: 1450602 - protein, 16 aa, Mycobacterium tuberculosis
SDRGFARGEQAHEGVS

SEQ ID NO: 1450603 - protein, 9 aa, Mycobacterium tuberculosis
SDRGQGRRR

SEQ ID NO: 1450604 - protein, 20 aa, Mycobacterium tuberculosis
SDRGTAGAFSRAGPQTLSSP

SEQ ID NO: 1450605 - protein, 5 aa, Mycobacterium tuberculosis
SDRQG

SEQ ID NO: 1450606 - protein, 19 aa, Mycobacterium tuberculosis
SDRSGTVAKGCAGARRSAA

SEQ ID NO: 1450607 - protein, 6 aa, Mycobacterium tuberculosis
SDRSLE

SEQ ID NO: 1450608 - protein, 10 aa, Mycobacterium tuberculosis
SDSGGGAGIQ

SEQ ID NO: 1450609 - protein, 4 aa, Mycobacterium tuberculosis
SDSL

SEQ ID NO: 1450610 - protein, 6 aa, Mycobacterium tuberculosis
SDSPTY

SEQ ID NO: 1450611 - protein, 9 aa, Mycobacterium tuberculosis
SDSTPPDVN

SEQ ID NO: 1450612 - protein, 4 aa, Mycobacterium tuberculosis
SDSV

SEQ ID NO: 1450613 - protein, 5 aa, Mycobacterium tuberculosis
SDTAS

SEQ ID NO: 1450614 - protein, 10 aa, Mycobacterium tuberculosis
SDTIGKRDEQ

SEQ ID NO: 1450615 - protein, 9 aa, Mycobacterium tuberculosis
SDTTRCGNG

SEQ ID NO: 1450616 - protein, 12 aa, Mycobacterium tuberculosis
SDTWQPPTPRRL

SEQ ID NO: 1450617 - protein, 5 aa, Mycobacterium tuberculosis
SDVAD

SEQ ID NO: 1450618 - protein, 4 aa, Mycobacterium tuberculosis
SDWD

SEQ ID NO: 1450619 - protein, 5 aa, Mycobacterium tuberculosis
SEAAD

SEQ ID NO: 1450620 - protein, 9 aa, Mycobacterium tuberculosis
SEADPAAGR

SEQ ID NO: 1450621 - protein, 9 aa, Mycobacterium tuberculosis
SEDAEGPGA

SEQ ID NO: 1450622 - protein, 4 aa, Mycobacterium tuberculosis
SEDG

SEQ ID NO: 1450623 - protein, 8 aa, Mycobacterium tuberculosis
SEDGTRVT

SEQ ID NO: 1450624 - protein, 5 aa, Mycobacterium tuberculosis
SEEVE

SEQ ID NO: 1450625 - protein, 7 aa, Mycobacterium tuberculosis
SEGERDN

SEQ ID NO: 1450626 - protein, 15 aa, Mycobacterium tuberculosis
SEGLGMDGLSLFDPQ

SEQ ID NO: 1450627 - protein, 9 aa, Mycobacterium tuberculosis
SEHDTDAAL

SEQ ID NO: 1450628 - protein, 8 aa, Mycobacterium tuberculosis
SEHPEPKC

SEQ ID NO: 1450629 - protein, 5 aa, Mycobacterium tuberculosis
SEHPS

SEQ ID NO: 1450630 - protein, 4 aa, Mycobacterium tuberculosis
SEIR

SEQ ID NO: 1450631 - protein, 10 aa, Mycobacterium tuberculosis
SELADQKEKL

SEQ ID NO: 1450632 - protein, 5 aa, Mycobacterium tuberculosis
SELST

SEQ ID NO: 1450633 - protein, 8 aa, Mycobacterium tuberculosis
SEPGAGTD

SEQ ID NO: 1450634 - protein, 9 aa, Mycobacterium tuberculosis
SEQSARNPV

SEQ ID NO: 1450635 - protein, 7 aa, Mycobacterium tuberculosis
SEQTHDS

SEQ ID NO: 1450636 - protein, 9 aa, Mycobacterium tuberculosis
SERATGQRE

SEQ ID NO: 1450637 - protein, 13 aa, Mycobacterium tuberculosis
SERATGVLQTTRS

SEQ ID NO: 1450638 - protein, 8 aa, Mycobacterium tuberculosis
SERDGQNK

SEQ ID NO: 1450639 - protein, 8 aa, Mycobacterium tuberculosis
SERGAVPK

SEQ ID NO: 1450640 - protein, 8 aa, Mycobacterium tuberculosis
SERGEKLP

SEQ ID NO: 1450641 - protein, 4 aa, Mycobacterium tuberculosis
SERR

SEQ ID NO: 1450642 - protein, 28 aa, Mycobacterium tuberculosis
SESDTPAGMLDPGQAPKPGVVGGAPGPA

SEQ ID NO: 1450643 - protein, 10 aa, Mycobacterium tuberculosis
SESDTPRGCS

SEQ ID NO: 1450644 - protein, 6 aa, Mycobacterium tuberculosis
SESHAT

SEQ ID NO: 1450645 - protein, 4 aa, Mycobacterium tuberculosis
SESL

SEQ ID NO: 1450646 - protein, 8 aa, Mycobacterium tuberculosis
SESLPGDR

SEQ ID NO: 1450647 - protein, 16 aa, Mycobacterium tuberculosis
SESTVADNFDEMSPDA

SEQ ID NO: 1450648 - protein, 13 aa, Mycobacterium tuberculosis
SETRRTGRSRGKG

SEQ ID NO: 1450649 - protein, 22 aa, Mycobacterium tuberculosis
SETVTASSMTTASSRSVPRTSG

SEQ ID NO: 1450650 - protein, 9 aa, Mycobacterium tuberculosis
SETYPPGST

SEQ ID NO: 1450651 - protein, 7 aa, Mycobacterium tuberculosis
SEVADLP

SEQ ID NO: 1450652 - protein, 26 aa, Mycobacterium tuberculosis
SEVAGTPISPRRRLSGPTAPAGRGQG

SEQ ID NO: 1450653 - protein, 6 aa, Mycobacterium tuberculosis
SEVERV

SEQ ID NO: 1450654 - protein, 13 aa, Mycobacterium tuberculosis
SEVGGQRRRDNVP

SEQ ID NO: 1450655 - protein, 15 aa, Mycobacterium tuberculosis
SFDPREEPYCDPTTG

SEQ ID NO: 1450656 - protein, 5 aa, Mycobacterium tuberculosis
SFEPD

SEQ ID NO: 1450657 - protein, 7 aa, Mycobacterium tuberculosis
SFGGKGG

SEQ ID NO: 1450658 - protein, 28 aa, Mycobacterium tuberculosis
SFGGSKPAPAKGTAKSPGKGPDKSLDKA

SEQ ID NO: 1450659 - protein, 23 aa, Mycobacterium tuberculosis
SFGGSSNAPGSSPDGGFLGGGGR

SEQ ID NO: 1450660 - protein, 14 aa, Mycobacterium tuberculosis
SFNTAGVSRPFNTA

SEQ ID NO: 1450661 - protein, 13 aa, Mycobacterium tuberculosis
SFNTGIGNSGTRQ

SEQ ID NO: 1450662 - protein, 13 aa, Mycobacterium tuberculosis
SFNTGVGNSGTGQ

SEQ ID NO: 1450663 - protein, 13 aa, Mycobacterium tuberculosis
SFPAPTWSSSPRP

SEQ ID NO: 1450664 - protein, 29 aa, Mycobacterium tuberculosis
SFPDSLGDDQRARHPQGARDAEQRNRYHR

SEQ ID NO: 1450665 - protein, 11 aa, Mycobacterium tuberculosis
SFPTMRTPPGL

SEQ ID NO: 1450666 - protein, 11 aa, Mycobacterium tuberculosis
SFPTMRTPSGL

SEQ ID NO: 1450667 - protein, 17 aa, Mycobacterium tuberculosis
SFRGDAKERHPKCVCLR

SEQ ID NO: 1450668 - protein, 14 aa, Mycobacterium tuberculosis
SFYEPDSEGNRQRA

SEQ ID NO: 1450669 - protein, 5 aa, Mycobacterium tuberculosis
SGAER

SEQ ID NO: 1450670 - protein, 48 aa, Mycobacterium tuberculosis
SGAGGEAIPGGASTNSAGGDGGAGGTGGNGGDGGAGGAPGLGGAGGAG

SEQ ID NO: 1450671 - protein, 6 aa, Mycobacterium tuberculosis
SGAGGV

SEQ ID NO: 1450672 - protein, 31 aa, Mycobacterium tuberculosis
SGAGLGSRHRHQRAGGRRPCGRGGDRRRRRA

SEQ ID NO: 1450673 - protein, 10 aa, Mycobacterium tuberculosis
SGAHRPTPTI

SEQ ID NO: 1450674 - protein, 5 aa, Mycobacterium tuberculosis
SGAKD

SEQ ID NO: 1450675 - protein, 5 aa, Mycobacterium tuberculosis
SGAPV

SEQ ID NO: 1450676 - protein, 7 aa, Mycobacterium tuberculosis
SGAQESA

SEQ ID NO: 1450677 - protein, 12 aa, Mycobacterium tuberculosis
SGARCPKADGQS

SEQ ID NO: 1450678 - protein, 12 aa, Mycobacterium tuberculosis
SGATGPVTPTRG

SEQ ID NO: 1450679 - protein, 7 aa, Mycobacterium tuberculosis
SGATQAM

SEQ ID NO: 1450680 - protein, 4 aa, Mycobacterium tuberculosis
SGAV

SEQ ID NO: 1450681 - protein, 5 aa, Mycobacterium tuberculosis
SGAVD

SEQ ID NO: 1450682 - protein, 17 aa, Mycobacterium tuberculosis
SGCDSHNSGSLGADPRQ

SEQ ID NO: 1450683 - protein, 22 aa, Mycobacterium tuberculosis
SGCGGNAAAKGTAGGARQTART

SEQ ID NO: 1450684 - protein, 6 aa, Mycobacterium tuberculosis
SGCGPR

SEQ ID NO: 1450685 - protein, 15 aa, Mycobacterium tuberculosis
SGCPPKAACDSPNVS

SEQ ID NO: 1450686 - protein, 4 aa, Mycobacterium tuberculosis
SGDA

SEQ ID NO: 1450687 - protein, 5 aa, Mycobacterium tuberculosis
SGDAL

SEQ ID NO: 1450688 - protein, 7 aa, Mycobacterium tuberculosis
SGDGMQL

SEQ ID NO: 1450689 - protein, 9 aa, Mycobacterium tuberculosis
SGDGSTYMP

SEQ ID NO: 1450690 - protein, 7 aa, Mycobacterium tuberculosis
SGDPSLY

SEQ ID NO: 1450691 - protein, 12 aa, Mycobacterium tuberculosis
SGDRMAPGVHRA

SEQ ID NO: 1450692 - protein, 6 aa, Mycobacterium tuberculosis
SGDTPL

SEQ ID NO: 1450693 - protein, 14 aa, Mycobacterium tuberculosis
SGDVHSGLDQRSDQ

SEQ ID NO: 1450694 - protein, 5 aa, Mycobacterium tuberculosis
SGEEI

SEQ ID NO: 1450695 - protein, 85 aa, Mycobacterium tuberculosis
SGEENSGAQQYQPGGWSAGSRGAHPPGKGEKKKKKKKKKKKKKKKKKKKKKKKKKKKKKKKKKKKKKKKKKKKKKKKKKRKKKKK

SEQ ID NO: 1450696 - protein, 7 aa, Mycobacterium tuberculosis
SGEGADE

SEQ ID NO: 1450697 - protein, 26 aa, Mycobacterium tuberculosis
SGEHDAGRPECSTRRCSSRPKAARQL

SEQ ID NO: 1450698 - protein, 13 aa, Mycobacterium tuberculosis
SGEKRTSKEYNVE

SEQ ID NO: 1450699 - protein, 13 aa, Mycobacterium tuberculosis
SGEPTFSNEYGKH

SEQ ID NO: 1450700 - protein, 8 aa, Mycobacterium tuberculosis
SGEQVTVT

SEQ ID NO: 1450701 - protein, 12 aa, Mycobacterium tuberculosis
SGESAAQIPNSA

SEQ ID NO: 1450702 - protein, 12 aa, Mycobacterium tuberculosis
SGESDVEPPEVD

SEQ ID NO: 1450703 - protein, 9 aa, Mycobacterium tuberculosis
SGESKKKNL

SEQ ID NO: 1450704 - protein, 6 aa, Mycobacterium tuberculosis
SGEYAA

SEQ ID NO: 1450705 - protein, 6 aa, Mycobacterium tuberculosis
SGEYQD

SEQ ID NO: 1450706 - protein, 10 aa, Mycobacterium tuberculosis
SGFDATAPSA

SEQ ID NO: 1450707 - protein, 14 aa, Mycobacterium tuberculosis
SGFGQDGYDEGNAE

SEQ ID NO: 1450708 - protein, 6 aa, Mycobacterium tuberculosis
SGFPAT

SEQ ID NO: 1450709 - protein, 21 aa, Mycobacterium tuberculosis
SGFSNLGSGVSGFANRASCRS

SEQ ID NO: 1450710 - protein, 18 aa, Mycobacterium tuberculosis
SGGAANAAKRRPGANIKS

SEQ ID NO: 1450711 - protein, 17 aa, Mycobacterium tuberculosis
SGGAATADSAAGSPRPV

SEQ ID NO: 1450712 - protein, 26 aa, Mycobacterium tuberculosis
SGGAGGAGASATGAATGGAGGATGLS

SEQ ID NO: 1450713 - protein, 42 aa, Mycobacterium tuberculosis
SGGAGGAGASATGAATGGDGGPAASPERSVSEVTAAPAAPPV

SEQ ID NO: 1450714 - protein, 32 aa, Mycobacterium tuberculosis
SGGAGGAGASATGAATGGGRRGRRQVRSVRSR

SEQ ID NO: 1450715 - protein, 14 aa, Mycobacterium tuberculosis
SGGAGGARGVRRAR

SEQ ID NO: 1450716 - protein, 23 aa, Mycobacterium tuberculosis
SGGAGGFGGFGTAGEVGGAGGNA

SEQ ID NO: 1450717 - protein, 11 aa, Mycobacterium tuberculosis
SGGAGGGGSTV

SEQ ID NO: 1450718 - protein, 75 aa, Mycobacterium tuberculosis
SGGAGGIGGAGGVGGSGNDGGNGGDGGQGGASGLGIGNGGPGGSGGTGGAGGTGGSAGTGGAGGDGGNAALLIGT

SEQ ID NO: 1450719 - protein, 29 aa, Mycobacterium tuberculosis
SGGAGGNGGTGDTAGNGGNGGAGAVGGNA

SEQ ID NO: 1450720 - protein, 58 aa, Mycobacterium tuberculosis
SGGAGGQGGMGAAGADGVNPTPTGTADAGSTGTDQTLGGNAIGGNGGPGDAGDAMTSG

SEQ ID NO: 1450721 - protein, 131 aa, Mycobacterium tuberculosis
SGGAGGQGGMGAAGADGVNPTPTGTADAGSTGTDQTLGGNAIGGNGGPGDAGDAMTSGGAGGSGGNAVSTVNGDAVGGEGGKGGEGAYGGAGGAGGSAASIGNAAIGGNGGAGGNAQAPGGVGGAGGKGGD

SEQ ID NO: 1450722 - protein, 105 aa, Mycobacterium tuberculosis
SGGAGGQGGMGAAGADGVNPTPTGTADAGSTGTDQTLGGNAIGGNGGPGDAGDAMTSGGAGGSGGNAVSTVNGDAVGGEGGKGGEGAYGGAGGAGGSWISFGKAV

SEQ ID NO: 1450723 - protein, 24 aa, Mycobacterium tuberculosis
SGGAGGSGGAGAVGGNGGAGGNGG

SEQ ID NO: 1450724 - protein, 86 aa, Mycobacterium tuberculosis
SGGAGGSGGAGGFANGSTGGAGGAGGGAGLIGNGGNGGSGGTSVATGGAGNGGAGGAGGGAGLIGNGGNGGSGGMGDAPGGTGVGG

SEQ ID NO: 1450725 - protein, 25 aa, Mycobacterium tuberculosis
SGGAGGSGGFSNSGNGGAGGAGGDA

SEQ ID NO: 1450726 - protein, 25 aa, Mycobacterium tuberculosis
SGGAGGSGGFSNSGNGGDGGAGGDA

SEQ ID NO: 1450727 - protein, 21 aa, Mycobacterium tuberculosis
SGGAGGSGGFSNSGRRGRRRR

SEQ ID NO: 1450728 - protein, 12 aa, Mycobacterium tuberculosis
SGGAQAYAAAEA

SEQ ID NO: 1450729 - protein, 4 aa, Mycobacterium tuberculosis
SGGF

SEQ ID NO: 1450730 - protein, 6 aa, Mycobacterium tuberculosis
SGGGLG

SEQ ID NO: 1450731 - protein, 8 aa, Mycobacterium tuberculosis
SGGGRGAI

SEQ ID NO: 1450732 - protein, 13 aa, Mycobacterium tuberculosis
SGGKKRPQGAGGF

SEQ ID NO: 1450733 - protein, 6 aa, Mycobacterium tuberculosis
SGGLPL

SEQ ID NO: 1450734 - protein, 6 aa, Mycobacterium tuberculosis
SGGNFR

SEQ ID NO: 1450735 - protein, 45 aa, Mycobacterium tuberculosis
SGGNGAPGAPGQAGGAGGSAGLLGNGGSGGAGGTGAPGGNGGNAG

SEQ ID NO: 1450736 - protein, 23 aa, Mycobacterium tuberculosis
SGGNGGAGGAGPPEPSSRQASWI

SEQ ID NO: 1450737 - protein, 34 aa, Mycobacterium tuberculosis
SGGNQGARGAGPAGAIGAPGVAGGAGGAGGTAGL

SEQ ID NO: 1450738 - protein, 5 aa, Mycobacterium tuberculosis
SGGPV

SEQ ID NO: 1450739 - protein, 24 aa, Mycobacterium tuberculosis
SGGRGRAGRYGGSRGRRRQPHTHP

SEQ ID NO: 1450740 - protein, 24 aa, Mycobacterium tuberculosis
SGGRIDKSTAELADERSAVTELGL

SEQ ID NO: 1450741 - protein, 13 aa, Mycobacterium tuberculosis
SGGRLGEGAQTVV

SEQ ID NO: 1450742 - protein, 10 aa, Mycobacterium tuberculosis
SGGRRRPRRG

SEQ ID NO: 1450743 - protein, 27 aa, Mycobacterium tuberculosis
SGGSARPPADCGNQPHRRRRSPDDDCE

SEQ ID NO: 1450744 - protein, 56 aa, Mycobacterium tuberculosis; identical to SEQ ID NO: 231266

SEQ ID NO: 1450745 - protein, 20 aa, Mycobacterium tuberculosis
SGGSGWPARHPSAAGNPGIA

SEQ ID NO: 1450746 - protein, 9 aa, Mycobacterium tuberculosis
SGGSTTKLT

SEQ ID NO: 1450747 - protein, 13 aa, Mycobacterium tuberculosis
SGGSVAGTGGNGG

SEQ ID NO: 1450748 - protein, 17 aa, Mycobacterium tuberculosis
SGGTAVDPGAPTGIGDA

SEQ ID NO: 1450749 - protein, 37 aa, Mycobacterium tuberculosis
SGGTGGDGGNGGLGAGSGAKGNGGNGGDGGKGGDAQL

SEQ ID NO: 1450750 - protein, 27 aa, Mycobacterium tuberculosis
SGGTGGVGGAGHPPPAGVGGAGGNAGF

SEQ ID NO: 1450751 - protein, 9 aa, Mycobacterium tuberculosis
SGGTRGGLG

SEQ ID NO: 1450752 - protein, 6 aa, Mycobacterium tuberculosis
SGGVGG

SEQ ID NO: 1450753 - protein, 29 aa, Mycobacterium tuberculosis
SGGVNGATGADGAKGLDGATGGKGNNGNP

SEQ ID NO: 1450754 - protein, 22 aa, Mycobacterium tuberculosis
SGGVPGREGAVGQHNSCQHDGH

SEQ ID NO: 1450755 - protein, 6 aa, Mycobacterium tuberculosis
SGHAAR

SEQ ID NO: 1450756 - protein, 7 aa, Mycobacterium tuberculosis
SGHAARD

SEQ ID NO: 1450757 - protein, 15 aa, Mycobacterium tuberculosis
SGHAGPNDRRGPAPR

SEQ ID NO: 1450758 - protein, 8 aa, Mycobacterium tuberculosis
SGHGPTSV

SEQ ID NO: 1450759 - protein, 10 aa, Mycobacterium tuberculosis
SGHGQPIPDA

SEQ ID NO: 1450760 - protein, 7 aa, Mycobacterium tuberculosis
SGHQPRV

SEQ ID NO: 1450761 - protein, 5 aa, Mycobacterium tuberculosis
SGHRP

SEQ ID NO: 1450762 - protein, 7 aa, Mycobacterium tuberculosis
SGIAEGA

SEQ ID NO: 1450763 - protein, 17 aa, Mycobacterium tuberculosis
SGKGGPGGTGGRGGAAG

SEQ ID NO: 1450764 - protein, 25 aa, Mycobacterium tuberculosis
SGKGGVGKSTVTVNPDRRDGPSAAC

SEQ ID NO: 1450765 - protein, 6 aa, Mycobacterium tuberculosis
SGKPDF

SEQ ID NO: 1450766 - protein, 18 aa, Mycobacterium tuberculosis
SGLAGRGRIPAHSARRRG

SEQ ID NO: 1450767 - protein, 5 aa, Mycobacterium tuberculosis
SGLGI

SEQ ID NO: 1450768 - protein, 7 aa, Mycobacterium tuberculosis
SGLPDHA

SEQ ID NO: 1450769 - protein, 12 aa, Mycobacterium tuberculosis
SGLPGGGPEVAP

SEQ ID NO: 1450770 - protein, 22 aa, Mycobacterium tuberculosis
SGLPPGGHTREAKPDPGIPPGS

SEQ ID NO: 1450771 - protein, 5 aa, Mycobacterium tuberculosis
SGLRP

SEQ ID NO: 1450772 - protein, 14 aa, Mycobacterium tuberculosis
SGLSASTTACAAVA

SEQ ID NO: 1450773 - protein, 17 aa, Mycobacterium tuberculosis
SGLTGEFNSDANAIARG

SEQ ID NO: 1450774 - protein, 39 aa, Mycobacterium tuberculosis
SGMSASASAQRKAPQPDSAAAAAAAAAVRDQARARRRRR

SEQ ID NO: 1450775 - protein, 18 aa, Mycobacterium tuberculosis
SGMTSQAATFAANRLDHA

SEQ ID NO: 1450776 - protein, 21 aa, Mycobacterium tuberculosis
SGNAGKSGGAPGPSGAGGAGG

SEQ ID NO: 1450777 - protein, 7 aa, Mycobacterium tuberculosis
SGNEERG

SEQ ID NO: 1450778 - protein, 27 aa, Mycobacterium tuberculosis
SGNIGNTNFGNGNQGNLNFGSGNLLGN

SEQ ID NO: 1450779 - protein, 16 aa, Mycobacterium tuberculosis
SGNIGSSNIGFGNNGD

SEQ ID NO: 1450780 - protein, 16 aa, Mycobacterium tuberculosis
SGNIGSSNIGFRKQRR

SEQ ID NO: 1450781 - protein, 4 aa, Mycobacterium tuberculosis
SGNM

SEQ ID NO: 1450782 - protein, 8 aa, Mycobacterium tuberculosis
SGNPAYSL

SEQ ID NO: 1450783 - protein, 12 aa, Mycobacterium tuberculosis
SGNQHDAEDLTQ

SEQ ID NO: 1450784 - protein, 4 aa, Mycobacterium tuberculosis
SGNY

SEQ ID NO: 1450785 - protein, 8 aa, Mycobacterium tuberculosis
SGPADHGW

SEQ ID NO: 1450786 - protein, 22 aa, Mycobacterium tuberculosis
SGPAGTGKAAFRGPGPRAGGRL

SEQ ID NO: 1450787 - protein, 7 aa, Mycobacterium tuberculosis
SGPAGVD

SEQ ID NO: 1450788 - protein, 32 aa, Mycobacterium tuberculosis
SGPALKASSRYTACGPPARKATGMSRPIEGDG

SEQ ID NO: 1450789 - protein, 25 aa, Mycobacterium tuberculosis
SGPARCGSRGSARARRGDGLGPATP

SEQ ID NO: 1450790 - protein, 31 aa, Mycobacterium tuberculosis
SGPGAAAPLGRRGTHVEPAPGPARQVRHRHR

SEQ ID NO: 1450791 - protein, 8 aa, Mycobacterium tuberculosis
SGPGDTPT

SEQ ID NO: 1450792 - protein, 33 aa, Mycobacterium tuberculosis
SGPLAGTGAGFAAGAGAGWPDSGGSIRGGCGPW

SEQ ID NO: 1450793 - protein, 10 aa, Mycobacterium tuberculosis
SGPNSRPDNK

SEQ ID NO: 1450794 - protein, 18 aa, Mycobacterium tuberculosis
SGPRHTRGTPPNVVQTDP

SEQ ID NO: 1450795 - protein, 18 aa, Mycobacterium tuberculosis
SGPRTGQRPGQPAQTRAV

SEQ ID NO: 1450796 - protein, 4 aa, Mycobacterium tuberculosis
SGPV

SEQ ID NO: 1450797 - protein, 27 aa, Mycobacterium tuberculosis
SGPVGTRQRPRRPIPLQPSRRPRPRRV

SEQ ID NO: 1450798 - protein, 30 aa, Mycobacterium tuberculosis
SGQRRQRRAPGGTPGVVGNGGRGAALFGHG

SEQ ID NO: 1450799 - protein, 9 aa, Mycobacterium tuberculosis
SGQSSRTMA

SEQ ID NO: 1450800 - protein, 8 aa, Mycobacterium tuberculosis
SGQTDSAL

SEQ ID NO: 1450801 - protein, 9 aa, Mycobacterium tuberculosis
SGRAPGRAG

SEQ ID NO: 1450802 - protein, 6 aa, Mycobacterium tuberculosis
SGRELP

SEQ ID NO: 1450803 - protein, 16 aa, Mycobacterium tuberculosis
SGREMTHEDGAEASTG

SEQ ID NO: 1450804 - protein, 6 aa, Mycobacterium tuberculosis
SGRFPG

SEQ ID NO: 1450805 - protein, 32 aa, Mycobacterium tuberculosis
SGRGTDPRLDSNKRVGAAERKAARRRRREHGD

SEQ ID NO: 1450806 - protein, 13 aa, Mycobacterium tuberculosis
SGRGWKQKDYDEY

SEQ ID NO: 1450807 - protein, 14 aa, Mycobacterium tuberculosis
SGRHGRRSPNLAGP

SEQ ID NO: 1450808 - protein, 14 aa, Mycobacterium tuberculosis
SGRIPTTRATLSQP

SEQ ID NO: 1450809 - protein, 4 aa, Mycobacterium tuberculosis
SGRL

SEQ ID NO: 1450810 - protein, 22 aa, Mycobacterium tuberculosis
SGRPCPRRAPTVTASRCGPTRA

SEQ ID NO: 1450811 - protein, 15 aa, Mycobacterium tuberculosis
SGRPCRNQAGVAEPC

SEQ ID NO: 1450812 - protein, 7 aa, Mycobacterium tuberculosis
SGRRGPH

SEQ ID NO: 1450813 - protein, 23 aa, Mycobacterium tuberculosis
SGRRRGAGGNRRHRPLRQPPPAY

SEQ ID NO: 1450814 - protein, 19 aa, Mycobacterium tuberculosis
SGRSTSEVTEEQIRDATRR

SEQ ID NO: 1450815 - protein, 18 aa, Mycobacterium tuberculosis
SGSEPAGRAAQGPASRRA

SEQ ID NO: 1450816 - protein, 7 aa, Mycobacterium tuberculosis
SGSFNTG

SEQ ID NO: 1450817 - protein, 28 aa, Mycobacterium tuberculosis
SGSGCSGSAGYADIDRGTQVTVKNGQGD

SEQ ID NO: 1450818 - protein, 8 aa, Mycobacterium tuberculosis
SGSGGPEA

SEQ ID NO: 1450819 - protein, 15 aa, Mycobacterium tuberculosis
SGSGKLRDRKRGHRK

SEQ ID NO: 1450820 - protein, 6 aa, Mycobacterium tuberculosis
SGSGPM

SEQ ID NO: 1450821 - protein, 6 aa, Mycobacterium tuberculosis
SGSGSY

SEQ ID NO: 1450822 - protein, 8 aa, Mycobacterium tuberculosis
SGSGTADV

SEQ ID NO: 1450823 - protein, 8 aa, Mycobacterium tuberculosis
SGSNSGRV

SEQ ID NO: 1450824 - protein, 52 aa, Mycobacterium tuberculosis
SGSPGSGAAGGLGGAGGNGGAGGGGGTGFNPGAPGDPGTQGATGANGQHGLN

SEQ ID NO: 1450825 - protein, 14 aa, Mycobacterium tuberculosis
SGSRCPRSGCPGPT

SEQ ID NO: 1450826 - protein, 14 aa, Mycobacterium tuberculosis
SGSRGGSSRSTAAR

SEQ ID NO: 1450827 - protein, 7 aa, Mycobacterium tuberculosis
SGSTVGD

SEQ ID NO: 1450828 - protein, 15 aa, Mycobacterium tuberculosis
SGSVKRPTSAILAAP

SEQ ID NO: 1450829 - protein, 9 aa, Mycobacterium tuberculosis
SGTDAAVAE

SEQ ID NO: 1450830 - protein, 5 aa, Mycobacterium tuberculosis
SGTGD

SEQ ID NO: 1450831 - protein, 35 aa, Mycobacterium tuberculosis
SGTGNIGIGNSGIGNTGIGNPDVGNTGLGNSGTGN

SEQ ID NO: 1450832 - protein, 37 aa, Mycobacterium tuberculosis
SGTGNIGIGNSGIGNTGIGNPGVGNTGLGNSGTGNRG

SEQ ID NO: 1450833 - protein, 13 aa, Mycobacterium tuberculosis
SGTGNWGGVQFGE

SEQ ID NO: 1450834 - protein, 7 aa, Mycobacterium tuberculosis
SGTGRSR

SEQ ID NO: 1450835 - protein, 8 aa, Mycobacterium tuberculosis
SGTSYAAG

SEQ ID NO: 1450836 - protein, 10 aa, Mycobacterium tuberculosis
SGTTGSGKST

SEQ ID NO: 1450837 - protein, 17 aa, Mycobacterium tuberculosis
SGTTMRGRGGPNRGSRP

SEQ ID NO: 1450838 - protein, 41 aa, Mycobacterium tuberculosis
SGVAGGAGGRGGTAVAAGRAVEAATAGKAVAAGRAVEAEMA

SEQ ID NO: 1450839 - protein, 12 aa, Mycobacterium tuberculosis
SGVDASNEGRGD

SEQ ID NO: 1450840 - protein, 13 aa, Mycobacterium tuberculosis
SGVGGAGCSGGTA

SEQ ID NO: 1450841 - protein, 19 aa, Mycobacterium tuberculosis
SGVPATSGLPKPPFQTENR

SEQ ID NO: 1450842 - protein, 6 aa, Mycobacterium tuberculosis
SGVSAR

SEQ ID NO: 1450843 - protein, 18 aa, Mycobacterium tuberculosis
SGVSPGRHGGCRRQRRRR

SEQ ID NO: 1450844 - protein, 8 aa, Mycobacterium tuberculosis
SGVSPGWN

SEQ ID NO: 1450845 - protein, 8 aa, Mycobacterium tuberculosis
SGVTRSGG

SEQ ID NO: 1450846 - protein, 14 aa, Mycobacterium tuberculosis
SGWPRQRESTSRGW

SEQ ID NO: 1450847 - protein, 15 aa, Mycobacterium tuberculosis
SGYTGGGPNPFGPPR

SEQ ID NO: 1450848 - protein, 21 aa, Mycobacterium tuberculosis
SHAADEKQAAPPMRRRGDRHR

SEQ ID NO: 1450849 - protein, 5 aa, Mycobacterium tuberculosis
SHAAG

SEQ ID NO: 1450850 - protein, 16 aa, Mycobacterium tuberculosis
SHAGNRSPAQAPTQRT

SEQ ID NO: 1450851 - protein, 6 aa, Mycobacterium tuberculosis
SHATGR

SEQ ID NO: 1450852 - protein, 26 aa, Mycobacterium tuberculosis
SHATPGHPTHAGPASIPQRWLSSRTS

SEQ ID NO: 1450853 - protein, 4 aa, Mycobacterium tuberculosis
SHDW

SEQ ID NO: 1450854 - protein, 15 aa, Mycobacterium tuberculosis
SHEGLAGSSPQRTRC

SEQ ID NO: 1450855 - protein, 7 aa, Mycobacterium tuberculosis
SHGRDKP

SEQ ID NO: 1450856 - protein, 7 aa, Mycobacterium tuberculosis
SHNPVSR

SEQ ID NO: 1450857 - protein, 4 aa, Mycobacterium tuberculosis
SHPA

SEQ ID NO: 1450858 - protein, 8 aa, Mycobacterium tuberculosis
SHPGVSNT

SEQ ID NO: 1450859 - protein, 13 aa, Mycobacterium tuberculosis
SHPTTPFVAVDYD

SEQ ID NO: 1450860 - protein, 8 aa, Mycobacterium tuberculosis
SHQSASRA

SEQ ID NO: 1450861 - protein, 7 aa, Mycobacterium tuberculosis
SHRPRRR

SEQ ID NO: 1450862 - protein, 8 aa, Mycobacterium tuberculosis
SHRVSADS

SEQ ID NO: 1450863 - protein, 5 aa, Mycobacterium tuberculosis
SHSAQ

SEQ ID NO: 1450864 - protein, 5 aa, Mycobacterium tuberculosis
SHYPP

SEQ ID NO: 1450865 - protein, 13 aa, Mycobacterium tuberculosis
SIAAGGAGLACAD

SEQ ID NO: 1450866 - protein, 8 aa, Mycobacterium tuberculosis
SIASPTPG

SEQ ID NO: 1450867 - protein, 6 aa, Mycobacterium tuberculosis
SIDGNR

SEQ ID NO: 1450868 - protein, 18 aa, Mycobacterium tuberculosis
SIGGAGGTGGKRGQRRKR

SEQ ID NO: 1450869 - protein, 42 aa, Mycobacterium tuberculosis; identical to SEQ ID NO: 154053

SEQ ID NO: 1450870 - protein, 17 aa, Mycobacterium tuberculosis
SIPAGDDVLDPDEPTYD

SEQ ID NO: 1450871 - protein, 8 aa, Mycobacterium tuberculosis
SIPGPAGE

SEQ ID NO: 1450872 - protein, 4 aa, Mycobacterium tuberculosis
SIPY

SEQ ID NO: 1450873 - protein, 13 aa, Mycobacterium tuberculosis
SIRNQSPLGTRNE

SEQ ID NO: 1450874 - protein, 10 aa, Mycobacterium tuberculosis
SISGTAPSRL

SEQ ID NO: 1450875 - protein, 13 aa, Mycobacterium tuberculosis
SITAPDDRTVNAE

SEQ ID NO: 1450876 - protein, 19 aa, Mycobacterium tuberculosis
SITDGASSRRNQLLWTWAP

SEQ ID NO: 1450877 - protein, 12 aa, Mycobacterium tuberculosis
SITDGNGPSGVA

SEQ ID NO: 1450878 - protein, 7 aa, Mycobacterium tuberculosis
SITSAGQ

SEQ ID NO: 1450879 - protein, 8 aa, Mycobacterium tuberculosis
SITSAGQP

SEQ ID NO: 1450880 - protein, 17 aa, Mycobacterium tuberculosis
SITTTVDSGVRSGQSRC

SEQ ID NO: 1450881 - protein, 21 aa, Mycobacterium tuberculosis
SKGEAGTGDVSNATTHMRAHR

SEQ ID NO: 1450882 - protein, 7 aa, Mycobacterium tuberculosis
SKIGEKS

SEQ ID NO: 1450883 - protein, 35 aa, Mycobacterium tuberculosis
SKKTNRYDRSMSRRRSRRRRTAKRAGRSVDKREGL

SEQ ID NO: 1450884 - protein, 7 aa, Mycobacterium tuberculosis
SKNGGGR

SEQ ID NO: 1450885 - protein, 23 aa, Mycobacterium tuberculosis
SKPGWGAARTGTRRHRAQAGNHT

SEQ ID NO: 1450886 - protein, 9 aa, Mycobacterium tuberculosis
SKPLPEGMR

SEQ ID NO: 1450887 - protein, 7 aa, Mycobacterium tuberculosis
SKPPFAQ

SEQ ID NO: 1450888 - protein, 16 aa, Mycobacterium tuberculosis
SKPPFPPLPPSPPVPA

SEQ ID NO: 1450889 - protein, 14 aa, Mycobacterium tuberculosis
SKPTAAQGSMSPRV

SEQ ID NO: 1450890 - protein, 19 aa, Mycobacterium tuberculosis
SKPTNSSLWPASNGHAASR

SEQ ID NO: 1450891 - protein, 32 aa, Mycobacterium tuberculosis; identical to SEQ ID NO: 187738

SEQ ID NO: 1450892 - protein, 19 aa, Mycobacterium tuberculosis
SKQRQLDREARTGKKVSAH

SEQ ID NO: 1450893 - protein, 7 aa, Mycobacterium tuberculosis
SKTGARY

SEQ ID NO: 1450894 - protein, 7 aa, Mycobacterium tuberculosis
SKTRNHI

SEQ ID NO: 1450895 - protein, 4 aa, Mycobacterium tuberculosis
SKVL

SEQ ID NO: 1450896 - protein, 13 aa, Mycobacterium tuberculosis
SKYPYTPDGNREF

SEQ ID NO: 1450897 - protein, 5 aa, Mycobacterium tuberculosis
SLAPL

SEQ ID NO: 1450898 - protein, 5 aa, Mycobacterium tuberculosis
SLART

SEQ ID NO: 1450899 - protein, 11 aa, Mycobacterium tuberculosis
SLASKSSDKVE

SEQ ID NO: 1450900 - protein, 4 aa, Mycobacterium tuberculosis
SLAT

SEQ ID NO: 1450901 - protein, 4 aa, Mycobacterium tuberculosis
SLDA

SEQ ID NO: 1450902 - protein, 9 aa, Mycobacterium tuberculosis
SLDDGESDL

SEQ ID NO: 1450903 - protein, 17 aa, Mycobacterium tuberculosis
SLDGGRARRADVDRRRQ

SEQ ID NO: 1450904 - protein, 7 aa, Mycobacterium tuberculosis
SLDSGPI

SEQ ID NO: 1450905 - protein, 10 aa, Mycobacterium tuberculosis
SLEEGQDEIK

SEQ ID NO: 1450906 - protein, 7 aa, Mycobacterium tuberculosis
SLEGGKQ

SEQ ID NO: 1450907 - protein, 5 aa, Mycobacterium tuberculosis
SLETP

SEQ ID NO: 1450908 - protein, 8 aa, Mycobacterium tuberculosis
SLGDGARR

SEQ ID NO: 1450909 - protein, 7 aa, Mycobacterium tuberculosis
SLGDTAT

SEQ ID NO: 1450910 - protein, 17 aa, Mycobacterium tuberculosis
SLGENATVTGGNGGQAV

SEQ ID NO: 1450911 - protein, 7 aa, Mycobacterium tuberculosis
SLGPPGL

SEQ ID NO: 1450912 - protein, 15 aa, Mycobacterium tuberculosis
SLGSSLGSSGLGGGV

SEQ ID NO: 1450913 - protein, 28 aa, Mycobacterium tuberculosis
SLGSSLGSSGLGGGVAANSGRAASVGSL

SEQ ID NO: 1450914 - protein, 4 aa, Mycobacterium tuberculosis
SLNA

SEQ ID NO: 1450915 - protein, 5 aa, Mycobacterium tuberculosis
SLNGP

SEQ ID NO: 1450916 - protein, 11 aa, Mycobacterium tuberculosis
SLPEEAKSIAG

SEQ ID NO: 1450917 - protein, 12 aa, Mycobacterium tuberculosis
SLPGAGGSLTRT

SEQ ID NO: 1450918 - protein, 22 aa, Mycobacterium tuberculosis
SLPGRESTPSDDGGSLHPSEDL

SEQ ID NO: 1450919 - protein, 10 aa, Mycobacterium tuberculosis
SLPGSLGNGC

SEQ ID NO: 1450920 - protein, 5 aa, Mycobacterium tuberculosis
SLPPF

SEQ ID NO: 1450921 - protein, 6 aa, Mycobacterium tuberculosis
SLPPGV

SEQ ID NO: 1450922 - protein, 12 aa, Mycobacterium tuberculosis
SLPTSVNPWDPT

SEQ ID NO: 1450923 - protein, 13 aa, Mycobacterium tuberculosis
SLQSSRADGTTNK

SEQ ID NO: 1450924 - protein, 6 aa, Mycobacterium tuberculosis
SLRSYP

SEQ ID NO: 1450925 - protein, 10 aa, Mycobacterium tuberculosis
SLSGGGTGTR

SEQ ID NO: 1450926 - protein, 10 aa, Mycobacterium tuberculosis
SLSNERKVAE

SEQ ID NO: 1450927 - protein, 12 aa, Mycobacterium tuberculosis
SLSPYGPPGHRY

SEQ ID NO: 1450928 - protein, 37 aa, Mycobacterium tuberculosis
SLTEPGRSSAFGGQLPGPGGRAGAGGCGTPAWGRRQG

SEQ ID NO: 1450929 - protein, 4 aa, Mycobacterium tuberculosis
SMGA

SEQ ID NO: 1450930 - protein, 17 aa, Mycobacterium tuberculosis
SMGQENDGLDRVNPPRP

SEQ ID NO: 1450931 - protein, 13 aa, Mycobacterium tuberculosis
SMPAHGRDHDRRI

SEQ ID NO: 1450932 - protein, 33 aa, Mycobacterium tuberculosis
SMPARRGPAGWGPASTAIRTPASTTSPRASPRF

SEQ ID NO: 1450933 - protein, 12 aa, Mycobacterium tuberculosis
SMSAPDSENGGE

SEQ ID NO: 1450934 - protein, 11 aa, Mycobacterium tuberculosis
SMTTNGVSHSR

SEQ ID NO: 1450935 - protein, 15 aa, Mycobacterium tuberculosis
SNAGTNLLGSSRDNL

SEQ ID NO: 1450936 - protein, 7 aa, Mycobacterium tuberculosis
SNASATV

SEQ ID NO: 1450937 - protein, 7 aa, Mycobacterium tuberculosis
SNDERPA

SEQ ID NO: 1450938 - protein, 21 aa, Mycobacterium tuberculosis
SNESTVASSTARICPAGPAAR

SEQ ID NO: 1450939 - protein, 4 aa, Mycobacterium tuberculosis
SNEV

SEQ ID NO: 1450940 - protein, 7 aa, Mycobacterium tuberculosis
SNGAGTV

SEQ ID NO: 1450941 - protein, 36 aa, Mycobacterium tuberculosis
SNGGNGGAGGNGGNDNSSTLADAGSGGAGAAGGNGG

SEQ ID NO: 1450942 - protein, 6 aa, Mycobacterium tuberculosis
SNGIGS

SEQ ID NO: 1450943 - protein, 6 aa, Mycobacterium tuberculosis
SNGMNN

SEQ ID NO: 1450944 - protein, 81 aa, Mycobacterium tuberculosis
SNGSNGETSGAARIGRNGGTGDTGGLFGQSGSPGSGAAGGLGGAGGNGGAGGGGGTGFNPGAPGDPGTQGATGANGQHGLN

SEQ ID NO: 1450945 - protein, 11 aa, Mycobacterium tuberculosis
SNLGELRPGSR

SEQ ID NO: 1450946 - protein, 14 aa, Mycobacterium tuberculosis
SNLPDAQDRARWAG

SEQ ID NO: 1450947 - protein, 6 aa, Mycobacterium tuberculosis
SNMAST

SEQ ID NO: 1450948 - protein, 8 aa, Mycobacterium tuberculosis
SNPGPAGY

SEQ ID NO: 1450949 - protein, 13 aa, Mycobacterium tuberculosis
SNPPAPGCGWIRH

SEQ ID NO: 1450950 - protein, 6 aa, Mycobacterium tuberculosis
SNREDM

SEQ ID NO: 1450951 - protein, 15 aa, Mycobacterium tuberculosis
SNRTSVIHRRRRGWP

SEQ ID NO: 1450952 - protein, 24 aa, Mycobacterium tuberculosis
SNSAQRDARNSRDESARASDTDRI

SEQ ID NO: 1450953 - protein, 10 aa, Mycobacterium tuberculosis
SNSGCKGPKL

SEQ ID NO: 1450954 - protein, 5 aa, Mycobacterium tuberculosis
SNSHR

SEQ ID NO: 1450955 - protein, 44 aa, Mycobacterium tuberculosis
SNSSPTTRYTTTRKRTCHRAPGRPPVGTPTGSVASTCSPPTLRA

SEQ ID NO: 1450956 - protein, 19 aa, Mycobacterium tuberculosis
SNSTGQAGLATTATDQLKR

SEQ ID NO: 1450957 - protein, 13 aa, Mycobacterium tuberculosis
SNTPSGCHAPSGH

SEQ ID NO: 1450958 - protein, 4 aa, Mycobacterium tuberculosis
SNVP

SEQ ID NO: 1450959 - protein, 10 aa, Mycobacterium tuberculosis
SPAALTDPKR

SEQ ID NO: 1450960 - protein, 9 aa, Mycobacterium tuberculosis
SPADESVRE

SEQ ID NO: 1450961 - protein, 10 aa, Mycobacterium tuberculosis
SPAGEAGDVG

SEQ ID NO: 1450962 - protein, 5 aa, Mycobacterium tuberculosis
SPAGQ

SEQ ID NO: 1450963 - protein, 17 aa, Mycobacterium tuberculosis
SPALATASATAATSRIP

SEQ ID NO: 1450964 - protein, 5 aa, Mycobacterium tuberculosis
SPAPT

SEQ ID NO: 1450965 - protein, 15 aa, Mycobacterium tuberculosis
SPARRRTRRGRRRRR

SEQ ID NO: 1450966 - protein, 23 aa, Mycobacterium tuberculosis
SPARRRTRRGRRRRRCRTTIRRP

SEQ ID NO: 1450967 - protein, 9 aa, Mycobacterium tuberculosis
SPASRPDGR

SEQ ID NO: 1450968 - protein, 9 aa, Mycobacterium tuberculosis
SPASSLRKA

SEQ ID NO: 1450969 - protein, 51 aa, Mycobacterium tuberculosis
SPATANAGCNGSTDGASEDGDNGNAGSGATGGTGGNGGTGGDGGAAGLGGV

SEQ ID NO: 1450970 - protein, 44 aa, Mycobacterium tuberculosis
SPAVVGEEPATPAMPSPPLPPAPPLPTSPPLPPLPPAPPAPPAT

SEQ ID NO: 1450971 - protein, 35 aa, Mycobacterium tuberculosis
SPAWAPPAPPAPPAPPLPPSSPGVPDEPRKIAVIS

SEQ ID NO: 1450972 - protein, 13 aa, Mycobacterium tuberculosis
SPDCGREGSYRDT

SEQ ID NO: 1450973 - protein, 18 aa, Mycobacterium tuberculosis
SPDEQAPAKAPPSPYPAR

SEQ ID NO: 1450974 - protein, 8 aa, Mycobacterium tuberculosis
SPDGSVHD

SEQ ID NO: 1450975 - protein, 7 aa, Mycobacterium tuberculosis
SPDQRQE

SEQ ID NO: 1450976 - protein, 9 aa, Mycobacterium tuberculosis
SPEADTGGM

SEQ ID NO: 1450977 - protein, 13 aa, Mycobacterium tuberculosis
SPEGQASSLESIG

SEQ ID NO: 1450978 - protein, 4 aa, Mycobacterium tuberculosis
SPEQ

SEQ ID NO: 1450979 - protein, 4 aa, Mycobacterium tuberculosis
SPEV

SEQ ID NO: 1450980 - protein, 5 aa, Mycobacterium tuberculosis
SPFPR

SEQ ID NO: 1450981 - protein, 5 aa, Mycobacterium tuberculosis
SPFQH

SEQ ID NO: 1450982 - protein, 17 aa, Mycobacterium tuberculosis
SPFSPSSSPPAPPAPLG

SEQ ID NO: 1450983 - protein, 25 aa, Mycobacterium tuberculosis
SPFSPSSSPPAPPAPLGPGAPPDFP

SEQ ID NO: 1450984 - protein, 24 aa, Mycobacterium tuberculosis
SPGAVVGGNGGVGGLGGAGSPGGL

SEQ ID NO: 1450985 - protein, 13 aa, Mycobacterium tuberculosis
SPGFDATSPAKLG

SEQ ID NO: 1450986 - protein, 6 aa, Mycobacterium tuberculosis
SPGGKT

SEQ ID NO: 1450987 - protein, 37 aa, Mycobacterium tuberculosis
SPGGLGGAGGTGGLGGAGAGGGADGDDGDDGQPGNNG

SEQ ID NO: 1450988 - protein, 7 aa, Mycobacterium tuberculosis
SPGGRTC

SEQ ID NO: 1450989 - protein, 116 aa, Mycobacterium tuberculosis
SPGHTGHTGNPITPGTPITPGTPITPGNPDHSGNSNHTHPGSAGNSDHTNARHSRHAGDPGQAGHPGDPGQTGHTRRANPDHAGHPPGRPGHTGNPGHARYPSSRSTPAAGSGTGA

SEQ ID NO: 1450990 - protein, 7 aa, Mycobacterium tuberculosis
SPGLPSE

SEQ ID NO: 1450991 - protein, 14 aa, Mycobacterium tuberculosis
SPGLTGASPSYAPS

SEQ ID NO: 1450992 - protein, 19 aa, Mycobacterium tuberculosis
SPGRPSPTTSACTETPSSS

SEQ ID NO: 1450993 - protein, 12 aa, Mycobacterium tuberculosis
SPGSGQDREREE

SEQ ID NO: 1450994 - protein, 4 aa, Mycobacterium tuberculosis
SPGV

SEQ ID NO: 1450995 - protein, 6 aa, Mycobacterium tuberculosis
SPHPAG

SEQ ID NO: 1450996 - protein, 8 aa, Mycobacterium tuberculosis
SPHPSPLS

SEQ ID NO: 1450997 - protein, 5 aa, Mycobacterium tuberculosis
SPIAE

SEQ ID NO: 1450998 - protein, 6 aa, Mycobacterium tuberculosis
SPIAGH

SEQ ID NO: 1450999 - protein, 13 aa, Mycobacterium tuberculosis
SPITNDNDQARYD

SEQ ID NO: 1451000 - protein, 7 aa, Mycobacterium tuberculosis
SPKTSRR

SEQ ID NO: 1451001 - protein, 14 aa, Mycobacterium tuberculosis
SPLAPEKEGDADIR

SEQ ID NO: 1451002 - protein, 5 aa, Mycobacterium tuberculosis
SPLAR

SEQ ID NO: 1451003 - protein, 8 aa, Mycobacterium tuberculosis
SPLPAAYA

SEQ ID NO: 1451004 - protein, 7 aa, Mycobacterium tuberculosis
SPLPAGR

SEQ ID NO: 1451005 - protein, 5 aa, Mycobacterium tuberculosis
SPLPW

SEQ ID NO: 1451006 - protein, 71 aa, Mycobacterium tuberculosis
SPLSRPALPPAPPSPAVSPNPPAPPAPPAPESPAALPPAPPAPPTDPNSMPVPPAPPAPPSPINPPVPPVR

SEQ ID NO: 1451007 - protein, 12 aa, Mycobacterium tuberculosis
SPLTPDHVNPER

SEQ ID NO: 1451008 - protein, 7 aa, Mycobacterium tuberculosis
SPMPPAS

SEQ ID NO: 1451009 - protein, 7 aa, Mycobacterium tuberculosis
SPNLPPG

SEQ ID NO: 1451010 - protein, 8 aa, Mycobacterium tuberculosis
SPNSPLGG

SEQ ID NO: 1451011 - protein, 13 aa, Mycobacterium tuberculosis
SPPAPPAPPAPPA

SEQ ID NO: 1451012 - protein, 5 aa, Mycobacterium tuberculosis
SPPAV

SEQ ID NO: 1451013 - protein, 8 aa, Mycobacterium tuberculosis
SPPFPPFP

SEQ ID NO: 1451014 - protein, 26 aa, Mycobacterium tuberculosis
SPPGLSSPATWATAPSGAATSRAYSA

SEQ ID NO: 1451015 - protein, 14 aa, Mycobacterium tuberculosis
SPPMPPAPPPTPGL

SEQ ID NO: 1451016 - protein, 18 aa, Mycobacterium tuberculosis
SPPNQDAQEGRPDSPTAE

SEQ ID NO: 1451017 - protein, 21 aa, Mycobacterium tuberculosis
SPPPAGIPATSTSPAHARHTG

SEQ ID NO: 1451018 - protein, 6 aa, Mycobacterium tuberculosis
SPPPIA

SEQ ID NO: 1451019 - protein, 23 aa, Mycobacterium tuberculosis
SPPRQRAPPSPPLPPSDTSTALK

SEQ ID NO: 1451020 - protein, 14 aa, Mycobacterium tuberculosis
SPPTPATPSGTCAA

SEQ ID NO: 1451021 - protein, 17 aa, Mycobacterium tuberculosis
SPPTPPSPPGPRCRSAH

SEQ ID NO: 1451022 - protein, 9 aa, Mycobacterium tuberculosis
SPPYTGGPV

SEQ ID NO: 1451023 - protein, 20 aa, Mycobacterium tuberculosis
SPQGGGPVNAYPPSRPGEKN

SEQ ID NO: 1451024 - protein, 5 aa, Mycobacterium tuberculosis
SPQHA

SEQ ID NO: 1451025 - protein, 5 aa, Mycobacterium tuberculosis
SPQHE

SEQ ID NO: 1451026 - protein, 4 aa, Mycobacterium tuberculosis
SPQQ

SEQ ID NO: 1451027 - protein, 5 aa, Mycobacterium tuberculosis
SPRDK

SEQ ID NO: 1451028 - protein, 14 aa, Mycobacterium tuberculosis
SPRDRIPGTAAAYP

SEQ ID NO: 1451029 - protein, 8 aa, Mycobacterium tuberculosis
SPRKAGVY

SEQ ID NO: 1451030 - protein, 13 aa, Mycobacterium tuberculosis
SPRKRSATGRSGL

SEQ ID NO: 1451031 - protein, 31 aa, Mycobacterium tuberculosis
SPRLRSPVSDGGDPLRPASPRLRSPLGASRP

SEQ ID NO: 1451032 - protein, 6 aa, Mycobacterium tuberculosis
SPRPLG

SEQ ID NO: 1451033 - protein, 21 aa, Mycobacterium tuberculosis
SPRTPGVPRPGLSPIFIPALY

SEQ ID NO: 1451034 - protein, 8 aa, Mycobacterium tuberculosis
SPSAPTPI

SEQ ID NO: 1451035 - protein, 13 aa, Mycobacterium tuberculosis
SPSEDAREMRQNS

SEQ ID NO: 1451036 - protein, 13 aa, Mycobacterium tuberculosis
SPSPSKRRTASRA

SEQ ID NO: 1451037 - protein, 19 aa, Mycobacterium tuberculosis
SPSTAASAPSASRPPPLWM

SEQ ID NO: 1451038 - protein, 7 aa, Mycobacterium tuberculosis
SPSYDPN

SEQ ID NO: 1451039 - protein, 10 aa, Mycobacterium tuberculosis
SPTCGAEQRQ

SEQ ID NO: 1451040 - protein, 14 aa, Mycobacterium tuberculosis
SPTCVSTPKTPTGT

SEQ ID NO: 1451041 - protein, 6 aa, Mycobacterium tuberculosis
SPTDPP

SEQ ID NO: 1451042 - protein, 13 aa, Mycobacterium tuberculosis
SPTNPCDWRGGAL

SEQ ID NO: 1451043 - protein, 34 aa, Mycobacterium tuberculosis
SPTPAAAAAADPGPGDAPTSASRISGHIRAALAA

SEQ ID NO: 1451044 - protein, 5 aa, Mycobacterium tuberculosis
SPTRR

SEQ ID NO: 1451045 - protein, 11 aa, Mycobacterium tuberculosis
SPTSMSHPQQV

SEQ ID NO: 1451046 - protein, 12 aa, Mycobacterium tuberculosis
SPTTDAAMALSG

SEQ ID NO: 1451047 - protein, 4 aa, Mycobacterium tuberculosis
SPTW

SEQ ID NO: 1451048 - protein, 6 aa, Mycobacterium tuberculosis
SPTWDP

SEQ ID NO: 1451049 - protein, 9 aa, Mycobacterium tuberculosis
SPVAAAKTT

SEQ ID NO: 1451050 - protein, 15 aa, Mycobacterium tuberculosis
SPVGNFPADSGRRIS

SEQ ID NO: 1451051 - protein, 8 aa, Mycobacterium tuberculosis
SPVRGPAP

SEQ ID NO: 1451052 - protein, 4 aa, Mycobacterium tuberculosis
SPWQ

SEQ ID NO: 1451053 - protein, 14 aa, Mycobacterium tuberculosis
SPYPSRTRNENVFH

SEQ ID NO: 1451054 - protein, 27 aa, Mycobacterium tuberculosis
SQAADSTSGPGPAGRTTASPDTANPRF

SEQ ID NO: 1451055 - protein, 13 aa, Mycobacterium tuberculosis
SQAAKNPPYTATR

SEQ ID NO: 1451056 - protein, 10 aa, Mycobacterium tuberculosis
SQAQQGGQQH

SEQ ID NO: 1451057 - protein, 11 aa, Mycobacterium tuberculosis
SQDAASVRRAA

SEQ ID NO: 1451058 - protein, 15 aa, Mycobacterium tuberculosis
SQGAPAKTTKQSINT

SEQ ID NO: 1451059 - protein, 4 aa, Mycobacterium tuberculosis
SQGD

SEQ ID NO: 1451060 - protein, 9 aa, Mycobacterium tuberculosis
SQGDMRRER

SEQ ID NO: 1451061 - protein, 6 aa, Mycobacterium tuberculosis
SQGIEH

SEQ ID NO: 1451062 - protein, 5 aa, Mycobacterium tuberculosis
SQGTT

SEQ ID NO: 1451063 - protein, 9 aa, Mycobacterium tuberculosis
SQGTTAHST

SEQ ID NO: 1451064 - protein, 7 aa, Mycobacterium tuberculosis
SQHALSG

SEQ ID NO: 1451065 - protein, 22 aa, Mycobacterium tuberculosis
SQHPAGRAPPCGNPPRDAHGPL

SEQ ID NO: 1451066 - protein, 8 aa, Mycobacterium tuberculosis
SQHSGLPA

SEQ ID NO: 1451067 - protein, 5 aa, Mycobacterium tuberculosis
SQPDY

SEQ ID NO: 1451068 - protein, 4 aa, Mycobacterium tuberculosis
SQPI

SEQ ID NO: 1451069 - protein, 21 aa, Mycobacterium tuberculosis
SQRARRRLSTPRAPPDDPRAA

SEQ ID NO: 1451070 - protein, 5 aa, Mycobacterium tuberculosis
SQRFT

SEQ ID NO: 1451071 - protein, 10 aa, Mycobacterium tuberculosis
SQRGGERDLT

SEQ ID NO: 1451072 - protein, 18 aa, Mycobacterium tuberculosis
SQRHPGGTTTQTDAAAGV

SEQ ID NO: 1451073 - protein, 40 aa, Mycobacterium tuberculosis
SQRPLPRTNPSGRPHQQHPRRRRIPRPEAFTQPNRGLTAD

SEQ ID NO: 1451074 - protein, 10 aa, Mycobacterium tuberculosis
SQRRGGPPLP

SEQ ID NO: 1451075 - protein, 7 aa, Mycobacterium tuberculosis
SQSAGDQ

SEQ ID NO: 1451076 - protein, 10 aa, Mycobacterium tuberculosis
SQSRNGGQKE

SEQ ID NO: 1451077 - protein, 6 aa, Mycobacterium tuberculosis
SQVGAK

SEQ ID NO: 1451078 - protein, 34 aa, Mycobacterium tuberculosis
SQVQPRQYERGADQDKPDRDGQSLAATDPHDRSA

SEQ ID NO: 1451079 - protein, 14 aa, Mycobacterium tuberculosis
SQWQGRASRPSTCT

SEQ ID NO: 1451080 - protein, 9 aa, Mycobacterium tuberculosis
SRAAEATET

SEQ ID NO: 1451081 - protein, 10 aa, Mycobacterium tuberculosis
SRAAESPWKS

SEQ ID NO: 1451082 - protein, 29 aa, Mycobacterium tuberculosis
SRADSGHQERAAGQISPRAARDKPRSKKY

SEQ ID NO: 1451083 - protein, 23 aa, Mycobacterium tuberculosis
SRAGANANIGAGDAEDAGGARSD

SEQ ID NO: 1451084 - protein, 16 aa, Mycobacterium tuberculosis
SRAGGQSGPPGPGGRH

SEQ ID NO: 1451085 - protein, 9 aa, Mycobacterium tuberculosis
SRAGSESVL

SEQ ID NO: 1451086 - protein, 5 aa, Mycobacterium tuberculosis
SRAKD

SEQ ID NO: 1451087 - protein, 10 aa, Mycobacterium tuberculosis
SRARGPMGRH

SEQ ID NO: 1451088 - protein, 12 aa, Mycobacterium tuberculosis
SRASEIAPNTTD

SEQ ID NO: 1451089 - protein, 21 aa, Mycobacterium tuberculosis
SRCRPSAGWRSADSTRCTGRG

SEQ ID NO: 1451090 - protein, 12 aa, Mycobacterium tuberculosis
SRCSASVSATRS

SEQ ID NO: 1451091 - protein, 25 aa, Mycobacterium tuberculosis
SRCTGSSTCSAGTPHPGTATAPARP

SEQ ID NO: 1451092 - protein, 13 aa, Mycobacterium tuberculosis
SRDGGGGAGTSVA

SEQ ID NO: 1451093 - protein, 9 aa, Mycobacterium tuberculosis
SRDITPSEA

SEQ ID NO: 1451094 - protein, 10 aa, Mycobacterium tuberculosis
SRDPTVSASG

SEQ ID NO: 1451095 - protein, 15 aa, Mycobacterium tuberculosis
SRDRRRQWRRALSCP

SEQ ID NO: 1451096 - protein, 9 aa, Mycobacterium tuberculosis
SRDSWRGRD

SEQ ID NO: 1451097 - protein, 6 aa, Mycobacterium tuberculosis
SREAGR

SEQ ID NO: 1451098 - protein, 5 aa, Mycobacterium tuberculosis
SREDA

SEQ ID NO: 1451099 - protein, 15 aa, Mycobacterium tuberculosis
SREQTRGTSGRLHDD

SEQ ID NO: 1451100 - protein, 7 aa, Mycobacterium tuberculosis
SRERGPA

SEQ ID NO: 1451101 - protein, 11 aa, Mycobacterium tuberculosis
SRETASDDAKL

SEQ ID NO: 1451102 - protein, 4 aa, Mycobacterium tuberculosis
SREV

SEQ ID NO: 1451103 - protein, 7 aa, Mycobacterium tuberculosis
SREVPET

SEQ ID NO: 1451104 - protein, 5 aa, Mycobacterium tuberculosis
SRFPG

SEQ ID NO: 1451105 - protein, 10 aa, Mycobacterium tuberculosis
SRFPSSGPYK

SEQ ID NO: 1451106 - protein, 11 aa, Mycobacterium tuberculosis
SRFSPDRGSSL

SEQ ID NO: 1451107 - protein, 22 aa, Mycobacterium tuberculosis
SRGAGRAAGCRPRRPRRLMRPL

SEQ ID NO: 1451108 - protein, 17 aa, Mycobacterium tuberculosis
SRGARRQPDSAGGQEVG

SEQ ID NO: 1451109 - protein, 6 aa, Mycobacterium tuberculosis
SRGPEY

SEQ ID NO: 1451110 - protein, 15 aa, Mycobacterium tuberculosis
SRGRRSCRAARRPSA

SEQ ID NO: 1451111 - protein, 19 aa, Mycobacterium tuberculosis
SRGRSPRQRTRAPKPHARN

SEQ ID NO: 1451112 - protein, 29 aa, Mycobacterium tuberculosis
SRGSLPASARKNGPRLPERQSASFNFTLH

SEQ ID NO: 1451113 - protein, 17 aa, Mycobacterium tuberculosis
SRGSTRCARSAPNARRR

SEQ ID NO: 1451114 - protein, 16 aa, Mycobacterium tuberculosis
SRHPLAGGSSASAGAG

SEQ ID NO: 1451115 - protein, 17 aa, Mycobacterium tuberculosis
SRHPLTPGSRRGAAGTR

SEQ ID NO: 1451116 - protein, 15 aa, Mycobacterium tuberculosis
SRHRDDARGVVTSPE

SEQ ID NO: 1451117 - protein, 12 aa, Mycobacterium tuberculosis
SRHRRQRAATRR

SEQ ID NO: 1451118 - protein, 12 aa, Mycobacterium tuberculosis
SRIEGIGRPRVE

SEQ ID NO: 1451119 - protein, 4 aa, Mycobacterium tuberculosis
SRIR

SEQ ID NO: 1451120 - protein, 8 aa, Mycobacterium tuberculosis
SRKVAEGR

SEQ ID NO: 1451121 - protein, 18 aa, Mycobacterium tuberculosis
SRLDGSDRRNSGGGATRM

SEQ ID NO: 1451122 - protein, 7 aa, Mycobacterium tuberculosis
SRMPQSR

SEQ ID NO: 1451123 - protein, 14 aa, Mycobacterium tuberculosis
SRNSSSPPTKLPED

SEQ ID NO: 1451124 - protein, 23 aa, Mycobacterium tuberculosis
SRPATGAVPPGRQSVRNAQAAAT

SEQ ID NO: 1451125 - protein, 4 aa, Mycobacterium tuberculosis
SRPE

SEQ ID NO: 1451126 - protein, 20 aa, Mycobacterium tuberculosis
SRPGLPAAAAGAGHRAARPR

SEQ ID NO: 1451127 - protein, 32 aa, Mycobacterium tuberculosis
SRPLAPSAPVAPLTPPLPPAPPFPPAAPVPPT

SEQ ID NO: 1451128 - protein, 45 aa, Mycobacterium tuberculosis
SRPLAPSAPVAPLTPPLPPAPPFPPAAPVPPTPPSPPVPAAPGVP

SEQ ID NO: 1451129 - protein, 6 aa, Mycobacterium tuberculosis
SRPRAG

SEQ ID NO: 1451130 - protein, 15 aa, Mycobacterium tuberculosis
SRPSCPTSPSSPAPT

SEQ ID NO: 1451131 - protein, 18 aa, Mycobacterium tuberculosis
SRPSGCTATSVGTSGVVP

SEQ ID NO: 1451132 - protein, 6 aa, Mycobacterium tuberculosis
SRPSRY

SEQ ID NO: 1451133 - protein, 4 aa, Mycobacterium tuberculosis
SRPV

SEQ ID NO: 1451134 - protein, 11 aa, Mycobacterium tuberculosis
SRPVGGRGDHL

SEQ ID NO: 1451135 - protein, 21 aa, Mycobacterium tuberculosis
SRQHGDAGPDEWAAAPDRSTK

SEQ ID NO: 1451136 - protein, 5 aa, Mycobacterium tuberculosis
SRQNG

SEQ ID NO: 1451137 - protein, 10 aa, Mycobacterium tuberculosis
SRQRRGPETT

SEQ ID NO: 1451138 - protein, 6 aa, Mycobacterium tuberculosis
SRRATL

SEQ ID NO: 1451139 - protein, 11 aa, Mycobacterium tuberculosis
SRREAEDQGQG

SEQ ID NO: 1451140 - protein, 35 aa, Mycobacterium tuberculosis
SRRGGKGHAGRVRPPPHPAAGGDCPPTDSAQAAQP

SEQ ID NO: 1451141 - protein, 25 aa, Mycobacterium tuberculosis
SRRGGSYRRSARPNMRARWRPGAQT

SEQ ID NO: 1451142 - protein, 10 aa, Mycobacterium tuberculosis
SRRGTRSSRR

SEQ ID NO: 1451143 - protein, 17 aa, Mycobacterium tuberculosis
SRRIPPRAPGRRTRPWP

SEQ ID NO: 1451144 - protein, 32 aa, Mycobacterium tuberculosis
SRRKSTKDHVDTQPAARHGPSRRRSFDRGAKR

SEQ ID NO: 1451145 - protein, 9 aa, Mycobacterium tuberculosis
SRRNHGRSR

SEQ ID NO: 1451146 - protein, 4 aa, Mycobacterium tuberculosis
SRRP

SEQ ID NO: 1451147 - protein, 7 aa, Mycobacterium tuberculosis
SRRPAAL

SEQ ID NO: 1451148 - protein, 21 aa, Mycobacterium tuberculosis
SRRPAGLQPIEKTTDRPTTRR

SEQ ID NO: 1451149 - protein, 5 aa, Mycobacterium tuberculosis
SRRPL

SEQ ID NO: 1451150 - protein, 13 aa, Mycobacterium tuberculosis
SRRPRSWRPNGET

SEQ ID NO: 1451151 - protein, 16 aa, Mycobacterium tuberculosis
SRRPTSRASRCRSPST

SEQ ID NO: 1451152 - protein, 4 aa, Mycobacterium tuberculosis
SRRR

SEQ ID NO: 1451153 - protein, 8 aa, Mycobacterium tuberculosis
SRRRAGSH

SEQ ID NO: 1451154 - protein, 8 aa, Mycobacterium tuberculosis
SRRREEGL

SEQ ID NO: 1451155 - protein, 12 aa, Mycobacterium tuberculosis
SRRRRSMGAPVS

SEQ ID NO: 1451156 - protein, 9 aa, Mycobacterium tuberculosis
SRRRTSWPA

SEQ ID NO: 1451157 - protein, 20 aa, Mycobacterium tuberculosis
SRRSPSRSSRRARTGSRLRR

SEQ ID NO: 1451158 - protein, 24 aa, Mycobacterium tuberculosis
SRRVGVGRPGPRQGHPGLVLRCPG

SEQ ID NO: 1451159 - protein, 10 aa, Mycobacterium tuberculosis
SRSALTQAAT

SEQ ID NO: 1451160 - protein, 6 aa, Mycobacterium tuberculosis
SRSANN

SEQ ID NO: 1451161 - protein, 108 aa, Mycobacterium tuberculosis
SRSGATGSVNAAGSSTHAVQTAAGKNAGSSGSTSSASRAPTEVSAPAVPIRSSTSPAAVSRTPTRSPAAAPNVASVPGSSSSAPPGSMASSGMPRRSSSSSSYPASTI

SEQ ID NO: 1451162 - protein, 7 aa, Mycobacterium tuberculosis
SRSGITP

SEQ ID NO: 1451163 - protein, 5 aa, Mycobacterium tuberculosis
SRSHG

SEQ ID NO: 1451164 - protein, 13 aa, Mycobacterium tuberculosis
SRSPDFVDETAGQ

SEQ ID NO: 1451165 - protein, 15 aa, Mycobacterium tuberculosis
SRSRRSTRPGWPRHP

SEQ ID NO: 1451166 - protein, 15 aa, Mycobacterium tuberculosis
SRSSPGGPTSFATRT

SEQ ID NO: 1451167 - protein, 11 aa, Mycobacterium tuberculosis
SRSTALPVRST

SEQ ID NO: 1451168 - protein, 21 aa, Mycobacterium tuberculosis
SRSTRRGSKPHGATSRGGRWT

SEQ ID NO: 1451169 - protein, 8 aa, Mycobacterium tuberculosis
SRSTTSAA

SEQ ID NO: 1451170 - protein, 30 aa, Mycobacterium tuberculosis
SRSTWAADRASPVTRPSSPPSPTNPSHRWF

SEQ ID NO: 1451171 - protein, 13 aa, Mycobacterium tuberculosis
SRSWPSTPSDHVS

SEQ ID NO: 1451172 - protein, 4 aa, Mycobacterium tuberculosis
SRTA

SEQ ID NO: 1451173 - protein, 9 aa, Mycobacterium tuberculosis
SRTGTVGDY

SEQ ID NO: 1451174 - protein, 5 aa, Mycobacterium tuberculosis
SRTNY

SEQ ID NO: 1451175 - protein, 9 aa, Mycobacterium tuberculosis
SRTRTGGSA

SEQ ID NO: 1451176 - protein, 19 aa, Mycobacterium tuberculosis
SRTSLSASSGEHDWSSPLG

SEQ ID NO: 1451177 - protein, 9 aa, Mycobacterium tuberculosis
SRTSSLGDL

SEQ ID NO: 1451178 - protein, 12 aa, Mycobacterium tuberculosis
SRTSTQRWPRHT

SEQ ID NO: 1451179 - protein, 6 aa, Mycobacterium tuberculosis
SRTTVS

SEQ ID NO: 1451180 - protein, 20 aa, Mycobacterium tuberculosis
SRVAARRRAGQRAESRQHPS

SEQ ID NO: 1451181 - protein, 26 aa, Mycobacterium tuberculosis
SRVATSTHSISRTSTAAGAPSDQEVM

SEQ ID NO: 1451182 - protein, 13 aa, Mycobacterium tuberculosis
SRVEGGRAGEPGV

SEQ ID NO: 1451183 - protein, 4 aa, Mycobacterium tuberculosis
SRWE

SEQ ID NO: 1451184 - protein, 7 aa, Mycobacterium tuberculosis
SRWPRAG

SEQ ID NO: 1451185 - protein, 12 aa, Mycobacterium tuberculosis
SRYSAATAATAA

SEQ ID NO: 1451186 - protein, 9 aa, Mycobacterium tuberculosis
SSAANNSNI

SEQ ID NO: 1451187 - protein, 12 aa, Mycobacterium tuberculosis
SSADQKVDLDRQ

SEQ ID NO: 1451188 - protein, 60 aa, Mycobacterium tuberculosis
SSAGANRSAPTSRLRPEPSGSRHPSTQRSVKPKLTRRAPPQGQNPETPTPTAAVQPPPVL

SEQ ID NO: 1451189 - protein, 12 aa, Mycobacterium tuberculosis
SSAGSGGGATID

SEQ ID NO: 1451190 - protein, 10 aa, Mycobacterium tuberculosis
SSAQSHDEQL

SEQ ID NO: 1451191 - protein, 7 aa, Mycobacterium tuberculosis
SSARPRR

SEQ ID NO: 1451192 - protein, 43 aa, Mycobacterium tuberculosis
SSARTSSVARLSPSPAPPRRTPSSKARSTSCPRTRAGGTRRFS

SEQ ID NO: 1451193 - protein, 22 aa, Mycobacterium tuberculosis
SSASDRSMPAPEAIRAASRVRA

SEQ ID NO: 1451194 - protein, 23 aa, Mycobacterium tuberculosis
SSASRSAPPTTTGCAGAAELWPS

SEQ ID NO: 1451195 - protein, 12 aa, Mycobacterium tuberculosis
SSATRPPSTPDA

SEQ ID NO: 1451196 - protein, 6 aa, Mycobacterium tuberculosis
SSATVR

SEQ ID NO: 1451197 - protein, 17 aa, Mycobacterium tuberculosis
SSCANSTAKPTEPPSSS

SEQ ID NO: 1451198 - protein, 8 aa, Mycobacterium tuberculosis
SSCSADWS

SEQ ID NO: 1451199 - protein, 8 aa, Mycobacterium tuberculosis
SSDDGAAE

SEQ ID NO: 1451200 - protein, 15 aa, Mycobacterium tuberculosis
SSDGWYSGRSEAGLP

SEQ ID NO: 1451201 - protein, 13 aa, Mycobacterium tuberculosis
SSDNPYVDVFVRV

SEQ ID NO: 1451202 - protein, 12 aa, Mycobacterium tuberculosis
SSDPKPREGTET

SEQ ID NO: 1451203 - protein, 48 aa, Mycobacterium tuberculosis
SSDPKPREGTETPSDAGTEVDDKPSSDPKPREGTETSTPSVPHTGPVP

SEQ ID NO: 1451204 - protein, 6 aa, Mycobacterium tuberculosis
SSDRAT

SEQ ID NO: 1451205 - protein, 8 aa, Mycobacterium tuberculosis
SSDRTFGT

SEQ ID NO: 1451206 - protein, 5 aa, Mycobacterium tuberculosis
SSDTA

SEQ ID NO: 1451207 - protein, 8 aa, Mycobacterium tuberculosis
SSEAATDV

SEQ ID NO: 1451208 - protein, 5 aa, Mycobacterium tuberculosis
SSETL

SEQ ID NO: 1451209 - protein, 12 aa, Mycobacterium tuberculosis
SSFLGGGGAGGR

SEQ ID NO: 1451210 - protein, 14 aa, Mycobacterium tuberculosis
SSGCPEFRPGDDLS

SEQ ID NO: 1451211 - protein, 10 aa, Mycobacterium tuberculosis
SSGCSNSDSC

SEQ ID NO: 1451212 - protein, 30 aa, Mycobacterium tuberculosis
SSGDDPPEDPSGRDKRGKDGADSGSGANPL

SEQ ID NO: 1451213 - protein, 7 aa, Mycobacterium tuberculosis
SSGESVA

SEQ ID NO: 1451214 - protein, 14 aa, Mycobacterium tuberculosis
SSGHRAARRPRCSP

SEQ ID NO: 1451215 - protein, 8 aa, Mycobacterium tuberculosis
SSGHTGRV

SEQ ID NO: 1451216 - protein, 7 aa, Mycobacterium tuberculosis
SSGREAD

SEQ ID NO: 1451217 - protein, 7 aa, Mycobacterium tuberculosis
SSGSVQA

SEQ ID NO: 1451218 - protein, 4 aa, Mycobacterium tuberculosis
SSHA

SEQ ID NO: 1451219 - protein, 16 aa, Mycobacterium tuberculosis
SSIGAANAATAGSTTS

SEQ ID NO: 1451220 - protein, 7 aa, Mycobacterium tuberculosis
SSLGGTT

SEQ ID NO: 1451221 - protein, 5 aa, Mycobacterium tuberculosis
SSLPA

SEQ ID NO: 1451222 - protein, 5 aa, Mycobacterium tuberculosis
SSNEV

SEQ ID NO: 1451223 - protein, 15 aa, Mycobacterium tuberculosis
SSNLRDDATSGNGDY

SEQ ID NO: 1451224 - protein, 11 aa, Mycobacterium tuberculosis
SSNPPAPPVPG

SEQ ID NO: 1451225 - protein, 22 aa, Mycobacterium tuberculosis
SSNTGHPRGRAGAARQTRGVGG

SEQ ID NO: 1451226 - protein, 12 aa, Mycobacterium tuberculosis
SSPAAANSPLVG

SEQ ID NO: 1451227 - protein, 7 aa, Mycobacterium tuberculosis
SSPAWPA

SEQ ID NO: 1451228 - protein, 44 aa, Mycobacterium tuberculosis
SSPLDERAHRRAARRPARAHPSCPADRPGPASGDRRRRRRGPIP

SEQ ID NO: 1451229 - protein, 14 aa, Mycobacterium tuberculosis
SSPMAADQQTAGPL

SEQ ID NO: 1451230 - protein, 4 aa, Mycobacterium tuberculosis
SSPR

SEQ ID NO: 1451231 - protein, 6 aa, Mycobacterium tuberculosis
SSPRAA

SEQ ID NO: 1451232 - protein, 16 aa, Mycobacterium tuberculosis
SSPSDIGPGKATVDPL

SEQ ID NO: 1451233 - protein, 14 aa, Mycobacterium tuberculosis
SSPSQVNQSSWAPS

SEQ ID NO: 1451234 - protein, 5 aa, Mycobacterium tuberculosis
SSPTG

SEQ ID NO: 1451235 - protein, 8 aa, Mycobacterium tuberculosis
SSPTSTQI

SEQ ID NO: 1451236 - protein, 8 aa, Mycobacterium tuberculosis
SSQISDGA

SEQ ID NO: 1451237 - protein, 8 aa, Mycobacterium tuberculosis
SSQLEDNV

SEQ ID NO: 1451238 - protein, 20 aa, Mycobacterium tuberculosis
SSQSGPKDAGPSPADASTAK

SEQ ID NO: 1451239 - protein, 28 aa, Mycobacterium tuberculosis
SSRAFEPVNPSSAGPNSDEKVKAGTLDS

SEQ ID NO: 1451240 - protein, 28 aa, Mycobacterium tuberculosis
SSRAFEPVNPSSTGPNSDEKVKAGTLDS

SEQ ID NO: 1451241 - protein, 14 aa, Mycobacterium tuberculosis
SSRATSAPSRLAHS

SEQ ID NO: 1451242 - protein, 6 aa, Mycobacterium tuberculosis
SSRCAQ

SEQ ID NO: 1451243 - protein, 7 aa, Mycobacterium tuberculosis
SSRCASG

SEQ ID NO: 1451244 - protein, 7 aa, Mycobacterium tuberculosis
SSRHVSS

SEQ ID NO: 1451245 - protein, 5 aa, Mycobacterium tuberculosis
SSRKL

SEQ ID NO: 1451246 - protein, 9 aa, Mycobacterium tuberculosis
SSRPAVSAE

SEQ ID NO: 1451247 - protein, 8 aa, Mycobacterium tuberculosis
SSRPSTCR

SEQ ID NO: 1451248 - protein, 8 aa, Mycobacterium tuberculosis
SSRRDAAG

SEQ ID NO: 1451249 - protein, 8 aa, Mycobacterium tuberculosis
SSRSARPH

SEQ ID NO: 1451250 - protein, 12 aa, Mycobacterium tuberculosis
SSRSGGSGPRWP

SEQ ID NO: 1451251 - protein, 24 aa, Mycobacterium tuberculosis
SSRSRSWRNTTPTKSWPSIQDGEA

SEQ ID NO: 1451252 - protein, 25 aa, Mycobacterium tuberculosis
SSSASGAGQEHPTGDSTPNATRAIT

SEQ ID NO: 1451253 - protein, 9 aa, Mycobacterium tuberculosis
SSSDQQSLA

SEQ ID NO: 1451254 - protein, 12 aa, Mycobacterium tuberculosis
SSSGAGTGWSAI

SEQ ID NO: 1451255 - protein, 5 aa, Mycobacterium tuberculosis
SSSHA

SEQ ID NO: 1451256 - protein, 31 aa, Mycobacterium tuberculosis
SSSPARPTRPEPSSRPKNWRPSRRGVTHRMS

SEQ ID NO: 1451257 - protein, 4 aa, Mycobacterium tuberculosis
SSSQ

SEQ ID NO: 1451258 - protein, 6 aa, Mycobacterium tuberculosis
SSSRDT

SEQ ID NO: 1451259 - protein, 5 aa, Mycobacterium tuberculosis
SSSSA

SEQ ID NO: 1451260 - protein, 8 aa, Mycobacterium tuberculosis
SSSTDPAI

SEQ ID NO: 1451261 - protein, 26 aa, Mycobacterium tuberculosis
SSSTPPRPARSRPSSSRPTASGLASD

SEQ ID NO: 1451262 - protein, 25 aa, Mycobacterium tuberculosis
SSSTSSGPPTAPTPTSPFGTAPMPP

SEQ ID NO: 1451263 - protein, 10 aa, Mycobacterium tuberculosis
SSSVAEPKSL

SEQ ID NO: 1451264 - protein, 12 aa, Mycobacterium tuberculosis
SSSWPSRWVGWS

SEQ ID NO: 1451265 - protein, 10 aa, Mycobacterium tuberculosis
SSTATSGAAV

SEQ ID NO: 1451266 - protein, 45 aa, Mycobacterium tuberculosis
SSTCPHSGSAGFRSPTVNGKTSSTTAVTPSRGGGRNVAGSTASAR

SEQ ID NO: 1451267 - protein, 7 aa, Mycobacterium tuberculosis
SSTHEAN

SEQ ID NO: 1451268 - protein, 27 aa, Mycobacterium tuberculosis
SSTINRSRSASGSPCSAPDSAAAMARS

SEQ ID NO: 1451269 - protein, 24 aa, Mycobacterium tuberculosis
SSTKPVSQDTSPKPATSPAAPVTT

SEQ ID NO: 1451270 - protein, 31 aa, Mycobacterium tuberculosis
SSTMPGAAGPVGTGCNTNRSRRRLRRCQVGI

SEQ ID NO: 1451271 - protein, 31 aa, Mycobacterium tuberculosis
SSTTAADALTSSARAPTSSVADRTPSSGCPT

SEQ ID NO: 1451272 - protein, 4 aa, Mycobacterium tuberculosis
SSVT

SEQ ID NO: 1451273 - protein, 5 aa, Mycobacterium tuberculosis
SSWKG

SEQ ID NO: 1451274 - protein, 8 aa, Mycobacterium tuberculosis
SSWQGPSA

SEQ ID NO: 1451275 - protein, 35 aa, Mycobacterium tuberculosis
SSWRPGDDAFGPRNRSARPARPTPAPQPAGPRPGR

SEQ ID NO: 1451276 - protein, 5 aa, Mycobacterium tuberculosis
SSWRT

SEQ ID NO: 1451277 - protein, 6 aa, Mycobacterium tuberculosis
SSWSDY

SEQ ID NO: 1451278 - protein, 5 aa, Mycobacterium tuberculosis
SSYGT

SEQ ID NO: 1451279 - protein, 11 aa, Mycobacterium tuberculosis
STACAPTPRAR

SEQ ID NO: 1451280 - protein, 6 aa, Mycobacterium tuberculosis
STADEG

SEQ ID NO: 1451281 - protein, 13 aa, Mycobacterium tuberculosis
STADNTGDQRIPK

SEQ ID NO: 1451282 - protein, 14 aa, Mycobacterium tuberculosis
STADNTGDQRIPKA

SEQ ID NO: 1451283 - protein, 7 aa, Mycobacterium tuberculosis
STAGADS

SEQ ID NO: 1451284 - protein, 8 aa, Mycobacterium tuberculosis
STAGADSV

SEQ ID NO: 1451285 - protein, 25 aa, Mycobacterium tuberculosis
STAGGAGGAGGAGGLFTTGGVGGAG

SEQ ID NO: 1451286 - protein, 22 aa, Mycobacterium tuberculosis
STAGGAGGTVFGGGKGRGRRSR

SEQ ID NO: 1451287 - protein, 15 aa, Mycobacterium tuberculosis
STALERAEDPILNGS

SEQ ID NO: 1451288 - protein, 10 aa, Mycobacterium tuberculosis
STAPESNRGG

SEQ ID NO: 1451289 - protein, 34 aa, Mycobacterium tuberculosis
STAPPAPTAPRASTVPPAAKATTATPAESGFTES

SEQ ID NO: 1451290 - protein, 9 aa, Mycobacterium tuberculosis
STAPPSDGR

SEQ ID NO: 1451291 - protein, 35 aa, Mycobacterium tuberculosis
STARDASRGPESRAGVDASRSTSARCSLSRGRCRR

SEQ ID NO: 1451292 - protein, 16 aa, Mycobacterium tuberculosis
STATASGKSGHTSRTR

SEQ ID NO: 1451293 - protein, 4 aa, Mycobacterium tuberculosis
STDD

SEQ ID NO: 1451294 - protein, 26 aa, Mycobacterium tuberculosis
STDLTAPRPRRQTRPGHRPRQRDPPA

SEQ ID NO: 1451295 - protein, 18 aa, Mycobacterium tuberculosis
STEAKAAGKMPALPRSSG

SEQ ID NO: 1451296 - protein, 18 aa, Mycobacterium tuberculosis
STEAKARRQMPALPRSSG

SEQ ID NO: 1451297 - protein, 8 aa, Mycobacterium tuberculosis
STEGNSYL

SEQ ID NO: 1451298 - protein, 10 aa, Mycobacterium tuberculosis
STEKNRRRSL

SEQ ID NO: 1451299 - protein, 9 aa, Mycobacterium tuberculosis
STEPVAGAD

SEQ ID NO: 1451300 - protein, 6 aa, Mycobacterium tuberculosis
STERPA

SEQ ID NO: 1451301 - protein, 9 aa, Mycobacterium tuberculosis
STEVRADST

SEQ ID NO: 1451302 - protein, 15 aa, Mycobacterium tuberculosis
STGGATGSGSSGSCA

SEQ ID NO: 1451303 - protein, 17 aa, Mycobacterium tuberculosis
STGGATGSGSSGSSAMD

SEQ ID NO: 1451304 - protein, 9 aa, Mycobacterium tuberculosis
STGKASHAS

SEQ ID NO: 1451305 - protein, 8 aa, Mycobacterium tuberculosis
STGNDIQA

SEQ ID NO: 1451306 - protein, 12 aa, Mycobacterium tuberculosis
STGRRAGGGARH

SEQ ID NO: 1451307 - protein, 24 aa, Mycobacterium tuberculosis
STGSSGAAGCTGCGPGWSSSNAAG

SEQ ID NO: 1451308 - protein, 9 aa, Mycobacterium tuberculosis
STGTPRPPF

SEQ ID NO: 1451309 - protein, 11 aa, Mycobacterium tuberculosis
STGTTKTGATA

SEQ ID NO: 1451310 - protein, 51 aa, Mycobacterium tuberculosis
STGVGGAGGAGGAGGAGGAGGSGGAGGHGDTTSGKNGSSGTAGFDGNPGQP

SEQ ID NO: 1451311 - protein, 13 aa, Mycobacterium tuberculosis
STGVRSWPCSFCP

SEQ ID NO: 1451312 - protein, 6 aa, Mycobacterium tuberculosis
STHAPG

SEQ ID NO: 1451313 - protein, 8 aa, Mycobacterium tuberculosis
STHPPSSL

SEQ ID NO: 1451314 - protein, 24 aa, Mycobacterium tuberculosis
STIGGGNTGTAVSQDGTELLVGSC

SEQ ID NO: 1451315 - protein, 20 aa, Mycobacterium tuberculosis
STITDQRDQTENPTCSAATD

SEQ ID NO: 1451316 - protein, 20 aa, Mycobacterium tuberculosis
STKPSTWAPSTSSRSTSPAC

SEQ ID NO: 1451317 - protein, 23 aa, Mycobacterium tuberculosis
STLGGPHRHRGSANTRMGPKWED

SEQ ID NO: 1451318 - protein, 9 aa, Mycobacterium tuberculosis
STLSGPPLT

SEQ ID NO: 1451319 - protein, 9 aa, Mycobacterium tuberculosis
STNGGRETT

SEQ ID NO: 1451320 - protein, 9 aa, Mycobacterium tuberculosis
STNRGSENF

SEQ ID NO: 1451321 - protein, 25 aa, Mycobacterium tuberculosis
STPAPSCRATSATASCGEATSRACS

SEQ ID NO: 1451322 - protein, 22 aa, Mycobacterium tuberculosis
STPARNIRSPYEAADESAHRAP

SEQ ID NO: 1451323 - protein, 9 aa, Mycobacterium tuberculosis
STPETSRRL

SEQ ID NO: 1451324 - protein, 7 aa, Mycobacterium tuberculosis
STPGIAT

SEQ ID NO: 1451325 - protein, 38 aa, Mycobacterium tuberculosis
STPGQPGGRGGAAGLIGNGGAGGAGGPGANGGAGGNGG

SEQ ID NO: 1451326 - protein, 21 aa, Mycobacterium tuberculosis
STPLAPPQPGSDAATATNNEP

SEQ ID NO: 1451327 - protein, 12 aa, Mycobacterium tuberculosis
STPPTPSTTAAG

SEQ ID NO: 1451328 - protein, 45 aa, Mycobacterium tuberculosis
STRAPETSALATRASETPGSATRMSATPAWGTRAPATGACGTQAP

SEQ ID NO: 1451329 - protein, 11 aa, Mycobacterium tuberculosis
STRHSTSYGMS

SEQ ID NO: 1451330 - protein, 5 aa, Mycobacterium tuberculosis
STRIM

SEQ ID NO: 1451331 - protein, 18 aa, Mycobacterium tuberculosis
STRSPRSKCATGSNPPPA

SEQ ID NO: 1451332 - protein, 8 aa, Mycobacterium tuberculosis
STRTSERE

SEQ ID NO: 1451333 - protein, 7 aa, Mycobacterium tuberculosis
STSDGAL

SEQ ID NO: 1451334 - protein, 14 aa, Mycobacterium tuberculosis
STSISRSKWTSPAA

SEQ ID NO: 1451335 - protein, 4 aa, Mycobacterium tuberculosis
STSP

SEQ ID NO: 1451336 - protein, 7 aa, Mycobacterium tuberculosis
STSRRRG

SEQ ID NO: 1451337 - protein, 14 aa, Mycobacterium tuberculosis
STSRSSTAPGCGAS

SEQ ID NO: 1451338 - protein, 24 aa, Mycobacterium tuberculosis
STSSDRCHPSSAGCRRSRRPGQPM

SEQ ID NO: 1451339 - protein, 35 aa, Mycobacterium tuberculosis
STTAGVAGGNGGAAGLIGNGGAGGGCGSGAAGYNG

SEQ ID NO: 1451340 - protein, 17 aa, Mycobacterium tuberculosis
STTGCSPRTGRFREAET

SEQ ID NO: 1451341 - protein, 12 aa, Mycobacterium tuberculosis
STTGIATQANSG

SEQ ID NO: 1451342 - protein, 12 aa, Mycobacterium tuberculosis
STTPAATATRSW

SEQ ID NO: 1451343 - protein, 13 aa, Mycobacterium tuberculosis
STTPATPQPSPAW

SEQ ID NO: 1451344 - protein, 10 aa, Mycobacterium tuberculosis
STTSTLPGAG

SEQ ID NO: 1451345 - protein, 6 aa, Mycobacterium tuberculosis
STTVDA

SEQ ID NO: 1451346 - protein, 10 aa, Mycobacterium tuberculosis
STVGPIPDSA

SEQ ID NO: 1451347 - protein, 13 aa, Mycobacterium tuberculosis
STVNSQNSQIQPQ

SEQ ID NO: 1451348 - protein, 12 aa, Mycobacterium tuberculosis
SVAAASNASGLA

SEQ ID NO: 1451349 - protein, 4 aa, Mycobacterium tuberculosis
SVAD

SEQ ID NO: 1451350 - protein, 8 aa, Mycobacterium tuberculosis
SVAENTAD

SEQ ID NO: 1451351 - protein, 15 aa, Mycobacterium tuberculosis
SVAGHGVDDVDEQGL

SEQ ID NO: 1451352 - protein, 14 aa, Mycobacterium tuberculosis
SVASQSTRLTRLWT

SEQ ID NO: 1451353 - protein, 14 aa, Mycobacterium tuberculosis
SVDDLSDGHAAEQQ

SEQ ID NO: 1451354 - protein, 7 aa, Mycobacterium tuberculosis
SVDPRRQ

SEQ ID NO: 1451355 - protein, 13 aa, Mycobacterium tuberculosis
SVETNGKGCSGSV

SEQ ID NO: 1451356 - protein, 10 aa, Mycobacterium tuberculosis
SVGCSRQDVE

SEQ ID NO: 1451357 - protein, 6 aa, Mycobacterium tuberculosis
SVGEVN

SEQ ID NO: 1451358 - protein, 6 aa, Mycobacterium tuberculosis
SVGHAG

SEQ ID NO: 1451359 - protein, 8 aa, Mycobacterium tuberculosis
SVKTSELE

SEQ ID NO: 1451360 - protein, 6 aa, Mycobacterium tuberculosis
SVMAPT

SEQ ID NO: 1451361 - protein, 13 aa, Mycobacterium tuberculosis
SVPASAAPARSTE

SEQ ID NO: 1451362 - protein, 32 aa, Mycobacterium tuberculosis
SVPATATAGGEDAGTGGPGASGATVADQPDGV

SEQ ID NO: 1451363 - protein, 16 aa, Mycobacterium tuberculosis
SVPGGPKPPCAPAGRA

SEQ ID NO: 1451364 - protein, 8 aa, Mycobacterium tuberculosis
SVPPGRRI

SEQ ID NO: 1451365 - protein, 5 aa, Mycobacterium tuberculosis
SVPSD

SEQ ID NO: 1451366 - protein, 5 aa, Mycobacterium tuberculosis
SVQAS

SEQ ID NO: 1451367 - protein, 9 aa, Mycobacterium tuberculosis
SVREGQASD

SEQ ID NO: 1451368 - protein, 18 aa, Mycobacterium tuberculosis
SVRPPGADARRPSPPPPL

SEQ ID NO: 1451369 - protein, 8 aa, Mycobacterium tuberculosis
SVRRPGAR

SEQ ID NO: 1451370 - protein, 4 aa, Mycobacterium tuberculosis
SVRS

SEQ ID NO: 1451371 - protein, 11 aa, Mycobacterium tuberculosis
SVRSEPGRCAR

SEQ ID NO: 1451372 - protein, 8 aa, Mycobacterium tuberculosis
SVRTPSAA

SEQ ID NO: 1451373 - protein, 7 aa, Mycobacterium tuberculosis
SVSFGRG

SEQ ID NO: 1451374 - protein, 34 aa, Mycobacterium tuberculosis
SVSGVAEADVADGRRQPRTDVAEPDVGAADVGAA

SEQ ID NO: 1451375 - protein, 47 aa, Mycobacterium tuberculosis
SVSRPSAAAPPESVPTVSATSSSASSGSASAAPMSPSRSTNESEPVS

SEQ ID NO: 1451376 - protein, 7 aa, Mycobacterium tuberculosis
SVSRRDR

SEQ ID NO: 1451377 - protein, 16 aa, Mycobacterium tuberculosis
SVTDERRRRHRGCTGV

SEQ ID NO: 1451378 - protein, 6 aa, Mycobacterium tuberculosis
SVTDGA

SEQ ID NO: 1451379 - protein, 16 aa, Mycobacterium tuberculosis
SVTDRSAHSAERSTEH

SEQ ID NO: 1451380 - protein, 6 aa, Mycobacterium tuberculosis
SVTGPV

SEQ ID NO: 1451381 - protein, 34 aa, Mycobacterium tuberculosis
SVTNPGDGRAQRHGAGADQGGQDSSHARSLLPVE

SEQ ID NO: 1451382 - protein, 30 aa, Mycobacterium tuberculosis
SVTPTPGASTRAASTPAGSTPATPTPGWPT

SEQ ID NO: 1451383 - protein, 6 aa, Mycobacterium tuberculosis
SVWPGA

SEQ ID NO: 1451384 - protein, 7 aa, Mycobacterium tuberculosis
SWAGGLR

SEQ ID NO: 1451385 - protein, 8 aa, Mycobacterium tuberculosis
SWAGGSLP

SEQ ID NO: 1451386 - protein, 8 aa, Mycobacterium tuberculosis
SWEYTGDG

SEQ ID NO: 1451387 - protein, 12 aa, Mycobacterium tuberculosis
SWGPADAQPGVA

SEQ ID NO: 1451388 - protein, 39 aa, Mycobacterium tuberculosis
SWNGPRRSRAIGPSAATPNRSSRPGSGTRRGTAGLRVEK

SEQ ID NO: 1451389 - protein, 4 aa, Mycobacterium tuberculosis
SWRD

SEQ ID NO: 1451390 - protein, 6 aa, Mycobacterium tuberculosis
SWRREP

SEQ ID NO: 1451391 - protein, 7 aa, Mycobacterium tuberculosis
SWRTRRP

SEQ ID NO: 1451392 - protein, 11 aa, Mycobacterium tuberculosis
SYAPERARRSD

SEQ ID NO: 1451393 - protein, 28 aa, Mycobacterium tuberculosis
SYEESTSQPSACAPASRSGSPHPASPPR

SEQ ID NO: 1451394 - protein, 5 aa, Mycobacterium tuberculosis
SYGMA

SEQ ID NO: 1451395 - protein, 7 aa, Mycobacterium tuberculosis
SYGMSGT

SEQ ID NO: 1451396 - protein, 9 aa, Mycobacterium tuberculosis
SYGQSGGPL

SEQ ID NO: 1451397 - protein, 4 aa, Mycobacterium tuberculosis
SYGS

SEQ ID NO: 1451398 - protein, 7 aa, Mycobacterium tuberculosis
SYGSARN

SEQ ID NO: 1451399 - protein, 8 aa, Mycobacterium tuberculosis
SYQPSRHG

SEQ ID NO: 1451400 - protein, 18 aa, Mycobacterium tuberculosis
SYSRGGAGPEPPSTPTSR

SEQ ID NO: 1451401 - protein, 29 aa, Mycobacterium tuberculosis
TAAAAGEDRHGQGVGAGRESRWRGPGCPA

SEQ ID NO: 1451402 - protein, 25 aa, Mycobacterium tuberculosis
TAAADAARIGSAINTTNTAAAATTQ

SEQ ID NO: 1451403 - protein, 7 aa, Mycobacterium tuberculosis
TAAAEGC

SEQ ID NO: 1451404 - protein, 31 aa, Mycobacterium tuberculosis
TAAAEPVDEQCAPSAATTGPAHEKHLAVRPT

SEQ ID NO: 1451405 - protein, 16 aa, Mycobacterium tuberculosis
TAAAGSAIGAGGPAYA

SEQ ID NO: 1451406 - protein, 8 aa, Mycobacterium tuberculosis
TAAATTSA

SEQ ID NO: 1451407 - protein, 17 aa, Mycobacterium tuberculosis
TAADGPHKRERASDLAP

SEQ ID NO: 1451408 - protein, 8 aa, Mycobacterium tuberculosis
TAAEPIPR

SEQ ID NO: 1451409 - protein, 13 aa, Mycobacterium tuberculosis
TAAEQRAVPGDGA

SEQ ID NO: 1451410 - protein, 13 aa, Mycobacterium tuberculosis
TAAGADPRDPGKL

SEQ ID NO: 1451411 - protein, 17 aa, Mycobacterium tuberculosis
TAAGAYGSAEAQMPSPL

SEQ ID NO: 1451412 - protein, 9 aa, Mycobacterium tuberculosis
TAAGHQQGA

SEQ ID NO: 1451413 - protein, 9 aa, Mycobacterium tuberculosis
TAAGSAEAT

SEQ ID NO: 1451414 - protein, 18 aa, Mycobacterium tuberculosis
TAAGTPSAPVHPAPESAP

SEQ ID NO: 1451415 - protein, 25 aa, Mycobacterium tuberculosis
TAAMPSSATRGPVGAPGPAGTERAP

SEQ ID NO: 1451416 - protein, 4 aa, Mycobacterium tuberculosis
TAAN

SEQ ID NO: 1451417 - protein, 12 aa, Mycobacterium tuberculosis
TAANAAAAVPTS

SEQ ID NO: 1451418 - protein, 10 aa, Mycobacterium tuberculosis
TAANQDGRTV

SEQ ID NO: 1451419 - protein, 30 aa, Mycobacterium tuberculosis
TAAPAAPPAGSSASAATAGPAGSVLPASTA

SEQ ID NO: 1451420 - protein, 12 aa, Mycobacterium tuberculosis
TAAQHGARILTY

SEQ ID NO: 1451421 - protein, 11 aa, Mycobacterium tuberculosis
TAAQRYSGTAD

SEQ ID NO: 1451422 - protein, 16 aa, Mycobacterium tuberculosis
TAAQTKQTATQARAAA

SEQ ID NO: 1451423 - protein, 24 aa, Mycobacterium tuberculosis
TAARASPPGSAPPAEAKGSRQKPD

SEQ ID NO: 1451424 - protein, 8 aa, Mycobacterium tuberculosis
TAARPPTA

SEQ ID NO: 1451425 - protein, 7 aa, Mycobacterium tuberculosis
TAASDNF

SEQ ID NO: 1451426 - protein, 9 aa, Mycobacterium tuberculosis
TAASGARSA

SEQ ID NO: 1451427 - protein, 14 aa, Mycobacterium tuberculosis
TAASSKSTVRRCWR

SEQ ID NO: 1451428 - protein, 21 aa, Mycobacterium tuberculosis
TAATAARRCGRAPRSQRRCLC

SEQ ID NO: 1451429 - protein, 21 aa, Mycobacterium tuberculosis
TAATAARVAPQASPAVAGGAA

SEQ ID NO: 1451430 - protein, 14 aa, Mycobacterium tuberculosis
TAATAATTGDAHQH

SEQ ID NO: 1451431 - protein, 18 aa, Mycobacterium tuberculosis
TAATAVSATLAKTGVGTG

SEQ ID NO: 1451432 - protein, 7 aa, Mycobacterium tuberculosis
TAATDGS

SEQ ID NO: 1451433 - protein, 5 aa, Mycobacterium tuberculosis
TAATE

SEQ ID NO: 1451434 - protein, 13 aa, Mycobacterium tuberculosis
TAATELAATVAAA

SEQ ID NO: 1451435 - protein, 15 aa, Mycobacterium tuberculosis
TAATGASELGSGGRT

SEQ ID NO: 1451436 - protein, 9 aa, Mycobacterium tuberculosis
TAATGRRTQ

SEQ ID NO: 1451437 - protein, 51 aa, Mycobacterium tuberculosis
TAATSAWSTPISSTPNKRSGSNNGSRPSTSNPLWPNRNTSSASSTPPRPLK

SEQ ID NO: 1451438 - protein, 33 aa, Mycobacterium tuberculosis
TACGGAGPPAPGGGALAASPPGAVATRPVPGPN

SEQ ID NO: 1451439 - protein, 11 aa, Mycobacterium tuberculosis
TADAEEALGGA

SEQ ID NO: 1451440 - protein, 8 aa, Mycobacterium tuberculosis
TADAVGRT

SEQ ID NO: 1451441 - protein, 5 aa, Mycobacterium tuberculosis
TADEL

SEQ ID NO: 1451442 - protein, 18 aa, Mycobacterium tuberculosis
TADGLSARGCRGSGAQAV

SEQ ID NO: 1451443 - protein, 5 aa, Mycobacterium tuberculosis
TADGP

SEQ ID NO: 1451444 - protein, 19 aa, Mycobacterium tuberculosis
TADGPTGAPAADRLDPAPG

SEQ ID NO: 1451445 - protein, 6 aa, Mycobacterium tuberculosis
TADNPR

SEQ ID NO: 1451446 - protein, 8 aa, Mycobacterium tuberculosis
TADPITAL

SEQ ID NO: 1451447 - protein, 9 aa, Mycobacterium tuberculosis
TADPITALG

SEQ ID NO: 1451448 - protein, 11 aa, Mycobacterium tuberculosis
TADPPESSPDS

SEQ ID NO: 1451449 - protein, 31 aa, Mycobacterium tuberculosis; identical to SEQ ID NO: 1373056

SEQ ID NO: 1451450 - protein, 5 aa, Mycobacterium tuberculosis
TADQP

SEQ ID NO: 1451451 - protein, 4 aa, Mycobacterium tuberculosis
TADR

SEQ ID NO: 1451452 - protein, 5 aa, Mycobacterium tuberculosis
TADTH

SEQ ID NO: 1451453 - protein, 9 aa, Mycobacterium tuberculosis
TADTSSQLT

SEQ ID NO: 1451454 - protein, 9 aa, Mycobacterium tuberculosis
TAEAEAMRR

SEQ ID NO: 1451455 - protein, 22 aa, Mycobacterium tuberculosis
TAEATKPANAPGVSIVCASPQV

SEQ ID NO: 1451456 - protein, 13 aa, Mycobacterium tuberculosis
TAEATVSTADDVG

SEQ ID NO: 1451457 - protein, 5 aa, Mycobacterium tuberculosis
TAEEL

SEQ ID NO: 1451458 - protein, 27 aa, Mycobacterium tuberculosis
TAEERANAVRGRADSLRRAAAAEREAR

SEQ ID NO: 1451459 - protein, 4 aa, Mycobacterium tuberculosis
TAEF

SEQ ID NO: 1451460 - protein, 9 aa, Mycobacterium tuberculosis
TAEPAGTAG

SEQ ID NO: 1451461 - protein, 13 aa, Mycobacterium tuberculosis
TAEPAGTGGDSWQ

SEQ ID NO: 1451462 - protein, 13 aa, Mycobacterium tuberculosis
TAEPFDERHQPRD

SEQ ID NO: 1451463 - protein, 23 aa, Mycobacterium tuberculosis
TAEPRARGPRTCGREEGDCVGSR

SEQ ID NO: 1451464 - protein, 4 aa, Mycobacterium tuberculosis
TAES

SEQ ID NO: 1451465 - protein, 5 aa, Mycobacterium tuberculosis
TAESR

SEQ ID NO: 1451466 - protein, 11 aa, Mycobacterium tuberculosis
TAETSPAPGRR

SEQ ID NO: 1451467 - protein, 17 aa, Mycobacterium tuberculosis
TAFATQGVSAEAQANRA

SEQ ID NO: 1451468 - protein, 9 aa, Mycobacterium tuberculosis
TAGAAAPWS

SEQ ID NO: 1451469 - protein, 45 aa, Mycobacterium tuberculosis
TAGAASKASATHRAGACGGVGAGTAGPAVAAGAAGTTFAASTGHA

SEQ ID NO: 1451470 - protein, 7 aa, Mycobacterium tuberculosis
TAGAAST

SEQ ID NO: 1451471 - protein, 20 aa, Mycobacterium tuberculosis
TAGAGSYAAAEAASAASITS

SEQ ID NO: 1451472 - protein, 19 aa, Mycobacterium tuberculosis
TAGDLEGADEDAHIADPRA

SEQ ID NO: 1451473 - protein, 14 aa, Mycobacterium tuberculosis
TAGGAGGAGGAGGL

SEQ ID NO: 1451474 - protein, 6 aa, Mycobacterium tuberculosis
TAGGDL

SEQ ID NO: 1451475 - protein, 10 aa, Mycobacterium tuberculosis
TAGGNGGDGG

SEQ ID NO: 1451476 - protein, 10 aa, Mycobacterium tuberculosis
TAGGRHRRSA

SEQ ID NO: 1451477 - protein, 23 aa, Mycobacterium tuberculosis
TAGGTRQRGSRAGRFAAPCGCGG

SEQ ID NO: 1451478 - protein, 12 aa, Mycobacterium tuberculosis
TAGLPANADAAA

SEQ ID NO: 1451479 - protein, 5 aa, Mycobacterium tuberculosis
TAGLQ

SEQ ID NO: 1451480 - protein, 4 aa, Mycobacterium tuberculosis
TAGM

SEQ ID NO: 1451481 - protein, 5 aa, Mycobacterium tuberculosis
TAGPA

SEQ ID NO: 1451482 - protein, 26 aa, Mycobacterium tuberculosis
TAGPAGPAGPPGLALPPGPARPAGAA

SEQ ID NO: 1451483 - protein, 14 aa, Mycobacterium tuberculosis
TAGPGRAPKSVCFD

SEQ ID NO: 1451484 - protein, 12 aa, Mycobacterium tuberculosis
TAGPLGGEGTWP

SEQ ID NO: 1451485 - protein, 16 aa, Mycobacterium tuberculosis
TAGRTVAAPAAVADQP

SEQ ID NO: 1451486 - protein, 33 aa, Mycobacterium tuberculosis
TAGSAVTAAPAETAARAARAARAACSASPVAPG

SEQ ID NO: 1451487 - protein, 6 aa, Mycobacterium tuberculosis
TAGTTV

SEQ ID NO: 1451488 - protein, 4 aa, Mycobacterium tuberculosis
TAGY

SEQ ID NO: 1451489 - protein, 13 aa, Mycobacterium tuberculosis
TAHRGARESSNIV

SEQ ID NO: 1451490 - protein, 8 aa, Mycobacterium tuberculosis
TAKGARNV

SEQ ID NO: 1451491 - protein, 14 aa, Mycobacterium tuberculosis
TAKSGEQKCGHGSR

SEQ ID NO: 1451492 - protein, 34 aa, Mycobacterium tuberculosis
TALPGPRGPHPSPSSTDQHRRTRQAANHQHPSTD

SEQ ID NO: 1451493 - protein, 4 aa, Mycobacterium tuberculosis
TALT

SEQ ID NO: 1451494 - protein, 8 aa, Mycobacterium tuberculosis
TANAGSFN

SEQ ID NO: 1451495 - protein, 12 aa, Mycobacterium tuberculosis
TANLGRPEPTHD

SEQ ID NO: 1451496 - protein, 18 aa, Mycobacterium tuberculosis
TANPATTAAEAPPAPDNA

SEQ ID NO: 1451497 - protein, 24 aa, Mycobacterium tuberculosis
TANPATTAAEAPPATRQRRRCGAP

SEQ ID NO: 1451498 - protein, 62 aa, Mycobacterium tuberculosis
TANSGNGGGGGTGGAGGTHGTPGSGNAGGTGTGNADSTNGGPGSDGLGGDAFNGSRGTDGNP

SEQ ID NO: 1451499 - protein, 11 aa, Mycobacterium tuberculosis
TANSTQRDEEE

SEQ ID NO: 1451500 - protein, 9 aa, Mycobacterium tuberculosis
TAPALTPAD

SEQ ID NO: 1451501 - protein, 12 aa, Mycobacterium tuberculosis
TAPASTSLRDAC

SEQ ID NO: 1451502 - protein, 9 aa, Mycobacterium tuberculosis
TAPASTSPL

SEQ ID NO: 1451503 - protein, 11 aa, Mycobacterium tuberculosis
TAPASTSPLRT

SEQ ID NO: 1451504 - protein, 6 aa, Mycobacterium tuberculosis
TAPATL

SEQ ID NO: 1451505 - protein, 12 aa, Mycobacterium tuberculosis
TAPAVPNGQPVK

SEQ ID NO: 1451506 - protein, 12 aa, Mycobacterium tuberculosis
TAPDAGRRARAR

SEQ ID NO: 1451507 - protein, 6 aa, Mycobacterium tuberculosis
TAPEAV

SEQ ID NO: 1451508 - protein, 11 aa, Mycobacterium tuberculosis
TAPEGKTMGPR

SEQ ID NO: 1451509 - protein, 10 aa, Mycobacterium tuberculosis
TAPEGTPGEW

SEQ ID NO: 1451510 - protein, 10 aa, Mycobacterium tuberculosis
TAPFPPSPAM

SEQ ID NO: 1451511 - protein, 12 aa, Mycobacterium tuberculosis
TAPGGNSPVNLP

SEQ ID NO: 1451512 - protein, 12 aa, Mycobacterium tuberculosis
TAPMPTSSAVET

SEQ ID NO: 1451513 - protein, 7 aa, Mycobacterium tuberculosis
TAPPPLN

SEQ ID NO: 1451514 - protein, 6 aa, Mycobacterium tuberculosis
TAPSYR

SEQ ID NO: 1451515 - protein, 25 aa, Mycobacterium tuberculosis
TAPTAPTPHRCSSRPSASSRCYGRR

SEQ ID NO: 1451516 - protein, 59 aa, Mycobacterium tuberculosis
TAPTASPPTAVTGGNGGNGGKGGTAGNGSGAAGGNGGNGGSGLNGGDAGNGGNGGGALN

SEQ ID NO: 1451517 - protein, 5 aa, Mycobacterium tuberculosis
TAPTD

SEQ ID NO: 1451518 - protein, 12 aa, Mycobacterium tuberculosis
TAPTRDVNQAQD

SEQ ID NO: 1451519 - protein, 4 aa, Mycobacterium tuberculosis
TAQE

SEQ ID NO: 1451520 - protein, 8 aa, Mycobacterium tuberculosis
TAQESTKA

SEQ ID NO: 1451521 - protein, 4 aa, Mycobacterium tuberculosis
TAQL

SEQ ID NO: 1451522 - protein, 17 aa, Mycobacterium tuberculosis
TAQPKGVGDHRTRPRDR

SEQ ID NO: 1451523 - protein, 7 aa, Mycobacterium tuberculosis
TAQPPGR

SEQ ID NO: 1451524 - protein, 7 aa, Mycobacterium tuberculosis
TAQRVTH

SEQ ID NO: 1451525 - protein, 5 aa, Mycobacterium tuberculosis
TARAQ

SEQ ID NO: 1451526 - protein, 26 aa, Mycobacterium tuberculosis
TARGPRQPDPASSPAVCTTTTPTGCS

SEQ ID NO: 1451527 - protein, 14 aa, Mycobacterium tuberculosis
TARPADRCWIRVAP

SEQ ID NO: 1451528 - protein, 16 aa, Mycobacterium tuberculosis
TARPALAPRLRSALSR

SEQ ID NO: 1451529 - protein, 9 aa, Mycobacterium tuberculosis
TARPPTPTA

SEQ ID NO: 1451530 - protein, 6 aa, Mycobacterium tuberculosis
TARPPY

SEQ ID NO: 1451531 - protein, 8 aa, Mycobacterium tuberculosis
TARPRRPS

SEQ ID NO: 1451532 - protein, 9 aa, Mycobacterium tuberculosis
TARQSGAQL

SEQ ID NO: 1451533 - protein, 12 aa, Mycobacterium tuberculosis
TARRCTPPTSRS

SEQ ID NO: 1451534 - protein, 9 aa, Mycobacterium tuberculosis
TARRGSGAC

SEQ ID NO: 1451535 - protein, 16 aa, Mycobacterium tuberculosis
TARSAQLAGEQLSRGW

SEQ ID NO: 1451536 - protein, 13 aa, Mycobacterium tuberculosis
TARSSSTTRIRTD

SEQ ID NO: 1451537 - protein, 11 aa, Mycobacterium tuberculosis
TASAASSAATA

SEQ ID NO: 1451538 - protein, 28 aa, Mycobacterium tuberculosis
TASAATAPSPKAAAAFSAARAASAATAV

SEQ ID NO: 1451539 - protein, 5 aa, Mycobacterium tuberculosis
TASAN

SEQ ID NO: 1451540 - protein, 8 aa, Mycobacterium tuberculosis
TASDVERA

SEQ ID NO: 1451541 - protein, 12 aa, Mycobacterium tuberculosis
TASGEVRQRADA

SEQ ID NO: 1451542 - protein, 5 aa, Mycobacterium tuberculosis
TASLE

SEQ ID NO: 1451543 - protein, 37 aa, Mycobacterium tuberculosis
TASLGSRSWRKASSSHRFSKRQASKLNPPGASQSSSC

SEQ ID NO: 1451544 - protein, 13 aa, Mycobacterium tuberculosis
TASNDPDARRQLS

SEQ ID NO: 1451545 - protein, 10 aa, Mycobacterium tuberculosis
TASPDQIRGA

SEQ ID NO: 1451546 - protein, 4 aa, Mycobacterium tuberculosis
TASS

SEQ ID NO: 1451547 - protein, 9 aa, Mycobacterium tuberculosis
TASSAPSRW

SEQ ID NO: 1451548 - protein, 11 aa, Mycobacterium tuberculosis
TATAAPAAPAA

SEQ ID NO: 1451549 - protein, 18 aa, Mycobacterium tuberculosis
TATAGNPVSTSAPGPTHH

SEQ ID NO: 1451550 - protein, 15 aa, Mycobacterium tuberculosis
TATARAGPAKVPTTP

SEQ ID NO: 1451551 - protein, 14 aa, Mycobacterium tuberculosis
TATASGGMRACPVR

SEQ ID NO: 1451552 - protein, 11 aa, Mycobacterium tuberculosis
TATDGQARPPA

SEQ ID NO: 1451553 - protein, 44 aa, Mycobacterium tuberculosis
TATGCGYTGAPHDGSRSPPNGAPVTTGRSAGPYGRRRCSSRPAM

SEQ ID NO: 1451554 - protein, 22 aa, Mycobacterium tuberculosis
TATGCGYTGAPHDGSRSPPNGH

SEQ ID NO: 1451555 - protein, 19 aa, Mycobacterium tuberculosis
TATGPRAFAGSAKGGPDRM

SEQ ID NO: 1451556 - protein, 8 aa, Mycobacterium tuberculosis
TATGRPAG

SEQ ID NO: 1451557 - protein, 12 aa, Mycobacterium tuberculosis
TATLRRSSGGGI

SEQ ID NO: 1451558 - protein, 7 aa, Mycobacterium tuberculosis
TATPAVT

SEQ ID NO: 1451559 - protein, 14 aa, Mycobacterium tuberculosis
TATPSARPRRSRRA

SEQ ID NO: 1451560 - protein, 9 aa, Mycobacterium tuberculosis
TATRPAAAR

SEQ ID NO: 1451561 - protein, 5 aa, Mycobacterium tuberculosis
TATRR

SEQ ID NO: 1451562 - protein, 10 aa, Mycobacterium tuberculosis
TATRRARRAV

SEQ ID NO: 1451563 - protein, 8 aa, Mycobacterium tuberculosis
TATRSSCS

SEQ ID NO: 1451564 - protein, 9 aa, Mycobacterium tuberculosis
TATRTPTRS

SEQ ID NO: 1451565 - protein, 16 aa, Mycobacterium tuberculosis
TATTTRPLPPGLTPPR

SEQ ID NO: 1451566 - protein, 15 aa, Mycobacterium tuberculosis
TCAAESGRAPCALRF

SEQ ID NO: 1451567 - protein, 6 aa, Mycobacterium tuberculosis
TCAGRY

SEQ ID NO: 1451568 - protein, 6 aa, Mycobacterium tuberculosis
TCATTP

SEQ ID NO: 1451569 - protein, 4 aa, Mycobacterium tuberculosis
TCNG

SEQ ID NO: 1451570 - protein, 28 aa, Mycobacterium tuberculosis
TCNHGGSARRRVPATSTRSAQPVHTRHG

SEQ ID NO: 1451571 - protein, 10 aa, Mycobacterium tuberculosis
TCPEAPPTSI

SEQ ID NO: 1451572 - protein, 21 aa, Mycobacterium tuberculosis
TCPGSPPTSPYRTAPPRRCWS

SEQ ID NO: 1451573 - protein, 7 aa, Mycobacterium tuberculosis
TCRDDSG

SEQ ID NO: 1451574 - protein, 9 aa, Mycobacterium tuberculosis
TCTRERAGQ

SEQ ID NO: 1451575 - protein, 17 aa, Mycobacterium tuberculosis
TCVPRTSRPRCSPGVNA

SEQ ID NO: 1451576 - protein, 17 aa, Mycobacterium tuberculosis
TDAADESRCSSPGIAAT

SEQ ID NO: 1451577 - protein, 10 aa, Mycobacterium tuberculosis
TDAAESRAAI

SEQ ID NO: 1451578 - protein, 17 aa, Mycobacterium tuberculosis
TDADERVDDGTGSDTPK

SEQ ID NO: 1451579 - protein, 12 aa, Mycobacterium tuberculosis
TDAELRAKTDEF

SEQ ID NO: 1451580 - protein, 38 aa, Mycobacterium tuberculosis
TDAEVAGPGVEEPDVAGAGVEQADIAGTGVQAPDAGEV

SEQ ID NO: 1451581 - protein, 4 aa, Mycobacterium tuberculosis
TDAT

SEQ ID NO: 1451582 - protein, 4 aa, Mycobacterium tuberculosis
TDDA

SEQ ID NO: 1451583 - protein, 16 aa, Mycobacterium tuberculosis
TDDAPRSQADRYCRGR

SEQ ID NO: 1451584 - protein, 19 aa, Mycobacterium tuberculosis
TDDAQGERGCRRRGGAPTD

SEQ ID NO: 1451585 - protein, 20 aa, Mycobacterium tuberculosis
TDDNNNEAIRGDRSAARRQA

SEQ ID NO: 1451586 - protein, 8 aa, Mycobacterium tuberculosis
TDDNSAAV

SEQ ID NO: 1451587 - protein, 12 aa, Mycobacterium tuberculosis
TDDRDRPRVQSR

SEQ ID NO: 1451588 - protein, 6 aa, Mycobacterium tuberculosis
TDDSGK

SEQ ID NO: 1451589 - protein, 6 aa, Mycobacterium tuberculosis
TDEAGA

SEQ ID NO: 1451590 - protein, 18 aa, Mycobacterium tuberculosis
TDEPTAAACPSCGGWSRY

SEQ ID NO: 1451591 - protein, 108 aa, Mycobacterium tuberculosis; identical to SEQ ID NO: 195082

SEQ ID NO: 1451592 - protein, 13 aa, Mycobacterium tuberculosis
TDEQAAAGHHGGS

SEQ ID NO: 1451593 - protein, 7 aa, Mycobacterium tuberculosis
TDEQRAA

SEQ ID NO: 1451594 - protein, 4 aa, Mycobacterium tuberculosis
TDES

SEQ ID NO: 1451595 - protein, 8 aa, Mycobacterium tuberculosis
TDETRGTG

SEQ ID NO: 1451596 - protein, 21 aa, Mycobacterium tuberculosis
TDFPSEAPARFEGDSYNEGGP

SEQ ID NO: 1451597 - protein, 19 aa, Mycobacterium tuberculosis
TDFSGSDRGGYRDLAGSEQ

SEQ ID NO: 1451598 - protein, 23 aa, Mycobacterium tuberculosis
TDGETNASMRKGDDVASITDERA

SEQ ID NO: 1451599 - protein, 6 aa, Mycobacterium tuberculosis
TDGGEQ

SEQ ID NO: 1451600 - protein, 12 aa, Mycobacterium tuberculosis
TDGGGIGGVGGA

SEQ ID NO: 1451601 - protein, 11 aa, Mycobacterium tuberculosis
TDGGGYPTGRE

SEQ ID NO: 1451602 - protein, 16 aa, Mycobacterium tuberculosis
TDGHARRTVDIEVRDR

SEQ ID NO: 1451603 - protein, 21 aa, Mycobacterium tuberculosis
TDGHRLGPGRRPVAQSGRDRH

SEQ ID NO: 1451604 - protein, 8 aa, Mycobacterium tuberculosis
TDHAGIAT

SEQ ID NO: 1451605 - protein, 5 aa, Mycobacterium tuberculosis
TDHDT

SEQ ID NO: 1451606 - protein, 7 aa, Mycobacterium tuberculosis
TDHRPVK

SEQ ID NO: 1451607 - protein, 6 aa, Mycobacterium tuberculosis
TDKDWR

SEQ ID NO: 1451608 - protein, 6 aa, Mycobacterium tuberculosis
TDKSQI

SEQ ID NO: 1451609 - protein, 5 aa, Mycobacterium tuberculosis
TDLGR

SEQ ID NO: 1451610 - protein, 6 aa, Mycobacterium tuberculosis
TDLGRT

SEQ ID NO: 1451611 - protein, 18 aa, Mycobacterium tuberculosis
TDLSGRGGRGHQDRPVSA

SEQ ID NO: 1451612 - protein, 24 aa, Mycobacterium tuberculosis
TDLSGYRAGDPHRRRVRQGPNYQR

SEQ ID NO: 1451613 - protein, 4 aa, Mycobacterium tuberculosis
TDLT

SEQ ID NO: 1451614 - protein, 7 aa, Mycobacterium tuberculosis
TDNAPIA

SEQ ID NO: 1451615 - protein, 7 aa, Mycobacterium tuberculosis
TDNRAEL

SEQ ID NO: 1451616 - protein, 5 aa, Mycobacterium tuberculosis
TDNRQ

SEQ ID NO: 1451617 - protein, 6 aa, Mycobacterium tuberculosis
TDPAAA

SEQ ID NO: 1451618 - protein, 9 aa, Mycobacterium tuberculosis
TDPAGDGFG

SEQ ID NO: 1451619 - protein, 14 aa, Mycobacterium tuberculosis
TDPAGTDRDAAGAD

SEQ ID NO: 1451620 - protein, 8 aa, Mycobacterium tuberculosis
TDPAPANR

SEQ ID NO: 1451621 - protein, 7 aa, Mycobacterium tuberculosis
TDPARVG

SEQ ID NO: 1451622 - protein, 11 aa, Mycobacterium tuberculosis
TDPAVPAGGTI

SEQ ID NO: 1451623 - protein, 17 aa, Mycobacterium tuberculosis
TDPEAPPGSGKPEPFGD

SEQ ID NO: 1451624 - protein, 23 aa, Mycobacterium tuberculosis
TDPNATPRHQGMSSTRRAGTHGV

SEQ ID NO: 1451625 - protein, 10 aa, Mycobacterium tuberculosis
TDPNLSRPRV

SEQ ID NO: 1451626 - protein, 25 aa, Mycobacterium tuberculosis
TDPPGLTAAPSCSSPTTCARRCGWR

SEQ ID NO: 1451627 - protein, 6 aa, Mycobacterium tuberculosis
TDPQRA

SEQ ID NO: 1451628 - protein, 11 aa, Mycobacterium tuberculosis
TDQRAPQQRLG

SEQ ID NO: 1451629 - protein, 6 aa, Mycobacterium tuberculosis
TDRELS

SEQ ID NO: 1451630 - protein, 8 aa, Mycobacterium tuberculosis
TDRFPTTE

SEQ ID NO: 1451631 - protein, 9 aa, Mycobacterium tuberculosis
TDRSLAGEN

SEQ ID NO: 1451632 - protein, 13 aa, Mycobacterium tuberculosis
TDRSLGRRKPPAV

SEQ ID NO: 1451633 - protein, 4 aa, Mycobacterium tuberculosis
TDSD

SEQ ID NO: 1451634 - protein, 7 aa, Mycobacterium tuberculosis
TDSERRA

SEQ ID NO: 1451635 - protein, 59 aa, Mycobacterium tuberculosis
TDSPITTGTAAAAEAATAAATGAAVTEQPPTTATGPAGPAVTGGKAEDSTADTADAAGA

SEQ ID NO: 1451636 - protein, 7 aa, Mycobacterium tuberculosis
TDSTGWT

SEQ ID NO: 1451637 - protein, 7 aa, Mycobacterium tuberculosis
TDTAKEQ

SEQ ID NO: 1451638 - protein, 7 aa, Mycobacterium tuberculosis
TDTDNNR

SEQ ID NO: 1451639 - protein, 4 aa, Mycobacterium tuberculosis
TDTE

SEQ ID NO: 1451640 - protein, 5 aa, Mycobacterium tuberculosis
TDTLS

SEQ ID NO: 1451641 - protein, 8 aa, Mycobacterium tuberculosis
TDTYDAAA

SEQ ID NO: 1451642 - protein, 11 aa, Mycobacterium tuberculosis
TEAAEQGPGGR

SEQ ID NO: 1451643 - protein, 10 aa, Mycobacterium tuberculosis
TEAEAGDDQR

SEQ ID NO: 1451644 - protein, 5 aa, Mycobacterium tuberculosis
TEANG

SEQ ID NO: 1451645 - protein, 10 aa, Mycobacterium tuberculosis
TEAPRAAQRD

SEQ ID NO: 1451646 - protein, 14 aa, Mycobacterium tuberculosis
TEDAERQIDSCDPT

SEQ ID NO: 1451647 - protein, 13 aa, Mycobacterium tuberculosis
TEDGSPPGGSHGG

SEQ ID NO: 1451648 - protein, 8 aa, Mycobacterium tuberculosis
TEDPAASD

SEQ ID NO: 1451649 - protein, 14 aa, Mycobacterium tuberculosis
TEDPAGRKADREGL

SEQ ID NO: 1451650 - protein, 5 aa, Mycobacterium tuberculosis
TEEAN

SEQ ID NO: 1451651 - protein, 9 aa, Mycobacterium tuberculosis
TEEGHTGRH

SEQ ID NO: 1451652 - protein, 6 aa, Mycobacterium tuberculosis
TEEQSA

SEQ ID NO: 1451653 - protein, 4 aa, Mycobacterium tuberculosis
TEFD

SEQ ID NO: 1451654 - protein, 8 aa, Mycobacterium tuberculosis
TEFDTSAP

SEQ ID NO: 1451655 - protein, 5 aa, Mycobacterium tuberculosis
TEGLR

SEQ ID NO: 1451656 - protein, 10 aa, Mycobacterium tuberculosis
TEKAASKAIG

SEQ ID NO: 1451657 - protein, 9 aa, Mycobacterium tuberculosis
TEKQAASWD

SEQ ID NO: 1451658 - protein, 4 aa, Mycobacterium tuberculosis
TELG

SEQ ID NO: 1451659 - protein, 10 aa, Mycobacterium tuberculosis
TELSVAGSTI

SEQ ID NO: 1451660 - protein, 11 aa, Mycobacterium tuberculosis
TENPTCSAATD

SEQ ID NO: 1451661 - protein, 8 aa, Mycobacterium tuberculosis
TENSHGID

SEQ ID NO: 1451662 - protein, 4 aa, Mycobacterium tuberculosis
TEPG

SEQ ID NO: 1451663 - protein, 13 aa, Mycobacterium tuberculosis
TEPNPTYAGRFYT

SEQ ID NO: 1451664 - protein, 4 aa, Mycobacterium tuberculosis
TEQP

SEQ ID NO: 1451665 - protein, 7 aa, Mycobacterium tuberculosis
TEQQKRR

SEQ ID NO: 1451666 - protein, 8 aa, Mycobacterium tuberculosis
TERAGGAV

SEQ ID NO: 1451667 - protein, 12 aa, Mycobacterium tuberculosis
TERCLRGAHRTF

SEQ ID NO: 1451668 - protein, 6 aa, Mycobacterium tuberculosis
TERDGV

SEQ ID NO: 1451669 - protein, 11 aa, Mycobacterium tuberculosis
TEREADRALKA

SEQ ID NO: 1451670 - protein, 15 aa, Mycobacterium tuberculosis
TERFGPQPAQPAAGP

SEQ ID NO: 1451671 - protein, 7 aa, Mycobacterium tuberculosis
TESANRE

SEQ ID NO: 1451672 - protein, 9 aa, Mycobacterium tuberculosis
TESTEKDNS

SEQ ID NO: 1451673 - protein, 5 aa, Mycobacterium tuberculosis
TETGG

SEQ ID NO: 1451674 - protein, 29 aa, Mycobacterium tuberculosis
TETKASEGVIPPPEPVPGRAMNMATGFAA

SEQ ID NO: 1451675 - protein, 6 aa, Mycobacterium tuberculosis
TEYGSA

SEQ ID NO: 1451676 - protein, 10 aa, Mycobacterium tuberculosis
TFAQDGVGGL

SEQ ID NO: 1451677 - protein, 12 aa, Mycobacterium tuberculosis
TFATDGAVRPHP

SEQ ID NO: 1451678 - protein, 4 aa, Mycobacterium tuberculosis
TFGE

SEQ ID NO: 1451679 - protein, 10 aa, Mycobacterium tuberculosis
TFGGGAPDRV

SEQ ID NO: 1451680 - protein, 8 aa, Mycobacterium tuberculosis
TFGRGPNP

SEQ ID NO: 1451681 - protein, 4 aa, Mycobacterium tuberculosis
TFPG

SEQ ID NO: 1451682 - protein, 7 aa, Mycobacterium tuberculosis
TGAAAEA

SEQ ID NO: 1451683 - protein, 9 aa, Mycobacterium tuberculosis
TGAAGPRGV

SEQ ID NO: 1451684 - protein, 11 aa, Mycobacterium tuberculosis
TGAATSVQRDR

SEQ ID NO: 1451685 - protein, 6 aa, Mycobacterium tuberculosis
TGADAL

SEQ ID NO: 1451686 - protein, 8 aa, Mycobacterium tuberculosis
TGADPTPS

SEQ ID NO: 1451687 - protein, 7 aa, Mycobacterium tuberculosis
TGADQPG

SEQ ID NO: 1451688 - protein, 10 aa, Mycobacterium tuberculosis
TGAEAASVSS

SEQ ID NO: 1451689 - protein, 4 aa, Mycobacterium tuberculosis
TGAG

SEQ ID NO: 1451690 - protein, 17 aa, Mycobacterium tuberculosis
TGAGAYASAEAAAAAPL

SEQ ID NO: 1451691 - protein, 9 aa, Mycobacterium tuberculosis
TGAGSGIGQ

SEQ ID NO: 1451692 - protein, 13 aa, Mycobacterium tuberculosis
TGAGSPPDPQFRP

SEQ ID NO: 1451693 - protein, 6 aa, Mycobacterium tuberculosis
TGAGVR

SEQ ID NO: 1451694 - protein, 6 aa, Mycobacterium tuberculosis
TGAIAA

SEQ ID NO: 1451695 - protein, 11 aa, Mycobacterium tuberculosis
TGAPVAPSSLT

SEQ ID NO: 1451696 - protein, 27 aa, Mycobacterium tuberculosis
TGARGGDVVTGDGPYEAADLDEQGHSR

SEQ ID NO: 1451697 - protein, 21 aa, Mycobacterium tuberculosis
TGARGGNVVTGEGPVRRRRTW

SEQ ID NO: 1451698 - protein, 16 aa, Mycobacterium tuberculosis
TGARSATTSTTRPTVM

SEQ ID NO: 1451699 - protein, 9 aa, Mycobacterium tuberculosis
TGASGAGKT

SEQ ID NO: 1451700 - protein, 8 aa, Mycobacterium tuberculosis
TGATARES

SEQ ID NO: 1451701 - protein, 19 aa, Mycobacterium tuberculosis
TGCTSSIASSPSAGMSCSA

SEQ ID NO: 1451702 - protein, 14 aa, Mycobacterium tuberculosis
TGDFRRGSISENYR

SEQ ID NO: 1451703 - protein, 12 aa, Mycobacterium tuberculosis
TGDHQAAKGDGD

SEQ ID NO: 1451704 - protein, 7 aa, Mycobacterium tuberculosis
TGDLPTI

SEQ ID NO: 1451705 - protein, 10 aa, Mycobacterium tuberculosis
TGDPNGACGV

SEQ ID NO: 1451706 - protein, 11 aa, Mycobacterium tuberculosis
TGDRADDCGPA

SEQ ID NO: 1451707 - protein, 4 aa, Mycobacterium tuberculosis
TGDY

SEQ ID NO: 1451708 - protein, 15 aa, Mycobacterium tuberculosis
TGEEELQSSEAKVGP

SEQ ID NO: 1451709 - protein, 8 aa, Mycobacterium tuberculosis
TGELPPGA

SEQ ID NO: 1451710 - protein, 7 aa, Mycobacterium tuberculosis
TGETCGT

SEQ ID NO: 1451711 - protein, 8 aa, Mycobacterium tuberculosis
TGETCGTV

SEQ ID NO: 1451712 - protein, 10 aa, Mycobacterium tuberculosis
TGEYTDTTTA

SEQ ID NO: 1451713 - protein, 49 aa, Mycobacterium tuberculosis
TGFRGRPGGGGGGRPGQRGGAADAFGRPGGAPRRGRKSKRQKRQEYDSM

SEQ ID NO: 1451714 - protein, 24 aa, Mycobacterium tuberculosis
TGGAGGAGGFGGFGGDGGDGGIGG

SEQ ID NO: 1451715 - protein, 22 aa, Mycobacterium tuberculosis
TGGAPMRPPRPPASRRCRARSI

SEQ ID NO: 1451716 - protein, 5 aa, Mycobacterium tuberculosis
TGGEP

SEQ ID NO: 1451717 - protein, 7 aa, Mycobacterium tuberculosis
TGGERGE

SEQ ID NO: 1451718 - protein, 20 aa, Mycobacterium tuberculosis
TGGGCGATAANGGVGGTSVA

SEQ ID NO: 1451719 - protein, 55 aa, Mycobacterium tuberculosis
TGGHGGDGGAGGQGATAGAGGAGANGVSSTNGGGTGGNGGIGGTGGSGGAGGNAG

SEQ ID NO: 1451720 - protein, 23 aa, Mycobacterium tuberculosis
TGGNGGNGGTAPTPAAPEPAAPA

SEQ ID NO: 1451721 - protein, 15 aa, Mycobacterium tuberculosis
TGGNGGNGGTTADGA

SEQ ID NO: 1451722 - protein, 8 aa, Mycobacterium tuberculosis
TGGNGGRA

SEQ ID NO: 1451723 - protein, 47 aa, Mycobacterium tuberculosis
TGGNGGTGVGSPGGLGGAGGTGGLGGAGAGGGADGDDGDDGQPGNNG

SEQ ID NO: 1451724 - protein, 9 aa, Mycobacterium tuberculosis
TGGPESETL

SEQ ID NO: 1451725 - protein, 13 aa, Mycobacterium tuberculosis
TGGPGRPRWATSA

SEQ ID NO: 1451726 - protein, 24 aa, Mycobacterium tuberculosis
TGGQPLQPFKPSRSPTRCGLRCRF

SEQ ID NO: 1451727 - protein, 14 aa, Mycobacterium tuberculosis
TGGRSAPARTSARP

SEQ ID NO: 1451728 - protein, 20 aa, Mycobacterium tuberculosis
TGGSSALGGSAAANAAASGA

SEQ ID NO: 1451729 - protein, 39 aa, Mycobacterium tuberculosis
TGGTGGAGGNGGTQAGDGGTGGAGGAGGDGGSGGAGSIG

SEQ ID NO: 1451730 - protein, 31 aa, Mycobacterium tuberculosis
TGGTGGAGGVGTKGTGGDGGSVGAAFLRVSG

SEQ ID NO: 1451731 - protein, 20 aa, Mycobacterium tuberculosis
TGGTGGAGGVSARALLGNWL

SEQ ID NO: 1451732 - protein, 87 aa, Mycobacterium tuberculosis
TGGTGGLGDPRVDGSGGDGGTGGSGGAAGNGGNGGNAGAGGNGNGGTGGAGGIGGTGGNGGDGGKAPAGGTRRRRRRRRSGRQGRQR

SEQ ID NO: 1451733 - protein, 23 aa, Mycobacterium tuberculosis
TGGTGGSGGPGATGLGGIGGAGG

SEQ ID NO: 1451734 - protein, 5 aa, Mycobacterium tuberculosis
TGGTQ

SEQ ID NO: 1451735 - protein, 25 aa, Mycobacterium tuberculosis
TGGVGGAGGAGGDGGDGGAGGAGGL

SEQ ID NO: 1451736 - protein, 9 aa, Mycobacterium tuberculosis
TGGVRTRRA

SEQ ID NO: 1451737 - protein, 15 aa, Mycobacterium tuberculosis
TGHEGGFGHRTRQQP

SEQ ID NO: 1451738 - protein, 15 aa, Mycobacterium tuberculosis
TGHGVSSACDRLQRR

SEQ ID NO: 1451739 - protein, 9 aa, Mycobacterium tuberculosis
TGHRPARGH

SEQ ID NO: 1451740 - protein, 4 aa, Mycobacterium tuberculosis
TGIA

SEQ ID NO: 1451741 - protein, 4 aa, Mycobacterium tuberculosis
TGIK

SEQ ID NO: 1451742 - protein, 4 aa, Mycobacterium tuberculosis
TGIP

SEQ ID NO: 1451743 - protein, 5 aa, Mycobacterium tuberculosis
TGKAH

SEQ ID NO: 1451744 - protein, 25 aa, Mycobacterium tuberculosis
TGKRESKSRPREGHRHTRAHRPQPA

SEQ ID NO: 1451745 - protein, 22 aa, Mycobacterium tuberculosis
TGKSGSANVRPRSDINPDGPTT

SEQ ID NO: 1451746 - protein, 14 aa, Mycobacterium tuberculosis
TGKTPVSKDDAQQH

SEQ ID NO: 1451747 - protein, 11 aa, Mycobacterium tuberculosis
TGKTSGSNAGF

SEQ ID NO: 1451748 - protein, 19 aa, Mycobacterium tuberculosis
TGLAGRITTADTTPESAAD

SEQ ID NO: 1451749 - protein, 8 aa, Mycobacterium tuberculosis
TGLAKPAG

SEQ ID NO: 1451750 - protein, 14 aa, Mycobacterium tuberculosis
TGLANAGSYNTGSL

SEQ ID NO: 1451751 - protein, 12 aa, Mycobacterium tuberculosis
TGLGADAARARE

SEQ ID NO: 1451752 - protein, 9 aa, Mycobacterium tuberculosis
TGLKTSPNC

SEQ ID NO: 1451753 - protein, 22 aa, Mycobacterium tuberculosis
TGLNTKQVGASRNSLKHYVATA

SEQ ID NO: 1451754 - protein, 5 aa, Mycobacterium tuberculosis
TGLQE

SEQ ID NO: 1451755 - protein, 26 aa, Mycobacterium tuberculosis
TGLTDQPDLSQLGDQANDTTGSSETV

SEQ ID NO: 1451756 - protein, 21 aa, Mycobacterium tuberculosis
TGMIGDPRDVGERSLNEADTV

SEQ ID NO: 1451757 - protein, 9 aa, Mycobacterium tuberculosis
TGNANTGVV

SEQ ID NO: 1451758 - protein, 18 aa, Mycobacterium tuberculosis
TGNGRGPAGFGGDRGWAG

SEQ ID NO: 1451759 - protein, 6 aa, Mycobacterium tuberculosis
TGNGYY

SEQ ID NO: 1451760 - protein, 35 aa, Mycobacterium tuberculosis
TGNPGDPRYPYRPEPPAPPPGGPPPGPPAQQPGDQ

SEQ ID NO: 1451761 - protein, 15 aa, Mycobacterium tuberculosis
TGNTNTGIANSGQCQ

SEQ ID NO: 1451762 - protein, 23 aa, Mycobacterium tuberculosis
TGPAEAPRPPQSLSASGPGPDAG

SEQ ID NO: 1451763 - protein, 5 aa, Mycobacterium tuberculosis
TGPAL

SEQ ID NO: 1451764 - protein, 9 aa, Mycobacterium tuberculosis
TGPATRGID

SEQ ID NO: 1451765 - protein, 18 aa, Mycobacterium tuberculosis
TGPDDDEELEFFGFAGPE

SEQ ID NO: 1451766 - protein, 9 aa, Mycobacterium tuberculosis
TGPDGMGKS

SEQ ID NO: 1451767 - protein, 5 aa, Mycobacterium tuberculosis
TGPEV

SEQ ID NO: 1451768 - protein, 16 aa, Mycobacterium tuberculosis
TGPPPRPPLPPLPAAP

SEQ ID NO: 1451769 - protein, 22 aa, Mycobacterium tuberculosis
TGPRHRAAAGGNGNHAGSGGPC

SEQ ID NO: 1451770 - protein, 9 aa, Mycobacterium tuberculosis
TGPRPGGFG

SEQ ID NO: 1451771 - protein, 12 aa, Mycobacterium tuberculosis
TGPSRCPDRAGR

SEQ ID NO: 1451772 - protein, 211 aa, Mycobacterium tuberculosis
TGPTAATAREQGPSPAAAAGEAATAATPATPVPAAPAAPAPPQARRGRPAASCTTGGKGRSRAATGAASGGNGGPGGHGGNGGNGGTGANGGNGGIGGTGGAGSTGAKGVLGTNEGDGGDGGRGGNGGRGGNGGQGLTGAGGNGGTGGTPGNGGNGGNGASGDLVTSPGDGGGGGRGGDAGRGGDAGLGGSSGPGGTPGDWGTGGTGGTGG

SEQ ID NO: 1451773 - protein, 16 aa, Mycobacterium tuberculosis
TGPTGQRSGHIFLRYE

SEQ ID NO: 1451774 - protein, 5 aa, Mycobacterium tuberculosis
TGPTQ

SEQ ID NO: 1451775 - protein, 11 aa, Mycobacterium tuberculosis
TGPTSTPPQVK

SEQ ID NO: 1451776 - protein, 13 aa, Mycobacterium tuberculosis
TGPTSTPPQVKEA

SEQ ID NO: 1451777 - protein, 9 aa, Mycobacterium tuberculosis
TGQAGELPE

SEQ ID NO: 1451778 - protein, 8 aa, Mycobacterium tuberculosis
TGQAGGAG

SEQ ID NO: 1451779 - protein, 16 aa, Mycobacterium tuberculosis
TGQASQRAAGASGGVT

SEQ ID NO: 1451780 - protein, 12 aa, Mycobacterium tuberculosis
TGQKTETAHASP

SEQ ID NO: 1451781 - protein, 14 aa, Mycobacterium tuberculosis
TGQPATAPPRPDAG

SEQ ID NO: 1451782 - protein, 8 aa, Mycobacterium tuberculosis
TGQPRAVS

SEQ ID NO: 1451783 - protein, 22 aa, Mycobacterium tuberculosis
TGQRSSLGEVAGGAGVDDGDDR

SEQ ID NO: 1451784 - protein, 18 aa, Mycobacterium tuberculosis
TGQTRRECREEIRRSNGW

SEQ ID NO: 1451785 - protein, 12 aa, Mycobacterium tuberculosis
TGRADDVVRPTD

SEQ ID NO: 1451786 - protein, 8 aa, Mycobacterium tuberculosis
TGRAETMN

SEQ ID NO: 1451787 - protein, 9 aa, Mycobacterium tuberculosis
TGRCSKRDQ

SEQ ID NO: 1451788 - protein, 12 aa, Mycobacterium tuberculosis
TGRDQAGTDPVY

SEQ ID NO: 1451789 - protein, 8 aa, Mycobacterium tuberculosis
TGRNRATS

SEQ ID NO: 1451790 - protein, 14 aa, Mycobacterium tuberculosis
TGRPLIGDGANGID

SEQ ID NO: 1451791 - protein, 21 aa, Mycobacterium tuberculosis
TGRPPRAVTADRGCGDASVED

SEQ ID NO: 1451792 - protein, 6 aa, Mycobacterium tuberculosis
TGRQTH

SEQ ID NO: 1451793 - protein, 12 aa, Mycobacterium tuberculosis
TGRRCGHNRAGA

SEQ ID NO: 1451794 - protein, 11 aa, Mycobacterium tuberculosis
TGRSGSAYRGD

SEQ ID NO: 1451795 - protein, 13 aa, Mycobacterium tuberculosis
TGRVSDTSVRASW

SEQ ID NO: 1451796 - protein, 7 aa, Mycobacterium tuberculosis
TGRWRNA

SEQ ID NO: 1451797 - protein, 6 aa, Mycobacterium tuberculosis
TGSATY

SEQ ID NO: 1451798 - protein, 17 aa, Mycobacterium tuberculosis
TGSAVPGHARGDGQRPR

SEQ ID NO: 1451799 - protein, 10 aa, Mycobacterium tuberculosis
TGSIPVGTGA

SEQ ID NO: 1451800 - protein, 5 aa, Mycobacterium tuberculosis
TGSLI

SEQ ID NO: 1451801 - protein, 9 aa, Mycobacterium tuberculosis
TGSPIPTPS

SEQ ID NO: 1451802 - protein, 6 aa, Mycobacterium tuberculosis
TGSPVA

SEQ ID NO: 1451803 - protein, 20 aa, Mycobacterium tuberculosis
TGSRHRQPRRSPRLRRWVSA

SEQ ID NO: 1451804 - protein, 7 aa, Mycobacterium tuberculosis
TGSTETG

SEQ ID NO: 1451805 - protein, 21 aa, Mycobacterium tuberculosis
TGSTGCRSRAARHGFRASTTR

SEQ ID NO: 1451806 - protein, 19 aa, Mycobacterium tuberculosis
TGTADSPGTPVAQQQSAQA

SEQ ID NO: 1451807 - protein, 17 aa, Mycobacterium tuberculosis
TGTAPGQPSVEPVGLLF

SEQ ID NO: 1451808 - protein, 6 aa, Mycobacterium tuberculosis
TGTGNF

SEQ ID NO: 1451809 - protein, 9 aa, Mycobacterium tuberculosis
TGTGRPGVT

SEQ ID NO: 1451810 - protein, 8 aa, Mycobacterium tuberculosis
TGTIPSKT

SEQ ID NO: 1451811 - protein, 15 aa, Mycobacterium tuberculosis
TGTRDRQTPRRCESG

SEQ ID NO: 1451812 - protein, 10 aa, Mycobacterium tuberculosis
TGTRTQVGYG

SEQ ID NO: 1451813 - protein, 10 aa, Mycobacterium tuberculosis
TGTVTAASEW

SEQ ID NO: 1451814 - protein, 20 aa, Mycobacterium tuberculosis
TGVAAAPAGPADASDAYGVP

SEQ ID NO: 1451815 - protein, 14 aa, Mycobacterium tuberculosis
TGVDDRRCRRYRIL

SEQ ID NO: 1451816 - protein, 12 aa, Mycobacterium tuberculosis
TGVDKPDLYDPQ

SEQ ID NO: 1451817 - protein, 12 aa, Mycobacterium tuberculosis
TGVGGGLVLDGA

SEQ ID NO: 1451818 - protein, 13 aa, Mycobacterium tuberculosis
TGVSTASRAVDQR

SEQ ID NO: 1451819 - protein, 4 aa, Mycobacterium tuberculosis
TGWG

SEQ ID NO: 1451820 - protein, 4 aa, Mycobacterium tuberculosis
TGWP

SEQ ID NO: 1451821 - protein, 8 aa, Mycobacterium tuberculosis
TGYPDVPA

SEQ ID NO: 1451822 - protein, 19 aa, Mycobacterium tuberculosis
TGYPNRRPGRRPGGPHPHH

SEQ ID NO: 1451823 - protein, 8 aa, Mycobacterium tuberculosis
THAARGPV

SEQ ID NO: 1451824 - protein, 4 aa, Mycobacterium tuberculosis
THDQ

SEQ ID NO: 1451825 - protein, 8 aa, Mycobacterium tuberculosis
THEDASAP

SEQ ID NO: 1451826 - protein, 56 aa, Mycobacterium tuberculosis
THGAAGTGGDGGVGGTGAAGGKGGAGGSGGVNGATGADGAKGLDGATGGKGNNGNP

SEQ ID NO: 1451827 - protein, 26 aa, Mycobacterium tuberculosis
THGHAVGTGGAVAAESAEAAVAAGAT

SEQ ID NO: 1451828 - protein, 8 aa, Mycobacterium tuberculosis
THGRNKTA

SEQ ID NO: 1451829 - protein, 16 aa, Mycobacterium tuberculosis
THHRSAGSTPWPGGEL

SEQ ID NO: 1451830 - protein, 6 aa, Mycobacterium tuberculosis
THPHRP

SEQ ID NO: 1451831 - protein, 13 aa, Mycobacterium tuberculosis
THPTKPRVSSGSR

SEQ ID NO: 1451832 - protein, 18 aa, Mycobacterium tuberculosis
THQRDDNAAINSHATRNH

SEQ ID NO: 1451833 - protein, 6 aa, Mycobacterium tuberculosis
THRRGY

SEQ ID NO: 1451834 - protein, 21 aa, Mycobacterium tuberculosis
THRRNAHGPHNDAEGGASGDV

SEQ ID NO: 1451835 - protein, 6 aa, Mycobacterium tuberculosis
THRRSY

SEQ ID NO: 1451836 - protein, 5 aa, Mycobacterium tuberculosis
TIAAS

SEQ ID NO: 1451837 - protein, 4 aa, Mycobacterium tuberculosis
TIAP

SEQ ID NO: 1451838 - protein, 6 aa, Mycobacterium tuberculosis
TIESRA

SEQ ID NO: 1451839 - protein, 9 aa, Mycobacterium tuberculosis
TIGGGGAWD

SEQ ID NO: 1451840 - protein, 12 aa, Mycobacterium tuberculosis
TIPPEDIPGQFS

SEQ ID NO: 1451841 - protein, 13 aa, Mycobacterium tuberculosis
TIPRTSSGKIGRR

SEQ ID NO: 1451842 - protein, 16 aa, Mycobacterium tuberculosis
TISGSGSPAAARSGSA

SEQ ID NO: 1451843 - protein, 8 aa, Mycobacterium tuberculosis
TITPDEAR

SEQ ID NO: 1451844 - protein, 4 aa, Mycobacterium tuberculosis
TITS

SEQ ID NO: 1451845 - protein, 18 aa, Mycobacterium tuberculosis
TKDHQRRRSGHRQDRRRG

SEQ ID NO: 1451846 - protein, 7 aa, Mycobacterium tuberculosis
TKKRGND

SEQ ID NO: 1451847 - protein, 7 aa, Mycobacterium tuberculosis
TKLGETY

SEQ ID NO: 1451848 - protein, 7 aa, Mycobacterium tuberculosis
TKNAINA

SEQ ID NO: 1451849 - protein, 4 aa, Mycobacterium tuberculosis
TKPA

SEQ ID NO: 1451850 - protein, 13 aa, Mycobacterium tuberculosis
TKPAAAGRPTPSS

SEQ ID NO: 1451851 - protein, 5 aa, Mycobacterium tuberculosis
TKPEA

SEQ ID NO: 1451852 - protein, 32 aa, Mycobacterium tuberculosis
TKPEAGRRSARSRRSRTSSSTHRRTASPTVDR

SEQ ID NO: 1451853 - protein, 11 aa, Mycobacterium tuberculosis
TKPGTTTPHTE

SEQ ID NO: 1451854 - protein, 7 aa, Mycobacterium tuberculosis
TKPSPIR

SEQ ID NO: 1451855 - protein, 7 aa, Mycobacterium tuberculosis
TKQAYRG

SEQ ID NO: 1451856 - protein, 33 aa, Mycobacterium tuberculosis
TKQPKTLDTNRSEVNGTYPAATASRAAKARKSV

SEQ ID NO: 1451857 - protein, 34 aa, Mycobacterium tuberculosis
TKQPKTLDTNRSEVNGTYPAATASRAAKARKSVG

SEQ ID NO: 1451858 - protein, 9 aa, Mycobacterium tuberculosis
TKRDRPGCN

SEQ ID NO: 1451859 - protein, 4 aa, Mycobacterium tuberculosis
TKRG

SEQ ID NO: 1451860 - protein, 5 aa, Mycobacterium tuberculosis
TKRGC

SEQ ID NO: 1451861 - protein, 16 aa, Mycobacterium tuberculosis
TKSASRRAGCDRRPRN

SEQ ID NO: 1451862 - protein, 27 aa, Mycobacterium tuberculosis
TKSDSRTSDFQPVSATARYQDFSGSQI

SEQ ID NO: 1451863 - protein, 18 aa, Mycobacterium tuberculosis
TKSGGTRTGNVTLAEGPP

SEQ ID NO: 1451864 - protein, 18 aa, Mycobacterium tuberculosis
TKSHSRPHTSNDNPLSEA

SEQ ID NO: 1451865 - protein, 5 aa, Mycobacterium tuberculosis
TKTAD

SEQ ID NO: 1451866 - protein, 15 aa, Mycobacterium tuberculosis
TLAGRGAARPTAQLA

SEQ ID NO: 1451867 - protein, 8 aa, Mycobacterium tuberculosis
TLAPTTSV

SEQ ID NO: 1451868 - protein, 23 aa, Mycobacterium tuberculosis
TLASTSTTSPASSHPPSANTTVT

SEQ ID NO: 1451869 - protein, 12 aa, Mycobacterium tuberculosis
TLDPGPEFSTPA

SEQ ID NO: 1451870 - protein, 14 aa, Mycobacterium tuberculosis
TLGADSADAQSGSI

SEQ ID NO: 1451871 - protein, 80 aa, Mycobacterium tuberculosis
TLGGNGGNGRAPGALGGKGGSGGLIGRAGSDGGVGAGGAGGAGGAGGTGGEGGTGGDGKTTDGNPGMGGSPGSAGQPGQP

SEQ ID NO: 1451872 - protein, 6 aa, Mycobacterium tuberculosis
TLGHGD

SEQ ID NO: 1451873 - protein, 7 aa, Mycobacterium tuberculosis
TLGTSTE

SEQ ID NO: 1451874 - protein, 24 aa, Mycobacterium tuberculosis
TLPDASAPRPKTPSNWPRRWHAVF

SEQ ID NO: 1451875 - protein, 7 aa, Mycobacterium tuberculosis
TLPDSAQ

SEQ ID NO: 1451876 - protein, 9 aa, Mycobacterium tuberculosis
TLPGRGLSP

SEQ ID NO: 1451877 - protein, 9 aa, Mycobacterium tuberculosis
TLPHPRRQA

SEQ ID NO: 1451878 - protein, 7 aa, Mycobacterium tuberculosis
TLPPRRR

SEQ ID NO: 1451879 - protein, 13 aa, Mycobacterium tuberculosis
TLPTEPMRSRGRN

SEQ ID NO: 1451880 - protein, 6 aa, Mycobacterium tuberculosis
TLSAKE

SEQ ID NO: 1451881 - protein, 14 aa, Mycobacterium tuberculosis
TLSAKEMAKAPSAH

SEQ ID NO: 1451882 - protein, 18 aa, Mycobacterium tuberculosis
TLSAPSGGTHRFAAPRRA

SEQ ID NO: 1451883 - protein, 7 aa, Mycobacterium tuberculosis
TLSDPNQ

SEQ ID NO: 1451884 - protein, 15 aa, Mycobacterium tuberculosis
TLSPGQLEIRDGPAT

SEQ ID NO: 1451885 - protein, 6 aa, Mycobacterium tuberculosis
TLSSDP

SEQ ID NO: 1451886 - protein, 18 aa, Mycobacterium tuberculosis
TLTPYRRPGGVNGAASLV

SEQ ID NO: 1451887 - protein, 5 aa, Mycobacterium tuberculosis
TMDPT

SEQ ID NO: 1451888 - protein, 16 aa, Mycobacterium tuberculosis
TMNAQNAAAAAPTTGV

SEQ ID NO: 1451889 - protein, 5 aa, Mycobacterium tuberculosis
TMPTG

SEQ ID NO: 1451890 - protein, 13 aa, Mycobacterium tuberculosis
TMSPGARKAAHDA

SEQ ID NO: 1451891 - protein, 14 aa, Mycobacterium tuberculosis
TMSSASSRADDHHP

SEQ ID NO: 1451892 - protein, 8 aa, Mycobacterium tuberculosis
TNAAAGSV

SEQ ID NO: 1451893 - protein, 20 aa, Mycobacterium tuberculosis
TNAGKPAQRADRGRGAGTGR

SEQ ID NO: 1451894 - protein, 19 aa, Mycobacterium tuberculosis
TNANPQPVSESELGHTKRG

SEQ ID NO: 1451895 - protein, 9 aa, Mycobacterium tuberculosis
TNANSSAHH

SEQ ID NO: 1451896 - protein, 12 aa, Mycobacterium tuberculosis
TNATRHQHDAAA

SEQ ID NO: 1451897 - protein, 8 aa, Mycobacterium tuberculosis
TNATSEAV

SEQ ID NO: 1451898 - protein, 10 aa, Mycobacterium tuberculosis
TNCGNSTRAI

SEQ ID NO: 1451899 - protein, 14 aa, Mycobacterium tuberculosis
TNDDHAGTTTRGRW

SEQ ID NO: 1451900 - protein, 10 aa, Mycobacterium tuberculosis
TNDKDTPGAK

SEQ ID NO: 1451901 - protein, 9 aa, Mycobacterium tuberculosis
TNDTPGITN

SEQ ID NO: 1451902 - protein, 7 aa, Mycobacterium tuberculosis
TNEGLRS

SEQ ID NO: 1451903 - protein, 6 aa, Mycobacterium tuberculosis
TNEGSA

SEQ ID NO: 1451904 - protein, 4 aa, Mycobacterium tuberculosis
TNGA

SEQ ID NO: 1451905 - protein, 5 aa, Mycobacterium tuberculosis
TNNHP

SEQ ID NO: 1451906 - protein, 7 aa, Mycobacterium tuberculosis
TNNTARA

SEQ ID NO: 1451907 - protein, 6 aa, Mycobacterium tuberculosis
TNPAVT

SEQ ID NO: 1451908 - protein, 4 aa, Mycobacterium tuberculosis
TNPD

SEQ ID NO: 1451909 - protein, 22 aa, Mycobacterium tuberculosis
TNPESSGAKKTPWHIGVNRADD

SEQ ID NO: 1451910 - protein, 22 aa, Mycobacterium tuberculosis
TNPGGLAAQSAAVGSAAATAAV

SEQ ID NO: 1451911 - protein, 16 aa, Mycobacterium tuberculosis
TNPSPPGEDGPWSQHD

SEQ ID NO: 1451912 - protein, 21 aa, Mycobacterium tuberculosis
TNPWRGPPIPYGTEVTDGRNI

SEQ ID NO: 1451913 - protein, 12 aa, Mycobacterium tuberculosis
TNRDGETTRHAT

SEQ ID NO: 1451914 - protein, 7 aa, Mycobacterium tuberculosis
TNSAGKV

SEQ ID NO: 1451915 - protein, 22 aa, Mycobacterium tuberculosis
TNSPPPSPPKPPPPPAPPALLV

SEQ ID NO: 1451916 - protein, 21 aa, Mycobacterium tuberculosis
TNSTPYQPDPTRAHTPASNYG

SEQ ID NO: 1451917 - protein, 8 aa, Mycobacterium tuberculosis
TNTIGTES

SEQ ID NO: 1451918 - protein, 18 aa, Mycobacterium tuberculosis
TNTKTHRGLRSPPAPPKG

SEQ ID NO: 1451919 - protein, 19 aa, Mycobacterium tuberculosis
TNTSSSRDIRGMQCWRRDR

SEQ ID NO: 1451920 - protein, 10 aa, Mycobacterium tuberculosis
TNWSTGQPMT

SEQ ID NO: 1451921 - protein, 5 aa, Mycobacterium tuberculosis
TPAGR

SEQ ID NO: 1451922 - protein, 8 aa, Mycobacterium tuberculosis
TPAITTPP

SEQ ID NO: 1451923 - protein, 5 aa, Mycobacterium tuberculosis
TPAQI

SEQ ID NO: 1451924 - protein, 34 aa, Mycobacterium tuberculosis
TPASAPPATTQPPATTQPPATTSPSPPPIPPIPP

SEQ ID NO: 1451925 - protein, 13 aa, Mycobacterium tuberculosis
TPATEAKSETPVP

SEQ ID NO: 1451926 - protein, 27 aa, Mycobacterium tuberculosis
TPATGANSSCWPADPSQHHRIAESRAC

SEQ ID NO: 1451927 - protein, 9 aa, Mycobacterium tuberculosis
TPATRGPQP

SEQ ID NO: 1451928 - protein, 8 aa, Mycobacterium tuberculosis
TPATRHEA

SEQ ID NO: 1451929 - protein, 8 aa, Mycobacterium tuberculosis
TPCRTTPP

SEQ ID NO: 1451930 - protein, 14 aa, Mycobacterium tuberculosis
TPDEAAALVTNSRR

SEQ ID NO: 1451931 - protein, 8 aa, Mycobacterium tuberculosis
TPDEVDPD

SEQ ID NO: 1451932 - protein, 14 aa, Mycobacterium tuberculosis
TPDIDEAGHNHAGT

SEQ ID NO: 1451933 - protein, 6 aa, Mycobacterium tuberculosis
TPDQHP

SEQ ID NO: 1451934 - protein, 10 aa, Mycobacterium tuberculosis
TPDTSRGQQA

SEQ ID NO: 1451935 - protein, 10 aa, Mycobacterium tuberculosis
TPEGDEPLPG

SEQ ID NO: 1451936 - protein, 7 aa, Mycobacterium tuberculosis
TPEGPSI

SEQ ID NO: 1451937 - protein, 5 aa, Mycobacterium tuberculosis
TPEHG

SEQ ID NO: 1451938 - protein, 8 aa, Mycobacterium tuberculosis
TPESFTDR

SEQ ID NO: 1451939 - protein, 5 aa, Mycobacterium tuberculosis
TPESR

SEQ ID NO: 1451940 - protein, 18 aa, Mycobacterium tuberculosis
TPFSPPGADRQPGRAGQT

SEQ ID NO: 1451941 - protein, 15 aa, Mycobacterium tuberculosis
TPGADGPADAAGLGL

SEQ ID NO: 1451942 - protein, 171 aa, Mycobacterium tuberculosis
TPGDDARRLRREEEPGNQTTPGDDARRLRREEEPGNQTTPGDDARRLRREEEPGNQTTPGDDARRLRREEEPGNQTTPGDDARRLRREEEPGNQTTPGDDARRLRREEEPGNQTTPGDDARRLRREEEPGNQTTPGDDARRLRREEEPGNQTTPGDDARRLRREEEPGNQT

SEQ ID NO: 1451943 - protein, 35 aa, Mycobacterium tuberculosis
TPGGGGLSGRRGRRRDAAAQLDQRARPGRYRPSAD

SEQ ID NO: 1451944 - protein, 11 aa, Mycobacterium tuberculosis
TPGHADFGGEV

SEQ ID NO: 1451945 - protein, 7 aa, Mycobacterium tuberculosis
TPGKEGH

SEQ ID NO: 1451946 - protein, 17 aa, Mycobacterium tuberculosis
TPGPGNDATGWCQSRCR

SEQ ID NO: 1451947 - protein, 5 aa, Mycobacterium tuberculosis
TPGRA

SEQ ID NO: 1451948 - protein, 21 aa, Mycobacterium tuberculosis
TPGSAPSGGTCGTGMASGRAT

SEQ ID NO: 1451949 - protein, 18 aa, Mycobacterium tuberculosis
TPGSRSVGRTATRSPRPC

SEQ ID NO: 1451950 - protein, 10 aa, Mycobacterium tuberculosis
TPGTERRTAT

SEQ ID NO: 1451951 - protein, 7 aa, Mycobacterium tuberculosis
TPKAPGL

SEQ ID NO: 1451952 - protein, 5 aa, Mycobacterium tuberculosis
TPLAA

SEQ ID NO: 1451953 - protein, 7 aa, Mycobacterium tuberculosis
TPLATDP

SEQ ID NO: 1451954 - protein, 14 aa, Mycobacterium tuberculosis
TPLPPAPPAAPAPF

SEQ ID NO: 1451955 - protein, 10 aa, Mycobacterium tuberculosis
TPLPTSTTAY

SEQ ID NO: 1451956 - protein, 8 aa, Mycobacterium tuberculosis
TPNGVPEH

SEQ ID NO: 1451957 - protein, 6 aa, Mycobacterium tuberculosis
TPNSDQ

SEQ ID NO: 1451958 - protein, 5 aa, Mycobacterium tuberculosis
TPPAA

SEQ ID NO: 1451959 - protein, 27 aa, Mycobacterium tuberculosis
TPPAPPAPPLPSSPLAPPAPPVPPVPP

SEQ ID NO: 1451960 - protein, 24 aa, Mycobacterium tuberculosis
TPPAPPLPPTPTSPPLPPSPPAPW

SEQ ID NO: 1451961 - protein, 12 aa, Mycobacterium tuberculosis
TPPATRPSYAGA

SEQ ID NO: 1451962 - protein, 6 aa, Mycobacterium tuberculosis
TPPPCA

SEQ ID NO: 1451963 - protein, 31 aa, Mycobacterium tuberculosis
TPPQAQADPEHGRPAAAAGDSGQQLRPPRAG

SEQ ID NO: 1451964 - protein, 15 aa, Mycobacterium tuberculosis
TPPQTPGGTAPRART

SEQ ID NO: 1451965 - protein, 6 aa, Mycobacterium tuberculosis
TPQARE

SEQ ID NO: 1451966 - protein, 14 aa, Mycobacterium tuberculosis
TPQERADRYVARMP

SEQ ID NO: 1451967 - protein, 20 aa, Mycobacterium tuberculosis
TPQQATAGGVKAAVIVEAVG

SEQ ID NO: 1451968 - protein, 25 aa, Mycobacterium tuberculosis
TPQRSTDSAYRDHGSGHADLGSSSR

SEQ ID NO: 1451969 - protein, 10 aa, Mycobacterium tuberculosis
TPREPTPENW

SEQ ID NO: 1451970 - protein, 12 aa, Mycobacterium tuberculosis
TPRGNQKNGSLH

SEQ ID NO: 1451971 - protein, 63 aa, Mycobacterium tuberculosis
TPRHGRPGPHHPHPGAHGRGDQQAGPHSTRAAAGPGPRAHARGAGQRDGHHPGEGAGNPAIRP

SEQ ID NO: 1451972 - protein, 4 aa, Mycobacterium tuberculosis
TPRL

SEQ ID NO: 1451973 - protein, 10 aa, Mycobacterium tuberculosis
TPRPLSRSTR

SEQ ID NO: 1451974 - protein, 7 aa, Mycobacterium tuberculosis
TPRPNRY

SEQ ID NO: 1451975 - protein, 5 aa, Mycobacterium tuberculosis
TPRPP

SEQ ID NO: 1451976 - protein, 8 aa, Mycobacterium tuberculosis
TPRRSCPA

SEQ ID NO: 1451977 - protein, 16 aa, Mycobacterium tuberculosis
TPRRWPPTTALLAADC

SEQ ID NO: 1451978 - protein, 25 aa, Mycobacterium tuberculosis
TPRTPTLRPARPRPPPPPTSAPNLH

SEQ ID NO: 1451979 - protein, 7 aa, Mycobacterium tuberculosis
TPSAPSR

SEQ ID NO: 1451980 - protein, 8 aa, Mycobacterium tuberculosis
TPSATAVG

SEQ ID NO: 1451981 - protein, 5 aa, Mycobacterium tuberculosis
TPSLT

SEQ ID NO: 1451982 - protein, 7 aa, Mycobacterium tuberculosis
TPSQTAN

SEQ ID NO: 1451983 - protein, 5 aa, Mycobacterium tuberculosis
TPSRI

SEQ ID NO: 1451984 - protein, 22 aa, Mycobacterium tuberculosis
TPSWASKPTGRCPASRSPPGMS

SEQ ID NO: 1451985 - protein, 17 aa, Mycobacterium tuberculosis
TPTAGAHRAPLTNAVSR

SEQ ID NO: 1451986 - protein, 5 aa, Mycobacterium tuberculosis
TPTAR

SEQ ID NO: 1451987 - protein, 5 aa, Mycobacterium tuberculosis
TPTDT

SEQ ID NO: 1451988 - protein, 8 aa, Mycobacterium tuberculosis
TPTPGAAQ

SEQ ID NO: 1451989 - protein, 14 aa, Mycobacterium tuberculosis
TPTPSTSAPGCRPT

SEQ ID NO: 1451990 - protein, 14 aa, Mycobacterium tuberculosis
TPTRRGTSRPSDSK

SEQ ID NO: 1451991 - protein, 5 aa, Mycobacterium tuberculosis
TPTSK

SEQ ID NO: 1451992 - protein, 14 aa, Mycobacterium tuberculosis
TPTTAGDVSPTGLR

SEQ ID NO: 1451993 - protein, 21 aa, Mycobacterium tuberculosis
TPTTPRAPAAGTHRTSLPSRR

SEQ ID NO: 1451994 - protein, 24 aa, Mycobacterium tuberculosis
TPVAAEPRTSEFGGGGSGRPSPRP

SEQ ID NO: 1451995 - protein, 48 aa, Mycobacterium tuberculosis
TPVASTQAAPTPAGSTPVTPTPASPTRAMSTPAPSSRATLATASYGGA

SEQ ID NO: 1451996 - protein, 4 aa, Mycobacterium tuberculosis
TPVE

SEQ ID NO: 1451997 - protein, 21 aa, Mycobacterium tuberculosis
TPYASPRRCKPPSKTATGSSP

SEQ ID NO: 1451998 - protein, 8 aa, Mycobacterium tuberculosis
TQAASRAA

SEQ ID NO: 1451999 - protein, 5 aa, Mycobacterium tuberculosis
TQAHP

SEQ ID NO: 1452000 - protein, 115 aa, Mycobacterium tuberculosis
TQDRTGGTGTGQSRGAGGFGGVGQAGGKGWDGGPIGNGQVGEQHGAGQLGSTDGNPGVAGAAHGSGVSASHGSGATGAAGVADPGGSGAGVGSAAGNGTGAGSADAVGGAGTGRD

SEQ ID NO: 1452001 - protein, 13 aa, Mycobacterium tuberculosis
TQGCSDRPAAADD

SEQ ID NO: 1452002 - protein, 100 aa, Mycobacterium tuberculosis
TQGGDGTPGGAGVNGGNGGAGGDANGNPANTSIANAGAGGNGAAGGDGGANGGAGGAGGQAASAGSSVGGDGGNGGAGGTGTNGHAGGAGGAGGAGGRGG

SEQ ID NO: 1452003 - protein, 8 aa, Mycobacterium tuberculosis
TQGHTQSL

SEQ ID NO: 1452004 - protein, 13 aa, Mycobacterium tuberculosis
TQGQEPRGRGQID

SEQ ID NO: 1452005 - protein, 6 aa, Mycobacterium tuberculosis
TQGRGA

SEQ ID NO: 1452006 - protein, 10 aa, Mycobacterium tuberculosis
TQHAAPPAHR

SEQ ID NO: 1452007 - protein, 5 aa, Mycobacterium tuberculosis
TQIDA

SEQ ID NO: 1452008 - protein, 34 aa, Mycobacterium tuberculosis
TQKSVANGESTDTASAATEGHRGEIDAGRTRCRR

SEQ ID NO: 1452009 - protein, 4 aa, Mycobacterium tuberculosis
TQPA

SEQ ID NO: 1452010 - protein, 32 aa, Mycobacterium tuberculosis
TQPEPGTALGPKSVSSCKASTAPGSATAFVVP

SEQ ID NO: 1452011 - protein, 17 aa, Mycobacterium tuberculosis
TQPGRTYDVSSPDLPTV

SEQ ID NO: 1452012 - protein, 6 aa, Mycobacterium tuberculosis
TQPNTH

SEQ ID NO: 1452013 - protein, 6 aa, Mycobacterium tuberculosis
TQPPRI

SEQ ID NO: 1452014 - protein, 18 aa, Mycobacterium tuberculosis
TQQRRPIGRTAPTDHPAQ

SEQ ID NO: 1452015 - protein, 10 aa, Mycobacterium tuberculosis
TQRAGSSPIN

SEQ ID NO: 1452016 - protein, 7 aa, Mycobacterium tuberculosis
TQRESLG

SEQ ID NO: 1452017 - protein, 12 aa, Mycobacterium tuberculosis
TQRWPSSPIPSP

SEQ ID NO: 1452018 - protein, 8 aa, Mycobacterium tuberculosis
TQSGEEEV

SEQ ID NO: 1452019 - protein, 7 aa, Mycobacterium tuberculosis
TQSLGAD

SEQ ID NO: 1452020 - protein, 13 aa, Mycobacterium tuberculosis
TQSPYPGGGPIPE

SEQ ID NO: 1452021 - protein, 6 aa, Mycobacterium tuberculosis
TQSTSW

SEQ ID NO: 1452022 - protein, 5 aa, Mycobacterium tuberculosis
TQVSD

SEQ ID NO: 1452023 - protein, 16 aa, Mycobacterium tuberculosis
TRAAPAQARVPGPDPA

SEQ ID NO: 1452024 - protein, 35 aa, Mycobacterium tuberculosis
TRAASARTAPPARPPSTDHIDKPDRSESADDGTPV

SEQ ID NO: 1452025 - protein, 21 aa, Mycobacterium tuberculosis
TRAASTPAGSTPATPTPASPI

SEQ ID NO: 1452026 - protein, 44 aa, Mycobacterium tuberculosis
TRAASTPATPTPVASTRAASTPAGSTPGMPTPGWPTRAPSAPAP

SEQ ID NO: 1452027 - protein, 16 aa, Mycobacterium tuberculosis
TRADAEQGRAGADGLG

SEQ ID NO: 1452028 - protein, 14 aa, Mycobacterium tuberculosis
TRAKRRRATRVTGP

SEQ ID NO: 1452029 - protein, 93 aa, Mycobacterium tuberculosis
TRAPATSASATRAPATSASATRAPETGASPTPVTPTPASSTPATSTPACSTPATSTPASSTPAITTPAASTPAASTRPASTRVATTRDWPTRA

SEQ ID NO: 1452030 - protein, 88 aa, Mycobacterium tuberculosis
TRAPATSASATRAPATSASATRAPETGASPTPVTPTPASSTPATSTPACSTPATSTPASSTPAITTPAASTPAASTRPASTRVATTRV

SEQ ID NO: 1452031 - protein, 8 aa, Mycobacterium tuberculosis
TRAQRVTS

SEQ ID NO: 1452032 - protein, 6 aa, Mycobacterium tuberculosis
TRAQWD

SEQ ID NO: 1452033 - protein, 55 aa, Mycobacterium tuberculosis
TRCGDRSLDGRSGRRGGGRGADPGPGITGDRGPVEADGAAVRAGHDGVAGTRRRS

SEQ ID NO: 1452034 - protein, 17 aa, Mycobacterium tuberculosis
TRCRSPHRGHRADPTRS

SEQ ID NO: 1452035 - protein, 8 aa, Mycobacterium tuberculosis
TRCSPTSA

SEQ ID NO: 1452036 - protein, 9 aa, Mycobacterium tuberculosis
TRDAAGNGD

SEQ ID NO: 1452037 - protein, 11 aa, Mycobacterium tuberculosis
TRDEPHADAEK

SEQ ID NO: 1452038 - protein, 22 aa, Mycobacterium tuberculosis
TRDGDRGHRWPEPPEERAGQRL

SEQ ID NO: 1452039 - protein, 9 aa, Mycobacterium tuberculosis
TRDGGGHGH

SEQ ID NO: 1452040 - protein, 4 aa, Mycobacterium tuberculosis
TRDL

SEQ ID NO: 1452041 - protein, 7 aa, Mycobacterium tuberculosis
TREGNRY

SEQ ID NO: 1452042 - protein, 9 aa, Mycobacterium tuberculosis
TREQDPDRA

SEQ ID NO: 1452043 - protein, 25 aa, Mycobacterium tuberculosis
TRGARVPTPQRRRPYQPPPRPNSEA

SEQ ID NO: 1452044 - protein, 13 aa, Mycobacterium tuberculosis
TRGGDGQGAPFGA

SEQ ID NO: 1452045 - protein, 22 aa, Mycobacterium tuberculosis
TRGIPVRSNRGVAGIDGTVSTA

SEQ ID NO: 1452046 - protein, 21 aa, Mycobacterium tuberculosis
TRGPNRWTPPSIRGPWTTRPT

SEQ ID NO: 1452047 - protein, 15 aa, Mycobacterium tuberculosis
TRGSTPCGGPPRSRP

SEQ ID NO: 1452048 - protein, 10 aa, Mycobacterium tuberculosis
TRHPQPATAP

SEQ ID NO: 1452049 - protein, 8 aa, Mycobacterium tuberculosis
TRHRRRAA

SEQ ID NO: 1452050 - protein, 6 aa, Mycobacterium tuberculosis
TRIPTR

SEQ ID NO: 1452051 - protein, 7 aa, Mycobacterium tuberculosis
TRKGRAL

SEQ ID NO: 1452052 - protein, 18 aa, Mycobacterium tuberculosis
TRKGVEDGGGTYQPHSAE

SEQ ID NO: 1452053 - protein, 4 aa, Mycobacterium tuberculosis
TRKT

SEQ ID NO: 1452054 - protein, 7 aa, Mycobacterium tuberculosis
TRLSQTR

SEQ ID NO: 1452055 - protein, 17 aa, Mycobacterium tuberculosis
TRNDEPEQASRPFDKDR

SEQ ID NO: 1452056 - protein, 17 aa, Mycobacterium tuberculosis
TRPASSVGSHTHRSSTN

SEQ ID NO: 1452057 - protein, 24 aa, Mycobacterium tuberculosis
TRPGAAGRAARGRSPAPAAGARPA

SEQ ID NO: 1452058 - protein, 17 aa, Mycobacterium tuberculosis
TRPGGGPSGTTRRSKRP

SEQ ID NO: 1452059 - protein, 26 aa, Mycobacterium tuberculosis
TRPGHHKETSRQHLGSATSRRSATRP

SEQ ID NO: 1452060 - protein, 15 aa, Mycobacterium tuberculosis
TRPGLPSGGRSGSSV

SEQ ID NO: 1452061 - protein, 9 aa, Mycobacterium tuberculosis
TRPHRSKRV

SEQ ID NO: 1452062 - protein, 8 aa, Mycobacterium tuberculosis
TRPLDAGP

SEQ ID NO: 1452063 - protein, 8 aa, Mycobacterium tuberculosis
TRPPSTSA

SEQ ID NO: 1452064 - protein, 12 aa, Mycobacterium tuberculosis
TRPPVGGEMAGR

SEQ ID NO: 1452065 - protein, 8 aa, Mycobacterium tuberculosis
TRPQRPAP

SEQ ID NO: 1452066 - protein, 8 aa, Mycobacterium tuberculosis
TRPRHPDD

SEQ ID NO: 1452067 - protein, 5 aa, Mycobacterium tuberculosis
TRPRR

SEQ ID NO: 1452068 - protein, 20 aa, Mycobacterium tuberculosis
TRPTPPIPPDSHPPNRPVQS

SEQ ID NO: 1452069 - protein, 21 aa, Mycobacterium tuberculosis
TRPTTLTTTGRPERSGEPGLA

SEQ ID NO: 1452070 - protein, 18 aa, Mycobacterium tuberculosis
TRQAPRRDRHAGAHAGRR

SEQ ID NO: 1452071 - protein, 8 aa, Mycobacterium tuberculosis
TRRAEEDR

SEQ ID NO: 1452072 - protein, 15 aa, Mycobacterium tuberculosis
TRRAGPAMSATATGA

SEQ ID NO: 1452073 - protein, 5 aa, Mycobacterium tuberculosis
TRRAM

SEQ ID NO: 1452074 - protein, 18 aa, Mycobacterium tuberculosis
TRRFSPPGGGSGGNGGNG

SEQ ID NO: 1452075 - protein, 4 aa, Mycobacterium tuberculosis
TRRG

SEQ ID NO: 1452076 - protein, 17 aa, Mycobacterium tuberculosis
TRRGTATRCPVSTSPGV

SEQ ID NO: 1452077 - protein, 4 aa, Mycobacterium tuberculosis
TRRK

SEQ ID NO: 1452078 - protein, 11 aa, Mycobacterium tuberculosis
TRRNPGDGSYV

SEQ ID NO: 1452079 - protein, 12 aa, Mycobacterium tuberculosis
TRRPDAKPYGAL

SEQ ID NO: 1452080 - protein, 7 aa, Mycobacterium tuberculosis
TRRPSAD

SEQ ID NO: 1452081 - protein, 20 aa, Mycobacterium tuberculosis
TRRRGCRPGTACARPPSRHR

SEQ ID NO: 1452082 - protein, 13 aa, Mycobacterium tuberculosis
TRRSPHSSGCSST

SEQ ID NO: 1452083 - protein, 4 aa, Mycobacterium tuberculosis
TRSG

SEQ ID NO: 1452084 - protein, 4 aa, Mycobacterium tuberculosis
TRSI

SEQ ID NO: 1452085 - protein, 11 aa, Mycobacterium tuberculosis
TRSKVRQQQEA

SEQ ID NO: 1452086 - protein, 5 aa, Mycobacterium tuberculosis
TRSNE

SEQ ID NO: 1452087 - protein, 4 aa, Mycobacterium tuberculosis
TRSR

SEQ ID NO: 1452088 - protein, 6 aa, Mycobacterium tuberculosis
TRTCSS

SEQ ID NO: 1452089 - protein, 15 aa, Mycobacterium tuberculosis
TRTGDGYGGLAHAVT

SEQ ID NO: 1452090 - protein, 20 aa, Mycobacterium tuberculosis
TRTGRQRAGRPPQAGPNRAR

SEQ ID NO: 1452091 - protein, 60 aa, Mycobacterium tuberculosis
TRVGQSAGSGIPESTLRTAQGQQASETSAAEETAPSLRPEAAAGQLRPRVRQDPKIQMRG

SEQ ID NO: 1452092 - protein, 9 aa, Mycobacterium tuberculosis
TRVSSSVGD

SEQ ID NO: 1452093 - protein, 7 aa, Mycobacterium tuberculosis
TRWGDPR

SEQ ID NO: 1452094 - protein, 4 aa, Mycobacterium tuberculosis
TRYP

SEQ ID NO: 1452095 - protein, 5 aa, Mycobacterium tuberculosis
TRYRG

SEQ ID NO: 1452096 - protein, 9 aa, Mycobacterium tuberculosis
TSAAGNDLS

SEQ ID NO: 1452097 - protein, 12 aa, Mycobacterium tuberculosis
TSAARAASAAAP

SEQ ID NO: 1452098 - protein, 14 aa, Mycobacterium tuberculosis
TSAEDGAGWLAFFR

SEQ ID NO: 1452099 - protein, 13 aa, Mycobacterium tuberculosis
TSAEVTESTPRRI

SEQ ID NO: 1452100 - protein, 8 aa, Mycobacterium tuberculosis
TSAGATVA

SEQ ID NO: 1452101 - protein, 8 aa, Mycobacterium tuberculosis
TSAGRTRH

SEQ ID NO: 1452102 - protein, 8 aa, Mycobacterium tuberculosis
TSAGSGRG

SEQ ID NO: 1452103 - protein, 9 aa, Mycobacterium tuberculosis
TSAQAPPVR

SEQ ID NO: 1452104 - protein, 54 aa, Mycobacterium tuberculosis
TSATTTWAAPTSASTTWAAPTSATSTWAAPTSATSTWAAPTSAAPTSGSATSVR

SEQ ID NO: 1452105 - protein, 10 aa, Mycobacterium tuberculosis
TSAVAASRAA

SEQ ID NO: 1452106 - protein, 26 aa, Mycobacterium tuberculosis
TSCYPGHARSRSRRGPATSLSPTSPG

SEQ ID NO: 1452107 - protein, 7 aa, Mycobacterium tuberculosis
TSDEHPG

SEQ ID NO: 1452108 - protein, 7 aa, Mycobacterium tuberculosis
TSEGVDP

SEQ ID NO: 1452109 - protein, 6 aa, Mycobacterium tuberculosis
TSGASL

SEQ ID NO: 1452110 - protein, 18 aa, Mycobacterium tuberculosis
TSGEQRLSGHRGPTGGVS

SEQ ID NO: 1452111 - protein, 6 aa, Mycobacterium tuberculosis
TSGFRP

SEQ ID NO: 1452112 - protein, 12 aa, Mycobacterium tuberculosis
TSGHTYVSTPGS

SEQ ID NO: 1452113 - protein, 18 aa, Mycobacterium tuberculosis
TSGPGATKPGEFHHSGDD

SEQ ID NO: 1452114 - protein, 61 aa, Mycobacterium tuberculosis
TSGPRLPSGSRAPPAATAARAAPVAATPTAQVATAARAATAVPAATGARSAPTAASSAVPV

SEQ ID NO: 1452115 - protein, 10 aa, Mycobacterium tuberculosis
TSGPSPESVD

SEQ ID NO: 1452116 - protein, 16 aa, Mycobacterium tuberculosis
TSGQVAGVGGAQRGVR

SEQ ID NO: 1452117 - protein, 30 aa, Mycobacterium tuberculosis
TSGRRQRGRVEGGAAMSARRPTRSSGATQI

SEQ ID NO: 1452118 - protein, 10 aa, Mycobacterium tuberculosis
TSGSRRPPVG

SEQ ID NO: 1452119 - protein, 10 aa, Mycobacterium tuberculosis
TSGSTADPRG

SEQ ID NO: 1452120 - protein, 13 aa, Mycobacterium tuberculosis
TSGSTGAPKGAMY

SEQ ID NO: 1452121 - protein, 10 aa, Mycobacterium tuberculosis
TSGSTRIPSG

SEQ ID NO: 1452122 - protein, 8 aa, Mycobacterium tuberculosis
TSGWKPAG

SEQ ID NO: 1452123 - protein, 25 aa, Mycobacterium tuberculosis
TSGWPTPAPATSGSGWWGTTSPASG

SEQ ID NO: 1452124 - protein, 8 aa, Mycobacterium tuberculosis
TSHRRPPF

SEQ ID NO: 1452125 - protein, 6 aa, Mycobacterium tuberculosis
TSLPAA

SEQ ID NO: 1452126 - protein, 5 aa, Mycobacterium tuberculosis
TSNRA

SEQ ID NO: 1452127 - protein, 13 aa, Mycobacterium tuberculosis
TSPAAPAPPSPAL

SEQ ID NO: 1452128 - protein, 22 aa, Mycobacterium tuberculosis
TSPASATRWGQPRTASRLSSMT

SEQ ID NO: 1452129 - protein, 30 aa, Mycobacterium tuberculosis
TSPAVRTATPSESGTQTTRVNAHDDSASVT

SEQ ID NO: 1452130 - protein, 9 aa, Mycobacterium tuberculosis
TSPGPASSP

SEQ ID NO: 1452131 - protein, 6 aa, Mycobacterium tuberculosis
TSPLPP

SEQ ID NO: 1452132 - protein, 5 aa, Mycobacterium tuberculosis
TSPPQ

SEQ ID NO: 1452133 - protein, 5 aa, Mycobacterium tuberculosis
TSPRT

SEQ ID NO: 1452134 - protein, 7 aa, Mycobacterium tuberculosis
TSPSSSL

SEQ ID NO: 1452135 - protein, 18 aa, Mycobacterium tuberculosis
TSPTPQPHCGRGGCSGPA

SEQ ID NO: 1452136 - protein, 14 aa, Mycobacterium tuberculosis
TSQAQLDDDPHRSA

SEQ ID NO: 1452137 - protein, 7 aa, Mycobacterium tuberculosis
TSQPRTL

SEQ ID NO: 1452138 - protein, 14 aa, Mycobacterium tuberculosis
TSRGRRARGGFQHP

SEQ ID NO: 1452139 - protein, 7 aa, Mycobacterium tuberculosis
TSRPPAD

SEQ ID NO: 1452140 - protein, 12 aa, Mycobacterium tuberculosis
TSRRAKPISSSR

SEQ ID NO: 1452141 - protein, 4 aa, Mycobacterium tuberculosis
TSRY

SEQ ID NO: 1452142 - protein, 8 aa, Mycobacterium tuberculosis
TSSAPAVN

SEQ ID NO: 1452143 - protein, 9 aa, Mycobacterium tuberculosis
TSSAVSSEL

SEQ ID NO: 1452144 - protein, 7 aa, Mycobacterium tuberculosis
TSSDERA

SEQ ID NO: 1452145 - protein, 19 aa, Mycobacterium tuberculosis
TSSMGRPTSSWPPATGPGW

SEQ ID NO: 1452146 - protein, 7 aa, Mycobacterium tuberculosis
TSSSAIP

SEQ ID NO: 1452147 - protein, 12 aa, Mycobacterium tuberculosis
TSSTCSRPSTSV

SEQ ID NO: 1452148 - protein, 14 aa, Mycobacterium tuberculosis
TSSVGGAGGAGGHA

SEQ ID NO: 1452149 - protein, 5 aa, Mycobacterium tuberculosis
TSSYG

SEQ ID NO: 1452150 - protein, 16 aa, Mycobacterium tuberculosis
TSTATGREAGSSAGVP

SEQ ID NO: 1452151 - protein, 5 aa, Mycobacterium tuberculosis
TSTDA

SEQ ID NO: 1452152 - protein, 14 aa, Mycobacterium tuberculosis
TSTPLTGHRSPCRP

SEQ ID NO: 1452153 - protein, 6 aa, Mycobacterium tuberculosis
TSTSMS

SEQ ID NO: 1452154 - protein, 4 aa, Mycobacterium tuberculosis
TSVP

SEQ ID NO: 1452155 - protein, 8 aa, Mycobacterium tuberculosis
TSVPPACG

SEQ ID NO: 1452156 - protein, 7 aa, Mycobacterium tuberculosis
TSVPPDI

SEQ ID NO: 1452157 - protein, 13 aa, Mycobacterium tuberculosis
TTAAQPDAAGRQH

SEQ ID NO: 1452158 - protein, 8 aa, Mycobacterium tuberculosis
TTAAQQTL

SEQ ID NO: 1452159 - protein, 38 aa, Mycobacterium tuberculosis
TTAGLTGGTGGSAGLIGNGGNGGAGGAGANGGAGGNGG

SEQ ID NO: 1452160 - protein, 9 aa, Mycobacterium tuberculosis
TTALTTPSG

SEQ ID NO: 1452161 - protein, 10 aa, Mycobacterium tuberculosis
TTAPSAAPNI

SEQ ID NO: 1452162 - protein, 16 aa, Mycobacterium tuberculosis
TTARASGLGAGIGMRQ

SEQ ID NO: 1452163 - protein, 10 aa, Mycobacterium tuberculosis
TTASKNPKEH

SEQ ID NO: 1452164 - protein, 8 aa, Mycobacterium tuberculosis
TTATLNDG

SEQ ID NO: 1452165 - protein, 13 aa, Mycobacterium tuberculosis
TTATQSYCQALPP

SEQ ID NO: 1452166 - protein, 5 aa, Mycobacterium tuberculosis
TTCGR

SEQ ID NO: 1452167 - protein, 17 aa, Mycobacterium tuberculosis
TTCPGGGDPTDANTHVP

SEQ ID NO: 1452168 - protein, 6 aa, Mycobacterium tuberculosis
TTDDGS

SEQ ID NO: 1452169 - protein, 19 aa, Mycobacterium tuberculosis
TTDEGSHTEYRPASIRPWY

SEQ ID NO: 1452170 - protein, 12 aa, Mycobacterium tuberculosis
TTDKASGIVNDP

SEQ ID NO: 1452171 - protein, 10 aa, Mycobacterium tuberculosis
TTEAIGETQI

SEQ ID NO: 1452172 - protein, 7 aa, Mycobacterium tuberculosis
TTEIRST

SEQ ID NO: 1452173 - protein, 4 aa, Mycobacterium tuberculosis
TTET

SEQ ID NO: 1452174 - protein, 25 aa, Mycobacterium tuberculosis
TTGCGDERIAEQSSVLPNASAECSC

SEQ ID NO: 1452175 - protein, 5 aa, Mycobacterium tuberculosis
TTGDV

SEQ ID NO: 1452176 - protein, 17 aa, Mycobacterium tuberculosis
TTGGGAYAAAEAAAETP

SEQ ID NO: 1452177 - protein, 6 aa, Mycobacterium tuberculosis
TTGGGR

SEQ ID NO: 1452178 - protein, 5 aa, Mycobacterium tuberculosis
TTGKV

SEQ ID NO: 1452179 - protein, 40 aa, Mycobacterium tuberculosis
TTGLPRNIPTRPGSTTAGRHCAGRRKRRRTGGDPSRIAVA

SEQ ID NO: 1452180 - protein, 24 aa, Mycobacterium tuberculosis
TTGPIAGSAKAYREIEAPGSGAPL

SEQ ID NO: 1452181 - protein, 24 aa, Mycobacterium tuberculosis
TTGPIAGSAKAYREIEAPGSGATL

SEQ ID NO: 1452182 - protein, 17 aa, Mycobacterium tuberculosis
TTGPRPPQGNQPPASRI

SEQ ID NO: 1452183 - protein, 14 aa, Mycobacterium tuberculosis
TTGRAGGNRPPHRA

SEQ ID NO: 1452184 - protein, 10 aa, Mycobacterium tuberculosis
TTGRTGTGAA

SEQ ID NO: 1452185 - protein, 4 aa, Mycobacterium tuberculosis
TTGS

SEQ ID NO: 1452186 - protein, 7 aa, Mycobacterium tuberculosis
TTGSSGG

SEQ ID NO: 1452187 - protein, 10 aa, Mycobacterium tuberculosis
TTGYISPRSA

SEQ ID NO: 1452188 - protein, 25 aa, Mycobacterium tuberculosis
TTHATVDPSGGTVTPLTPGSHAAGA

SEQ ID NO: 1452189 - protein, 14 aa, Mycobacterium tuberculosis
TTKIEDKDGNPVDP

SEQ ID NO: 1452190 - protein, 36 aa, Mycobacterium tuberculosis
TTKKYSEGAAAGTEDAERAPVEADAGGGQKVLVRNV

SEQ ID NO: 1452191 - protein, 25 aa, Mycobacterium tuberculosis
TTKRHPDPQRTAPAPALQVSVSAVG

SEQ ID NO: 1452192 - protein, 4 aa, Mycobacterium tuberculosis
TTKV

SEQ ID NO: 1452193 - protein, 4 aa, Mycobacterium tuberculosis
TTLA

SEQ ID NO: 1452194 - protein, 14 aa, Mycobacterium tuberculosis
TTLDASPGTTWRLR

SEQ ID NO: 1452195 - protein, 9 aa, Mycobacterium tuberculosis
TTLGPGATV

SEQ ID NO: 1452196 - protein, 17 aa, Mycobacterium tuberculosis
TTMQSAQRDEKGVGRLG

SEQ ID NO: 1452197 - protein, 25 aa, Mycobacterium tuberculosis
TTNKRYPLTPPGPAAPIRTTHVPRP

SEQ ID NO: 1452198 - protein, 9 aa, Mycobacterium tuberculosis
TTPAAAHPF

SEQ ID NO: 1452199 - protein, 9 aa, Mycobacterium tuberculosis
TTPAASPTV

SEQ ID NO: 1452200 - protein, 13 aa, Mycobacterium tuberculosis
TTPATPNPRGSRD

SEQ ID NO: 1452201 - protein, 20 aa, Mycobacterium tuberculosis
TTPDARQAAVEAAGQARDDA

SEQ ID NO: 1452202 - protein, 8 aa, Mycobacterium tuberculosis
TTPDQADV

SEQ ID NO: 1452203 - protein, 16 aa, Mycobacterium tuberculosis
TTPIDGGAISASAAML

SEQ ID NO: 1452204 - protein, 17 aa, Mycobacterium tuberculosis
TTPIGDGNAVHQGSNGF

SEQ ID NO: 1452205 - protein, 4 aa, Mycobacterium tuberculosis
TTPL

SEQ ID NO: 1452206 - protein, 5 aa, Mycobacterium tuberculosis
TTPNS

SEQ ID NO: 1452207 - protein, 31 aa, Mycobacterium tuberculosis
TTPPITTPPLTKRAHQRNPVHPPHNQRATRL

SEQ ID NO: 1452208 - protein, 107 aa, Mycobacterium tuberculosis
TTPPTTPVTTPPTTPPTTPVTTPPTTVAPTTVAPTTVAPTTVAPTTVAPATATPTTVAPQPTQQPTQQPTQQMPTQQQTVAPQTVAPAPQPPSGGRNGSGGGDLFGG

SEQ ID NO: 1452209 - protein, 9 aa, Mycobacterium tuberculosis
TTPRRQPPV

SEQ ID NO: 1452210 - protein, 10 aa, Mycobacterium tuberculosis
TTPSLATTPC

SEQ ID NO: 1452211 - protein, 9 aa, Mycobacterium tuberculosis
TTPTAGGYT

SEQ ID NO: 1452212 - protein, 26 aa, Mycobacterium tuberculosis
TTPTNGRQTHGRQTQNPERGRKPAKY

SEQ ID NO: 1452213 - protein, 11 aa, Mycobacterium tuberculosis
TTQRDGTVVGT

SEQ ID NO: 1452214 - protein, 16 aa, Mycobacterium tuberculosis
TTRGAPARHGDRKPAT

SEQ ID NO: 1452215 - protein, 27 aa, Mycobacterium tuberculosis
TTRPGHHKETSRQHLGSATSRRSATRP

SEQ ID NO: 1452216 - protein, 5 aa, Mycobacterium tuberculosis
TTRRR

SEQ ID NO: 1452217 - protein, 16 aa, Mycobacterium tuberculosis
TTRSSWPAGRRAAAPR

SEQ ID NO: 1452218 - protein, 9 aa, Mycobacterium tuberculosis
TTSAEQDLG

SEQ ID NO: 1452219 - protein, 8 aa, Mycobacterium tuberculosis
TTSAESGV

SEQ ID NO: 1452220 - protein, 7 aa, Mycobacterium tuberculosis
TTSFGPK

SEQ ID NO: 1452221 - protein, 6 aa, Mycobacterium tuberculosis
TTSGYP

SEQ ID NO: 1452222 - protein, 9 aa, Mycobacterium tuberculosis
TTTDSAEGV

SEQ ID NO: 1452223 - protein, 6 aa, Mycobacterium tuberculosis
TTTGRA

SEQ ID NO: 1452224 - protein, 13 aa, Mycobacterium tuberculosis
TTTPFTPTGPPRC

SEQ ID NO: 1452225 - protein, 27 aa, Mycobacterium tuberculosis
TTTRIGRPLPTGSPITVGGPDPNVRPT

SEQ ID NO: 1452226 - protein, 8 aa, Mycobacterium tuberculosis
TTVATAPP

SEQ ID NO: 1452227 - protein, 44 aa, Mycobacterium tuberculosis; identical to SEQ ID NO: 231653

SEQ ID NO: 1452228 - protein, 16 aa, Mycobacterium tuberculosis
TTVSAGSCRRSRPSRC

SEQ ID NO: 1452229 - protein, 18 aa, Mycobacterium tuberculosis
TTVSERAGQPGHGQQNPA

SEQ ID NO: 1452230 - protein, 6 aa, Mycobacterium tuberculosis
TTYSTT

SEQ ID NO: 1452231 - protein, 27 aa, Mycobacterium tuberculosis
TVAAGTAGPAIAGVGPTRAAGPTGPAV

SEQ ID NO: 1452232 - protein, 4 aa, Mycobacterium tuberculosis
TVAG

SEQ ID NO: 1452233 - protein, 24 aa, Mycobacterium tuberculosis
TVAGAETGAGIGGGGSRGSAEAFP

SEQ ID NO: 1452234 - protein, 19 aa, Mycobacterium tuberculosis
TVAGAGSARGGNRRCGAGY

SEQ ID NO: 1452235 - protein, 24 aa, Mycobacterium tuberculosis
TVAPAPQPPSGGRNGSGGGDLFGG

SEQ ID NO: 1452236 - protein, 4 aa, Mycobacterium tuberculosis
TVAQ

SEQ ID NO: 1452237 - protein, 13 aa, Mycobacterium tuberculosis
TVASAAGPGPAAV

SEQ ID NO: 1452238 - protein, 4 aa, Mycobacterium tuberculosis
TVDP

SEQ ID NO: 1452239 - protein, 20 aa, Mycobacterium tuberculosis
TVGAPGWPGSDSSDHHAAPT

SEQ ID NO: 1452240 - protein, 7 aa, Mycobacterium tuberculosis
TVGARGS

SEQ ID NO: 1452241 - protein, 7 aa, Mycobacterium tuberculosis
TVGDGAD

SEQ ID NO: 1452242 - protein, 20 aa, Mycobacterium tuberculosis
TVGPEGLGADGQAGAAGVNP

SEQ ID NO: 1452243 - protein, 9 aa, Mycobacterium tuberculosis
TVGPRQGRG

SEQ ID NO: 1452244 - protein, 5 aa, Mycobacterium tuberculosis
TVGPT

SEQ ID NO: 1452245 - protein, 4 aa, Mycobacterium tuberculosis
TVGR

SEQ ID NO: 1452246 - protein, 9 aa, Mycobacterium tuberculosis
TVGSAGGCT

SEQ ID NO: 1452247 - protein, 7 aa, Mycobacterium tuberculosis
TVGSGDA

SEQ ID NO: 1452248 - protein, 7 aa, Mycobacterium tuberculosis
TVIRPGE

SEQ ID NO: 1452249 - protein, 38 aa, Mycobacterium tuberculosis
TVPAGQGSMGNNGEPGGPGQPGTEFGQTGGTGGTGGTG

SEQ ID NO: 1452250 - protein, 18 aa, Mycobacterium tuberculosis
TVPAQPGYRGLVGGAQCR

SEQ ID NO: 1452251 - protein, 9 aa, Mycobacterium tuberculosis
TVPFGQPAA

SEQ ID NO: 1452252 - protein, 14 aa, Mycobacterium tuberculosis
TVPQTPRTSGPGGG

SEQ ID NO: 1452253 - protein, 9 aa, Mycobacterium tuberculosis
TVPSGTGPE

SEQ ID NO: 1452254 - protein, 14 aa, Mycobacterium tuberculosis
TVQASDSLTGAEET

SEQ ID NO: 1452255 - protein, 16 aa, Mycobacterium tuberculosis
TVQDSSPVAGQLGRPI

SEQ ID NO: 1452256 - protein, 12 aa, Mycobacterium tuberculosis
TVRSRSEHGRIG

SEQ ID NO: 1452257 - protein, 12 aa, Mycobacterium tuberculosis
TVSAGEDSPAGC

SEQ ID NO: 1452258 - protein, 16 aa, Mycobacterium tuberculosis
TVSASERLAVAAMGRA

SEQ ID NO: 1452259 - protein, 5 aa, Mycobacterium tuberculosis
TVSGH

SEQ ID NO: 1452260 - protein, 7 aa, Mycobacterium tuberculosis
TVTAADT

SEQ ID NO: 1452261 - protein, 5 aa, Mycobacterium tuberculosis
TVTPA

SEQ ID NO: 1452262 - protein, 12 aa, Mycobacterium tuberculosis
TVTSEANRARRV

SEQ ID NO: 1452263 - protein, 23 aa, Mycobacterium tuberculosis
TVTSTARAAITANATAPARPGSA

SEQ ID NO: 1452264 - protein, 4 aa, Mycobacterium tuberculosis
TVYR

SEQ ID NO: 1452265 - protein, 9 aa, Mycobacterium tuberculosis
TWAPTTPVA

SEQ ID NO: 1452266 - protein, 17 aa, Mycobacterium tuberculosis
TWGPTTPDMSSSSGSSS

SEQ ID NO: 1452267 - protein, 12 aa, Mycobacterium tuberculosis
TWPGGAGRTSRS

SEQ ID NO: 1452268 - protein, 6 aa, Mycobacterium tuberculosis
TWPGGR

SEQ ID NO: 1452269 - protein, 8 aa, Mycobacterium tuberculosis
TYDGAGTN

SEQ ID NO: 1452270 - protein, 15 aa, Mycobacterium tuberculosis
TYEPSRTSLATGPPA

SEQ ID NO: 1452271 - protein, 4 aa, Mycobacterium tuberculosis
TYGR

SEQ ID NO: 1452272 - protein, 5 aa, Mycobacterium tuberculosis
TYGTN

SEQ ID NO: 1452273 - protein, 4 aa, Mycobacterium tuberculosis
TYPG

SEQ ID NO: 1452274 - protein, 17 aa, Mycobacterium tuberculosis
TYREDSKATNPHAAQPS

SEQ ID NO: 1452275 - protein, 6 aa, Mycobacterium tuberculosis
TYSPPY

SEQ ID NO: 1452276 - protein, 10 aa, Mycobacterium tuberculosis
TYSPTPVPAA

SEQ ID NO: 1452277 - protein, 25 aa, Mycobacterium tuberculosis
TYTPGDSLRRTVDSTAPTSSVQPRA

SEQ ID NO: 1452278 - protein, 5 aa, Mycobacterium tuberculosis
TYTTQ

SEQ ID NO: 1452279 - protein, 11 aa, Mycobacterium tuberculosis
VAAAAGQSWED

SEQ ID NO: 1452280 - protein, 34 aa, Mycobacterium tuberculosis
VAAAGRGGAAGTVCTRGGSGAADPTSTTDAAATA

SEQ ID NO: 1452281 - protein, 13 aa, Mycobacterium tuberculosis
VAAAGSDRQPPID

SEQ ID NO: 1452282 - protein, 8 aa, Mycobacterium tuberculosis
VAAAPTTE

SEQ ID NO: 1452283 - protein, 8 aa, Mycobacterium tuberculosis
VAAEGVAG

SEQ ID NO: 1452284 - protein, 10 aa, Mycobacterium tuberculosis
VAAGGCGGRV

SEQ ID NO: 1452285 - protein, 9 aa, Mycobacterium tuberculosis
VAAGPTVPA

SEQ ID NO: 1452286 - protein, 10 aa, Mycobacterium tuberculosis
VAAGRRQRDH

SEQ ID NO: 1452287 - protein, 27 aa, Mycobacterium tuberculosis
VAAPPAPPAPPAPNSMADPPAPPAPPI

SEQ ID NO: 1452288 - protein, 17 aa, Mycobacterium tuberculosis
VAARAGRARHRVGTCTT

SEQ ID NO: 1452289 - protein, 13 aa, Mycobacterium tuberculosis
VAATPSTPPAPQI

SEQ ID NO: 1452290 - protein, 11 aa, Mycobacterium tuberculosis
VADAVGGNGYS

SEQ ID NO: 1452291 - protein, 4 aa, Mycobacterium tuberculosis
VADD

SEQ ID NO: 1452292 - protein, 8 aa, Mycobacterium tuberculosis
VADDRAGR

SEQ ID NO: 1452293 - protein, 10 aa, Mycobacterium tuberculosis
VADPAGPNYW

SEQ ID NO: 1452294 - protein, 14 aa, Mycobacterium tuberculosis
VADPPDVPTGPRGT

SEQ ID NO: 1452295 - protein, 23 aa, Mycobacterium tuberculosis
VAEEPDRPRQGRRGGLPDDGALP

SEQ ID NO: 1452296 - protein, 7 aa, Mycobacterium tuberculosis
VAEEPTR

SEQ ID NO: 1452297 - protein, 10 aa, Mycobacterium tuberculosis
VAEPAQTGQA

SEQ ID NO: 1452298 - protein, 22 aa, Mycobacterium tuberculosis
VAEPGPDAPALTGDRSARSAIP

SEQ ID NO: 1452299 - protein, 9 aa, Mycobacterium tuberculosis
VAEPPTRGR

SEQ ID NO: 1452300 - protein, 7 aa, Mycobacterium tuberculosis
VAERNDE

SEQ ID NO: 1452301 - protein, 5 aa, Mycobacterium tuberculosis
VAESG

SEQ ID NO: 1452302 - protein, 26 aa, Mycobacterium tuberculosis
VAGAAGPSVTAPRARRRRPSRPEPRL

SEQ ID NO: 1452303 - protein, 10 aa, Mycobacterium tuberculosis
VAGADATSTV

SEQ ID NO: 1452304 - protein, 12 aa, Mycobacterium tuberculosis
VAGAGGAVAGAA

SEQ ID NO: 1452305 - protein, 21 aa, Mycobacterium tuberculosis
VAGAGQSGRTLSGHGAVFRRQ

SEQ ID NO: 1452306 - protein, 9 aa, Mycobacterium tuberculosis
VAGDDQPVV

SEQ ID NO: 1452307 - protein, 14 aa, Mycobacterium tuberculosis
VAGDDTARVCAQLR

SEQ ID NO: 1452308 - protein, 7 aa, Mycobacterium tuberculosis
VAGEPDA

SEQ ID NO: 1452309 - protein, 9 aa, Mycobacterium tuberculosis
VAGEPDADV

SEQ ID NO: 1452310 - protein, 17 aa, Mycobacterium tuberculosis
VAGGGCGRRAARGRGDR

SEQ ID NO: 1452311 - protein, 9 aa, Mycobacterium tuberculosis
VAGGRQDHP

SEQ ID NO: 1452312 - protein, 7 aa, Mycobacterium tuberculosis
VAGNPSL

SEQ ID NO: 1452313 - protein, 15 aa, Mycobacterium tuberculosis
VAGPAATAGGCSATA

SEQ ID NO: 1452314 - protein, 17 aa, Mycobacterium tuberculosis
VAGPATAKALEPTCAPP

SEQ ID NO: 1452315 - protein, 10 aa, Mycobacterium tuberculosis
VAGPTDPYGV

SEQ ID NO: 1452316 - protein, 61 aa, Mycobacterium tuberculosis
VAGQGEPDRDVDRDTRRGHAGSPRRIPHDDQSPQWRDGGHHDRRPRGGHRQRADQDGRACS

SEQ ID NO: 1452317 - protein, 8 aa, Mycobacterium tuberculosis
VAGQRGRD

SEQ ID NO: 1452318 - protein, 8 aa, Mycobacterium tuberculosis
VAGRKEEF

SEQ ID NO: 1452319 - protein, 14 aa, Mycobacterium tuberculosis
VAGRRDDGYPGGAG

SEQ ID NO: 1452320 - protein, 22 aa, Mycobacterium tuberculosis
VAGSDGRRGPGGARRRCGEYAA

SEQ ID NO: 1452321 - protein, 93 aa, Mycobacterium tuberculosis
VAGSSPTTAGESGTSGQNGGAGGAGGAGGRGGDFGGDGGTGGAGGNGADGGAGGNGANGANATTPGAKGGDGGHGGPGAQGGNGGQGGPGGLA

SEQ ID NO: 1452322 - protein, 8 aa, Mycobacterium tuberculosis
VAHSSKRA

SEQ ID NO: 1452323 - protein, 8 aa, Mycobacterium tuberculosis
VAPAGPEF

SEQ ID NO: 1452324 - protein, 15 aa, Mycobacterium tuberculosis
VAPDGSRTEEPRPDD

SEQ ID NO: 1452325 - protein, 18 aa, Mycobacterium tuberculosis
VAPDSGGGSVASTAHGAG

SEQ ID NO: 1452326 - protein, 15 aa, Mycobacterium tuberculosis
VAPGSVRRADPRPRC

SEQ ID NO: 1452327 - protein, 14 aa, Mycobacterium tuberculosis
VAPKSTALVVWKPR

SEQ ID NO: 1452328 - protein, 52 aa, Mycobacterium tuberculosis
VAPPAPPAPAAPPVPPAPPAKPAPVGLSAPDPPAPPVPPLPPAPPAPPEPLV

SEQ ID NO: 1452329 - protein, 10 aa, Mycobacterium tuberculosis
VAPPPPLPPL

SEQ ID NO: 1452330 - protein, 38 aa, Mycobacterium tuberculosis
VAPPPPPPEDAGAMAPSNGPPDPQSEDEPAVPPPPAGR

SEQ ID NO: 1452331 - protein, 42 aa, Mycobacterium tuberculosis; identical to SEQ ID NO: 154783

SEQ ID NO: 1452332 - protein, 14 aa, Mycobacterium tuberculosis
VAPREGVDRPGTRL

SEQ ID NO: 1452333 - protein, 41 aa, Mycobacterium tuberculosis
VAPRRPRLQPPRPEPAEPARLPPGPPPSRRPRSPRRPPGQP

SEQ ID NO: 1452334 - protein, 12 aa, Mycobacterium tuberculosis
VAPSRRSTTSVG

SEQ ID NO: 1452335 - protein, 6 aa, Mycobacterium tuberculosis
VAPSTV

SEQ ID NO: 1452336 - protein, 9 aa, Mycobacterium tuberculosis
VAPTDAGRA

SEQ ID NO: 1452337 - protein, 4 aa, Mycobacterium tuberculosis
VAQG

SEQ ID NO: 1452338 - protein, 5 aa, Mycobacterium tuberculosis
VAQGG

SEQ ID NO: 1452339 - protein, 10 aa, Mycobacterium tuberculosis
VAQRSGTTTY

SEQ ID NO: 1452340 - protein, 8 aa, Mycobacterium tuberculosis
VAQTRNGD

SEQ ID NO: 1452341 - protein, 5 aa, Mycobacterium tuberculosis
VAQTV

SEQ ID NO: 1452342 - protein, 8 aa, Mycobacterium tuberculosis
VARESRDA

SEQ ID NO: 1452343 - protein, 4 aa, Mycobacterium tuberculosis
VARG

SEQ ID NO: 1452344 - protein, 18 aa, Mycobacterium tuberculosis
VARGAGDRAARWGRGVVV

SEQ ID NO: 1452345 - protein, 13 aa, Mycobacterium tuberculosis
VARGGARGLAGPA

SEQ ID NO: 1452346 - protein, 28 aa, Mycobacterium tuberculosis
VARKTQKSQTEAPREPAPVSDEKQTDVA

SEQ ID NO: 1452347 - protein, 11 aa, Mycobacterium tuberculosis
VARSGGPAVKR

SEQ ID NO: 1452348 - protein, 9 aa, Mycobacterium tuberculosis
VARTPAIRP

SEQ ID NO: 1452349 - protein, 11 aa, Mycobacterium tuberculosis
VASGDRRPRPA

SEQ ID NO: 1452350 - protein, 12 aa, Mycobacterium tuberculosis
VASRSERSKCHR

SEQ ID NO: 1452351 - protein, 20 aa, Mycobacterium tuberculosis
VASTSRGNSSGSVASSSSDI

SEQ ID NO: 1452352 - protein, 4 aa, Mycobacterium tuberculosis
VATA

SEQ ID NO: 1452353 - protein, 12 aa, Mycobacterium tuberculosis
VATAGRPAGCPA

SEQ ID NO: 1452354 - protein, 8 aa, Mycobacterium tuberculosis
VATDEQLE

SEQ ID NO: 1452355 - protein, 25 aa, Mycobacterium tuberculosis
VATEPAARPARATGTAGTSGAAGAT

SEQ ID NO: 1452356 - protein, 12 aa, Mycobacterium tuberculosis
VATGDRQGAGHA

SEQ ID NO: 1452357 - protein, 29 aa, Mycobacterium tuberculosis
VATQPAWGTGEQAAQPLNGSTSRFAMSES

SEQ ID NO: 1452358 - protein, 12 aa, Mycobacterium tuberculosis
VAVPGRRDDLGG

SEQ ID NO: 1452359 - protein, 6 aa, Mycobacterium tuberculosis
VCGGGG

SEQ ID NO: 1452360 - protein, 6 aa, Mycobacterium tuberculosis
VDADEV

SEQ ID NO: 1452361 - protein, 16 aa, Mycobacterium tuberculosis
VDAGARPGDQRPKNPL

SEQ ID NO: 1452362 - protein, 15 aa, Mycobacterium tuberculosis
VDAGARPGTTTEDPL

SEQ ID NO: 1452363 - protein, 27 aa, Mycobacterium tuberculosis
VDAGARPGTTTEESAELKPLAAGQRRI

SEQ ID NO: 1452364 - protein, 14 aa, Mycobacterium tuberculosis
VDAGARPRDHDRRI

SEQ ID NO: 1452365 - protein, 8 aa, Mycobacterium tuberculosis
VDAGDATC

SEQ ID NO: 1452366 - protein, 21 aa, Mycobacterium tuberculosis
VDAGSGAGGGGGGAGGTGGTA

SEQ ID NO: 1452367 - protein, 23 aa, Mycobacterium tuberculosis
VDASGYEPHDQQPQQQQQQQQQG

SEQ ID NO: 1452368 - protein, 10 aa, Mycobacterium tuberculosis
VDDAESAAPD

SEQ ID NO: 1452369 - protein, 9 aa, Mycobacterium tuberculosis
VDDPGAERA

SEQ ID NO: 1452370 - protein, 7 aa, Mycobacterium tuberculosis
VDDPGQL

SEQ ID NO: 1452371 - protein, 6 aa, Mycobacterium tuberculosis
VDDPGY

SEQ ID NO: 1452372 - protein, 18 aa, Mycobacterium tuberculosis
VDDRHDQRTITCDWTAAQ

SEQ ID NO: 1452373 - protein, 15 aa, Mycobacterium tuberculosis
VDDRQAVMSFVKPSA

SEQ ID NO: 1452374 - protein, 10 aa, Mycobacterium tuberculosis
VDEGPRESSL

SEQ ID NO: 1452375 - protein, 7 aa, Mycobacterium tuberculosis
VDEPTSA

SEQ ID NO: 1452376 - protein, 6 aa, Mycobacterium tuberculosis
VDEQTT

SEQ ID NO: 1452377 - protein, 45 aa, Mycobacterium tuberculosis
VDESAGAAVPPAPPLTPTAPDPPAPPLPINQPPSPPLAPVPGAPL

SEQ ID NO: 1452378 - protein, 10 aa, Mycobacterium tuberculosis
VDESTTRTAI

SEQ ID NO: 1452379 - protein, 5 aa, Mycobacterium tuberculosis
VDGMP

SEQ ID NO: 1452380 - protein, 10 aa, Mycobacterium tuberculosis
VDGRQTDGGY

SEQ ID NO: 1452381 - protein, 4 aa, Mycobacterium tuberculosis
VDPA

SEQ ID NO: 1452382 - protein, 11 aa, Mycobacterium tuberculosis
VDPATLAESQT

SEQ ID NO: 1452383 - protein, 4 aa, Mycobacterium tuberculosis
VDPC

SEQ ID NO: 1452384 - protein, 12 aa, Mycobacterium tuberculosis
VDPDGPVSVQPN

SEQ ID NO: 1452385 - protein, 7 aa, Mycobacterium tuberculosis
VDPEAGR

SEQ ID NO: 1452386 - protein, 6 aa, Mycobacterium tuberculosis
VDPEDI

SEQ ID NO: 1452387 - protein, 12 aa, Mycobacterium tuberculosis
VDPGAASRTTPV

SEQ ID NO: 1452388 - protein, 9 aa, Mycobacterium tuberculosis
VDPPPGFGY

SEQ ID NO: 1452389 - protein, 8 aa, Mycobacterium tuberculosis
VDPQRGRL

SEQ ID NO: 1452390 - protein, 31 aa, Mycobacterium tuberculosis
VDPRDTRADVEHTRAQRADIQHPRSRPRQRA

SEQ ID NO: 1452391 - protein, 5 aa, Mycobacterium tuberculosis
VDPRE

SEQ ID NO: 1452392 - protein, 10 aa, Mycobacterium tuberculosis
VDPRQPRTEV

SEQ ID NO: 1452393 - protein, 12 aa, Mycobacterium tuberculosis
VDPSGLAAYGRG

SEQ ID NO: 1452394 - protein, 28 aa, Mycobacterium tuberculosis
VDQDRADSDAGAEVQRDAVDRDRRGAEA

SEQ ID NO: 1452395 - protein, 15 aa, Mycobacterium tuberculosis
VDRATGHVDHPRLGW

SEQ ID NO: 1452396 - protein, 6 aa, Mycobacterium tuberculosis
VDRDDS

SEQ ID NO: 1452397 - protein, 10 aa, Mycobacterium tuberculosis
VDRGAGGSAY

SEQ ID NO: 1452398 - protein, 24 aa, Mycobacterium tuberculosis
VDRGARRARLSANSVGGDLVLARA

SEQ ID NO: 1452399 - protein, 18 aa, Mycobacterium tuberculosis
VDRGPPARIAAAGSRRRG

SEQ ID NO: 1452400 - protein, 8 aa, Mycobacterium tuberculosis
VDRRAGPY

SEQ ID NO: 1452401 - protein, 7 aa, Mycobacterium tuberculosis
VDRTAPG

SEQ ID NO: 1452402 - protein, 7 aa, Mycobacterium tuberculosis
VDSGDYD

SEQ ID NO: 1452403 - protein, 5 aa, Mycobacterium tuberculosis
VDSGH

SEQ ID NO: 1452404 - protein, 17 aa, Mycobacterium tuberculosis
VDSGNVGHGNIGDSNVG

SEQ ID NO: 1452405 - protein, 11 aa, Mycobacterium tuberculosis
VDSRDDEASLT

SEQ ID NO: 1452406 - protein, 12 aa, Mycobacterium tuberculosis
VDSSDHDGEEHA

SEQ ID NO: 1452407 - protein, 12 aa, Mycobacterium tuberculosis
VDTHAGGRPADQ

SEQ ID NO: 1452408 - protein, 28 aa, Mycobacterium tuberculosis
VDTNTSVSPAPSVPDSTTTSVSTGPPEV

SEQ ID NO: 1452409 - protein, 5 aa, Mycobacterium tuberculosis
VDTRG

SEQ ID NO: 1452410 - protein, 8 aa, Mycobacterium tuberculosis
VEAKGEHQ

SEQ ID NO: 1452411 - protein, 6 aa, Mycobacterium tuberculosis
VEATGV

SEQ ID NO: 1452412 - protein, 12 aa, Mycobacterium tuberculosis
VEDDASGYTRFY

SEQ ID NO: 1452413 - protein, 6 aa, Mycobacterium tuberculosis
VEEGRG

SEQ ID NO: 1452414 - protein, 21 aa, Mycobacterium tuberculosis
VEETRRRSGGRVAKARGRRDI

SEQ ID NO: 1452415 - protein, 20 aa, Mycobacterium tuberculosis
VEGESESRHGLARRVVAWLG

SEQ ID NO: 1452416 - protein, 11 aa, Mycobacterium tuberculosis
VEGPDRKPTVP

SEQ ID NO: 1452417 - protein, 8 aa, Mycobacterium tuberculosis
VEHRDRQQ

SEQ ID NO: 1452418 - protein, 29 aa, Mycobacterium tuberculosis
VEPAASARSNSHRANRTTARRRLGRRQLV

SEQ ID NO: 1452419 - protein, 16 aa, Mycobacterium tuberculosis
VEPAGVDGARVEPPGV

SEQ ID NO: 1452420 - protein, 7 aa, Mycobacterium tuberculosis
VEPATGA

SEQ ID NO: 1452421 - protein, 16 aa, Mycobacterium tuberculosis
VEPDPRVSGVPSTKGA

SEQ ID NO: 1452422 - protein, 34 aa, Mycobacterium tuberculosis
VEPDRESAGQLGGRYRSRRPHRCGASGSRRRRRP

SEQ ID NO: 1452423 - protein, 6 aa, Mycobacterium tuberculosis
VEPEAM

SEQ ID NO: 1452424 - protein, 9 aa, Mycobacterium tuberculosis
VEPPKGPAW

SEQ ID NO: 1452425 - protein, 6 aa, Mycobacterium tuberculosis
VEPPSA

SEQ ID NO: 1452426 - protein, 11 aa, Mycobacterium tuberculosis
VEPRTRNIPRP

SEQ ID NO: 1452427 - protein, 23 aa, Mycobacterium tuberculosis
VEQAADQHADGPGLPGRCKHSGS

SEQ ID NO: 1452428 - protein, 14 aa, Mycobacterium tuberculosis
VEQPEVAGPGVEEP

SEQ ID NO: 1452429 - protein, 5 aa, Mycobacterium tuberculosis
VERAG

SEQ ID NO: 1452430 - protein, 17 aa, Mycobacterium tuberculosis
VERGGGRGGGRGVAGSQ

SEQ ID NO: 1452431 - protein, 8 aa, Mycobacterium tuberculosis
VERPSSGY

SEQ ID NO: 1452432 - protein, 9 aa, Mycobacterium tuberculosis
VERRSDGTR

SEQ ID NO: 1452433 - protein, 14 aa, Mycobacterium tuberculosis
VERSGDRSAPYAAP

SEQ ID NO: 1452434 - protein, 5 aa, Mycobacterium tuberculosis
VESQY

SEQ ID NO: 1452435 - protein, 8 aa, Mycobacterium tuberculosis
VESRPGWA

SEQ ID NO: 1452436 - protein, 28 aa, Mycobacterium tuberculosis
VETRDPNATLRPGSPSNPAAPGSVGNSW

SEQ ID NO: 1452437 - protein, 6 aa, Mycobacterium tuberculosis
VFPGGS

SEQ ID NO: 1452438 - protein, 6 aa, Mycobacterium tuberculosis
VGAAED

SEQ ID NO: 1452439 - protein, 6 aa, Mycobacterium tuberculosis
VGADPL

SEQ ID NO: 1452440 - protein, 11 aa, Mycobacterium tuberculosis
VGAGGQRAQRV

SEQ ID NO: 1452441 - protein, 28 aa, Mycobacterium tuberculosis
VGAGRGVGAVQTQQQPTDAADAGAARGI

SEQ ID NO: 1452442 - protein, 5 aa, Mycobacterium tuberculosis
VGANS

SEQ ID NO: 1452443 - protein, 43 aa, Mycobacterium tuberculosis
VGAPGQPGGAGGHGGAGGNGGAGGNGGQGVVSDGAGGAGGPAL

SEQ ID NO: 1452444 - protein, 16 aa, Mycobacterium tuberculosis
VGAPRRTGPIPRPAGS

SEQ ID NO: 1452445 - protein, 13 aa, Mycobacterium tuberculosis
VGASGATAGLRRT

SEQ ID NO: 1452446 - protein, 30 aa, Mycobacterium tuberculosis
VGASPGAGAAGGGGGAGGSLFGSPGTTGPH

SEQ ID NO: 1452447 - protein, 9 aa, Mycobacterium tuberculosis
VGASYGPGH

SEQ ID NO: 1452448 - protein, 13 aa, Mycobacterium tuberculosis
VGDDATITLFETG

SEQ ID NO: 1452449 - protein, 8 aa, Mycobacterium tuberculosis
VGDDKDKA

SEQ ID NO: 1452450 - protein, 14 aa, Mycobacterium tuberculosis
VGDDPAAVAANRAR

SEQ ID NO: 1452451 - protein, 17 aa, Mycobacterium tuberculosis
VGDQTAERFARQADRAD

SEQ ID NO: 1452452 - protein, 10 aa, Mycobacterium tuberculosis
VGDRPQRRLG

SEQ ID NO: 1452453 - protein, 9 aa, Mycobacterium tuberculosis
VGDSGGRRR

SEQ ID NO: 1452454 - protein, 31 aa, Mycobacterium tuberculosis
VGEGNVGNGNVGNHQSRLGQHRQRQHRQRQH

SEQ ID NO: 1452455 - protein, 9 aa, Mycobacterium tuberculosis
VGEGTRGVP

SEQ ID NO: 1452456 - protein, 7 aa, Mycobacterium tuberculosis
VGEPDLG

SEQ ID NO: 1452457 - protein, 15 aa, Mycobacterium tuberculosis
VGESESGSNRAPASQ

SEQ ID NO: 1452458 - protein, 21 aa, Mycobacterium tuberculosis
VGGAATDTGGNGGAGGSGTGL

SEQ ID NO: 1452459 - protein, 5 aa, Mycobacterium tuberculosis
VGGAD

SEQ ID NO: 1452460 - protein, 12 aa, Mycobacterium tuberculosis
VGGAGGAAGAVT

SEQ ID NO: 1452461 - protein, 22 aa, Mycobacterium tuberculosis
VGGAGGAGGNAAGLSGAGGAGG

SEQ ID NO: 1452462 - protein, 38 aa, Mycobacterium tuberculosis
VGGAGGAGGNAAGLSGAGGAGGAGGFGETAGDGGAGGN

SEQ ID NO: 1452463 - protein, 23 aa, Mycobacterium tuberculosis
VGGAPRPGSAGHTATSWGHEGAA

SEQ ID NO: 1452464 - protein, 19 aa, Mycobacterium tuberculosis
VGGASLTASLGEASSVGGL

SEQ ID NO: 1452465 - protein, 30 aa, Mycobacterium tuberculosis
VGGDGGNGGAGGAGGNGGKGGAGGAGGGAG

SEQ ID NO: 1452466 - protein, 7 aa, Mycobacterium tuberculosis
VGGEPGS

SEQ ID NO: 1452467 - protein, 11 aa, Mycobacterium tuberculosis
VGGGEAGEAAL

SEQ ID NO: 1452468 - protein, 12 aa, Mycobacterium tuberculosis
VGGGESPWRSLM

SEQ ID NO: 1452469 - protein, 16 aa, Mycobacterium tuberculosis
VGGGGTSAQLSTGGGG

SEQ ID NO: 1452470 - protein, 11 aa, Mycobacterium tuberculosis
VGGGPDAPGAG

SEQ ID NO: 1452471 - protein, 9 aa, Mycobacterium tuberculosis
VGGGTRRGA

SEQ ID NO: 1452472 - protein, 26 aa, Mycobacterium tuberculosis
VGGGVAGGQRGTLDHEPALGPDRHDD

SEQ ID NO: 1452473 - protein, 6 aa, Mycobacterium tuberculosis
VGGHGG

SEQ ID NO: 1452474 - protein, 8 aa, Mycobacterium tuberculosis
VGGHQIGG

SEQ ID NO: 1452475 - protein, 7 aa, Mycobacterium tuberculosis
VGGKPAR

SEQ ID NO: 1452476 - protein, 8 aa, Mycobacterium tuberculosis
VGGLTTAD

SEQ ID NO: 1452477 - protein, 11 aa, Mycobacterium tuberculosis
VGGPDGEGFNP

SEQ ID NO: 1452478 - protein, 10 aa, Mycobacterium tuberculosis
VGGPGGGQRA

SEQ ID NO: 1452479 - protein, 7 aa, Mycobacterium tuberculosis
VGGPGLG

SEQ ID NO: 1452480 - protein, 18 aa, Mycobacterium tuberculosis
VGGPPVEASAAALVTWRV

SEQ ID NO: 1452481 - protein, 44 aa, Mycobacterium tuberculosis
VGGPRRGWRGPPPKTGGIGGAGGLGVGAAGRRRRRRRSRRRRFG

SEQ ID NO: 1452482 - protein, 6 aa, Mycobacterium tuberculosis
VGGPSA

SEQ ID NO: 1452483 - protein, 15 aa, Mycobacterium tuberculosis
VGGQEEVDGWAVGGD

SEQ ID NO: 1452484 - protein, 21 aa, Mycobacterium tuberculosis
VGGRRAGKPGRRLIVLQLRSS

SEQ ID NO: 1452485 - protein, 38 aa, Mycobacterium tuberculosis
VGGRRGGPCSRRAGHAPRLSTRTGGSGRRHRSRPDAAG

SEQ ID NO: 1452486 - protein, 14 aa, Mycobacterium tuberculosis
VGGSRRPMSGADTG

SEQ ID NO: 1452487 - protein, 13 aa, Mycobacterium tuberculosis
VGKGGGPDNKVDA

SEQ ID NO: 1452488 - protein, 14 aa, Mycobacterium tuberculosis
VGKGGGPDNKVDAD

SEQ ID NO: 1452489 - protein, 10 aa, Mycobacterium tuberculosis
VGKTPSATAA

SEQ ID NO: 1452490 - protein, 19 aa, Mycobacterium tuberculosis
VGKTPSATAARPGRSLSGF

SEQ ID NO: 1452491 - protein, 7 aa, Mycobacterium tuberculosis
VGKTRLA

SEQ ID NO: 1452492 - protein, 11 aa, Mycobacterium tuberculosis
VGKVATGPSIQ

SEQ ID NO: 1452493 - protein, 36 aa, Mycobacterium tuberculosis
VGNGGDGGHGGNGGHGNSGGAGGAGGAGGAGGAGGH

SEQ ID NO: 1452494 - protein, 27 aa, Mycobacterium tuberculosis
VGNGRTNFNGHRREPGGTGGKGAANGF

SEQ ID NO: 1452495 - protein, 24 aa, Mycobacterium tuberculosis
VGNGSGEPAHRPRLGRRQHGRGGV

SEQ ID NO: 1452496 - protein, 10 aa, Mycobacterium tuberculosis
VGNPGRRRAP

SEQ ID NO: 1452497 - protein, 7 aa, Mycobacterium tuberculosis
VGNQSTI

SEQ ID NO: 1452498 - protein, 8 aa, Mycobacterium tuberculosis
VGNTAAPD

SEQ ID NO: 1452499 - protein, 10 aa, Mycobacterium tuberculosis
VGNTRTRACQ

SEQ ID NO: 1452500 - protein, 5 aa, Mycobacterium tuberculosis
VGPAD

SEQ ID NO: 1452501 - protein, 10 aa, Mycobacterium tuberculosis
VGPDTQERRA

SEQ ID NO: 1452502 - protein, 4 aa, Mycobacterium tuberculosis
VGPE

SEQ ID NO: 1452503 - protein, 12 aa, Mycobacterium tuberculosis
VGPFGGPDFPAP

SEQ ID NO: 1452504 - protein, 11 aa, Mycobacterium tuberculosis
VGPGETVAPPV

SEQ ID NO: 1452505 - protein, 5 aa, Mycobacterium tuberculosis
VGPGV

SEQ ID NO: 1452506 - protein, 7 aa, Mycobacterium tuberculosis
VGPLRQP

SEQ ID NO: 1452507 - protein, 6 aa, Mycobacterium tuberculosis
VGPMNN

SEQ ID NO: 1452508 - protein, 9 aa, Mycobacterium tuberculosis
VGPQRRQHG

SEQ ID NO: 1452509 - protein, 8 aa, Mycobacterium tuberculosis
VGPVTSEF

SEQ ID NO: 1452510 - protein, 12 aa, Mycobacterium tuberculosis
VGQAGGAGGSAG

SEQ ID NO: 1452511 - protein, 8 aa, Mycobacterium tuberculosis
VGQGGGQP

SEQ ID NO: 1452512 - protein, 12 aa, Mycobacterium tuberculosis
VGQGSTGGGRRP

SEQ ID NO: 1452513 - protein, 5 aa, Mycobacterium tuberculosis
VGQIG

SEQ ID NO: 1452514 - protein, 4 aa, Mycobacterium tuberculosis
VGRA

SEQ ID NO: 1452515 - protein, 24 aa, Mycobacterium tuberculosis
VGRGGDGGSGGLIGDGGTGWRCRR

SEQ ID NO: 1452516 - protein, 15 aa, Mycobacterium tuberculosis
VGRPADRCVRRLRRR

SEQ ID NO: 1452517 - protein, 7 aa, Mycobacterium tuberculosis
VGRPYPG

SEQ ID NO: 1452518 - protein, 10 aa, Mycobacterium tuberculosis
VGRQGTPARV

SEQ ID NO: 1452519 - protein, 6 aa, Mycobacterium tuberculosis
VGRRAR

SEQ ID NO: 1452520 - protein, 6 aa, Mycobacterium tuberculosis
VGRRKE

SEQ ID NO: 1452521 - protein, 29 aa, Mycobacterium tuberculosis
VGRRPSLPALQPADQGEGHQRRRAGHHRP

SEQ ID NO: 1452522 - protein, 12 aa, Mycobacterium tuberculosis
VGRSKAQSARDS

SEQ ID NO: 1452523 - protein, 18 aa, Mycobacterium tuberculosis
VGSAGTVTTLGSGKQIPA

SEQ ID NO: 1452524 - protein, 10 aa, Mycobacterium tuberculosis
VGSAPTPSGW

SEQ ID NO: 1452525 - protein, 5 aa, Mycobacterium tuberculosis
VGSGI

SEQ ID NO: 1452526 - protein, 6 aa, Mycobacterium tuberculosis
VGSPEK

SEQ ID NO: 1452527 - protein, 37 aa, Mycobacterium tuberculosis
VGSSRGPARRPAPAAPPSPPVPPAPRRCQTPDPPVAA

SEQ ID NO: 1452528 - protein, 12 aa, Mycobacterium tuberculosis
VGSTAGDGALGR

SEQ ID NO: 1452529 - protein, 13 aa, Mycobacterium tuberculosis
VGSTGGVGGATGL

SEQ ID NO: 1452530 - protein, 24 aa, Mycobacterium tuberculosis
VGTAGAAGTAESAQPAGAAGSSGA

SEQ ID NO: 1452531 - protein, 7 aa, Mycobacterium tuberculosis
VGTDNEQ

SEQ ID NO: 1452532 - protein, 26 aa, Mycobacterium tuberculosis
VGTDSGGGGRAGPAHRDAGAQGAARG

SEQ ID NO: 1452533 - protein, 31 aa, Mycobacterium tuberculosis
VGTGGGAASALAAGTADTGITAVGHRRHLHH

SEQ ID NO: 1452534 - protein, 10 aa, Mycobacterium tuberculosis
VGTHATKRAV

SEQ ID NO: 1452535 - protein, 10 aa, Mycobacterium tuberculosis
VGTPSSGGVS

SEQ ID NO: 1452536 - protein, 11 aa, Mycobacterium tuberculosis
VGTSPSGQTIP

SEQ ID NO: 1452537 - protein, 12 aa, Mycobacterium tuberculosis
VGTSPSGQTIPG

SEQ ID NO: 1452538 - protein, 9 aa, Mycobacterium tuberculosis
VGVASTPSL

SEQ ID NO: 1452539 - protein, 22 aa, Mycobacterium tuberculosis
VGVPGDPGGVGGDGGVGGAAGL

SEQ ID NO: 1452540 - protein, 61 aa, Mycobacterium tuberculosis
VGWAEKAGSAGPAGPAETADCSAPAAPAGPAAPSAPVSPGWAGPAGPAGPADCSAPAAPAA

SEQ ID NO: 1452541 - protein, 5 aa, Mycobacterium tuberculosis
VGWPS

SEQ ID NO: 1452542 - protein, 4 aa, Mycobacterium tuberculosis
VGYQ

SEQ ID NO: 1452543 - protein, 6 aa, Mycobacterium tuberculosis
VHDDAG

SEQ ID NO: 1452544 - protein, 19 aa, Mycobacterium tuberculosis
VHPGERPAHRHPQAGTPAV

SEQ ID NO: 1452545 - protein, 15 aa, Mycobacterium tuberculosis
VHPPRRRLRSRYSWC

SEQ ID NO: 1452546 - protein, 6 aa, Mycobacterium tuberculosis
VHPPRS

SEQ ID NO: 1452547 - protein, 26 aa, Mycobacterium tuberculosis
VHRGPGSDHVAAAGRRRRAGSGAGQA

SEQ ID NO: 1452548 - protein, 24 aa, Mycobacterium tuberculosis
VHRGSGQTRPGGDRGGQDDFRPHR

SEQ ID NO: 1452549 - protein, 10 aa, Mycobacterium tuberculosis
VHSPSPPGLR

SEQ ID NO: 1452550 - protein, 10 aa, Mycobacterium tuberculosis
VIAGKSAAAM

SEQ ID NO: 1452551 - protein, 31 aa, Mycobacterium tuberculosis
VIPDQPRTQVGPHRRQGVRRADERGRDVATR

SEQ ID NO: 1452552 - protein, 6 aa, Mycobacterium tuberculosis
VKAARK

SEQ ID NO: 1452553 - protein, 10 aa, Mycobacterium tuberculosis
VKAGGAGGAV

SEQ ID NO: 1452554 - protein, 16 aa, Mycobacterium tuberculosis
VKAHEAAAALASGASE

SEQ ID NO: 1452555 - protein, 12 aa, Mycobacterium tuberculosis
VKDARMKAVCGG

SEQ ID NO: 1452556 - protein, 25 aa, Mycobacterium tuberculosis
VKGGAGETNFAANNGADGNKRRRQT

SEQ ID NO: 1452557 - protein, 6 aa, Mycobacterium tuberculosis
VKGGRR

SEQ ID NO: 1452558 - protein, 9 aa, Mycobacterium tuberculosis
VKGGRSSSS

SEQ ID NO: 1452559 - protein, 22 aa, Mycobacterium tuberculosis
VKKPGDDQYRTLSPGEGGTELD

SEQ ID NO: 1452560 - protein, 10 aa, Mycobacterium tuberculosis
VKPPSSPVTS

SEQ ID NO: 1452561 - protein, 19 aa, Mycobacterium tuberculosis
VKPQPDPDHRTRRSQRVRR

SEQ ID NO: 1452562 - protein, 8 aa, Mycobacterium tuberculosis
VKPTYGTV

SEQ ID NO: 1452563 - protein, 37 aa, Mycobacterium tuberculosis
VKRGADRKTGPRPAGGCEARKGSSPKAAEQPLDGVQV

SEQ ID NO: 1452564 - protein, 7 aa, Mycobacterium tuberculosis
VKSATTN

SEQ ID NO: 1452565 - protein, 28 aa, Mycobacterium tuberculosis
VLGNGGTGGNGQLGSGAVSSAGGMGGNG

SEQ ID NO: 1452566 - protein, 13 aa, Mycobacterium tuberculosis
VLPGGSDVLGRGG

SEQ ID NO: 1452567 - protein, 8 aa, Mycobacterium tuberculosis
VLPSATET

SEQ ID NO: 1452568 - protein, 11 aa, Mycobacterium tuberculosis
VNAKGGAASTA

SEQ ID NO: 1452569 - protein, 11 aa, Mycobacterium tuberculosis
VNCGGNRRAPG

SEQ ID NO: 1452570 - protein, 5 aa, Mycobacterium tuberculosis
VNDKR

SEQ ID NO: 1452571 - protein, 123 aa, Mycobacterium tuberculosis
VNGGDGGKGGSGGNVGNGGNGGAGGNGAAGQAGTPGPTSGDSGTSGTDGGAGGNGGAGGAGGTLAGHGGNGGKGGNGGQGGIGGAGERGADGAGPNANGANGENGGSGGNGGDGGAGGNGGAG

SEQ ID NO: 1452572 - protein, 218 aa, Mycobacterium tuberculosis
VNGGNGGNGGNGDHALSGNGAAGGNGGNGGNGSLRGSGGAGGHGGNGGNASRGMGGDGGTGGAGGNAGQIGNGGAGGNGGDGGTGSDGNPGAITGSGGRGGDGGVGGQGGSVAGDGADGGRGGAGGTGGTGLRGTTGATGATGTFDAGADGHGGNGGTGGVGGTGGAGGGGGGNGGAGGKALSPTGNNGSQGAGGDGGAGGAGGTGGTGGDGGRGAHG

SEQ ID NO: 1452573 - protein, 28 aa, Mycobacterium tuberculosis
VNGSRRRRQCGPPGCRSPKHPTPGPGRW

SEQ ID NO: 1452574 - protein, 13 aa, Mycobacterium tuberculosis
VNGSRSPGCPSSS

SEQ ID NO: 1452575 - protein, 10 aa, Mycobacterium tuberculosis
VNHDGRSNGL

SEQ ID NO: 1452576 - protein, 17 aa, Mycobacterium tuberculosis
VNHDGRSNGLIAPNQDA

SEQ ID NO: 1452577 - protein, 34 aa, Mycobacterium tuberculosis
VNHDGRSNGPDRTQPGRAGRRAAPGLQGRRHRSA

SEQ ID NO: 1452578 - protein, 9 aa, Mycobacterium tuberculosis
VNLGSGKPR

SEQ ID NO: 1452579 - protein, 16 aa, Mycobacterium tuberculosis
VNPDDDKPSGSSDETL

SEQ ID NO: 1452580 - protein, 8 aa, Mycobacterium tuberculosis
VNPRTRRP

SEQ ID NO: 1452581 - protein, 33 aa, Mycobacterium tuberculosis
VNPSRPSSSPPAPPVPPTPGGTPSPPLPPLPPL

SEQ ID NO: 1452582 - protein, 22 aa, Mycobacterium tuberculosis
VNQGRPIQRADGPQPSGPDGGA

SEQ ID NO: 1452583 - protein, 6 aa, Mycobacterium tuberculosis
VNQVGR

SEQ ID NO: 1452584 - protein, 5 aa, Mycobacterium tuberculosis
VNRPT

SEQ ID NO: 1452585 - protein, 47 aa, Mycobacterium tuberculosis
VNSSANPPFPPSAPRPPGAPAPPMPPLPPAPPAPPLPINPALLPAPR

SEQ ID NO: 1452586 - protein, 16 aa, Mycobacterium tuberculosis
VNSSSVVSPAGADRRI

SEQ ID NO: 1452587 - protein, 19 aa, Mycobacterium tuberculosis
VNSYASAEAANASPLQAVE

SEQ ID NO: 1452588 - protein, 6 aa, Mycobacterium tuberculosis
VNTQRV

SEQ ID NO: 1452589 - protein, 12 aa, Mycobacterium tuberculosis
VNVSPDADSLIL

SEQ ID NO: 1452590 - protein, 10 aa, Mycobacterium tuberculosis
VPAAGDDGRV

SEQ ID NO: 1452591 - protein, 9 aa, Mycobacterium tuberculosis
VPAAPAGPV

SEQ ID NO: 1452592 - protein, 30 aa, Mycobacterium tuberculosis
VPAAPSGQRCPYPPPARADNTIGQNPRPYR

SEQ ID NO: 1452593 - protein, 7 aa, Mycobacterium tuberculosis
VPAASRK

SEQ ID NO: 1452594 - protein, 9 aa, Mycobacterium tuberculosis
VPAASRNAC

SEQ ID NO: 1452595 - protein, 20 aa, Mycobacterium tuberculosis
VPAATTAAAAFDQPARDTLA

SEQ ID NO: 1452596 - protein, 16 aa, Mycobacterium tuberculosis
VPAEPPASVARAGPAD

SEQ ID NO: 1452597 - protein, 46 aa, Mycobacterium tuberculosis
VPAETAATPAKCSATAGPAEPAARAAPVPVPRPAAPVATAVTAATP

SEQ ID NO: 1452598 - protein, 10 aa, Mycobacterium tuberculosis
VPAGPAAPAL

SEQ ID NO: 1452599 - protein, 87 aa, Mycobacterium tuberculosis
VPAGPGERPDCSATAVSAASAVTADKAATVPAPGPAAPRAVTPAPAGRAVPAAGSTATAAPAVSAAPAGPADKPVPAPPAHPANRAA

SEQ ID NO: 1452600 - protein, 4 aa, Mycobacterium tuberculosis
VPAP

SEQ ID NO: 1452601 - protein, 8 aa, Mycobacterium tuberculosis
VPAPPAAT

SEQ ID NO: 1452602 - protein, 8 aa, Mycobacterium tuberculosis
VPAPTELP

SEQ ID NO: 1452603 - protein, 9 aa, Mycobacterium tuberculosis
VPAQPMRQR

SEQ ID NO: 1452604 - protein, 12 aa, Mycobacterium tuberculosis
VPARNGYVPRPG

SEQ ID NO: 1452605 - protein, 12 aa, Mycobacterium tuberculosis
VPARRGRHKNIP

SEQ ID NO: 1452606 - protein, 4 aa, Mycobacterium tuberculosis
VPAS

SEQ ID NO: 1452607 - protein, 17 aa, Mycobacterium tuberculosis
VPATQDVPNRVRADEGA

SEQ ID NO: 1452608 - protein, 13 aa, Mycobacterium tuberculosis
VPAYSGAKIAGGA

SEQ ID NO: 1452609 - protein, 14 aa, Mycobacterium tuberculosis
VPCGGGARVCFALG

SEQ ID NO: 1452610 - protein, 12 aa, Mycobacterium tuberculosis
VPDEPRKIAVIS

SEQ ID NO: 1452611 - protein, 15 aa, Mycobacterium tuberculosis
VPDFPTQRGRRTQAA

SEQ ID NO: 1452612 - protein, 9 aa, Mycobacterium tuberculosis
VPDGAGTVA

SEQ ID NO: 1452613 - protein, 25 aa, Mycobacterium tuberculosis
VPDGAGTVAARSSISTLAAAPRIGS

SEQ ID NO: 1452614 - protein, 8 aa, Mycobacterium tuberculosis
VPDLPTPW

SEQ ID NO: 1452615 - protein, 8 aa, Mycobacterium tuberculosis
VPDSMPAD

SEQ ID NO: 1452616 - protein, 8 aa, Mycobacterium tuberculosis
VPDTPVPG

SEQ ID NO: 1452617 - protein, 26 aa, Mycobacterium tuberculosis
VPEDTGEYQPASGDHPETGVYSSPAE

SEQ ID NO: 1452618 - protein, 12 aa, Mycobacterium tuberculosis
VPEEDKGLRTRS

SEQ ID NO: 1452619 - protein, 8 aa, Mycobacterium tuberculosis
VPEGPTLR

SEQ ID NO: 1452620 - protein, 5 aa, Mycobacterium tuberculosis
VPEKP

SEQ ID NO: 1452621 - protein, 6 aa, Mycobacterium tuberculosis
VPEPPS

SEQ ID NO: 1452622 - protein, 6 aa, Mycobacterium tuberculosis
VPERAD

SEQ ID NO: 1452623 - protein, 5 aa, Mycobacterium tuberculosis
VPESV

SEQ ID NO: 1452624 - protein, 6 aa, Mycobacterium tuberculosis
VPGAPT

SEQ ID NO: 1452625 - protein, 8 aa, Mycobacterium tuberculosis
VPGASPVH

SEQ ID NO: 1452626 - protein, 10 aa, Mycobacterium tuberculosis
VPGDDGRVTG

SEQ ID NO: 1452627 - protein, 17 aa, Mycobacterium tuberculosis
VPGDHSRADRCGDQLPQ

SEQ ID NO: 1452628 - protein, 8 aa, Mycobacterium tuberculosis
VPGKRAPT

SEQ ID NO: 1452629 - protein, 5 aa, Mycobacterium tuberculosis
VPGNR

SEQ ID NO: 1452630 - protein, 6 aa, Mycobacterium tuberculosis
VPGPED

SEQ ID NO: 1452631 - protein, 10 aa, Mycobacterium tuberculosis
VPGPESEAGP

SEQ ID NO: 1452632 - protein, 5 aa, Mycobacterium tuberculosis
VPGPS

SEQ ID NO: 1452633 - protein, 33 aa, Mycobacterium tuberculosis
VPGRDWPRAAAGGRDHAAASTGIDRAAASAARH

SEQ ID NO: 1452634 - protein, 14 aa, Mycobacterium tuberculosis
VPGRKYPSNGPLSK

SEQ ID NO: 1452635 - protein, 16 aa, Mycobacterium tuberculosis
VPGRPRRARTAGSDRR

SEQ ID NO: 1452636 - protein, 17 aa, Mycobacterium tuberculosis
VPGRRGDRREPATNPAV

SEQ ID NO: 1452637 - protein, 6 aa, Mycobacterium tuberculosis
VPGTRQ

SEQ ID NO: 1452638 - protein, 14 aa, Mycobacterium tuberculosis
VPGYHAPPDRTAGV

SEQ ID NO: 1452639 - protein, 5 aa, Mycobacterium tuberculosis
VPHLP

SEQ ID NO: 1452640 - protein, 18 aa, Mycobacterium tuberculosis
VPHQPDPDVAGAGVGQPD

SEQ ID NO: 1452641 - protein, 13 aa, Mycobacterium tuberculosis
VPPAAKSSSFGPD

SEQ ID NO: 1452642 - protein, 5 aa, Mycobacterium tuberculosis
VPPAG

SEQ ID NO: 1452643 - protein, 6 aa, Mycobacterium tuberculosis
VPPAPI

SEQ ID NO: 1452644 - protein, 13 aa, Mycobacterium tuberculosis
VPPAPPEPPQPPL

SEQ ID NO: 1452645 - protein, 42 aa, Mycobacterium tuberculosis
VPPDGHLPHGQRRGQRGGSAAAGPRCRRTPRRRRVGDAQHGS

SEQ ID NO: 1452646 - protein, 10 aa, Mycobacterium tuberculosis
VPPGCGSPAA

SEQ ID NO: 1452647 - protein, 61 aa, Mycobacterium tuberculosis
VPPGGGGGAGGDGGAANTDSAGSSRKAFGGDGGVGGDGASALGTGGEGGIGGQGGNGGAGG

SEQ ID NO: 1452648 - protein, 5 aa, Mycobacterium tuberculosis
VPPGQ

SEQ ID NO: 1452649 - protein, 16 aa, Mycobacterium tuberculosis
VPPGWSAPPATPQAQT

SEQ ID NO: 1452650 - protein, 15 aa, Mycobacterium tuberculosis
VPPIAGGDRGSTMSA

SEQ ID NO: 1452651 - protein, 9 aa, Mycobacterium tuberculosis
VPPLPPVPP

SEQ ID NO: 1452652 - protein, 26 aa, Mycobacterium tuberculosis
VPPMPPAPPSPPAPAPPPPTPPLPPA

SEQ ID NO: 1452653 - protein, 6 aa, Mycobacterium tuberculosis
VPPPVA

SEQ ID NO: 1452654 - protein, 9 aa, Mycobacterium tuberculosis
VPPPYRSDG

SEQ ID NO: 1452655 - protein, 4 aa, Mycobacterium tuberculosis
VPPR

SEQ ID NO: 1452656 - protein, 57 aa, Mycobacterium tuberculosis
VPPSKRRSGWSSSGSVVPTSGKAWPPTAKSAPRGSAPTPIPAPAAEHSSARLCTRVG

SEQ ID NO: 1452657 - protein, 9 aa, Mycobacterium tuberculosis
VPPSRAPSA

SEQ ID NO: 1452658 - protein, 11 aa, Mycobacterium tuberculosis
VPPSSPTRREP

SEQ ID NO: 1452659 - protein, 8 aa, Mycobacterium tuberculosis
VPPSTCQS

SEQ ID NO: 1452660 - protein, 31 aa, Mycobacterium tuberculosis
VPPSVPVKSADDSRWSPSRRDGSLCADDDRV

SEQ ID NO: 1452661 - protein, 16 aa, Mycobacterium tuberculosis
VPPTTWRSSPSTTPRR

SEQ ID NO: 1452662 - protein, 5 aa, Mycobacterium tuberculosis
VPPTW

SEQ ID NO: 1452663 - protein, 43 aa, Mycobacterium tuberculosis
VPPVPGAPPAPPTPPAPPPAPPAPPAPPAPPLPPLPLRMAGPP

SEQ ID NO: 1452664 - protein, 6 aa, Mycobacterium tuberculosis
VPPVPP

SEQ ID NO: 1452665 - protein, 7 aa, Mycobacterium tuberculosis
VPRGPIP

SEQ ID NO: 1452666 - protein, 15 aa, Mycobacterium tuberculosis
VPRGPVDAGSEAQID

SEQ ID NO: 1452667 - protein, 44 aa, Mycobacterium tuberculosis
VPRLGDGGCRQQPGSGAAVRARPTRPGGAWERSASGSTRRAVTR

SEQ ID NO: 1452668 - protein, 10 aa, Mycobacterium tuberculosis
VPRPRPDHTQ

SEQ ID NO: 1452669 - protein, 18 aa, Mycobacterium tuberculosis
VPRSRRQVRGRRSDVDAK

SEQ ID NO: 1452670 - protein, 10 aa, Mycobacterium tuberculosis
VPRSTSTSED

SEQ ID NO: 1452671 - protein, 11 aa, Mycobacterium tuberculosis
VPSDTVPDSST

SEQ ID NO: 1452672 - protein, 7 aa, Mycobacterium tuberculosis
VPSRVSA

SEQ ID NO: 1452673 - protein, 18 aa, Mycobacterium tuberculosis
VPSTPGRVTDTAEGAKAI

SEQ ID NO: 1452674 - protein, 6 aa, Mycobacterium tuberculosis
VPTAST

SEQ ID NO: 1452675 - protein, 9 aa, Mycobacterium tuberculosis
VPTATSVRA

SEQ ID NO: 1452676 - protein, 17 aa, Mycobacterium tuberculosis
VPTPGGTEIRDNRSING

SEQ ID NO: 1452677 - protein, 8 aa, Mycobacterium tuberculosis
VPTQDAEA

SEQ ID NO: 1452678 - protein, 4 aa, Mycobacterium tuberculosis
VPVD

SEQ ID NO: 1452679 - protein, 5 aa, Mycobacterium tuberculosis
VPYRT

SEQ ID NO: 1452680 - protein, 19 aa, Mycobacterium tuberculosis
VQAAEGADAEAAAMDEWRV

SEQ ID NO: 1452681 - protein, 6 aa, Mycobacterium tuberculosis
VQAPGP

SEQ ID NO: 1452682 - protein, 20 aa, Mycobacterium tuberculosis
VQCRSDTGLTVNGRPLKEPY

SEQ ID NO: 1452683 - protein, 18 aa, Mycobacterium tuberculosis
VQGGRPEALGGLGGGRIE

SEQ ID NO: 1452684 - protein, 23 aa, Mycobacterium tuberculosis
VQHEPSAHAAAADVEAARPHRRR

SEQ ID NO: 1452685 - protein, 20 aa, Mycobacterium tuberculosis
VQHTRSQRTEIGETRTRPSH

SEQ ID NO: 1452686 - protein, 10 aa, Mycobacterium tuberculosis
VQKDGPSHAP

SEQ ID NO: 1452687 - protein, 6 aa, Mycobacterium tuberculosis
VQPAGV

SEQ ID NO: 1452688 - protein, 4 aa, Mycobacterium tuberculosis
VQPE

SEQ ID NO: 1452689 - protein, 7 aa, Mycobacterium tuberculosis
VQPHDPD

SEQ ID NO: 1452690 - protein, 10 aa, Mycobacterium tuberculosis
VQPPDRRKAQ

SEQ ID NO: 1452691 - protein, 4 aa, Mycobacterium tuberculosis
VQPR

SEQ ID NO: 1452692 - protein, 19 aa, Mycobacterium tuberculosis
VQPSGQQPGTLACIGREQP

SEQ ID NO: 1452693 - protein, 17 aa, Mycobacterium tuberculosis
VQPSPPNPDGPPPTPGI

SEQ ID NO: 1452694 - protein, 11 aa, Mycobacterium tuberculosis
VQPTHRQPGRR

SEQ ID NO: 1452695 - protein, 13 aa, Mycobacterium tuberculosis
VQQPGRAAPRGVR

SEQ ID NO: 1452696 - protein, 15 aa, Mycobacterium tuberculosis
VQQSSDPKPREGTET

SEQ ID NO: 1452697 - protein, 7 aa, Mycobacterium tuberculosis
VQRESGI

SEQ ID NO: 1452698 - protein, 12 aa, Mycobacterium tuberculosis
VQRGGKPQSVPE

SEQ ID NO: 1452699 - protein, 9 aa, Mycobacterium tuberculosis
VQRGPGRRH

SEQ ID NO: 1452700 - protein, 19 aa, Mycobacterium tuberculosis
VQRPGGAGPSAVGVCRTWR

SEQ ID NO: 1452701 - protein, 25 aa, Mycobacterium tuberculosis
VQSLTGAPIDRRRRETGIDGTGQAG

SEQ ID NO: 1452702 - protein, 17 aa, Mycobacterium tuberculosis
VQSRRSPPANKTRTAAF

SEQ ID NO: 1452703 - protein, 19 aa, Mycobacterium tuberculosis
VQTGTAAVTTTSPRSAGWP

SEQ ID NO: 1452704 - protein, 19 aa, Mycobacterium tuberculosis
VQTGTARGDDDLAESAGWP

SEQ ID NO: 1452705 - protein, 13 aa, Mycobacterium tuberculosis
VQTGTARGDDELA

SEQ ID NO: 1452706 - protein, 9 aa, Mycobacterium tuberculosis
VQTPDDPTF

SEQ ID NO: 1452707 - protein, 7 aa, Mycobacterium tuberculosis
VQTTPLT

SEQ ID NO: 1452708 - protein, 18 aa, Mycobacterium tuberculosis
VRAAASGLYRGQQRRRRP

SEQ ID NO: 1452709 - protein, 9 aa, Mycobacterium tuberculosis
VRAGAGDQL

SEQ ID NO: 1452710 - protein, 11 aa, Mycobacterium tuberculosis
VRANTAGPTLA

SEQ ID NO: 1452711 - protein, 17 aa, Mycobacterium tuberculosis
VRAPPRRDALFGTPDTG

SEQ ID NO: 1452712 - protein, 12 aa, Mycobacterium tuberculosis
VRASARSKGLNE

SEQ ID NO: 1452713 - protein, 6 aa, Mycobacterium tuberculosis
VRDGAY

SEQ ID NO: 1452714 - protein, 6 aa, Mycobacterium tuberculosis
VREPGD

SEQ ID NO: 1452715 - protein, 12 aa, Mycobacterium tuberculosis
VREQRRAQRQRD

SEQ ID NO: 1452716 - protein, 35 aa, Mycobacterium tuberculosis
VRETEVAGAGVKDADVAGARVEEPDVSAAGVEQPD

SEQ ID NO: 1452717 - protein, 11 aa, Mycobacterium tuberculosis
VRGASGSGKTT

SEQ ID NO: 1452718 - protein, 10 aa, Mycobacterium tuberculosis
VRGDSGSGRL

SEQ ID NO: 1452719 - protein, 14 aa, Mycobacterium tuberculosis
VRGDVARADRPPRL

SEQ ID NO: 1452720 - protein, 8 aa, Mycobacterium tuberculosis
VRGEGGRL

SEQ ID NO: 1452721 - protein, 17 aa, Mycobacterium tuberculosis
VRGHPQRDVDTQHRVRT

SEQ ID NO: 1452722 - protein, 17 aa, Mycobacterium tuberculosis
VRGRGGRRRALPRRRSA

SEQ ID NO: 1452723 - protein, 16 aa, Mycobacterium tuberculosis
VRGRQTQNPERGRKLR

SEQ ID NO: 1452724 - protein, 8 aa, Mycobacterium tuberculosis
VRGSRHKN

SEQ ID NO: 1452725 - protein, 8 aa, Mycobacterium tuberculosis
VRGTPPTL

SEQ ID NO: 1452726 - protein, 10 aa, Mycobacterium tuberculosis
VRPAGHDGGV

SEQ ID NO: 1452727 - protein, 14 aa, Mycobacterium tuberculosis
VRPARTLAKKGNIP

SEQ ID NO: 1452728 - protein, 15 aa, Mycobacterium tuberculosis
VRPARTLAKKGNIPV

SEQ ID NO: 1452729 - protein, 28 aa, Mycobacterium tuberculosis
VRPIGDKDDPAPAAAPLPAGAVPSRLPA

SEQ ID NO: 1452730 - protein, 5 aa, Mycobacterium tuberculosis
VRPNR

SEQ ID NO: 1452731 - protein, 10 aa, Mycobacterium tuberculosis
VRPPTPSRRL

SEQ ID NO: 1452732 - protein, 10 aa, Mycobacterium tuberculosis
VRPVEQGEGD

SEQ ID NO: 1452733 - protein, 7 aa, Mycobacterium tuberculosis
VRQERSA

SEQ ID NO: 1452734 - protein, 20 aa, Mycobacterium tuberculosis
VRQRRQRRQCPIGSRRRRSG

SEQ ID NO: 1452735 - protein, 22 aa, Mycobacterium tuberculosis
VRQSKVGDTVTSLSRARGLPPK

SEQ ID NO: 1452736 - protein, 14 aa, Mycobacterium tuberculosis
VRRAGGERVGSAPL

SEQ ID NO: 1452737 - protein, 7 aa, Mycobacterium tuberculosis
VRRGDQR

SEQ ID NO: 1452738 - protein, 24 aa, Mycobacterium tuberculosis
VRRGGNDRQWPRRSRRRRRRVRQW

SEQ ID NO: 1452739 - protein, 13 aa, Mycobacterium tuberculosis
VRRGPRGPEHPAR

SEQ ID NO: 1452740 - protein, 33 aa, Mycobacterium tuberculosis
VRRGSGNIATEDALTNDETAAADHSRPADRRRR

SEQ ID NO: 1452741 - protein, 21 aa, Mycobacterium tuberculosis
VRRPGSTASAPSQRRTLGEAS

SEQ ID NO: 1452742 - protein, 12 aa, Mycobacterium tuberculosis
VRRPRTRRIDGR

SEQ ID NO: 1452743 - protein, 12 aa, Mycobacterium tuberculosis
VRRPYRGTGCSP

SEQ ID NO: 1452744 - protein, 6 aa, Mycobacterium tuberculosis
VRRRDG

SEQ ID NO: 1452745 - protein, 9 aa, Mycobacterium tuberculosis
VRRRPSRGL

SEQ ID NO: 1452746 - protein, 10 aa, Mycobacterium tuberculosis
VRRSSRKLSP

SEQ ID NO: 1452747 - protein, 5 aa, Mycobacterium tuberculosis
VRSAE

SEQ ID NO: 1452748 - protein, 6 aa, Mycobacterium tuberculosis
VRSGEE

SEQ ID NO: 1452749 - protein, 14 aa, Mycobacterium tuberculosis
VRSGEQRGKRGAVS

SEQ ID NO: 1452750 - protein, 14 aa, Mycobacterium tuberculosis
VRSGHADLAAHFDN

SEQ ID NO: 1452751 - protein, 25 aa, Mycobacterium tuberculosis
VRSIPGQRASAANSEIQCPIPTLEL

SEQ ID NO: 1452752 - protein, 12 aa, Mycobacterium tuberculosis
VRSPRPVRPGRV

SEQ ID NO: 1452753 - protein, 14 aa, Mycobacterium tuberculosis
VRTDSSLDSNLHGR

SEQ ID NO: 1452754 - protein, 10 aa, Mycobacterium tuberculosis
VRTGGPGAAG

SEQ ID NO: 1452755 - protein, 13 aa, Mycobacterium tuberculosis
VRTNRPHPADAGQ

SEQ ID NO: 1452756 - protein, 7 aa, Mycobacterium tuberculosis
VRTYGPA

SEQ ID NO: 1452757 - protein, 9 aa, Mycobacterium tuberculosis
VSAADDVRQ

SEQ ID NO: 1452758 - protein, 34 aa, Mycobacterium tuberculosis
VSAAPEAAPSRSGNGGQSGAGGTGGDHSGGKRYR

SEQ ID NO: 1452759 - protein, 13 aa, Mycobacterium tuberculosis
VSAAPEAAPSRSV

SEQ ID NO: 1452760 - protein, 8 aa, Mycobacterium tuberculosis
VSAAPSSA

SEQ ID NO: 1452761 - protein, 21 aa, Mycobacterium tuberculosis
VSAEGDQRRTVGDAGAQRAQC

SEQ ID NO: 1452762 - protein, 22 aa, Mycobacterium tuberculosis
VSAGRGDADQIGVGTGQQIDHG

SEQ ID NO: 1452763 - protein, 13 aa, Mycobacterium tuberculosis
VSAPSTAPPAACS

SEQ ID NO: 1452764 - protein, 4 aa, Mycobacterium tuberculosis
VSAR

SEQ ID NO: 1452765 - protein, 12 aa, Mycobacterium tuberculosis
VSARTPSPNTVR

SEQ ID NO: 1452766 - protein, 25 aa, Mycobacterium tuberculosis
VSASDPYRGQPDARLEPIGTPIESG

SEQ ID NO: 1452767 - protein, 10 aa, Mycobacterium tuberculosis
VSASGSDSAV

SEQ ID NO: 1452768 - protein, 14 aa, Mycobacterium tuberculosis
VSAVNSDLDGTPQL

SEQ ID NO: 1452769 - protein, 7 aa, Mycobacterium tuberculosis
VSDAREA

SEQ ID NO: 1452770 - protein, 22 aa, Mycobacterium tuberculosis
VSDEDEGPPFGAGARDALYSEQ

SEQ ID NO: 1452771 - protein, 5 aa, Mycobacterium tuberculosis
VSDRD

SEQ ID NO: 1452772 - protein, 8 aa, Mycobacterium tuberculosis
VSDTHGTT

SEQ ID NO: 1452773 - protein, 9 aa, Mycobacterium tuberculosis
VSDTHGTTV

SEQ ID NO: 1452774 - protein, 13 aa, Mycobacterium tuberculosis
VSEEGLAALERRT

SEQ ID NO: 1452775 - protein, 6 aa, Mycobacterium tuberculosis
VSESTA

SEQ ID NO: 1452776 - protein, 5 aa, Mycobacterium tuberculosis
VSESV

SEQ ID NO: 1452777 - protein, 12 aa, Mycobacterium tuberculosis
VSESVDEFERED

SEQ ID NO: 1452778 - protein, 16 aa, Mycobacterium tuberculosis
VSGAAADLAAAGVCVL

SEQ ID NO: 1452779 - protein, 20 aa, Mycobacterium tuberculosis
VSGDDRPVAGLNGDGPFPAV

SEQ ID NO: 1452780 - protein, 20 aa, Mycobacterium tuberculosis
VSGEPGDRAGPAAPASSAGV

SEQ ID NO: 1452781 - protein, 12 aa, Mycobacterium tuberculosis
VSGGPQPFGDLV

SEQ ID NO: 1452782 - protein, 4 aa, Mycobacterium tuberculosis
VSGN

SEQ ID NO: 1452783 - protein, 17 aa, Mycobacterium tuberculosis
VSGPGRKPVMGETGGAH

SEQ ID NO: 1452784 - protein, 4 aa, Mycobacterium tuberculosis
VSGR

SEQ ID NO: 1452785 - protein, 12 aa, Mycobacterium tuberculosis
VSGRGDQPRPEP

SEQ ID NO: 1452786 - protein, 14 aa, Mycobacterium tuberculosis
VSGRPNRRGGGRHP

SEQ ID NO: 1452787 - protein, 19 aa, Mycobacterium tuberculosis
VSGTRRHADQRSGGRRRRA

SEQ ID NO: 1452788 - protein, 6 aa, Mycobacterium tuberculosis
VSHKPR

SEQ ID NO: 1452789 - protein, 6 aa, Mycobacterium tuberculosis
VSHPET

SEQ ID NO: 1452790 - protein, 26 aa, Mycobacterium tuberculosis
VSINSGGEKGLPRRGRGRFEGASPTC

SEQ ID NO: 1452791 - protein, 21 aa, Mycobacterium tuberculosis
VSKPNGDGAHIGKEPVDHLLG

SEQ ID NO: 1452792 - protein, 4 aa, Mycobacterium tuberculosis
VSKT

SEQ ID NO: 1452793 - protein, 5 aa, Mycobacterium tuberculosis
VSMTS

SEQ ID NO: 1452794 - protein, 13 aa, Mycobacterium tuberculosis
VSNRNSPTPQIDR

SEQ ID NO: 1452795 - protein, 23 aa, Mycobacterium tuberculosis
VSNSTKTGDRPRRPSTPAWRSPT

SEQ ID NO: 1452796 - protein, 26 aa, Mycobacterium tuberculosis
VSPAGRSAPACSRAATPPPCRALSWP

SEQ ID NO: 1452797 - protein, 10 aa, Mycobacterium tuberculosis
VSPEQAGRGL

SEQ ID NO: 1452798 - protein, 14 aa, Mycobacterium tuberculosis
VSPGGVTLSSGERL

SEQ ID NO: 1452799 - protein, 5 aa, Mycobacterium tuberculosis
VSPGT

SEQ ID NO: 1452800 - protein, 4 aa, Mycobacterium tuberculosis
VSPH

SEQ ID NO: 1452801 - protein, 28 aa, Mycobacterium tuberculosis
VSPPPPGLYTSGAGAATVGGGPARRAAR

SEQ ID NO: 1452802 - protein, 8 aa, Mycobacterium tuberculosis
VSPRGATT

SEQ ID NO: 1452803 - protein, 6 aa, Mycobacterium tuberculosis
VSPSFD

SEQ ID NO: 1452804 - protein, 24 aa, Mycobacterium tuberculosis
VSPTTPAAPEPPAAVPPSPQGTPP

SEQ ID NO: 1452805 - protein, 15 aa, Mycobacterium tuberculosis
VSPTTPAAPEPPTAV

SEQ ID NO: 1452806 - protein, 57 aa, Mycobacterium tuberculosis
VSPTTPAAPEPPTAVPPSPQAPHPGMAPGARPGPVPKPGIRTPRVGNNPFSSAQPAD

SEQ ID NO: 1452807 - protein, 75 aa, Mycobacterium tuberculosis
VSPTTPAAPEPPTAVPPSPQAPHPGMAPGARPGPVPKPGIRTPRVGNNPFSSAQPADRPIPRPPAPRPGTARPGV

SEQ ID NO: 1452808 - protein, 87 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPGSMPP

SEQ ID NO: 1452809 - protein, 124 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPGSMPPRPGGAVGGARPPRPGAPRPGGRPGAPGAGRSDAGGGN

SEQ ID NO: 1452810 - protein, 132 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPGSMPPRPGGAVGGARPPRPGAPRPGGRPGAPGAGRSDAGGGNYRGGGVGA

SEQ ID NO: 1452811 - protein, 138 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPGSMPPRPGGAVGGARPPRPGAPRPGGRPGAPGAGRSDAGGGNYRGGGVGAAPGTGF

SEQ ID NO: 1452812 - protein, 183 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPGSMPPRPGGAVGGARPPRPGAPRPGGRPGAPGAGRSDAGGGNYRGGGVGAAPGTGFRGRPGGGGGGRPGQRGGAAGAFGRPGGAPRRGRKSKRQKRQEYDS

SEQ ID NO: 1452813 - protein, 184 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPGSMPPRPGGAVGGARPPRPGASRPGGRPGAPGAGRSDAGGGNYRGGGVGAAPGTGFRGRPGGGGGGRPGQRGGAAGAFGRPGGAPRRGRKSKRQKRQEYDSM

SEQ ID NO: 1452814 - protein, 108 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPGSMPPRPGGAVGGARSTTSWCATTRG

SEQ ID NO: 1452815 - protein, 83 aa, Mycobacterium tuberculosis
VSPTTPAAPEPPTAVPPSPQAPHPGMAPGARPGPVPKPGIRTPRVGNNPFSSAQPADRPIPRPPAPRPGTARPGVPRPGASPV

SEQ ID NO: 1452816 - protein, 50 aa, Mycobacterium tuberculosis
VSPTTPAAPEPPTAVPPSPQAPHPGMAPGARPGPVPKPGIRTPRVGNNSF

SEQ ID NO: 1452817 - protein, 9 aa, Mycobacterium tuberculosis
VSPYTDDDG

SEQ ID NO: 1452818 - protein, 6 aa, Mycobacterium tuberculosis
VSQPTI

SEQ ID NO: 1452819 - protein, 26 aa, Mycobacterium tuberculosis
VSQRTTSRHEGSGAQQPELLRRTCGS

SEQ ID NO: 1452820 - protein, 4 aa, Mycobacterium tuberculosis
VSQS

SEQ ID NO: 1452821 - protein, 7 aa, Mycobacterium tuberculosis
VSQSGHR

SEQ ID NO: 1452822 - protein, 5 aa, Mycobacterium tuberculosis
VSQTS

SEQ ID NO: 1452823 - protein, 4 aa, Mycobacterium tuberculosis
VSQV

SEQ ID NO: 1452824 - protein, 10 aa, Mycobacterium tuberculosis
VSRAAARKRA

SEQ ID NO: 1452825 - protein, 15 aa, Mycobacterium tuberculosis
VSRDRGGSDRRLRRP

SEQ ID NO: 1452826 - protein, 21 aa, Mycobacterium tuberculosis
VSRRKPTSTTPEEAPEESQAV

SEQ ID NO: 1452827 - protein, 32 aa, Mycobacterium tuberculosis
VSRRSARRTASGSATPLSSRRRAMSSSLNGPC

SEQ ID NO: 1452828 - protein, 25 aa, Mycobacterium tuberculosis
VSSATGHRLRGRRGNSPRQRAFPTA

SEQ ID NO: 1452829 - protein, 19 aa, Mycobacterium tuberculosis
VSSDPKPREGTETRKRSTS

SEQ ID NO: 1452830 - protein, 6 aa, Mycobacterium tuberculosis
VSSEID

SEQ ID NO: 1452831 - protein, 26 aa, Mycobacterium tuberculosis
VSSGTTVPAHAQNPGRTPDTAVSSHT

SEQ ID NO: 1452832 - protein, 5 aa, Mycobacterium tuberculosis
VSSHR

SEQ ID NO: 1452833 - protein, 11 aa, Mycobacterium tuberculosis
VSSPGGKAPKR

SEQ ID NO: 1452834 - protein, 4 aa, Mycobacterium tuberculosis
VSSR

SEQ ID NO: 1452835 - protein, 13 aa, Mycobacterium tuberculosis
VSSRRRKGRRTLS

SEQ ID NO: 1452836 - protein, 10 aa, Mycobacterium tuberculosis
VSSSGPVRRE

SEQ ID NO: 1452837 - protein, 22 aa, Mycobacterium tuberculosis
VSSTSTLQGAGWTPAAPHGAAG

SEQ ID NO: 1452838 - protein, 52 aa, Mycobacterium tuberculosis
VSTAGSRRTAARGNHCRPRGPTGSRRPVSAPARRRPTARTRVSRHRGAGRHA

SEQ ID NO: 1452839 - protein, 13 aa, Mycobacterium tuberculosis
VSVSSPKLSSPVT

SEQ ID NO: 1452840 - protein, 14 aa, Mycobacterium tuberculosis
VTAGPAAMAGSCSA

SEQ ID NO: 1452841 - protein, 44 aa, Mycobacterium tuberculosis
VTAGPAVTGGQPTATVAAGTAVTRRSTQPPTPASPAVSGPADIP

SEQ ID NO: 1452842 - protein, 19 aa, Mycobacterium tuberculosis
VTASATGPSGTARVGADTA

SEQ ID NO: 1452843 - protein, 7 aa, Mycobacterium tuberculosis
VTASGDC

SEQ ID NO: 1452844 - protein, 4 aa, Mycobacterium tuberculosis
VTCP

SEQ ID NO: 1452845 - protein, 11 aa, Mycobacterium tuberculosis
VTDDPADPSTI

SEQ ID NO: 1452846 - protein, 21 aa, Mycobacterium tuberculosis
VTDKPFGVTSAPTQPTRATAS

SEQ ID NO: 1452847 - protein, 5 aa, Mycobacterium tuberculosis
VTDQR

SEQ ID NO: 1452848 - protein, 12 aa, Mycobacterium tuberculosis
VTDQSNGVAAAA

SEQ ID NO: 1452849 - protein, 6 aa, Mycobacterium tuberculosis
VTDTTF

SEQ ID NO: 1452850 - protein, 27 aa, Mycobacterium tuberculosis
VTEPEGGSTGPAVPAAVPAGPAGPAVT

SEQ ID NO: 1452851 - protein, 20 aa, Mycobacterium tuberculosis
VTERQLAGGGVGLGSRPACS

SEQ ID NO: 1452852 - protein, 4 aa, Mycobacterium tuberculosis
VTES

SEQ ID NO: 1452853 - protein, 8 aa, Mycobacterium tuberculosis
VTETAKRL

SEQ ID NO: 1452854 - protein, 15 aa, Mycobacterium tuberculosis
VTGAGAPDPDSPELA

SEQ ID NO: 1452855 - protein, 18 aa, Mycobacterium tuberculosis
VTGEPAGPPFAAGPADTL

SEQ ID NO: 1452856 - protein, 7 aa, Mycobacterium tuberculosis
VTGEPDV

SEQ ID NO: 1452857 - protein, 27 aa, Mycobacterium tuberculosis
VTGNAACATRSTARSAPTTSQSAACAK

SEQ ID NO: 1452858 - protein, 17 aa, Mycobacterium tuberculosis
VTGPDTADQPVPDDKRD

SEQ ID NO: 1452859 - protein, 9 aa, Mycobacterium tuberculosis
VTGPGEGPV

SEQ ID NO: 1452860 - protein, 8 aa, Mycobacterium tuberculosis
VTGSAELD

SEQ ID NO: 1452861 - protein, 5 aa, Mycobacterium tuberculosis
VTGSH

SEQ ID NO: 1452862 - protein, 9 aa, Mycobacterium tuberculosis
VTGTTGSSV

SEQ ID NO: 1452863 - protein, 9 aa, Mycobacterium tuberculosis
VTKYRQGDR

SEQ ID NO: 1452864 - protein, 18 aa, Mycobacterium tuberculosis
VTMPDSNSVKARELSGSS

SEQ ID NO: 1452865 - protein, 11 aa, Mycobacterium tuberculosis
VTNSPAVTEGR

SEQ ID NO: 1452866 - protein, 9 aa, Mycobacterium tuberculosis
VTNTPPTHH

SEQ ID NO: 1452867 - protein, 15 aa, Mycobacterium tuberculosis
VTPAVEAMGPDHLVG

SEQ ID NO: 1452868 - protein, 13 aa, Mycobacterium tuberculosis
VTPGDPGQLLTTA

SEQ ID NO: 1452869 - protein, 13 aa, Mycobacterium tuberculosis
VTPGHAGGGLSKA

SEQ ID NO: 1452870 - protein, 25 aa, Mycobacterium tuberculosis
VTPPADGSDRAVGAGPQRRAPQPAQ

SEQ ID NO: 1452871 - protein, 5 aa, Mycobacterium tuberculosis
VTPPR

SEQ ID NO: 1452872 - protein, 12 aa, Mycobacterium tuberculosis
VTPSPGAPEGPW

SEQ ID NO: 1452873 - protein, 6 aa, Mycobacterium tuberculosis
VTQPGD

SEQ ID NO: 1452874 - protein, 18 aa, Mycobacterium tuberculosis
VTRARPARRARRHEASPT

SEQ ID NO: 1452875 - protein, 14 aa, Mycobacterium tuberculosis
VTRGRRPRRHLVRG

SEQ ID NO: 1452876 - protein, 10 aa, Mycobacterium tuberculosis
VTRRGGREGD

SEQ ID NO: 1452877 - protein, 9 aa, Mycobacterium tuberculosis
VTRRGYGDE

SEQ ID NO: 1452878 - protein, 6 aa, Mycobacterium tuberculosis
VTSGSK

SEQ ID NO: 1452879 - protein, 15 aa, Mycobacterium tuberculosis
VTSGSSGAARSTTRV

SEQ ID NO: 1452880 - protein, 12 aa, Mycobacterium tuberculosis
VTSNSWEYTGDG

SEQ ID NO: 1452881 - protein, 24 aa, Mycobacterium tuberculosis
VTSSNDSHWQRPDDSPGPMPGRPV

SEQ ID NO: 1452882 - protein, 9 aa, Mycobacterium tuberculosis
VTSSPIKGT

SEQ ID NO: 1452883 - protein, 4 aa, Mycobacterium tuberculosis
VTTA

SEQ ID NO: 1452884 - protein, 7 aa, Mycobacterium tuberculosis
VTTARTI

SEQ ID NO: 1452885 - protein, 7 aa, Mycobacterium tuberculosis
VTTDDGS

SEQ ID NO: 1452886 - protein, 12 aa, Mycobacterium tuberculosis
VTTDKASGIVND

SEQ ID NO: 1452887 - protein, 6 aa, Mycobacterium tuberculosis
VTTPGS

SEQ ID NO: 1452888 - protein, 5 aa, Mycobacterium tuberculosis
VTTTL

SEQ ID NO: 1452889 - protein, 4 aa, Mycobacterium tuberculosis
VTVP

SEQ ID NO: 1452890 - protein, 12 aa, Mycobacterium tuberculosis
VTWTEPAPAPMD

SEQ ID NO: 1452891 - protein, 11 aa, Mycobacterium tuberculosis
VVGGNGGAGGQ

SEQ ID NO: 1452892 - protein, 10 aa, Mycobacterium tuberculosis
VVGPDSPASG

SEQ ID NO: 1452893 - protein, 5 aa, Mycobacterium tuberculosis
VVPGT

SEQ ID NO: 1452894 - protein, 4 aa, Mycobacterium tuberculosis
VVPP

SEQ ID NO: 1452895 - protein, 14 aa, Mycobacterium tuberculosis
VVPPPRIPPASSPR

SEQ ID NO: 1452896 - protein, 17 aa, Mycobacterium tuberculosis
VVSPAAPDLTDDLTDAE

SEQ ID NO: 1452897 - protein, 23 aa, Mycobacterium tuberculosis
VVTPSPRSLRPATAVPAATAANV

SEQ ID NO: 1452898 - protein, 13 aa, Mycobacterium tuberculosis
VYDGCRRKPINGE

SEQ ID NO: 1452899 - protein, 9 aa, Mycobacterium tuberculosis
VYPSSNHAE

SEQ ID NO: 1452900 - protein, 13 aa, Mycobacterium tuberculosis
WADGGPTSAHNGL

SEQ ID NO: 1452901 - protein, 15 aa, Mycobacterium tuberculosis
WANTTGYPRPSSCPP

SEQ ID NO: 1452902 - protein, 9 aa, Mycobacterium tuberculosis
WAPKSAGAL

SEQ ID NO: 1452903 - protein, 12 aa, Mycobacterium tuberculosis
WAPNRRGRPTRT

SEQ ID NO: 1452904 - protein, 19 aa, Mycobacterium tuberculosis
WAPPGPGRGCPGAITSPPT

SEQ ID NO: 1452905 - protein, 16 aa, Mycobacterium tuberculosis
WAPPTSVAASADHGES

SEQ ID NO: 1452906 - protein, 20 aa, Mycobacterium tuberculosis
WAPSTSPPPDVRYGRPSTTW

SEQ ID NO: 1452907 - protein, 37 aa, Mycobacterium tuberculosis
WAPTSPATSAPPPSFRPSTSRPSRWASPRSATSGRSA

SEQ ID NO: 1452908 - protein, 5 aa, Mycobacterium tuberculosis
WARPG

SEQ ID NO: 1452909 - protein, 11 aa, Mycobacterium tuberculosis
WARSAGSADVS

SEQ ID NO: 1452910 - protein, 7 aa, Mycobacterium tuberculosis
WARSGPI

SEQ ID NO: 1452911 - protein, 16 aa, Mycobacterium tuberculosis
WDGGQDRDGLDGDRAD

SEQ ID NO: 1452912 - protein, 5 aa, Mycobacterium tuberculosis
WDPAP

SEQ ID NO: 1452913 - protein, 5 aa, Mycobacterium tuberculosis
WDSGD

SEQ ID NO: 1452914 - protein, 16 aa, Mycobacterium tuberculosis
WEPGSKALATRAASGA

SEQ ID NO: 1452915 - protein, 25 aa, Mycobacterium tuberculosis
WGAPPARPRRRRRGLPGARRDRRRL

SEQ ID NO: 1452916 - protein, 25 aa, Mycobacterium tuberculosis
WGDPTQPQPRLRRRRAGRLRAFRVG

SEQ ID NO: 1452917 - protein, 10 aa, Mycobacterium tuberculosis
WGGAAPGGFD

SEQ ID NO: 1452918 - protein, 23 aa, Mycobacterium tuberculosis
WGGAAPVTRAGDDAEQSYGEERR

SEQ ID NO: 1452919 - protein, 13 aa, Mycobacterium tuberculosis
WGGDRPRSAQAAF

SEQ ID NO: 1452920 - protein, 45 aa, Mycobacterium tuberculosis
WGGHPDRGQWRQRRPRRQRRAMGQRGGGWSRSGRSGRRQRAKPGV

SEQ ID NO: 1452921 - protein, 10 aa, Mycobacterium tuberculosis
WGGKQRSDRR

SEQ ID NO: 1452922 - protein, 11 aa, Mycobacterium tuberculosis
WGGRQLGSGGL

SEQ ID NO: 1452923 - protein, 5 aa, Mycobacterium tuberculosis
WGGRR

SEQ ID NO: 1452924 - protein, 13 aa, Mycobacterium tuberculosis
WGGSGQRRQRVRH

SEQ ID NO: 1452925 - protein, 30 aa, Mycobacterium tuberculosis; identical to SEQ ID NO: 232515

SEQ ID NO: 1452926 - protein, 6 aa, Mycobacterium tuberculosis
WGPGCT

SEQ ID NO: 1452927 - protein, 5 aa, Mycobacterium tuberculosis
WGPGP

SEQ ID NO: 1452928 - protein, 40 aa, Mycobacterium tuberculosis
WGPPSPPMPPAPPPPPAPPSPKQQGPGGAVAADTTTTTGR

SEQ ID NO: 1452929 - protein, 13 aa, Mycobacterium tuberculosis
WGRAGSSSRPRGY

SEQ ID NO: 1452930 - protein, 43 aa, Mycobacterium tuberculosis; identical to SEQ ID NO: 231822

SEQ ID NO: 1452931 - protein, 28 aa, Mycobacterium tuberculosis
WGSGGSGGTGGQGGVGGGKSGDCGTGGY

SEQ ID NO: 1452932 - protein, 7 aa, Mycobacterium tuberculosis
WHPPGSL

SEQ ID NO: 1452933 - protein, 7 aa, Mycobacterium tuberculosis
WKTQRTV

SEQ ID NO: 1452934 - protein, 13 aa, Mycobacterium tuberculosis
WKTRKNAKGVAAR

SEQ ID NO: 1452935 - protein, 12 aa, Mycobacterium tuberculosis
WKTSPSTSEITD

SEQ ID NO: 1452936 - protein, 11 aa, Mycobacterium tuberculosis
WLGPSSAGMAA

SEQ ID NO: 1452937 - protein, 16 aa, Mycobacterium tuberculosis
WPAAGPEAFLYRNDWS

SEQ ID NO: 1452938 - protein, 114 aa, Mycobacterium tuberculosis
WPAAPPAPPRPATPPTPPLPPVPPTPPRTPSPPAPPVPPCPPAPPRPPCPPAPSSSAPRPPAPPAPPVPPVPPVPPNAPPSLPAPPAPPCPPAPPAPPGASHPPSPPTPPCPPV

SEQ ID NO: 1452939 - protein, 22 aa, Mycobacterium tuberculosis
WPADADDGATGSAGLSTGGGLD

SEQ ID NO: 1452940 - protein, 8 aa, Mycobacterium tuberculosis
WPANGPGW

SEQ ID NO: 1452941 - protein, 4 aa, Mycobacterium tuberculosis
WPAR

SEQ ID NO: 1452942 - protein, 11 aa, Mycobacterium tuberculosis
WPASPSGTPFR

SEQ ID NO: 1452943 - protein, 42 aa, Mycobacterium tuberculosis
WPASSADGTARPGPQSRRTGRSGGRRVGLGPRARRAVVADVH

SEQ ID NO: 1452944 - protein, 29 aa, Mycobacterium tuberculosis
WPATPSGSWTGYTPTATSPTPNAPANAAS

SEQ ID NO: 1452945 - protein, 37 aa, Mycobacterium tuberculosis
WPDGSQDRYQQPRCGRRAGVSDPGAESPHPARGHRAA

SEQ ID NO: 1452946 - protein, 42 aa, Mycobacterium tuberculosis
WPGARPHRRDRAGRNRRHHGRRRNGATPGRDPGGYRSAPTRV

SEQ ID NO: 1452947 - protein, 4 aa, Mycobacterium tuberculosis
WPGT

SEQ ID NO: 1452948 - protein, 16 aa, Mycobacterium tuberculosis
WPPPRGRRSRCTTPQT

SEQ ID NO: 1452949 - protein, 9 aa, Mycobacterium tuberculosis
WPPRARTAA

SEQ ID NO: 1452950 - protein, 20 aa, Mycobacterium tuberculosis
WPPSGAGGPRPDFSDNGETR

SEQ ID NO: 1452951 - protein, 12 aa, Mycobacterium tuberculosis
WPPSGPQRAPQI

SEQ ID NO: 1452952 - protein, 7 aa, Mycobacterium tuberculosis
WPPSSRH

SEQ ID NO: 1452953 - protein, 9 aa, Mycobacterium tuberculosis
WPPTPGSPL

SEQ ID NO: 1452954 - protein, 7 aa, Mycobacterium tuberculosis
WPPTVAP

SEQ ID NO: 1452955 - protein, 4 aa, Mycobacterium tuberculosis
WPQE

SEQ ID NO: 1452956 - protein, 13 aa, Mycobacterium tuberculosis
WPQPTDPVLFRRQ

SEQ ID NO: 1452957 - protein, 12 aa, Mycobacterium tuberculosis
WPQSAKGAQVTG

SEQ ID NO: 1452958 - protein, 32 aa, Mycobacterium tuberculosis
WPRGPGGLSGTAATRRTRPGRADDCESTCGNR

SEQ ID NO: 1452959 - protein, 5 aa, Mycobacterium tuberculosis
WPRPA

SEQ ID NO: 1452960 - protein, 21 aa, Mycobacterium tuberculosis
WPRPPPPNTPGWRCPPAIRSC

SEQ ID NO: 1452961 - protein, 15 aa, Mycobacterium tuberculosis
WPSDPTPGGRSASRP

SEQ ID NO: 1452962 - protein, 14 aa, Mycobacterium tuberculosis
WPSGSRSATSTSAW

SEQ ID NO: 1452963 - protein, 13 aa, Mycobacterium tuberculosis
WPSRGTAEQTRNR

SEQ ID NO: 1452964 - protein, 64 aa, Mycobacterium tuberculosis
WPSSPSSPSAPPPAPAPPRPPVPPAPPRPPGEPTPVPPLPPLPPLPPSPPSPTPVAAPPSAPSP

SEQ ID NO: 1452965 - protein, 68 aa, Mycobacterium tuberculosis
WPSSPSSPSAPPPAPAPPRPPVPPAPPRPPGEPTPVPPLPPLPPLPPSPPSPTPVAAPPSAPSPPSPP

SEQ ID NO: 1452966 - protein, 74 aa, Mycobacterium tuberculosis
WPSSPSSPSAPPPAPAPPRPPVPPAPPRPPGEPTPVPPLPPLPPLPPSPPSPTPVAAPPSAPSPPSPPAPPLPP

SEQ ID NO: 1452967 - protein, 75 aa, Mycobacterium tuberculosis
WPSSPSSPSAPPPAPAPPRPPVPPAPPRPPGEPTPVPPLPPLPPLPPSPPSPTPVAAPPSAPSPPSPPAPPLPPV

SEQ ID NO: 1452968 - protein, 78 aa, Mycobacterium tuberculosis
WPSSPSSPSAPPPAPAPPRPPVPPAPPRPPGEPTPVPPLPPLPPLPPSPPSPTPVAAPPSAPSPPSPPAPPLPPVPLP

SEQ ID NO: 1452969 - protein, 8 aa, Mycobacterium tuberculosis
WPTADVPG

SEQ ID NO: 1452970 - protein, 13 aa, Mycobacterium tuberculosis
WPTGPAAGVQPPL

SEQ ID NO: 1452971 - protein, 18 aa, Mycobacterium tuberculosis
WPTNASPSCNPPNAPPNA

SEQ ID NO: 1452972 - protein, 11 aa, Mycobacterium tuberculosis
WPTPAATTRAA

SEQ ID NO: 1452973 - protein, 13 aa, Mycobacterium tuberculosis
WPTPKSAAALAAA

SEQ ID NO: 1452974 - protein, 6 aa, Mycobacterium tuberculosis
WPTSGS

SEQ ID NO: 1452975 - protein, 4 aa, Mycobacterium tuberculosis
WQGV

SEQ ID NO: 1452976 - protein, 10 aa, Mycobacterium tuberculosis
WQKGRQVSAA

SEQ ID NO: 1452977 - protein, 5 aa, Mycobacterium tuberculosis
WQNEK

SEQ ID NO: 1452978 - protein, 10 aa, Mycobacterium tuberculosis
WQQPEANEET

SEQ ID NO: 1452979 - protein, 11 aa, Mycobacterium tuberculosis
WQRPGGGAVGA

SEQ ID NO: 1452980 - protein, 5 aa, Mycobacterium tuberculosis
WQSTR

SEQ ID NO: 1452981 - protein, 7 aa, Mycobacterium tuberculosis
WQTAQQK

SEQ ID NO: 1452982 - protein, 8 aa, Mycobacterium tuberculosis
WQTAQQKL

SEQ ID NO: 1452983 - protein, 14 aa, Mycobacterium tuberculosis
WRDQRGPPRRCWGA

SEQ ID NO: 1452984 - protein, 20 aa, Mycobacterium tuberculosis
WREKPTSDPPAKKESNGTKM

SEQ ID NO: 1452985 - protein, 12 aa, Mycobacterium tuberculosis
WRGRGGRTRRYR

SEQ ID NO: 1452986 - protein, 15 aa, Mycobacterium tuberculosis
WRGSAKRSPCPTPPF

SEQ ID NO: 1452987 - protein, 9 aa, Mycobacterium tuberculosis
WRPGGTAPV

SEQ ID NO: 1452988 - protein, 14 aa, Mycobacterium tuberculosis
WRPTPDLRPAPMTQ

SEQ ID NO: 1452989 - protein, 21 aa, Mycobacterium tuberculosis
WRRQSGCPGDARGHSRQRRRR

SEQ ID NO: 1452990 - protein, 6 aa, Mycobacterium tuberculosis
WRSAPP

SEQ ID NO: 1452991 - protein, 25 aa, Mycobacterium tuberculosis
WRTPARPQVPTASDTRRTPPRLPPG

SEQ ID NO: 1452992 - protein, 12 aa, Mycobacterium tuberculosis
WSASTRPGRSAR

SEQ ID NO: 1452993 - protein, 15 aa, Mycobacterium tuberculosis
WSATAANGGNAGEWH

SEQ ID NO: 1452994 - protein, 7 aa, Mycobacterium tuberculosis
WSGREPR

SEQ ID NO: 1452995 - protein, 17 aa, Mycobacterium tuberculosis
WSPAAGSPTSCAPADGA

SEQ ID NO: 1452996 - protein, 10 aa, Mycobacterium tuberculosis
WSPDSGETIA

SEQ ID NO: 1452997 - protein, 13 aa, Mycobacterium tuberculosis
WSPPAQRRMNPMA

SEQ ID NO: 1452998 - protein, 7 aa, Mycobacterium tuberculosis
WSPPGGH

SEQ ID NO: 1452999 - protein, 5 aa, Mycobacterium tuberculosis
WSPQA

SEQ ID NO: 1453000 - protein, 13 aa, Mycobacterium tuberculosis
WSPSAATTGLIPA

SEQ ID NO: 1453001 - protein, 18 aa, Mycobacterium tuberculosis
WSPTSRSEVTDSTSGAAE

SEQ ID NO: 1453002 - protein, 8 aa, Mycobacterium tuberculosis
WSSAGSDP

SEQ ID NO: 1453003 - protein, 16 aa, Mycobacterium tuberculosis
WSTGQGPLNSTAECSG

SEQ ID NO: 1453004 - protein, 18 aa, Mycobacterium tuberculosis
WSTPRPAARLRAGDGGQL

SEQ ID NO: 1453005 - protein, 4 aa, Mycobacterium tuberculosis
WTPH

SEQ ID NO: 1453006 - protein, 17 aa, Mycobacterium tuberculosis
WTPTTSTGCRCGTVRQV

SEQ ID NO: 1453007 - protein, 18 aa, Mycobacterium tuberculosis
WTTRRRTPGAPSRPLANR

SEQ ID NO: 1453008 - protein, 6 aa, Mycobacterium tuberculosis
WTVPPE

SEQ ID NO: 1453009 - protein, 10 aa, Mycobacterium tuberculosis
WVSGSGSGTV

SEQ ID NO: 1453010 - protein, 23 aa, Mycobacterium tuberculosis
WVTDPGRQTQNPERGRKPDGTEL

SEQ ID NO: 1453011 - protein, 7 aa, Mycobacterium tuberculosis
YAAQGSI

SEQ ID NO: 1453012 - protein, 11 aa, Mycobacterium tuberculosis
YAARGADPDFH

SEQ ID NO: 1453013 - protein, 6 aa, Mycobacterium tuberculosis
YAASQH

SEQ ID NO: 1453014 - protein, 12 aa, Mycobacterium tuberculosis
YAAWGGADGRTL

SEQ ID NO: 1453015 - protein, 16 aa, Mycobacterium tuberculosis
YADEPDEVGGPPIEEA

SEQ ID NO: 1453016 - protein, 12 aa, Mycobacterium tuberculosis
YAERASARSSEA

SEQ ID NO: 1453017 - protein, 12 aa, Mycobacterium tuberculosis
YAGAGSGPFEPP

SEQ ID NO: 1453018 - protein, 26 aa, Mycobacterium tuberculosis
YAGASGAASQLRRSPATGDHQRGRVA

SEQ ID NO: 1453019 - protein, 9 aa, Mycobacterium tuberculosis
YAGGPTMAD

SEQ ID NO: 1453020 - protein, 12 aa, Mycobacterium tuberculosis
YAGTSFATPDKL

SEQ ID NO: 1453021 - protein, 100 aa, Mycobacterium tuberculosis
YARPATTAGAAGAEQPARAAIPAGAAAKDAESAGPTGAAGAEQPAVSAGSAGPAGAGVGCPAGATDPAVGEQPAVSAGPAGAAGDGEGGCESRRDRRPRR

SEQ ID NO: 1453022 - protein, 91 aa, Mycobacterium tuberculosis
YARPQEDPRGGPDPQGGSDPRGGYPPETGGYPPQPGYPRPRHPDQATTPSKSGTPTRAYPEQRGYPDQRGYQDQGRGYPDQGQGGYPPPTS

SEQ ID NO: 1453023 - protein, 252 aa, Mycobacterium tuberculosis
YARPQEDPRGGPDPQGGSDPRGGYPPETGGYPPQPGYPRPRHPGQGDYPEQIGYPDQGGYPEQRGYPDQRGYQDQGRGYPDQGQGGYPPPYEQRPPVSPGPAAGYGAPGYDQGYRQSGGYGPSPGGGQPGYGGYGEYGRGPARHEEGSYVPSGPPGPPEQRPAYPDQGGYDQGYQQGATTYGRQDYGGGADYTRYTESPRVPGYAPQGGGYAEPAGRDYDYGQSGAPDYGQPAPGGYSGYGQGGYGSAGTSV

SEQ ID NO: 1453024 - protein, 10 aa, Mycobacterium tuberculosis
YASAEAANVE

SEQ ID NO: 1453025 - protein, 7 aa, Mycobacterium tuberculosis
YATAPGN

SEQ ID NO: 1453026 - protein, 15 aa, Mycobacterium tuberculosis
YATDGDDDGVADPQN

SEQ ID NO: 1453027 - protein, 15 aa, Mycobacterium tuberculosis
YCDGRTADPAAGDYP

SEQ ID NO: 1453028 - protein, 8 aa, Mycobacterium tuberculosis
YDAPLESD

SEQ ID NO: 1453029 - protein, 14 aa, Mycobacterium tuberculosis
YDEGDSFDQSARPR

SEQ ID NO: 1453030 - protein, 4 aa, Mycobacterium tuberculosis
YDPD

SEQ ID NO: 1453031 - protein, 9 aa, Mycobacterium tuberculosis
YDQPGGTQA

SEQ ID NO: 1453032 - protein, 20 aa, Mycobacterium tuberculosis
YDQSTEDKINQLNQQRAQTS

SEQ ID NO: 1453033 - protein, 4 aa, Mycobacterium tuberculosis
YDSS

SEQ ID NO: 1453034 - protein, 12 aa, Mycobacterium tuberculosis
YDTASAAASARG

SEQ ID NO: 1453035 - protein, 5 aa, Mycobacterium tuberculosis
YDTHY

SEQ ID NO: 1453036 - protein, 11 aa, Mycobacterium tuberculosis
YEASSDSPPGL

SEQ ID NO: 1453037 - protein, 11 aa, Mycobacterium tuberculosis
YEATGRRPSAS

SEQ ID NO: 1453038 - protein, 9 aa, Mycobacterium tuberculosis
YEEDSPAEV

SEQ ID NO: 1453039 - protein, 16 aa, Mycobacterium tuberculosis
YETEPRDPAGTDGSVE

SEQ ID NO: 1453040 - protein, 4 aa, Mycobacterium tuberculosis
YFGG

SEQ ID NO: 1453041 - protein, 18 aa, Mycobacterium tuberculosis
YGAAGARTARARSRPAGC

SEQ ID NO: 1453042 - protein, 9 aa, Mycobacterium tuberculosis
YGAGPRDLP

SEQ ID NO: 1453043 - protein, 16 aa, Mycobacterium tuberculosis
YGASGDGGNAGNGGLG

SEQ ID NO: 1453044 - protein, 6 aa, Mycobacterium tuberculosis
YGCPPT

SEQ ID NO: 1453045 - protein, 16 aa, Mycobacterium tuberculosis
YGDDEGGEEDFRFARR

SEQ ID NO: 1453046 - protein, 8 aa, Mycobacterium tuberculosis
YGETKTPE

SEQ ID NO: 1453047 - protein, 13 aa, Mycobacterium tuberculosis
YGGRREIVDVVRA

SEQ ID NO: 1453048 - protein, 6 aa, Mycobacterium tuberculosis
YGGTEI

SEQ ID NO: 1453049 - protein, 19 aa, Mycobacterium tuberculosis
YGNEAAGRAAQLQPPGVAR

SEQ ID NO: 1453050 - protein, 7 aa, Mycobacterium tuberculosis
YGNQAPK

SEQ ID NO: 1453051 - protein, 21 aa, Mycobacterium tuberculosis
YGNRDTGGLQGYGLTGTSISV

SEQ ID NO: 1453052 - protein, 10 aa, Mycobacterium tuberculosis
YGPGYIPRST

SEQ ID NO: 1453053 - protein, 8 aa, Mycobacterium tuberculosis
YGPQTAEF

SEQ ID NO: 1453054 - protein, 14 aa, Mycobacterium tuberculosis
YGPRTGGKSKVSGF

SEQ ID NO: 1453055 - protein, 14 aa, Mycobacterium tuberculosis
YGQGAGGAPLASAV

SEQ ID NO: 1453056 - protein, 27 aa, Mycobacterium tuberculosis
YGQRPQQLGGASRLPESGQRLERLQRH

SEQ ID NO: 1453057 - protein, 14 aa, Mycobacterium tuberculosis
YGRGTADDKAGIPT

SEQ ID NO: 1453058 - protein, 12 aa, Mycobacterium tuberculosis
YGSPSSARSGRR

SEQ ID NO: 1453059 - protein, 6 aa, Mycobacterium tuberculosis
YGTEGP

SEQ ID NO: 1453060 - protein, 10 aa, Mycobacterium tuberculosis
YGTEPRPQLA

SEQ ID NO: 1453061 - protein, 7 aa, Mycobacterium tuberculosis
YGTSSPS

SEQ ID NO: 1453062 - protein, 12 aa, Mycobacterium tuberculosis
YGVPVNSPNGYR

SEQ ID NO: 1453063 - protein, 17 aa, Mycobacterium tuberculosis
YHPEGDAHPTRATGAQP

SEQ ID NO: 1453064 - protein, 14 aa, Mycobacterium tuberculosis
YHPETDPVGAGGGA

SEQ ID NO: 1453065 - protein, 8 aa, Mycobacterium tuberculosis
YHPHGDAS

SEQ ID NO: 1453066 - protein, 12 aa, Mycobacterium tuberculosis
YHSNPGGIADTC

SEQ ID NO: 1453067 - protein, 8 aa, Mycobacterium tuberculosis
YKANDGGY

SEQ ID NO: 1453068 - protein, 12 aa, Mycobacterium tuberculosis
YKSPTTTHHRLG

SEQ ID NO: 1453069 - protein, 9 aa, Mycobacterium tuberculosis
YKSSARPAL

SEQ ID NO: 1453070 - protein, 15 aa, Mycobacterium tuberculosis
YLDPAQRAAAVAPRR

SEQ ID NO: 1453071 - protein, 20 aa, Mycobacterium tuberculosis
YLSGPAPEYPDGDARGERMG

SEQ ID NO: 1453072 - protein, 8 aa, Mycobacterium tuberculosis
YNAGGGHN

SEQ ID NO: 1453073 - protein, 4 aa, Mycobacterium tuberculosis
YNKQ

SEQ ID NO: 1453074 - protein, 10 aa, Mycobacterium tuberculosis
YNNPPAPPLG

SEQ ID NO: 1453075 - protein, 11 aa, Mycobacterium tuberculosis
YNNPPAPPVGI

SEQ ID NO: 1453076 - protein, 7 aa, Mycobacterium tuberculosis
YNTGSFN

SEQ ID NO: 1453077 - protein, 4 aa, Mycobacterium tuberculosis
YPAA

SEQ ID NO: 1453078 - protein, 13 aa, Mycobacterium tuberculosis
YPAEIGLLSRCCT

SEQ ID NO: 1453079 - protein, 8 aa, Mycobacterium tuberculosis
YPAGTNND

SEQ ID NO: 1453080 - protein, 5 aa, Mycobacterium tuberculosis
YPANG

SEQ ID NO: 1453081 - protein, 8 aa, Mycobacterium tuberculosis
YPARNETE

SEQ ID NO: 1453082 - protein, 15 aa, Mycobacterium tuberculosis
YPDARPALEEARRRG

SEQ ID NO: 1453083 - protein, 9 aa, Mycobacterium tuberculosis
YPDPGAQHG

SEQ ID NO: 1453084 - protein, 8 aa, Mycobacterium tuberculosis
YPDPSGAG

SEQ ID NO: 1453085 - protein, 7 aa, Mycobacterium tuberculosis
YPDRPAG

SEQ ID NO: 1453086 - protein, 9 aa, Mycobacterium tuberculosis
YPETLGKPD

SEQ ID NO: 1453087 - protein, 18 aa, Mycobacterium tuberculosis
YPFGPATWGGQSGSGQPK

SEQ ID NO: 1453088 - protein, 5 aa, Mycobacterium tuberculosis
YPGLN

SEQ ID NO: 1453089 - protein, 5 aa, Mycobacterium tuberculosis
YPHPA

SEQ ID NO: 1453090 - protein, 6 aa, Mycobacterium tuberculosis
YPPEVY

SEQ ID NO: 1453091 - protein, 6 aa, Mycobacterium tuberculosis
YPPGDP

SEQ ID NO: 1453092 - protein, 12 aa, Mycobacterium tuberculosis
YPPGRKPKPSWP

SEQ ID NO: 1453093 - protein, 6 aa, Mycobacterium tuberculosis
YPRPEE

SEQ ID NO: 1453094 - protein, 57 aa, Mycobacterium tuberculosis
YPRRPPARGGDGGVGGTGAAGGKGGAGGSGGVNGATGADGAKGLDGATGGKGNNGNP

SEQ ID NO: 1453095 - protein, 5 aa, Mycobacterium tuberculosis
YPRRS

SEQ ID NO: 1453096 - protein, 4 aa, Mycobacterium tuberculosis
YPRT

SEQ ID NO: 1453097 - protein, 12 aa, Mycobacterium tuberculosis
YPRTGQGGEPRL

SEQ ID NO: 1453098 - protein, 5 aa, Mycobacterium tuberculosis
YPRTP

SEQ ID NO: 1453099 - protein, 30 aa, Mycobacterium tuberculosis
YPSAPSSNPPKPPKPDLPASAPMPPSPPLP

SEQ ID NO: 1453100 - protein, 8 aa, Mycobacterium tuberculosis
YPSSNHAE

SEQ ID NO: 1453101 - protein, 8 aa, Mycobacterium tuberculosis
YPSTPGTT

SEQ ID NO: 1453102 - protein, 12 aa, Mycobacterium tuberculosis
YPTARSRGRRKP

SEQ ID NO: 1453103 - protein, 15 aa, Mycobacterium tuberculosis
YPTGTTTSGNQKSHC

SEQ ID NO: 1453104 - protein, 6 aa, Mycobacterium tuberculosis
YQDTNH

SEQ ID NO: 1453105 - protein, 6 aa, Mycobacterium tuberculosis
YQLTER

SEQ ID NO: 1453106 - protein, 8 aa, Mycobacterium tuberculosis
YQPGDGIP

SEQ ID NO: 1453107 - protein, 6 aa, Mycobacterium tuberculosis
YQPRSE

SEQ ID NO: 1453108 - protein, 4 aa, Mycobacterium tuberculosis
YQRA

SEQ ID NO: 1453109 - protein, 7 aa, Mycobacterium tuberculosis
YQRGAAA

SEQ ID NO: 1453110 - protein, 17 aa, Mycobacterium tuberculosis
YQTLSTQAAAFHSRLCS

SEQ ID NO: 1453111 - protein, 11 aa, Mycobacterium tuberculosis
YQTSGNGVSPT

SEQ ID NO: 1453112 - protein, 18 aa, Mycobacterium tuberculosis
YRAAAAGGNCTPSTITTS

SEQ ID NO: 1453113 - protein, 12 aa, Mycobacterium tuberculosis
YRADQAARQCAR

SEQ ID NO: 1453114 - protein, 20 aa, Mycobacterium tuberculosis
YRDTGDGRDHPLGDDARRVA

SEQ ID NO: 1453115 - protein, 17 aa, Mycobacterium tuberculosis
YRERSDERSNQRNGYRH

SEQ ID NO: 1453116 - protein, 18 aa, Mycobacterium tuberculosis
YRGPRDDSSEATKAAEAS

SEQ ID NO: 1453117 - protein, 4 aa, Mycobacterium tuberculosis
YRNR

SEQ ID NO: 1453118 - protein, 23 aa, Mycobacterium tuberculosis
YRPPTAAPPPAGARGGTEAGNLA

SEQ ID NO: 1453119 - protein, 17 aa, Mycobacterium tuberculosis
YRPTDRGSDGRVDRHQG

SEQ ID NO: 1453120 - protein, 7 aa, Mycobacterium tuberculosis
YRRPGPR

SEQ ID NO: 1453121 - protein, 52 aa, Mycobacterium tuberculosis
YRSGGTVRRRGGSGARRPPGPRGPSQTPPAWAGPPRAAIPSGTTGQGRGPTL

SEQ ID NO: 1453122 - protein, 12 aa, Mycobacterium tuberculosis
YRSNDPSRDRHH

SEQ ID NO: 1453123 - protein, 15 aa, Mycobacterium tuberculosis
YRSTDVAPPRGETPD

SEQ ID NO: 1453124 - protein, 33 aa, Mycobacterium tuberculosis
YRSTSSPAATSTAATSSTAPSCMSAPPHNASPT

SEQ ID NO: 1453125 - protein, 12 aa, Mycobacterium tuberculosis
YSAPDQRSAYPR

SEQ ID NO: 1453126 - protein, 25 aa, Mycobacterium tuberculosis
YSFPSKSAHRAPSTQNLPGTTRRSP

SEQ ID NO: 1453127 - protein, 200 aa, Mycobacterium tuberculosis
YSGRPGPPPPPPPPPKKKKKTKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKKSGGGGRGGGGGGGGGGGGGGGGGVEGPPRPPTKKKRA

SEQ ID NO: 1453128 - protein, 7 aa, Mycobacterium tuberculosis
YSGSQYN

SEQ ID NO: 1453129 - protein, 10 aa, Mycobacterium tuberculosis
YSKSVEPPRH

SEQ ID NO: 1453130 - protein, 8 aa, Mycobacterium tuberculosis
YSPAADGD

SEQ ID NO: 1453131 - protein, 24 aa, Mycobacterium tuberculosis
YSPAERPDRIPPTDPLGDHRRRHP

SEQ ID NO: 1453132 - protein, 10 aa, Mycobacterium tuberculosis
YSPGGESNVA

SEQ ID NO: 1453133 - protein, 12 aa, Mycobacterium tuberculosis
YSPHRGAARGEH

SEQ ID NO: 1453134 - protein, 18 aa, Mycobacterium tuberculosis
YSPKNPDNWTFTPNGPPV

SEQ ID NO: 1453135 - protein, 8 aa, Mycobacterium tuberculosis
YSPTPVPA

SEQ ID NO: 1453136 - protein, 14 aa, Mycobacterium tuberculosis
YSPVAGQRTSITSE

SEQ ID NO: 1453137 - protein, 4 aa, Mycobacterium tuberculosis
YSQG

SEQ ID NO: 1453138 - protein, 5 aa, Mycobacterium tuberculosis
YSQGA

SEQ ID NO: 1453139 - protein, 7 aa, Mycobacterium tuberculosis
YSRPSTG

SEQ ID NO: 1453140 - protein, 7 aa, Mycobacterium tuberculosis
YSSPPRF

SEQ ID NO: 1453141 - protein, 4 aa, Mycobacterium tuberculosis
YSTT

SEQ ID NO: 1453142 - protein, 6 aa, Mycobacterium tuberculosis
YTAGTA

SEQ ID NO: 1453143 - protein, 13 aa, Mycobacterium tuberculosis
YTARNTDPVGTRR

SEQ ID NO: 1453144 - protein, 12 aa, Mycobacterium tuberculosis
YTSGQPDPDSVI

SEQ ID NO: 1453145 - protein, 7 aa, Mycobacterium tuberculosis
YTSPLPP

SEQ ID NO: 1453146 - protein, 4 aa, Mycobacterium tuberculosis
YTTD

SEQ ID NO: 1453147 - protein, 9 aa, Mycobacterium tuberculosis
YTTKTSRIG

SEQ ID NO: 1453148 - protein, 8 aa, Mycobacterium tuberculosis
YTTTTTGA

SEQ ID NO: 1453149 - protein, 9 aa, Mycobacterium tuberculosis
YWGPPSKPG

SEQ ID NO: 1453150 - protein, 17 aa, Mycobacterium tuberculosis
VASTMATSMVLDAIEQA

SEQ ID NO: 1453151 - protein, 17 aa, Mycobacterium tuberculosis
IRFSERLAEAGIQPSVG

SEQ ID NO: 1453152 - protein, 21 aa, Mycobacterium tuberculosis
ELRERAVRMVAEIRGQHDSEW

SEQ ID NO: 1453153 - protein, 24 aa, Mycobacterium tuberculosis
DAYARRILGWRVASTMATSMVLDA

SEQ ID NO: 1453154 - protein, 26 aa, Mycobacterium tuberculosis
EDVELATARWVDWFNHRRLYQYCGDV

SEQ ID NO: 1453155 - protein, 24 aa, Mycobacterium tuberculosis
MGAEADALCGAGYRERSDERSNQR

SEQ ID NO: 1453156 - protein, 23 aa, Mycobacterium tuberculosis
AEDGAGWLAFFRDLVARGLSGVA

SEQ ID NO: 1453157 - protein, 31 aa, Mycobacterium tuberculosis; identical to SEQ ID NO: 195298

SEQ ID NO: 1453158 - protein, 25 aa, Mycobacterium tuberculosis
EDVELATARWVDWFNHRRLYQYCGD

SEQ ID NO: 1453159 - protein, 17 aa, Mycobacterium tuberculosis
IEGRRYLGLEVLTRARA

SEQ ID NO: 1453160 - protein, 28 aa, Mycobacterium tuberculosis
LMAATPKPSWPWVRTLLHSIYDQPDAES

SEQ ID NO: 1453161 - protein, 26 aa, Mycobacterium tuberculosis
ATLPAAAWQRCRTHYAANLMAATPKP

SEQ ID NO: 1453162 - protein, 20 aa, Mycobacterium tuberculosis
GRRYLGLEVLTRARAALTST

SEQ ID NO: 1453163 - protein, 23 aa, Mycobacterium tuberculosis
AYARRILGWRVASTMATSMVLDA

SEQ ID NO: 1453164 - protein, 22 aa, Mycobacterium tuberculosis
TSVVATCYLLGVSTRRMERLVE

SEQ ID NO: 1453165 - protein, 23 aa, Mycobacterium tuberculosis
TPQARATFEAVLAKLAAPGATNP

SEQ ID NO: 1453166 - protein, 17 aa, Mycobacterium tuberculosis
LTPGLMGLGNIGFGNAG

SEQ ID NO: 1453167 - protein, 23 aa, Mycobacterium tuberculosis
LTSVVATCYLLGVSTRRMERLVE

SEQ ID NO: 1453168 - protein, 27 aa, Mycobacterium tuberculosis
TDLLAFTAFPKKIWRQIWSNNPQERLN

SEQ ID NO: 1453169 - protein, 24 aa, Mycobacterium tuberculosis
DRDHIAGAIKLDWRTDLQDPVKRD

SEQ ID NO: 1453170 - protein, 23 aa, Mycobacterium tuberculosis
FRFFAAPGSWTLRALSAAGNGDA

SEQ ID NO: 1453171 - protein, 20 aa, Mycobacterium tuberculosis
AVTIPGFAINPFGLNVPLSG

SEQ ID NO: 1453172 - protein, 21 aa, Mycobacterium tuberculosis
DEVFAHVAAVFGVDAEVAEDI

SEQ ID NO: 1453173 - protein, 21 aa, Mycobacterium tuberculosis
ERSSHTWFVLRELLGHQNVKN

SEQ ID NO: 1453174 - protein, 19 aa, Mycobacterium tuberculosis
GMSRLSGYLTPQARATFEA

SEQ ID NO: 1453175 - protein, 23 aa, Mycobacterium tuberculosis
NNNWFAAYAYWYFKLYGHEKVKL

SEQ ID NO: 1453176 - protein, 21 aa, Mycobacterium tuberculosis
GRGSQWAGMGRQLLADEPAFA

SEQ ID NO: 1453177 - protein, 17 aa, Mycobacterium tuberculosis
RTVRPWFDRLLAADDPF

SEQ ID NO: 1453178 - protein, 17 aa, Mycobacterium tuberculosis
HLHGLATQLMDWLHPDG

SEQ ID NO: 1453179 - protein, 20 aa, Mycobacterium tuberculosis
RSPDEFSGKILAPAHLPQEQ

SEQ ID NO: 1453180 - protein, 24 aa, Mycobacterium tuberculosis
MHPFCARRELIASIPGIGVGASAT

SEQ ID NO: 1453181 - protein, 24 aa, Mycobacterium tuberculosis
DASLRLVAPGGVFLEMGKTDIRDP

SEQ ID NO: 1453182 - protein, 27 aa, Mycobacterium tuberculosis
HTKRLASPAQRIMLFANDRGCTKPGCD

SEQ ID NO: 1453183 - protein, 24 aa, Mycobacterium tuberculosis
PDELARYAQRVMDWLHPDGDLTDT

SEQ ID NO: 1453184 - protein, 29 aa, Mycobacterium tuberculosis
TMHMAGARHCARLRGAIVGKSKSDVIDAE

SEQ ID NO: 1453185 - protein, 22 aa, Mycobacterium tuberculosis
AGDFWGGAGSVACQEFITQLGR

SEQ ID NO: 1453186 - protein, 24 aa, Mycobacterium tuberculosis
SVACQEFITQLGRNFQVIYEQANA

SEQ ID NO: 1453187 - protein, 19 aa, Mycobacterium tuberculosis
LGIDVGGGLGPFTVFPDGY

SEQ ID NO: 1453188 - protein, 18 aa, Mycobacterium tuberculosis
LTGAPWVGAASLSMVAAA

SEQ ID NO: 1453189 - protein, 22 aa, Mycobacterium tuberculosis
FDDHHALMCRLHLAHLDQLDAM

SEQ ID NO: 1453190 - protein, 18 aa, Mycobacterium tuberculosis
FDDTVAWLAVACSKTAVC

SEQ ID NO: 1453191 - protein, 18 aa, Mycobacterium tuberculosis
GGLGPFTVFPDGYSLPAI

SEQ ID NO: 1453192 - protein, 24 aa, Mycobacterium tuberculosis
GVTRFKSEAAFACHAAVAPIPVWS

SEQ ID NO: 1453193 - protein, 27 aa, Mycobacterium tuberculosis
QLVALGELFAYRWSRCGGREEWVMDTM

SEQ ID NO: 1453194 - protein, 22 aa, Mycobacterium tuberculosis
RTSAINRLRWLVHELDPERAPA

SEQ ID NO: 1453195 - protein, 18 aa, Mycobacterium tuberculosis
SKETIAYCRIGERSSHTW

SEQ ID NO: 1453196 - protein, 19 aa, Mycobacterium tuberculosis
TAVCELMRIAWRTVGAIVA

SEQ ID NO: 1453197 - protein, 17 aa, Mycobacterium tuberculosis
TGNWGVFNSGSYNTGIG

SEQ ID NO: 1453198 - protein, 18 aa, Mycobacterium tuberculosis
EALERAGIDPTGLRGSAT

SEQ ID NO: 1453199 - protein, 24 aa, Mycobacterium tuberculosis
GSALLFPSLCHFSGGIPAPEADPP

SEQ ID NO: 1453200 - protein, 24 aa, Mycobacterium tuberculosis
KRAALRCLKRRLARTVFQALRTVH

SEQ ID NO: 1453201 - protein, 18 aa, Mycobacterium tuberculosis
RTRRAGVSSFGISGTNAH

SEQ ID NO: 1453202 - protein, 19 aa, Mycobacterium tuberculosis
FSAASAFQSVVWGLTVGSW

SEQ ID NO: 1453203 - protein, 23 aa, Mycobacterium tuberculosis
FTVFPDGYSLPAIPLGIDVGGGL

SEQ ID NO: 1453204 - protein, 18 aa, Mycobacterium tuberculosis
DAIQCADPFHVVAWATEA

SEQ ID NO: 1453205 - protein, 24 aa, Mycobacterium tuberculosis
DGVLRPLPVTTFDVRCAPAALRYL

SEQ ID NO: 1453206 - protein, 17 aa, Mycobacterium tuberculosis
RRLARTVFQALRTVHQP

SEQ ID NO: 1453207 - protein, 17 aa, Mycobacterium tuberculosis
RVNCPTHGPTVVAVPWA

SEQ ID NO: 1453208 - protein, 24 aa, Mycobacterium tuberculosis
TASKGKWDTLRAMGFDDDHISDSR

SEQ ID NO: 1453209 - protein, 24 aa, Mycobacterium tuberculosis
WPGPTGERADWWWYEPFQPQPPPI

SEQ ID NO: 1453210 - protein, 27 aa, Mycobacterium tuberculosis
DEQFSCWRIKLPHVEAAKFDAALQSHL

SEQ ID NO: 1453211 - protein, 18 aa, Mycobacterium tuberculosis
PTHGPTVVAVPWARHHAG

SEQ ID NO: 1453212 - protein, 21 aa, Mycobacterium tuberculosis
RSVAGLVAWKMGCSSGNAHTI

SEQ ID NO: 1453213 - protein, 25 aa, Mycobacterium tuberculosis
VQARPGCRPSLAELDSFVRSEIAGY

SEQ ID NO: 1453214 - protein, 18 aa, Mycobacterium tuberculosis
CQGFITQLGRNFQVIYEQ

SEQ ID NO: 1453215 - protein, 18 aa, Mycobacterium tuberculosis
LAASRLRYARAMRERLPK

SEQ ID NO: 1453216 - protein, 19 aa, Mycobacterium tuberculosis
RGITMGKQEFDGMSRISGL

SEQ ID NO: 1453217 - protein, 23 aa, Mycobacterium tuberculosis
TKRLASPAQRIMLYAKDRGCSRP

SEQ ID NO: 1453218 - protein, 22 aa, Mycobacterium tuberculosis
PGAAGRHGLDWVAIASAAEPGA

SEQ ID NO: 1453219 - protein, 18 aa, Mycobacterium tuberculosis
RATIEAVLAKLAAPGACN

SEQ ID NO: 1453220 - protein, 20 aa, Mycobacterium tuberculosis
DLLAFTAFPKQIWRQIWSNN

SEQ ID NO: 1453221 - protein, 24 aa, Mycobacterium tuberculosis
EPMTARFLSVVLRRIRGMRSDTRE

SEQ ID NO: 1453222 - protein, 18 aa, Mycobacterium tuberculosis
FPKQIWRQIWSNNPQERL

SEQ ID NO: 1453223 - protein, 18 aa, Mycobacterium tuberculosis
PASMLIGPMMQLAQMGTT

SEQ ID NO: 1453224 - protein, 22 aa, Mycobacterium tuberculosis
EQMWAADVAAMVGYHGGASAAA

SEQ ID NO: 1453225 - protein, 24 aa, Mycobacterium tuberculosis
IIGRIKDLLIVYGRNHSPDDIEAT

SEQ ID NO: 1453226 - protein, 21 aa, Mycobacterium tuberculosis
LAAAAARAGGAAVQAKAVAGA

SEQ ID NO: 1453227 - protein, 26 aa, Mycobacterium tuberculosis
VVAANRSAFVQLVLSNVFGQNAPAIA

SEQ ID NO: 1453228 - protein, 25 aa, Mycobacterium tuberculosis
AAHRRAHGLPAISLGWGLWDQASAM

SEQ ID NO: 1453229 - protein, 23 aa, Mycobacterium tuberculosis
DRGCSRPGCDAPAYHSEVHHVTP

SEQ ID NO: 1453230 - protein, 19 aa, Mycobacterium tuberculosis
FSGKILAPAHLPQEQSQRP

SEQ ID NO: 1453231 - protein, 18 aa, Mycobacterium tuberculosis
GIDVGGGLGPFTVFPDGY

SEQ ID NO: 1453232 - protein, 18 aa, Mycobacterium tuberculosis
LAAESFGLVTSGLAGGSG

SEQ ID NO: 1453233 - protein, 17 aa, Mycobacterium tuberculosis
LYRAYLLKESLRHVFSV

SEQ ID NO: 1453234 - protein, 17 aa, Mycobacterium tuberculosis
RAGVSSFGISGTNAHVI

SEQ ID NO: 1453235 - protein, 20 aa, Mycobacterium tuberculosis
SDHRLILEGIAWRFRTGSPW

SEQ ID NO: 1453236 - protein, 18 aa, Mycobacterium tuberculosis
EVAAHEFLLFPTVAHSHA

SEQ ID NO: 1453237 - protein, 19 aa, Mycobacterium tuberculosis
GAGAGMPAGMMGRGGANPH

SEQ ID NO: 1453238 - protein, 20 aa, Mycobacterium tuberculosis
GHTYAFDDTVAWLAVACSKT

SEQ ID NO: 1453239 - protein, 23 aa, Mycobacterium tuberculosis
HRDRTCVVPGCGATRGLHAHHIR

SEQ ID NO: 1453240 - protein, 17 aa, Mycobacterium tuberculosis
PVVPRREAGWAGPVVPW

SEQ ID NO: 1453241 - protein, 17 aa, Mycobacterium tuberculosis
RCGRCGRKASWYDRGAG

SEQ ID NO: 1453242 - protein, 20 aa, Mycobacterium tuberculosis
WSLAGRSVFEHRAVVVGGDR

SEQ ID NO: 1453243 - protein, 21 aa, Mycobacterium tuberculosis
AEVPAAGGPMGMMPMPMGMGG

SEQ ID NO: 1453244 - protein, 18 aa, Mycobacterium tuberculosis
AWRTVGAIVARVWADTEK

SEQ ID NO: 1453245 - protein, 19 aa, Mycobacterium tuberculosis
CQVQRELAHVAGLHHRSVK

SEQ ID NO: 1453246 - protein, 17 aa, Mycobacterium tuberculosis
GQVIGCGRTTRQINRRL

SEQ ID NO: 1453247 - protein, 20 aa, Mycobacterium tuberculosis
LVKTFWGWRDQQLPDGTLIL

SEQ ID NO: 1453248 - protein, 26 aa, Mycobacterium tuberculosis
MDPQHRMLLELSWEALERAGIDPTGL

SEQ ID NO: 1453249 - protein, 19 aa, Mycobacterium tuberculosis
MPAGMMGRGGANPHVVQAR

SEQ ID NO: 1453250 - protein, 17 aa, Mycobacterium tuberculosis
TQLSGILNRGAGISGVY

SEQ ID NO: 1453251 - protein, 21 aa, Mycobacterium tuberculosis
AVTIPGFAINPFGLDVPLSGG

SEQ ID NO: 1453252 - protein, 18 aa, Mycobacterium tuberculosis
IAQILAELATLFGDGVLR

SEQ ID NO: 1453253 - protein, 27 aa, Mycobacterium tuberculosis
SAELGKARLVGAMSVPPTWEGSVPARM

SEQ ID NO: 1453254 - protein, 22 aa, Mycobacterium tuberculosis
SDFWGGAGSAACQGFITQLGRN

SEQ ID NO: 1453255 - protein, 24 aa, Mycobacterium tuberculosis
SEDDFRQVLPVGGWEITYLGTTTY

SEQ ID NO: 1453256 - protein, 19 aa, Mycobacterium tuberculosis
AGTAVRSGAGAARVAGGSV

SEQ ID NO: 1453257 - protein, 20 aa, Mycobacterium tuberculosis
AIEDLHIWTAESVRADRLDF

SEQ ID NO: 1453258 - protein, 19 aa, Mycobacterium tuberculosis
AIYVGSLSVPQGWAEAAPV

SEQ ID NO: 1453259 - protein, 20 aa, Mycobacterium tuberculosis
ALGAEGIRVDTRCELRAGVQ

SEQ ID NO: 1453260 - protein, 17 aa, Mycobacterium tuberculosis
AQLAANVARWPSMTKAR

SEQ ID NO: 1453261 - protein, 19 aa, Mycobacterium tuberculosis
ASELVRFELLAGVRESELA

SEQ ID NO: 1453262 - protein, 17 aa, Mycobacterium tuberculosis
ASVGSLSVPQAWAAANQ

SEQ ID NO: 1453263 - protein, 30 aa, Mycobacterium tuberculosis; identical to SEQ ID NO: 197721

SEQ ID NO: 1453264 - protein, 18 aa, Mycobacterium tuberculosis
DHSRGSWRGRDFTGTEYV

SEQ ID NO: 1453265 - protein, 22 aa, Mycobacterium tuberculosis
EDIARIGGRLARRYRSSHRGID

SEQ ID NO: 1453266 - protein, 19 aa, Mycobacterium tuberculosis
EGIAWRFRTGSPWRDLPAE

SEQ ID NO: 1453267 - protein, 21 aa, Mycobacterium tuberculosis
EGYPSIGCAPCTAKPAEGADP

SEQ ID NO: 1453268 - protein, 28 aa, Mycobacterium tuberculosis
EVLSALSCRPAIVVPAFLSRGYHVRTDL

SEQ ID NO: 1453269 - protein, 20 aa, Mycobacterium tuberculosis
FQQRVWKALLTIPYGETRSY

SEQ ID NO: 1453270 - protein, 18 aa, Mycobacterium tuberculosis
GELTEFDVELDLRGTDFQ

SEQ ID NO: 1453271 - protein, 17 aa, Mycobacterium tuberculosis
GGIARAIYVGSLSVPQG

SEQ ID NO: 1453272 - protein, 24 aa, Mycobacterium tuberculosis
GGSIPEYNRDALVSTFQDLYGPAQ

SEQ ID NO: 1453273 - protein, 28 aa, Mycobacterium tuberculosis
GLPTSRLDSLLVRLSRDAGFQIVLARHE

SEQ ID NO: 1453274 - protein, 30 aa, Mycobacterium tuberculosis; identical to SEQ ID NO: 209583

SEQ ID NO: 1453275 - protein, 18 aa, Mycobacterium tuberculosis
IIIADTKFEFGIDRHGNL

SEQ ID NO: 1453276 - protein, 23 aa, Mycobacterium tuberculosis
LAALEAFFSAVVWTLVTEDIARI

SEQ ID NO: 1453277 - protein, 25 aa, Mycobacterium tuberculosis
LAANARIALHVRVLYGRDPHHITEA

SEQ ID NO: 1453278 - protein, 20 aa, Mycobacterium tuberculosis
LALQEVRQILAIHDRGEAPC

SEQ ID NO: 1453279 - protein, 18 aa, Mycobacterium tuberculosis
LASIPRGPVHIALPRDLV

SEQ ID NO: 1453280 - protein, 18 aa, Mycobacterium tuberculosis
LGSHASFDLTVRATGDVE

SEQ ID NO: 1453281 - protein, 22 aa, Mycobacterium tuberculosis
LIPDQRAGCSLADSITPDELRA

SEQ ID NO: 1453282 - protein, 19 aa, Mycobacterium tuberculosis
LPADPRRGGQLVSLPPGAG

SEQ ID NO: 1453283 - protein, 20 aa, Mycobacterium tuberculosis
LSFSRPATWASKAAGPLGAV

SEQ ID NO: 1453284 - protein, 19 aa, Mycobacterium tuberculosis
RAGVSRPTVYRRWPDTRSI

SEQ ID NO: 1453285 - protein, 19 aa, Mycobacterium tuberculosis
REVLFCPDQFLGAHVRRVT

SEQ ID NO: 1453286 - protein, 17 aa, Mycobacterium tuberculosis
RGSWRGRDFTGTEYVDA

SEQ ID NO: 1453287 - protein, 22 aa, Mycobacterium tuberculosis
RHPEVFRDASPIQRVTRNAPPF

SEQ ID NO: 1453288 - protein, 21 aa, Mycobacterium tuberculosis
RRFARHYVHAGMIGWDGHKMS

SEQ ID NO: 1453289 - protein, 18 aa, Mycobacterium tuberculosis
RRWPDTRSIMASMLTSHI

SEQ ID NO: 1453290 - protein, 25 aa, Mycobacterium tuberculosis
RVVEMGGPFSLELCGGTHVSNTAQI

SEQ ID NO: 1453291 - protein, 19 aa, Mycobacterium tuberculosis
SFDRVVEMVGALRANQLRD

SEQ ID NO: 1453292 - protein, 24 aa, Mycobacterium tuberculosis
SINDCLIAALAIRHGARIVHRDAD

SEQ ID NO: 1453293 - protein, 29 aa, Mycobacterium tuberculosis
TDMPGVTPAMWAWWFGWHGSDTRRYKLWH

SEQ ID NO: 1453294 - protein, 24 aa, Mycobacterium tuberculosis
TGPFFLLDIDSFWTPSGGSIPEYN

SEQ ID NO: 1453295 - protein, 18 aa, Mycobacterium tuberculosis
TSASAGWDTVLQSITTIL

SEQ ID NO: 1453296 - protein, 26 aa, Mycobacterium tuberculosis
VAEISARLDLPVGVARVLVGDLVTSG

SEQ ID NO: 1453297 - protein, 23 aa, Mycobacterium tuberculosis
VESGWRPGDSVILAAAGASDRRA

SEQ ID NO: 1453298 - protein, 20 aa, Mycobacterium tuberculosis
WVVRVVLSLMYWPAENDEAE

SEQ ID NO: 1453299 - protein, 27 aa, Mycobacterium tuberculosis
AAAELPRIAGMGFDVVYLPPIHPIGKV

SEQ ID NO: 1453300 - protein, 20 aa, Mycobacterium tuberculosis
AAAGKRARDVGVRIVYVVDT

SEQ ID NO: 1453301 - protein, 18 aa, Mycobacterium tuberculosis
AAAPLALLAPRARLAGAS

SEQ ID NO: 1453302 - protein, 23 aa, Mycobacterium tuberculosis
AAAPPRFDGLRALFINATLKRSP

SEQ ID NO: 1453303 - protein, 31 aa, Mycobacterium tuberculosis; identical to SEQ ID NO: 195749

SEQ ID NO: 1453304 - protein, 18 aa, Mycobacterium tuberculosis
AADHVWLMSTASYPEMAT

SEQ ID NO: 1453305 - protein, 17 aa, Mycobacterium tuberculosis
AAGEAMMRQALAQLTAA

SEQ ID NO: 1453306 - protein, 20 aa, Mycobacterium tuberculosis
AAGIPIRIGVNAGSLDKRFM

SEQ ID NO: 1453307 - protein, 24 aa, Mycobacterium tuberculosis
AAGLRSLLAYQWAHPGKQLLFMGQ

SEQ ID NO: 1453308 - protein, 18 aa, Mycobacterium tuberculosis
AAGLRVVATIDIGSSVRD

SEQ ID NO: 1453309 - protein, 18 aa, Mycobacterium tuberculosis
AAHTEYDTGLSLSAVCAL

SEQ ID NO: 1453310 - protein, 26 aa, Mycobacterium tuberculosis
AAIDLQRYGLTWKWPDVDCAHPLDDG

SEQ ID NO: 1453311 - protein, 17 aa, Mycobacterium tuberculosis
AAIDSDAAWQAPANDAG

SEQ ID NO: 1453312 - protein, 18 aa, Mycobacterium tuberculosis
AAILLGDLAQVWADDIVS

SEQ ID NO: 1453313 - protein, 19 aa, Mycobacterium tuberculosis
AAITPIGQRSWRMFAPFLR

SEQ ID NO: 1453314 - protein, 28 aa, Mycobacterium tuberculosis
AAKGTFRLAFGIGDFRRDTGFGEDPATL

SEQ ID NO: 1453315 - protein, 27 aa, Mycobacterium tuberculosis
AAKVERPDLVIGWWAAPTILEHGTPEQ

SEQ ID NO: 1453316 - protein, 22 aa, Mycobacterium tuberculosis
AALDRFGPPAGDPAWVVKDDRL

SEQ ID NO: 1453317 - protein, 19 aa, Mycobacterium tuberculosis
AALPDRPATSFVGGRLSGT

SEQ ID NO: 1453318 - protein, 24 aa, Mycobacterium tuberculosis
AALPEVACTVWSNLVMTAHLRPGQ

SEQ ID NO: 1453319 - protein, 23 aa, Mycobacterium tuberculosis
AALPGCQTLAVFVHALPNIEPER

SEQ ID NO: 1453320 - protein, 18 aa, Mycobacterium tuberculosis
AALPKLPSFSLTSTSITD

SEQ ID NO: 1453321 - protein, 18 aa, Mycobacterium tuberculosis
AALWKAAGITSPIDEIDA

SEQ ID NO: 1453322 - protein, 25 aa, Mycobacterium tuberculosis
AAMRLRPGERHWMAFRQLASDVDAN

SEQ ID NO: 1453323 - protein, 20 aa, Mycobacterium tuberculosis
AAMVEKGRRVLLVDLDPQGC

SEQ ID NO: 1453324 - protein, 27 aa, Mycobacterium tuberculosis
AANIRRLRRPDPYKGKGVRYEGEQIRR

SEQ ID NO: 1453325 - protein, 24 aa, Mycobacterium tuberculosis
AAPESTCREFAGLVDDVVCATMPT

SEQ ID NO: 1453326 - protein, 22 aa, Mycobacterium tuberculosis
AAPGSLLGGLPLAGAGGAGAGP

SEQ ID NO: 1453327 - protein, 20 aa, Mycobacterium tuberculosis
AAQGRAVYCWNVDEYEDIDF

SEQ ID NO: 1453328 - protein, 23 aa, Mycobacterium tuberculosis
AAQREFTRILGLLPDLHGEVDRW

SEQ ID NO: 1453329 - protein, 19 aa, Mycobacterium tuberculosis
AAQSWDLVRDGVFVGYQLD

SEQ ID NO: 1453330 - protein, 21 aa, Mycobacterium tuberculosis
AARHHRRSFVADRLGTGTAVL

SEQ ID NO: 1453331 - protein, 25 aa, Mycobacterium tuberculosis
AASPKETWLRLLLIDAGLPVPTTQI

SEQ ID NO: 1453332 - protein, 21 aa, Mycobacterium tuberculosis
AATGKPSWFLFDGLVKHDLLT

SEQ ID NO: 1453333 - protein, 18 aa, Mycobacterium tuberculosis
AATLRAGLRERLGVTVAV

SEQ ID NO: 1453334 - protein, 18 aa, Mycobacterium tuberculosis
AATSVHFVAPQSIDARLA

SEQ ID NO: 1453335 - protein, 21 aa, Mycobacterium tuberculosis
AAVAAAAPWLRDGDVVVVTSK

SEQ ID NO: 1453336 - protein, 21 aa, Mycobacterium tuberculosis
AAVADRCSWRRWWPDLRLQVT

SEQ ID NO: 1453337 - protein, 25 aa, Mycobacterium tuberculosis
AAVEEFRFHVGLARAAGNTMLDLFL

SEQ ID NO: 1453338 - protein, 26 aa, Mycobacterium tuberculosis
AAYRQLRYFWSRVIADTGWQLLDSKF

SEQ ID NO: 1453339 - protein, 22 aa, Mycobacterium tuberculosis
ACPSTWPWNLLGWPSINVPAGF

SEQ ID NO: 1453340 - protein, 26 aa, Mycobacterium tuberculosis
ADAARRFPVPIAMFAELIDGARMEID

SEQ ID NO: 1453341 - protein, 24 aa, Mycobacterium tuberculosis
ADAAWRAAFDHEQTCVAIIKHANP

SEQ ID NO: 1453342 - protein, 23 aa, Mycobacterium tuberculosis
ADAKRLRSIRGREIGYVPQDPMT

SEQ ID NO: 1453343 - protein, 26 aa, Mycobacterium tuberculosis
ADAPAAWRRYLEAGILIRDVGIPGYL

SEQ ID NO: 1453344 - protein, 35 aa, Mycobacterium tuberculosis; identical to SEQ ID NO: 195965

SEQ ID NO: 1453345 - protein, 25 aa, Mycobacterium tuberculosis
ADATLTRFLGIGVRTVLSQGSYLAR

SEQ ID NO: 1453346 - protein, 26 aa, Mycobacterium tuberculosis
ADGERRPGWVGLPLAGVQTRLVDDDG

SEQ ID NO: 1453347 - protein, 26 aa, Mycobacterium tuberculosis
ADGKEIAGRLAARIGSGLLVDVVDVR

SEQ ID NO: 1453348 - protein, 23 aa, Mycobacterium tuberculosis
ADIDKRGKISLILVADEDSTAAA

SEQ ID NO: 1453349 - protein, 18 aa, Mycobacterium tuberculosis
ADIGFWCSGSSDYLAGRA

SEQ ID NO: 1453350 - protein, 17 aa, Mycobacterium tuberculosis
ADIRESIHLRALGRQNP

SEQ ID NO: 1453351 - protein, 18 aa, Mycobacterium tuberculosis
ADLDRLGVEVLLDDRQAS

SEQ ID NO: 1453352 - protein, 21 aa, Mycobacterium tuberculosis
ADLGFPLSIHLEATYGVSAAA

SEQ ID NO: 1453353 - protein, 17 aa, Mycobacterium tuberculosis
ADLIEWRRKHEKHIERV

SEQ ID NO: 1453354 - protein, 24 aa, Mycobacterium tuberculosis
ADLRADWPTALGAAGFDPTQPTAW

SEQ ID NO: 1453355 - protein, 23 aa, Mycobacterium tuberculosis
ADLRDARLRLAADDLVSRRAERE

SEQ ID NO: 1453356 - protein, 21 aa, Mycobacterium tuberculosis
ADLRTDWPTPLTAAGFDPQRP

SEQ ID NO: 1453357 - protein, 30 aa, Mycobacterium tuberculosis; identical to SEQ ID NO: 196027

SEQ ID NO: 1453358 - protein, 23 aa, Mycobacterium tuberculosis
ADNPVLCDLILIRAALSPKTARL

SEQ ID NO: 1453359 - protein, 25 aa, Mycobacterium tuberculosis
ADPDRYAAEMAHIIGCEPAEVLRVS

SEQ ID NO: 1453360 - protein, 25 aa, Mycobacterium tuberculosis
ADPEVVRALDMLFILHADHEQNCST

SEQ ID NO: 1453361 - protein, 31 aa, Mycobacterium tuberculosis; identical to SEQ ID NO: 196052

SEQ ID NO: 1453362 - protein, 27 aa, Mycobacterium tuberculosis
ADSLGWLRDFLRLHTGGLVVISHNVDL

SEQ ID NO: 1453363 - protein, 21 aa, Mycobacterium tuberculosis
ADSSRGALLIHGHLDVVPAEP

SEQ ID NO: 1453364 - protein, 20 aa, Mycobacterium tuberculosis
ADTGLRYTVYPGELSSSVGG

SEQ ID NO: 1453365 - protein, 29 aa, Mycobacterium tuberculosis
ADVALIVGVPMDFRLGFGGVFGSTTQLIV

SEQ ID NO: 1453366 - protein, 23 aa, Mycobacterium tuberculosis
ADVFELAGLLRRSGEVVAAREGH

SEQ ID NO: 1453367 - protein, 18 aa, Mycobacterium tuberculosis
ADVPVLLVCGHRAGRAAV

SEQ ID NO: 1453368 - protein, 23 aa, Mycobacterium tuberculosis
ADVRPEVVSFTFGAPPPDVVQRL

SEQ ID NO: 1453369 - protein, 23 aa, Mycobacterium tuberculosis
ADVSCLKALLEVRNEIVAAGHTP

SEQ ID NO: 1453370 - protein, 26 aa, Mycobacterium tuberculosis
ADWAEMLMRMYIRWAEQHKYPVEVFD

SEQ ID NO: 1453371 - protein, 21 aa, Mycobacterium tuberculosis
ADYRVCTPLPRVGEVEDVANL

SEQ ID NO: 1453372 - protein, 19 aa, Mycobacterium tuberculosis
AEAAPVMRAVASVLPGTGA

SEQ ID NO: 1453373 - protein, 29 aa, Mycobacterium tuberculosis
AEAKLGYPLSRAHTAAIIWSDELDGDHSY

SEQ ID NO: 1453374 - protein, 18 aa, Mycobacterium tuberculosis
AEGLLRYLPPEAQDRLLD

SEQ ID NO: 1453375 - protein, 28 aa, Mycobacterium tuberculosis
AEHLLAMLKARGSGQWASFSELVADCTA

SEQ ID NO: 1453376 - protein, 24 aa, Mycobacterium tuberculosis
AEHPSSGVAFVLGERLGRVDVSEL

SEQ ID NO: 1453377 - protein, 18 aa, Mycobacterium tuberculosis
AEHSFPYEIVAKMGEMGL

SEQ ID NO: 1453378 - protein, 19 aa, Mycobacterium tuberculosis
AEIAWLRAELDTAREVIRV

SEQ ID NO: 1453379 - protein, 22 aa, Mycobacterium tuberculosis
AEIDMRCLLIVGSSQTRWYSVD

SEQ ID NO: 1453380 - protein, 25 aa, Mycobacterium tuberculosis
AEIDNLRAAFTWSRGNGDIAAALQL

SEQ ID NO: 1453381 - protein, 17 aa, Mycobacterium tuberculosis
AEIGFPVRRRKDADTYA

SEQ ID NO: 1453382 - protein, 25 aa, Mycobacterium tuberculosis
AELARSTGWTGLIVHGAVRDAAALR

SEQ ID NO: 1453383 - protein, 18 aa, Mycobacterium tuberculosis
AELGRRHELLSGLVPQIS

SEQ ID NO: 1453384 - protein, 20 aa, Mycobacterium tuberculosis
AELPHRCVIDGEIIIATDHG

SEQ ID NO: 1453385 - protein, 26 aa, Mycobacterium tuberculosis
AELVARVKALLRRRGSTATSSSETIT

SEQ ID NO: 1453386 - protein, 25 aa, Mycobacterium tuberculosis
AEPTARRILRHFGIEQHFEVIAGAS

SEQ ID NO: 1453387 - protein, 21 aa, Mycobacterium tuberculosis
AERIGALLFEVNRRFGTPVPP

SEQ ID NO: 1453388 - protein, 25 aa, Mycobacterium tuberculosis
AERREVWRLLASFRVQPATEVIARR

SEQ ID NO: 1453389 - protein, 19 aa, Mycobacterium tuberculosis
AESGLRFSGTSPDGHLVEF

SEQ ID NO: 1453390 - protein, 20 aa, Mycobacterium tuberculosis
AESIQHTWFGLSALAERVDA

SEQ ID NO: 1453391 - protein, 22 aa, Mycobacterium tuberculosis
AETALPRLLAALQHAGVTVHLD

SEQ ID NO: 1453392 - protein, 19 aa, Mycobacterium tuberculosis
AEVYLDLVRQVPCVTDVNV

SEQ ID NO: 1453393 - protein, 17 aa, Mycobacterium tuberculosis
AFEGKWDGYRLLVEADH

SEQ ID NO: 1453394 - protein, 19 aa, Mycobacterium tuberculosis
AFFCVVDLHAITIPQDPEA

SEQ ID NO: 1453395 - protein, 26 aa, Mycobacterium tuberculosis
AFGLPSRLRLGVCVTDAGRRNPAVTA

SEQ ID NO: 1453396 - protein, 29 aa, Mycobacterium tuberculosis
AFHRPGPRLRYLLAVKACFAVFQTGTPDH

SEQ ID NO: 1453397 - protein, 26 aa, Mycobacterium tuberculosis
AFKVDFAIEGDVGWTNPDCRRAGTVH

SEQ ID NO: 1453398 - protein, 18 aa, Mycobacterium tuberculosis
AFPPMAVSVRLADDIDIS

SEQ ID NO: 1453399 - protein, 29 aa, Mycobacterium tuberculosis
AFQRIKEPFSRWASLLIHAGEPGAGTRMK

SEQ ID NO: 1453400 - protein, 24 aa, Mycobacterium tuberculosis
AFTASPFRWLSWLSDSGATMTAAP

SEQ ID NO: 1453401 - protein, 24 aa, Mycobacterium tuberculosis
AGAPVGCGFITWSLARQPQLLDLA

SEQ ID NO: 1453402 - protein, 20 aa, Mycobacterium tuberculosis
AGFHTLKLQTFLTAGPKEAR

SEQ ID NO: 1453403 - protein, 23 aa, Mycobacterium tuberculosis
AGGKRFRPLFTVLSAQIGPQPDA

SEQ ID NO: 1453404 - protein, 25 aa, Mycobacterium tuberculosis
AGLEAAKPFIAALCTAQQELADAAG

SEQ ID NO: 1453405 - protein, 17 aa, Mycobacterium tuberculosis
AGLELLYRMADFCRPDW

SEQ ID NO: 1453406 - protein, 24 aa, Mycobacterium tuberculosis
AGLQARLGLDSGKWTHEQMARVAF

SEQ ID NO: 1453407 - protein, 17 aa, Mycobacterium tuberculosis
AGLWEWAERLGDEVTLD

SEQ ID NO: 1453408 - protein, 24 aa, Mycobacterium tuberculosis
AGPLPLQIICDMMGIPKADHQRIF

SEQ ID NO: 1453409 - protein, 24 aa, Mycobacterium tuberculosis
AGRHRCVGAAFAIMQIKAIFSVLL

SEQ ID NO: 1453410 - protein, 25 aa, Mycobacterium tuberculosis
AGRIVSFDAAGGWNIEEEGYQAVGS

SEQ ID NO: 1453411 - protein, 19 aa, Mycobacterium tuberculosis
AGRLHILEVQRLIRFMPKV

SEQ ID NO: 1453412 - protein, 26 aa, Mycobacterium tuberculosis
AGRTWHPHQVPAFLAAGYRCITFDNR

SEQ ID NO: 1453413 - protein, 19 aa, Mycobacterium tuberculosis
AGSALQIHGAIAFTWEHDL

SEQ ID NO: 1453414 - protein, 20 aa, Mycobacterium tuberculosis
AGVPLKAPVAGIAMGLVSDD

SEQ ID NO: 1453415 - protein, 25 aa, Mycobacterium tuberculosis
AHAAILPLYYLRRAGIAESDLQVIR

SEQ ID NO: 1453416 - protein, 17 aa, Mycobacterium tuberculosis
AHGPYAVGITGEDAQLF

SEQ ID NO: 1453417 - protein, 25 aa, Mycobacterium tuberculosis
AHSPKRLESELTWIEEHTGGKPYGV

SEQ ID NO: 1453418 - protein, 31 aa, Mycobacterium tuberculosis; identical to SEQ ID NO: 196477

SEQ ID NO: 1453419 - protein, 30 aa, Mycobacterium tuberculosis; identical to SEQ ID NO: 196484

SEQ ID NO: 1453420 - protein, 22 aa, Mycobacterium tuberculosis
AIHRRCRRGGDTVRSLIDCQVA

SEQ ID NO: 1453421 - protein, 23 aa, Mycobacterium tuberculosis
AITGCLIAGVPVVPVPADVGVTE

SEQ ID NO: 1453422 - protein, 17 aa, Mycobacterium tuberculosis
AKASLGQQVPHPSRLGN

SEQ ID NO: 1453423 - protein, 26 aa, Mycobacterium tuberculosis
AKGHDTFCPVGPWIVTDLAPFDPADL

SEQ ID NO: 1453424 - protein, 21 aa, Mycobacterium tuberculosis
AKKPVVTDFCDFRTAEQRERA

SEQ ID NO: 1453425 - protein, 17 aa, Mycobacterium tuberculosis
AKLPFVRELCRDYQHID

SEQ ID NO: 1453426 - protein, 25 aa, Mycobacterium tuberculosis
AKLQKRLTEELAWVRSGAKARQAKS

SEQ ID NO: 1453427 - protein, 22 aa, Mycobacterium tuberculosis
AKNLPARPAVPVLSGVLLTGSD

SEQ ID NO: 1453428 - protein, 22 aa, Mycobacterium tuberculosis
AKRTLAVAVYNHYKRIQAGEKG

SEQ ID NO: 1453429 - protein, 30 aa, Mycobacterium tuberculosis; identical to SEQ ID NO: 196549

SEQ ID NO: 1453430 - protein, 23 aa, Mycobacterium tuberculosis
AKVRPGVPVIFLDTGYHFVETIG

SEQ ID NO: 1453431 - protein, 19 aa, Mycobacterium tuberculosis
ALAALLARHRSAEVDASYA

SEQ ID NO: 1453432 - protein, 24 aa, Mycobacterium tuberculosis
ALADPRRVPVWLPYIRGERTPFHE

SEQ ID NO: 1453433 - protein, 23 aa, Mycobacterium tuberculosis
ALALRAAEYGRTVVVLTIDPAKR

SEQ ID NO: 1453434 - protein, 19 aa, Mycobacterium tuberculosis
ALAQCLRGGTPDEVAKLVL

SEQ ID NO: 1453435 - protein, 24 aa, Mycobacterium tuberculosis
ALAQLRPLPERLVMVGDRSHDVDG

SEQ ID NO: 1453436 - protein, 24 aa, Mycobacterium tuberculosis
ALDTFTLRVGRPIGPMLAQTATSV

SEQ ID NO: 1453437 - protein, 19 aa, Mycobacterium tuberculosis
ALDYEIWDDGWTVVTKDRK

SEQ ID NO: 1453438 - protein, 19 aa, Mycobacterium tuberculosis
ALGDMGLVPAMTVKCAVAL

SEQ ID NO: 1453439 - protein, 19 aa, Mycobacterium tuberculosis
ALHAWSDVDVSEWPGIDWP

SEQ ID NO: 1453440 - protein, 18 aa, Mycobacterium tuberculosis
ALHRVGVSVWERYTGPYT

SEQ ID NO: 1453441 - protein, 18 aa, Mycobacterium tuberculosis
ALIALAMLALGGRRPALP

SEQ ID NO: 1453442 - protein, 24 aa, Mycobacterium tuberculosis
ALIARWLAEPGVRIVGVSNDAAGL

SEQ ID NO: 1453443 - protein, 32 aa, Mycobacterium tuberculosis; identical to SEQ ID NO: 196639

SEQ ID NO: 1453444 - protein, 27 aa, Mycobacterium tuberculosis
ALLFTAGLWSVWKSYRSAPPLLSCTVI

SEQ ID NO: 1453445 - protein, 23 aa, Mycobacterium tuberculosis
ALLNFPGCAVVISHDRWFLDRTC

SEQ ID NO: 1453446 - protein, 25 aa, Mycobacterium tuberculosis
ALPARSRSALGWIIERYRVTTDKAS

SEQ ID NO: 1453447 - protein, 17 aa, Mycobacterium tuberculosis
ALPEYAKDIKLNLSSIT

SEQ ID NO: 1453448 - protein, 18 aa, Mycobacterium tuberculosis
ALQHSYPGLARVIKEHAN

SEQ ID NO: 1453449 - protein, 17 aa, Mycobacterium tuberculosis
ALQRLAAGLGVPHPDTE

SEQ ID NO: 1453450 - protein, 27 aa, Mycobacterium tuberculosis
ALRHRGSLRRFVPFDVDASVLSATATA

SEQ ID NO: 1453451 - protein, 19 aa, Mycobacterium tuberculosis
ALRLPELDLAAGMDSAREW

SEQ ID NO: 1453452 - protein, 25 aa, Mycobacterium tuberculosis
ALSPRAGQAGYLWQSITRGLRVTPI

SEQ ID NO: 1453453 - protein, 19 aa, Mycobacterium tuberculosis
ALSTLRDIYGAALGYQVDA

SEQ ID NO: 1453454 - protein, 24 aa, Mycobacterium tuberculosis
ALVAANRALVAWLAGSNVFGQNTP

SEQ ID NO: 1453455 - protein, 26 aa, Mycobacterium tuberculosis
ALVNSWSAAFARYGRTVGQVLLTAHD

SEQ ID NO: 1453456 - protein, 20 aa, Mycobacterium tuberculosis
AMLPGGRRRALLTGTVAVVG

SEQ ID NO: 1453457 - protein, 19 aa, Mycobacterium tuberculosis
AMSGIYRRQLALIRASPAV

SEQ ID NO: 1453458 - protein, 20 aa, Mycobacterium tuberculosis
AMSVGPWQGIAAWDVSTGEP

SEQ ID NO: 1453459 - protein, 19 aa, Mycobacterium tuberculosis
AMYLCRELTDLSLPKIGQA

SEQ ID NO: 1453460 - protein, 18 aa, Mycobacterium tuberculosis
ANRARRVAAAQAKAKKAA

SEQ ID NO: 1453461 - protein, 21 aa, Mycobacterium tuberculosis
APCAHVRQLLSTRIDEVRAQI

SEQ ID NO: 1453462 - protein, 26 aa, Mycobacterium tuberculosis
APDAGLRLARRFAHLTYRGEIELDTR

SEQ ID NO: 1453463 - protein, 20 aa, Mycobacterium tuberculosis
APDFRLFWDNAYAVHTLTLD

SEQ ID NO: 1453464 - protein, 20 aa, Mycobacterium tuberculosis
APDRNLAMELVRVTEAGAMA

SEQ ID NO: 1453465 - protein, 25 aa, Mycobacterium tuberculosis
APEIYRAPLSYPYRDGLLDKQLATN

SEQ ID NO: 1453466 - protein, 17 aa, Mycobacterium tuberculosis
APGALRWLPIDPVSNAG

SEQ ID NO: 1453467 - protein, 20 aa, Mycobacterium tuberculosis
APGSRVALGALGSRLDHEQL

SEQ ID NO: 1453468 - protein, 24 aa, Mycobacterium tuberculosis
APHHTRPTRFVWLQTPAIRARLLD

SEQ ID NO: 1453469 - protein, 23 aa, Mycobacterium tuberculosis
APHKRTGIDVALALLTPIVGQEF

SEQ ID NO: 1453470 - protein, 18 aa, Mycobacterium tuberculosis
APLFPLVVVVHADVELRV

SEQ ID NO: 1453471 - protein, 24 aa, Mycobacterium tuberculosis
APNVWALGDVASWRDPMGHQARVE

SEQ ID NO: 1453472 - protein, 20 aa, Mycobacterium tuberculosis
APTHIAAAFDVSRQTFRLQR

SEQ ID NO: 1453473 - protein, 19 aa, Mycobacterium tuberculosis
AQAFGKIRPVTSMVEVTAL

SEQ ID NO: 1453474 - protein, 27 aa, Mycobacterium tuberculosis
AQEGHPGHGPRYLWTRTVAGRGTKGRQ

SEQ ID NO: 1453475 - protein, 27 aa, Mycobacterium tuberculosis
AQGRTPLPFYVWRAFARYSPVLPAGRL

SEQ ID NO: 1453476 - protein, 21 aa, Mycobacterium tuberculosis
AQGTSRWLVAVRMVSEGVDVP

SEQ ID NO: 1453477 - protein, 17 aa, Mycobacterium tuberculosis
AQIILSVGVRVVDVPVQ

SEQ ID NO: 1453478 - protein, 19 aa, Mycobacterium tuberculosis
AQLQRRLGTTTVYVTHDQT

SEQ ID NO: 1453479 - protein, 18 aa, Mycobacterium tuberculosis
AQLRSYWARPLPATIVMR

SEQ ID NO: 1453480 - protein, 18 aa, Mycobacterium tuberculosis
AQNGRYGPYLKRGNDSRS

SEQ ID NO: 1453481 - protein, 19 aa, Mycobacterium tuberculosis
AQPYFAEAIELARAINDEW

SEQ ID NO: 1453482 - protein, 27 aa, Mycobacterium tuberculosis
AQRLRPCTRFGQRLRLRPFDLGAPKWV

SEQ ID NO: 1453483 - protein, 18 aa, Mycobacterium tuberculosis
AQVLRGKYLVDVQSVTKV

SEQ ID NO: 1453484 - protein, 17 aa, Mycobacterium tuberculosis
AQVRQWLAAHLPAADLR

SEQ ID NO: 1453485 - protein, 19 aa, Mycobacterium tuberculosis
AQYERAWGTIEALKEKDEA

SEQ ID NO: 1453486 - protein, 26 aa, Mycobacterium tuberculosis
AQYPRVDPALLLNCMLLAATERSVTG

SEQ ID NO: 1453487 - protein, 19 aa, Mycobacterium tuberculosis
ARAALTRAIHKLPIKARII

SEQ ID NO: 1453488 - protein, 21 aa, Mycobacterium tuberculosis
ARAHGADMLLLIVAALEQSVL

SEQ ID NO: 1453489 - protein, 24 aa, Mycobacterium tuberculosis
ARAMGMRNRVTWRVTKWDPPHEVA

SEQ ID NO: 1453490 - protein, 24 aa, Mycobacterium tuberculosis
ARANSDLTGLVAMFKGILDAEPTY

SEQ ID NO: 1453491 - protein, 18 aa, Mycobacterium tuberculosis
ARCELDVVYVFRPGDEGR

SEQ ID NO: 1453492 - protein, 23 aa, Mycobacterium tuberculosis
AREGRFGPYVTEILPEPAADAAA

SEQ ID NO: 1453493 - protein, 19 aa, Mycobacterium tuberculosis
ARFIGGMLACIAIAIHELT

SEQ ID NO: 1453494 - protein, 22 aa, Mycobacterium tuberculosis
ARFIGGVLACCGLAEHELTGTT

SEQ ID NO: 1453495 - protein, 19 aa, Mycobacterium tuberculosis
ARFVDFLERVVVQRTIDRH

SEQ ID NO: 1453496 - protein, 19 aa, Mycobacterium tuberculosis
ARFVRECARVLRGSGLLMV

SEQ ID NO: 1453497 - protein, 29 aa, Mycobacterium tuberculosis
ARGFPVTDFNVSLPWTKMVVLNPGVQTES

SEQ ID NO: 1453498 - protein, 24 aa, Mycobacterium tuberculosis
ARGGKLAGILAEVAQPFVVLGVGL

SEQ ID NO: 1453499 - protein, 23 aa, Mycobacterium tuberculosis
ARHVSAVLGRRVGPSTGTNLWGA

SEQ ID NO: 1453500 - protein, 23 aa, Mycobacterium tuberculosis
ARIRRFAHPVLLERSRAAELATA

SEQ ID NO: 1453501 - protein, 25 aa, Mycobacterium tuberculosis
ARKAGYEVLERVGLDPKVATRYPAQ

SEQ ID NO: 1453502 - protein, 19 aa, Mycobacterium tuberculosis
ARKTRYVDHGWPTTDPDDH

SEQ ID NO: 1453503 - protein, 19 aa, Mycobacterium tuberculosis
ARLACGRVGDGLRGFRASL

SEQ ID NO: 1453504 - protein, 20 aa, Mycobacterium tuberculosis
ARLASCRDALLPLLMSGIDG

SEQ ID NO: 1453505 - protein, 19 aa, Mycobacterium tuberculosis
ARLPFVGIAEAYVLNAFRR

SEQ ID NO: 1453506 - protein, 20 aa, Mycobacterium tuberculosis
ARLTILEVMAEAIDRPDEMS

SEQ ID NO: 1453507 - protein, 19 aa, Mycobacterium tuberculosis
ARQQLLALREEVDRLGQPP

SEQ ID NO: 1453508 - protein, 28 aa, Mycobacterium tuberculosis
ARRFAIPAVESKGALLLEDVGVPLPALG

SEQ ID NO: 1453509 - protein, 19 aa, Mycobacterium tuberculosis
ARRNMPILAVHTGEGKGKS

SEQ ID NO: 1453510 - protein, 19 aa, Mycobacterium tuberculosis
ARRRRLMVDLYKRVLDGVA

SEQ ID NO: 1453511 - protein, 29 aa, Mycobacterium tuberculosis
ARRVGRPRIRLAYRLTPRRVLGQRRAGGV

SEQ ID NO: 1453512 - protein, 21 aa, Mycobacterium tuberculosis
ARSPLGRKLGRRWHRETVYGV

SEQ ID NO: 1453513 - protein, 20 aa, Mycobacterium tuberculosis
ARTHAIGQIVPGKVTKLVPF

SEQ ID NO: 1453514 - protein, 21 aa, Mycobacterium tuberculosis
ARTRIRPHFFPFTEPSAEVDV

SEQ ID NO: 1453515 - protein, 24 aa, Mycobacterium tuberculosis
ARVALRAGFAFVRRICEQDGTVFD

SEQ ID NO: 1453516 - protein, 19 aa, Mycobacterium tuberculosis
ARVDGRTVGVVANQPMHMS

SEQ ID NO: 1453517 - protein, 24 aa, Mycobacterium tuberculosis
ARVGELRALVAPADAVFLDAAIES

SEQ ID NO: 1453518 - protein, 25 aa, Mycobacterium tuberculosis
ARVGFSVALGEHLACGPQAIRARLA

SEQ ID NO: 1453519 - protein, 18 aa, Mycobacterium tuberculosis
ARVPERFRGDVEPVDAVA

SEQ ID NO: 1453520 - protein, 19 aa, Mycobacterium tuberculosis
ARVSTPLHWEEVPGCDPAV

SEQ ID NO: 1453521 - protein, 21 aa, Mycobacterium tuberculosis
ARWPELRALLTEAFASHDRDH

SEQ ID NO: 1453522 - protein, 19 aa, Mycobacterium tuberculosis
ARYRRAVRARGHFPNEQSA

SEQ ID NO: 1453523 - protein, 21 aa, Mycobacterium tuberculosis
ASARCLAAYVYAAAGEGESTT

SEQ ID NO: 1453524 - protein, 21 aa, Mycobacterium tuberculosis
ASDLPGFVLHVEICEDMFVPM

SEQ ID NO: 1453525 - protein, 18 aa, Mycobacterium tuberculosis
ASECGWATPSAFIDTYRQ

SEQ ID NO: 1453526 - protein, 20 aa, Mycobacterium tuberculosis
ASGPRLTAYVAGGPQPPPVA

SEQ ID NO: 1453527 - protein, 17 aa, Mycobacterium tuberculosis
ASGVRMLLDAAKQVSGI

SEQ ID NO: 1453528 - protein, 19 aa, Mycobacterium tuberculosis
ASIGDAWAADVVVKVAPPT

SEQ ID NO: 1453529 - protein, 21 aa, Mycobacterium tuberculosis
ASLDRWLARWQPRYPDVRVQS

SEQ ID NO: 1453530 - protein, 25 aa, Mycobacterium tuberculosis
ASLPPEFRAAVVLCDIEGLSYEEIG

SEQ ID NO: 1453531 - protein, 23 aa, Mycobacterium tuberculosis
ASNAGGLFLNWVDRVIGPGDPAL

SEQ ID NO: 1453532 - protein, 24 aa, Mycobacterium tuberculosis
ASPAAVCPHVEWALSSTLQAKANL

SEQ ID NO: 1453533 - protein, 25 aa, Mycobacterium tuberculosis
ASQYKDVILGLVFLKYVSDAYDERR

SEQ ID NO: 1453534 - protein, 24 aa, Mycobacterium tuberculosis
ASTPLFFAQAIGRFVRSRRPGETA

SEQ ID NO: 1453535 - protein, 24 aa, Mycobacterium tuberculosis
ASVVGRLSVPASWSTAAPATAAGA

SEQ ID NO: 1453536 - protein, 18 aa, Mycobacterium tuberculosis
ATASRLTPFTAPPQTTNP

SEQ ID NO: 1453537 - protein, 18 aa, Mycobacterium tuberculosis
ATFPETQILAAFGQTEMS

SEQ ID NO: 1453538 - protein, 29 aa, Mycobacterium tuberculosis
ATGKLADFGELRWRDGVAVTVVLAAENYP

SEQ ID NO: 1453539 - protein, 26 aa, Mycobacterium tuberculosis
ATHLDPRLLIEFCLLATQYDAIAATI

SEQ ID NO: 1453540 - protein, 18 aa, Mycobacterium tuberculosis
ATIRPYRPSVSADLPPSA

SEQ ID NO: 1453541 - protein, 25 aa, Mycobacterium tuberculosis
ATMARPDLTFDLVRPGIAVYGLSPV

SEQ ID NO: 1453542 - protein, 18 aa, Mycobacterium tuberculosis
ATMHPSRYLTLIEGVTAV

SEQ ID NO: 1453543 - protein, 27 aa, Mycobacterium tuberculosis
ATMSPAWGMYCGYELFEHRAVREGSEE

SEQ ID NO: 1453544 - protein, 18 aa, Mycobacterium tuberculosis
ATPEALVESALWEASLFE

SEQ ID NO: 1453545 - protein, 20 aa, Mycobacterium tuberculosis
ATQAIPAYEPEPGKPAPAAV

SEQ ID NO: 1453546 - protein, 25 aa, Mycobacterium tuberculosis
ATQQYPLDRLKAIGAQYDATINDVA

SEQ ID NO: 1453547 - protein, 18 aa, Mycobacterium tuberculosis
ATQRCGEAGRTLRIPSPR

SEQ ID NO: 1453548 - protein, 29 aa, Mycobacterium tuberculosis
ATTCAPLTWPEGWRRWPQRVYGDTRLELA

SEQ ID NO: 1453549 - protein, 29 aa, Mycobacterium tuberculosis
AVADSFYLPLVVRRRIWFLAKSEYFTGTG

SEQ ID NO: 1453550 - protein, 19 aa, Mycobacterium tuberculosis
AVAGRRGGVTVATNMAGRG

SEQ ID NO: 1453551 - protein, 24 aa, Mycobacterium tuberculosis
AVALQIAALRARYLSRDDVPEDIV

SEQ ID NO: 1453552 - protein, 18 aa, Mycobacterium tuberculosis
AVAPLCNAMSRLGGVTLS

SEQ ID NO: 1453553 - protein, 29 aa, Mycobacterium tuberculosis
AVAPMPGGFPIELGMTIRLAREKNYDLLL

SEQ ID NO: 1453554 - protein, 24 aa, Mycobacterium tuberculosis
AVDSGVKVGMVFGELVHGEVDVRI

SEQ ID NO: 1453555 - protein, 20 aa, Mycobacterium tuberculosis
AVDYLEIWDAQAWQNYQQIH

SEQ ID NO: 1453556 - protein, 19 aa, Mycobacterium tuberculosis
AVEAGERLGFLPGTLSEKI

SEQ ID NO: 1453557 - protein, 24 aa, Mycobacterium tuberculosis
AVENALKAAFDWKSRHNQAHGIDP

SEQ ID NO: 1453558 - protein, 42 aa, Mycobacterium tuberculosis; identical to SEQ ID NO: 197249

SEQ ID NO: 1453559 - protein, 19 aa, Mycobacterium tuberculosis
AVFEAEFGDGSALGLQIEY

SEQ ID NO: 1453560 - protein, 25 aa, Mycobacterium tuberculosis
AVFPRYHPRWAWWLTSVPVLREFLV

SEQ ID NO: 1453561 - protein, 26 aa, Mycobacterium tuberculosis
AVIGRELDRYLPFLATTKVLMAAVRA

SEQ ID NO: 1453562 - protein, 25 aa, Mycobacterium tuberculosis
AVIVCPIGFVADHIEVVWDLDHELR

SEQ ID NO: 1453563 - protein, 25 aa, Mycobacterium tuberculosis
AVNGPAIGGGLCLALAADIRVASSS

SEQ ID NO: 1453564 - protein, 18 aa, Mycobacterium tuberculosis
AVNNLALQALVAAFAADK

SEQ ID NO: 1453565 - protein, 17 aa, Mycobacterium tuberculosis
AVQAALWAVDEAASRDI

SEQ ID NO: 1453566 - protein, 23 aa, Mycobacterium tuberculosis
AVRELRPDLVLLDLMLPGMNGID

SEQ ID NO: 1453567 - protein, 25 aa, Mycobacterium tuberculosis
AVRPEPFGALLYHFGTRKLSFLKNR

SEQ ID NO: 1453568 - protein, 21 aa, Mycobacterium tuberculosis
AVSFWRAVQTQVWRGHPDPKR

SEQ ID NO: 1453569 - protein, 19 aa, Mycobacterium tuberculosis
AVSLPSYGGSTLWANTAAA

SEQ ID NO: 1453570 - protein, 22 aa, Mycobacterium tuberculosis
AVSPEGLPAVPSVLARLDRFEI

SEQ ID NO: 1453571 - protein, 18 aa, Mycobacterium tuberculosis
AVSSHYEAPFAFTGGTIT

SEQ ID NO: 1453572 - protein, 24 aa, Mycobacterium tuberculosis
AVTTRLRFNFFVLKLPIRPPALVA

SEQ ID NO: 1453573 - protein, 17 aa, Mycobacterium tuberculosis
AVVLWEAQFGDFVNGAQ

SEQ ID NO: 1453574 - protein, 27 aa, Mycobacterium tuberculosis
AVVMSFSAAAVWRIRRAAPLLPTVLLG

SEQ ID NO: 1453575 - protein, 23 aa, Mycobacterium tuberculosis
AVYDFLNTRCLTIAGGTEQILLT

SEQ ID NO: 1453576 - protein, 25 aa, Mycobacterium tuberculosis
AVYRRMSLPDGRYVFTTRVIISARD

SEQ ID NO: 1453577 - protein, 18 aa, Mycobacterium tuberculosis
AWAALPRAGAVIFATGGM

SEQ ID NO: 1453578 - protein, 22 aa, Mycobacterium tuberculosis
AWNGRAGDYVAIPPTRHALHAV

SEQ ID NO: 1453579 - protein, 27 aa, Mycobacterium tuberculosis
AWRNDQWYTARLCPAPLRPEERQTTVV

SEQ ID NO: 1453580 - protein, 24 aa, Mycobacterium tuberculosis
AWRTALDPEGEWMPAVITAADRRL

SEQ ID NO: 1453581 - protein, 30 aa, Mycobacterium tuberculosis; identical to SEQ ID NO: 78436

SEQ ID NO: 1453582 - protein, 23 aa, Mycobacterium tuberculosis
AYLQGHLPGAVFVSLEDELSDHT

SEQ ID NO: 1453583 - protein, 17 aa, Mycobacterium tuberculosis
AYRADYSARGWAMNSLF

SEQ ID NO: 1453584 - protein, 20 aa, Mycobacterium tuberculosis
CALEVTWTQFGMRLAAIGAH

SEQ ID NO: 1453585 - protein, 20 aa, Mycobacterium tuberculosis
CAPDHPWAREHRQWFTELPD

SEQ ID NO: 1453586 - protein, 21 aa, Mycobacterium tuberculosis
CARVLRGSGLLMVSTPNRITF

SEQ ID NO: 1453587 - protein, 25 aa, Mycobacterium tuberculosis
CATMPTPFLAVGESFWDFRQVTDEE

SEQ ID NO: 1453588 - protein, 18 aa, Mycobacterium tuberculosis
CAVDGAIHVMTTVLATLP

SEQ ID NO: 1453589 - protein, 18 aa, Mycobacterium tuberculosis
CDRRKGLGADGVLRVTTA

SEQ ID NO: 1453590 - protein, 17 aa, Mycobacterium tuberculosis
CGHMGPPADPECALDTL

SEQ ID NO: 1453591 - protein, 23 aa, Mycobacterium tuberculosis
CIDSDGWVTYRCRADDTEVIGGV

SEQ ID NO: 1453592 - protein, 24 aa, Mycobacterium tuberculosis
CLHDPCLPVDLTVRGHPRDLYRVY

SEQ ID NO: 1453593 - protein, 21 aa, Mycobacterium tuberculosis
CLPESDFPTLIDLYLQGRLPL

SEQ ID NO: 1453594 - protein, 24 aa, Mycobacterium tuberculosis
CNRCPVTTECLSWALNTGQDSGVW

SEQ ID NO: 1453595 - protein, 25 aa, Mycobacterium tuberculosis
CQQAGIYGKLAWEKTIPNWFFEPDI

SEQ ID NO: 1453596 - protein, 18 aa, Mycobacterium tuberculosis
CRAPSLHNSQPWRWIAED

SEQ ID NO: 1453597 - protein, 21 aa, Mycobacterium tuberculosis
CRRSVPHLQRLLAHLESSLKD

SEQ ID NO: 1453598 - protein, 19 aa, Mycobacterium tuberculosis
CSFRAFSVHMRELRQVGVI

SEQ ID NO: 1453599 - protein, 17 aa, Mycobacterium tuberculosis
CSLQRRYQKLVEEAPAP

SEQ ID NO: 1453600 - protein, 23 aa, Mycobacterium tuberculosis
CSPDSFRSLRCVVSAGEALELGL

SEQ ID NO: 1453601 - protein, 19 aa, Mycobacterium tuberculosis
CSRKHGWEGVIAKRRDSRY

SEQ ID NO: 1453602 - protein, 20 aa, Mycobacterium tuberculosis
CTLPLTGVGCVDRIVTELAV

SEQ ID NO: 1453603 - protein, 20 aa, Mycobacterium tuberculosis
CVEFAAARPGMLGLQTALSV

SEQ ID NO: 1453604 - protein, 17 aa, Mycobacterium tuberculosis
DAAIAWGGANGAFELNV

SEQ ID NO: 1453605 - protein, 22 aa, Mycobacterium tuberculosis
DAAVALGRRVSFVGRSMVRNMR

SEQ ID NO: 1453606 - protein, 24 aa, Mycobacterium tuberculosis
DADVIRYLRWFTFLSADELAELEQ

SEQ ID NO: 1453607 - protein, 18 aa, Mycobacterium tuberculosis
DAEFPKFRQLLPTEHTAV

SEQ ID NO: 1453608 - protein, 24 aa, Mycobacterium tuberculosis
DAEGSALLREFVGMTLNLPTPEEA

SEQ ID NO: 1453609 - protein, 20 aa, Mycobacterium tuberculosis
DAFADFLAGFHIIDRHFATA

SEQ ID NO: 1453610 - protein, 17 aa, Mycobacterium tuberculosis
DAGDEWEAFLGKDDDLY

SEQ ID NO: 1453611 - protein, 20 aa, Mycobacterium tuberculosis
DAGVLAALLLNRISLAPGEA

SEQ ID NO: 1453612 - protein, 24 aa, Mycobacterium tuberculosis
DAIDFRAAAGIYRAARRAGETVRS

SEQ ID NO: 1453613 - protein, 26 aa, Mycobacterium tuberculosis
DAKAFARLGIRCFGFSPLRLPPDLDF

SEQ ID NO: 1453614 - protein, 24 aa, Mycobacterium tuberculosis
DAKREMLSRLGVEYVGDSRSVDFA

SEQ ID NO: 1453615 - protein, 19 aa, Mycobacterium tuberculosis
DALCAHLATMHPSRYLTLI

SEQ ID NO: 1453616 - protein, 17 aa, Mycobacterium tuberculosis
DALLRYQTLSARDALHI

SEQ ID NO: 1453617 - protein, 31 aa, Mycobacterium tuberculosis; identical to SEQ ID NO: 197574

SEQ ID NO: 1453618 - protein, 19 aa, Mycobacterium tuberculosis
DALPRNALGKVLKKQLLSE

SEQ ID NO: 1453619 - protein, 25 aa, Mycobacterium tuberculosis
DALSTARFEFRWNDQFALSLDPDTA

SEQ ID NO: 1453620 - protein, 28 aa, Mycobacterium tuberculosis
DAMAREVRRGGLPLQRLVNGESMAAVAR

SEQ ID NO: 1453621 - protein, 26 aa, Mycobacterium tuberculosis
DARGTIEWSETCYRYTGAHRDALSGE

SEQ ID NO: 1453622 - protein, 23 aa, Mycobacterium tuberculosis
DATKRYGDFVALDHVDFVVPTGS

SEQ ID NO: 1453623 - protein, 22 aa, Mycobacterium tuberculosis
DATQIHGGYGFMNEYPVARHYR

SEQ ID NO: 1453624 - protein, 24 aa, Mycobacterium tuberculosis
DAVLPEKPELILLDNFAVWQTQTA

SEQ ID NO: 1453625 - protein, 19 aa, Mycobacterium tuberculosis
DCGACKPACRVEAIYWEGD

SEQ ID NO: 1453626 - protein, 19 aa, Mycobacterium tuberculosis
DDGFTEMRGKLDGAAAGQQ

SEQ ID NO: 1453627 - protein, 19 aa, Mycobacterium tuberculosis
DDKNIRIAPSFPSVPDLRN

SEQ ID NO: 1453628 - protein, 19 aa, Mycobacterium tuberculosis
DDLQAVIAMLKKADLDVAL

SEQ ID NO: 1453629 - protein, 21 aa, Mycobacterium tuberculosis
DDMPEDLKPVLCRQMEVYAGF

SEQ ID NO: 1453630 - protein, 21 aa, Mycobacterium tuberculosis
DDRKVAFKRSYRDVDVLLVDD

SEQ ID NO: 1453631 - protein, 25 aa, Mycobacterium tuberculosis
DDRLCLRFSSRLGITVASVDYRLAP

SEQ ID NO: 1453632 - protein, 27 aa, Mycobacterium tuberculosis
DDRVVTKCFLLWAGVVGAISLEVFGQY

SEQ ID NO: 1453633 - protein, 24 aa, Mycobacterium tuberculosis
DDSPAAQVAVRWAARDAELRKIPL

SEQ ID NO: 1453634 - protein, 20 aa, Mycobacterium tuberculosis
DDTKLDWARTFGATHTVNAR

SEQ ID NO: 1453635 - protein, 20 aa, Mycobacterium tuberculosis
DDVVIRLPFRTDLTNDGTYF

SEQ ID NO: 1453636 - protein, 20 aa, Mycobacterium tuberculosis
DEAEAYFLSRLDEWENVIAG

SEQ ID NO: 1453637 - protein, 20 aa, Mycobacterium tuberculosis
DEITELFGPGLAEITVIRNG

SEQ ID NO: 1453638 - protein, 23 aa, Mycobacterium tuberculosis
DELAEPLLAAGYPRLEHITQDTE

SEQ ID NO: 1453639 - protein, 20 aa, Mycobacterium tuberculosis
DELDRLIARVKRLREEAGKT

SEQ ID NO: 1453640 - protein, 25 aa, Mycobacterium tuberculosis
DELLDRVSSKYALVIYAAKRARQIN

SEQ ID NO: 1453641 - protein, 23 aa, Mycobacterium tuberculosis
DELLRGFLDWLFARYRDIVDSTA

SEQ ID NO: 1453642 - protein, 19 aa, Mycobacterium tuberculosis
DELRGAAASAAFVVASGSL

SEQ ID NO: 1453643 - protein, 25 aa, Mycobacterium tuberculosis
DEWERRAIAVFGHRPYIGVSANIVA

SEQ ID NO: 1453644 - protein, 20 aa, Mycobacterium tuberculosis
DFDAGYWRAGGRIKIGSKRS

SEQ ID NO: 1453645 - protein, 18 aa, Mycobacterium tuberculosis
DFLRICVIATEFELVMPF

SEQ ID NO: 1453646 - protein, 28 aa, Mycobacterium tuberculosis
DGDRSACIKAMIEKVVDRMYAEIDDNRF

SEQ ID NO: 1453647 - protein, 18 aa, Mycobacterium tuberculosis
DGEPALLDCLEFEDELRY

SEQ ID NO: 1453648 - protein, 30 aa, Mycobacterium tuberculosis; identical to SEQ ID NO: 197760

SEQ ID NO: 1453649 - protein, 18 aa, Mycobacterium tuberculosis
DGGIWPRQRVRDEALTFM

SEQ ID NO: 1453650 - protein, 19 aa, Mycobacterium tuberculosis
DGLYTRWPDRDSLVSEIDT

SEQ ID NO: 1453651 - protein, 20 aa, Mycobacterium tuberculosis
DGPICKLALPERISSGTHSA

SEQ ID NO: 1453652 - protein, 17 aa, Mycobacterium tuberculosis
DGPVVVVGHSFGGAVAM

SEQ ID NO: 1453653 - protein, 19 aa, Mycobacterium tuberculosis
DGRIAGLVRQVCARALSLP

SEQ ID NO: 1453654 - protein, 27 aa, Mycobacterium tuberculosis
DGSSVLIQMMWAMRATGMWTDTRGANM

SEQ ID NO: 1453655 - protein, 21 aa, Mycobacterium tuberculosis
DGTWLRANFISSLDGGATVDG

SEQ ID NO: 1453656 - protein, 25 aa, Mycobacterium tuberculosis
DGVARRRARVVVPFQPRLLMVGDAF

SEQ ID NO: 1453657 - protein, 17 aa, Mycobacterium tuberculosis
DGVIIPTECEFFSLRGL

SEQ ID NO: 1453658 - protein, 23 aa, Mycobacterium tuberculosis
DGYSRSGAGFGVAAAASGGGTFL

SEQ ID NO: 1453659 - protein, 24 aa, Mycobacterium tuberculosis
DHGEIPLGIYCRASLAEYMDAERL

SEQ ID NO: 1453660 - protein, 18 aa, Mycobacterium tuberculosis
DHLLMAITVEEVYGSVAS

SEQ ID NO: 1453661 - protein, 27 aa, Mycobacterium tuberculosis
DIDEALKLADLVAVFAPGGALAQYDET

SEQ ID NO: 1453662 - protein, 20 aa, Mycobacterium tuberculosis
DIHFQPRYIFAAIDAGCAAV

SEQ ID NO: 1453663 - protein, 24 aa, Mycobacterium tuberculosis
DILSEVWVSGELVTAVAEQTLGAL

SEQ ID NO: 1453664 - protein, 23 aa, Mycobacterium tuberculosis
DITVNVDGFWMLQALLDIRHVAP

SEQ ID NO: 1453665 - protein, 20 aa, Mycobacterium tuberculosis
DIVRLLRLYDAGQLMLDELV

SEQ ID NO: 1453666 - protein, 24 aa, Mycobacterium tuberculosis
DKLDLKPGMTLLDIGCGWGTTMRR

SEQ ID NO: 1453667 - protein, 18 aa, Mycobacterium tuberculosis
DLALQCAPDHPWAREHRQ

SEQ ID NO: 1453668 - protein, 24 aa, Mycobacterium tuberculosis
DLEHWRWMWDTNVLGTLRVTRALL

SEQ ID NO: 1453669 - protein, 19 aa, Mycobacterium tuberculosis
DLFLGVPFNIASYALLTHM

SEQ ID NO: 1453670 - protein, 21 aa, Mycobacterium tuberculosis
DLILPGFRYRAAMADGTVENE

SEQ ID NO: 1453671 - protein, 25 aa, Mycobacterium tuberculosis
DLLIKDGRLAPDFDDEVIAQSCVTR

SEQ ID NO: 1453672 - protein, 24 aa, Mycobacterium tuberculosis
DLLQLKAAVLGSRRAMTRAGRHIP

SEQ ID NO: 1453673 - protein, 33 aa, Mycobacterium tuberculosis; identical to SEQ ID NO: 197924

SEQ ID NO: 1453674 - protein, 35 aa, Mycobacterium tuberculosis; identical to SEQ ID NO: 197926

SEQ ID NO: 1453675 - protein, 24 aa, Mycobacterium tuberculosis
DLVLRRLTESLARDRTRHQVSEVT

SEQ ID NO: 1453676 - protein, 24 aa, Mycobacterium tuberculosis
DNARLRARIGVMLQGGGGYPAARA

SEQ ID NO: 1453677 - protein, 19 aa, Mycobacterium tuberculosis
DNTYYCFGTAAGPHPFPTM

SEQ ID NO: 1453678 - protein, 19 aa, Mycobacterium tuberculosis
DPAIISWPNGIAAHGEIRD

SEQ ID NO: 1453679 - protein, 24 aa, Mycobacterium tuberculosis
DPDRMPFSVPWTRASREDLPFNTL

SEQ ID NO: 1453680 - protein, 26 aa, Mycobacterium tuberculosis
DPEEVAGFLADYGWRLTEQAGPEELV

SEQ ID NO: 1453681 - protein, 20 aa, Mycobacterium tuberculosis
DPEVPPALRRLVLEGQAAVQ

SEQ ID NO: 1453682 - protein, 18 aa, Mycobacterium tuberculosis
DPGRVGLFRHVLRPAFLQ

SEQ ID NO: 1453683 - protein, 20 aa, Mycobacterium tuberculosis
DPGTVFALEMAFFGALVQAG

SEQ ID NO: 1453684 - protein, 21 aa, Mycobacterium tuberculosis
DPIPHGLLFERFLNPERTSMP

SEQ ID NO: 1453685 - protein, 27 aa, Mycobacterium tuberculosis
DPIRYPARLAPLHGWGSDGADTIGTVG

SEQ ID NO: 1453686 - protein, 18 aa, Mycobacterium tuberculosis
DPQGCLTFSLGQDPDKLP

SEQ ID NO: 1453687 - protein, 19 aa, Mycobacterium tuberculosis
DPQLAAFYHRLMTTQRHCH

SEQ ID NO: 1453688 - protein, 25 aa, Mycobacterium tuberculosis
DPRARARFLAITGGGGFLLYLQMHE

SEQ ID NO: 1453689 - protein, 19 aa, Mycobacterium tuberculosis
DPRMLPILDELCADQDVAA

SEQ ID NO: 1453690 - protein, 19 aa, Mycobacterium tuberculosis
DPRSGRWQGLAKTECGLHA

SEQ ID NO: 1453691 - protein, 20 aa, Mycobacterium tuberculosis
DPRTGLPLVSVGTVVTSEDV

SEQ ID NO: 1453692 - protein, 23 aa, Mycobacterium tuberculosis
DQLIRAREFDVVVAGGQESMTKA

SEQ ID NO: 1453693 - protein, 24 aa, Mycobacterium tuberculosis
DQLRRYPWPQGHTMSVLSNALTDQ

SEQ ID NO: 1453694 - protein, 18 aa, Mycobacterium tuberculosis
DQLSRGPLLSGMFGTFPV

SEQ ID NO: 1453695 - protein, 23 aa, Mycobacterium tuberculosis
DQRRLGELIDLFNSARFSRQGEH

SEQ ID NO: 1453696 - protein, 18 aa, Mycobacterium tuberculosis
DRASCKYMKMITPAALLR

SEQ ID NO: 1453697 - protein, 25 aa, Mycobacterium tuberculosis
DRCAVGIPTVSGWRMLSGDETGWLL

SEQ ID NO: 1453698 - protein, 26 aa, Mycobacterium tuberculosis
DRCNLRCSYCMPERGLRWLPGEQLLR

SEQ ID NO: 1453699 - protein, 29 aa, Mycobacterium tuberculosis
DRGALPVKLCYAGPFFRYERPQAGRYRQL

SEQ ID NO: 1453700 - protein, 23 aa, Mycobacterium tuberculosis
DRGLRFMSACGVADRNLQTAEIY

SEQ ID NO: 1453701 - protein, 25 aa, Mycobacterium tuberculosis
DRITKARWVYFLTRMRNPTGDTAPF

SEQ ID NO: 1453702 - protein, 20 aa, Mycobacterium tuberculosis
DRIVSIGAFEHFGHDRHADF

SEQ ID NO: 1453703 - protein, 20 aa, Mycobacterium tuberculosis
DRIVSIGAFEHFGHERYDAF

SEQ ID NO: 1453704 - protein, 23 aa, Mycobacterium tuberculosis
DRLKPWDVIAARLTAAAAADLVL

SEQ ID NO: 1453705 - protein, 24 aa, Mycobacterium tuberculosis
DRLPFDSPMYWHLFEPALRDAVDK

SEQ ID NO: 1453706 - protein, 21 aa, Mycobacterium tuberculosis
DRLPRFMRYLAAITAQELNVA

SEQ ID NO: 1453707 - protein, 18 aa, Mycobacterium tuberculosis
DRLRKALWNLYWRGTANM

SEQ ID NO: 1453708 - protein, 20 aa, Mycobacterium tuberculosis
DRPDALVLDVMMPRLDGLEV

SEQ ID NO: 1453709 - protein, 19 aa, Mycobacterium tuberculosis
DRPPEWLVRQLAALLPELA

SEQ ID NO: 1453710 - protein, 20 aa, Mycobacterium tuberculosis
DRPSAHEILSAKLAPAQEAP

SEQ ID NO: 1453711 - protein, 20 aa, Mycobacterium tuberculosis
DRRCGPNLYSRQVAYATRLV

SEQ ID NO: 1453712 - protein, 23 aa, Mycobacterium tuberculosis
DRSIVPVRVIWLPPADRSRAGKV

SEQ ID NO: 1453713 - protein, 17 aa, Mycobacterium tuberculosis
DRTELRWITSALTEVEL

SEQ ID NO: 1453714 - protein, 18 aa, Mycobacterium tuberculosis
DRVAIHWEGEPVGDRRTL

SEQ ID NO: 1453715 - protein, 24 aa, Mycobacterium tuberculosis
DSAELPLFRYVGGPNAHILPVPMM

SEQ ID NO: 1453716 - protein, 17 aa, Mycobacterium tuberculosis
DSAVRRYVTDAGALLPR

SEQ ID NO: 1453717 - protein, 17 aa, Mycobacterium tuberculosis
DSDGFYYIVDRVKDMIV

SEQ ID NO: 1453718 - protein, 17 aa, Mycobacterium tuberculosis
DSGLLMSTFGPRTALWL

SEQ ID NO: 1453719 - protein, 18 aa, Mycobacterium tuberculosis
DSGVQAWLGPLPDDPAGL

SEQ ID NO: 1453720 - protein, 17 aa, Mycobacterium tuberculosis
DSLACAYAAVLAEAKRY

SEQ ID NO: 1453721 - protein, 18 aa, Mycobacterium tuberculosis
DSLHALVITGGYDLDPAA

SEQ ID NO: 1453722 - protein, 24 aa, Mycobacterium tuberculosis
DSPFRGVKKVHYWAARSTGGEFTP

SEQ ID NO: 1453723 - protein, 20 aa, Mycobacterium tuberculosis
DSQESFGLKESAWVIDELRE

SEQ ID NO: 1453724 - protein, 24 aa, Mycobacterium tuberculosis
DTATSLPGRGAWLHPLRQCAQQAI

SEQ ID NO: 1453725 - protein, 23 aa, Mycobacterium tuberculosis
DTDEVIDVVLLWWRDGDGDLVDT

SEQ ID NO: 1453726 - protein, 28 aa, Mycobacterium tuberculosis
DTEPWRGEPLLAYLRKMVFWSMVTPRAA

SEQ ID NO: 1453727 - protein, 26 aa, Mycobacterium tuberculosis
DTHLLRYPLPAAWCTDVDVELYLKDE

SEQ ID NO: 1453728 - protein, 20 aa, Mycobacterium tuberculosis
DTIAALSRRASALLDGLDGA

SEQ ID NO: 1453729 - protein, 18 aa, Mycobacterium tuberculosis
DTPKAIAALDGWVTDAVE

SEQ ID NO: 1453730 - protein, 20 aa, Mycobacterium tuberculosis
DTSFSMVMENRWLPMKRTAL

SEQ ID NO: 1453731 - protein, 24 aa, Mycobacterium tuberculosis
DVFSEALAAPLFWIAANAGLDGSV

SEQ ID NO: 1453732 - protein, 24 aa, Mycobacterium tuberculosis
DVGHIPGAVKIDWHTDLNDPRVRD

SEQ ID NO: 1453733 - protein, 24 aa, Mycobacterium tuberculosis
DVIAVGITPAGSWVLTDANPDALT

SEQ ID NO: 1453734 - protein, 25 aa, Mycobacterium tuberculosis
DVLEFRRRVGMLFQRPNPFPMSIMD

SEQ ID NO: 1453735 - protein, 18 aa, Mycobacterium tuberculosis
DVLPAEWLAVPLAGGGIV

SEQ ID NO: 1453736 - protein, 24 aa, Mycobacterium tuberculosis
DVLRCGICGSDLHARLHCDELADV

SEQ ID NO: 1453737 - protein, 18 aa, Mycobacterium tuberculosis
DVRAAGAGSRRDTRVLRG

SEQ ID NO: 1453738 - protein, 26 aa, Mycobacterium tuberculosis
DWDLKSLRWAWNRAKDDVAPWWAENS

SEQ ID NO: 1453739 - protein, 24 aa, Mycobacterium tuberculosis
DWLVGNGGLDWAVKRTADSSQRLY

SEQ ID NO: 1453740 - protein, 24 aa, Mycobacterium tuberculosis
DWNRAGSARAWWVLTAAGIANVRI

SEQ ID NO: 1453741 - protein, 20 aa, Mycobacterium tuberculosis
DWYADLPVASPQVFGDQTDV

SEQ ID NO: 1453742 - protein, 18 aa, Mycobacterium tuberculosis
DYAPVVMVNWEFFDNQTP

SEQ ID NO: 1453743 - protein, 17 aa, Mycobacterium tuberculosis
DYIRAGLNAGLDIDSFA

SEQ ID NO: 1453744 - protein, 25 aa, Mycobacterium tuberculosis
EAAKLRLAVLAGRLRAAGVRVDLAY

SEQ ID NO: 1453745 - protein, 17 aa, Mycobacterium tuberculosis
EAARLGLANATFERHDL

SEQ ID NO: 1453746 - protein, 24 aa, Mycobacterium tuberculosis
EAEQWPGVRVRVIPAMTAAQAVAS

SEQ ID NO: 1453747 - protein, 23 aa, Mycobacterium tuberculosis
EAGSKVKVTIMFRGREQSRPELG

SEQ ID NO: 1453748 - protein, 20 aa, Mycobacterium tuberculosis
EAHRIAPMVVEYVEEDIGPR

SEQ ID NO: 1453749 - protein, 17 aa, Mycobacterium tuberculosis
EAIDRFGLDMIDTTPSM

SEQ ID NO: 1453750 - protein, 17 aa, Mycobacterium tuberculosis
EAIQLFTERARLVQPNF

SEQ ID NO: 1453751 - protein, 24 aa, Mycobacterium tuberculosis
EALQKLAARCPIAVLSGRDLADVT

SEQ ID NO: 1453752 - protein, 21 aa, Mycobacterium tuberculosis
EALRRRTLITAAQYLALGIDP

SEQ ID NO: 1453753 - protein, 24 aa, Mycobacterium tuberculosis
EANLRLVVSLAKRYTGRGMPLLDL

SEQ ID NO: 1453754 - protein, 20 aa, Mycobacterium tuberculosis
EAPGIAGIVEELFPVAATTD

SEQ ID NO: 1453755 - protein, 20 aa, Mycobacterium tuberculosis
EAQLDRFLLKLNVTLPARDS

SEQ ID NO: 1453756 - protein, 25 aa, Mycobacterium tuberculosis
EARVSRRLVAMLARRGYGQTLACEV

SEQ ID NO: 1453757 - protein, 24 aa, Mycobacterium tuberculosis
EATAEAFAGGWFHSGDLVRMDSDG

SEQ ID NO: 1453758 - protein, 30 aa, Mycobacterium tuberculosis; identical to SEQ ID NO: 198360

SEQ ID NO: 1453759 - protein, 21 aa, Mycobacterium tuberculosis
EAVFWFLSRKTPVFVKWLLRR

SEQ ID NO: 1453760 - protein, 18 aa, Mycobacterium tuberculosis
EAVVAEFAEQFSVDVSAI

SEQ ID NO: 1453761 - protein, 33 aa, Mycobacterium tuberculosis; identical to SEQ ID NO: 198375

SEQ ID NO: 1453762 - protein, 22 aa, Mycobacterium tuberculosis
EAYLGRRWVKLDATIDAPTAAR

SEQ ID NO: 1453763 - protein, 22 aa, Mycobacterium tuberculosis
ECGGGRRWASAEARRHVTQGID

SEQ ID NO: 1453764 - protein, 23 aa, Mycobacterium tuberculosis
EDAEGPGATILLRLDQDVPDDVR

SEQ ID NO: 1453765 - protein, 27 aa, Mycobacterium tuberculosis
EDDEARLQRLLAFVARQEPRLNWAVGV

SEQ ID NO: 1453766 - protein, 19 aa, Mycobacterium tuberculosis
EDLLNRWTWIPFGAGRHRC

SEQ ID NO: 1453767 - protein, 19 aa, Mycobacterium tuberculosis
EDLRYGPDVTTLATVPASA

SEQ ID NO: 1453768 - protein, 21 aa, Mycobacterium tuberculosis
EDSHHVLKLAAGIEPPVELPF

SEQ ID NO: 1453769 - protein, 23 aa, Mycobacterium tuberculosis
EDSRGRTSLVITELPYQVNHDNF

SEQ ID NO: 1453770 - protein, 17 aa, Mycobacterium tuberculosis
EDYDRFWVRDEITGEEY

SEQ ID NO: 1453771 - protein, 21 aa, Mycobacterium tuberculosis
EEAREALADTVVRRGDTPLPV

SEQ ID NO: 1453772 - protein, 28 aa, Mycobacterium tuberculosis
EEDAVFGVFCRRWGVPLIDGGTVRLPRL

SEQ ID NO: 1453773 - protein, 18 aa, Mycobacterium tuberculosis
EEGLACAILGVPVADLIE

SEQ ID NO: 1453774 - protein, 21 aa, Mycobacterium tuberculosis
EEKHPTPEWIVVGAGTGGTSA

SEQ ID NO: 1453775 - protein, 22 aa, Mycobacterium tuberculosis
EELTELALGLGRQFVAQGRVRS

SEQ ID NO: 1453776 - protein, 29 aa, Mycobacterium tuberculosis
EEVEVLRLSALRGLFSAVIEDAVTFVNAP

SEQ ID NO: 1453777 - protein, 24 aa, Mycobacterium tuberculosis
EEVVLRLRALLRRTGVTTVDSGAQ

SEQ ID NO: 1453778 - protein, 20 aa, Mycobacterium tuberculosis
EFDIAISFRDAQNIKTVGDV

SEQ ID NO: 1453779 - protein, 26 aa, Mycobacterium tuberculosis
EFEKEAWLSMVMLEWGSCGQVATAVP

SEQ ID NO: 1453780 - protein, 19 aa, Mycobacterium tuberculosis
EFGAYPAVIGRELDRYLPF

SEQ ID NO: 1453781 - protein, 40 aa, Mycobacterium tuberculosis; identical to SEQ ID NO: 198448

SEQ ID NO: 1453782 - protein, 27 aa, Mycobacterium tuberculosis
EGAEARYLWPSMFAQVADEYDRRYGLD

SEQ ID NO: 1453783 - protein, 24 aa, Mycobacterium tuberculosis
EGARRFAAGAGRHGAPAPRAEQGD

SEQ ID NO: 1453784 - protein, 25 aa, Mycobacterium tuberculosis
EGHRLRADAILLRRTDRLPFAEPPD

SEQ ID NO: 1453785 - protein, 24 aa, Mycobacterium tuberculosis
EGLTRAKARLRWREKELVGVGLAR

SEQ ID NO: 1453786 - protein, 25 aa, Mycobacterium tuberculosis
EGPELRSDVRLDFKPVVQTRYEPKE

SEQ ID NO: 1453787 - protein, 18 aa, Mycobacterium tuberculosis
EGVDVPRLSVGVYATNAS

SEQ ID NO: 1453788 - protein, 26 aa, Mycobacterium tuberculosis
EHGASSEAARAWWGNFLAQKANEAGI

SEQ ID NO: 1453789 - protein, 25 aa, Mycobacterium tuberculosis
EHLRPPESFPGWLHDGDVVTLQVEG

SEQ ID NO: 1453790 - protein, 26 aa, Mycobacterium tuberculosis
EHPGKWRVVFFWPKDFTFVCPTEIAA

SEQ ID NO: 1453791 - protein, 20 aa, Mycobacterium tuberculosis
EHVADTFIAMGWELAEGPEV

SEQ ID NO: 1453792 - protein, 24 aa, Mycobacterium tuberculosis
EIHDRMPLLLAEEDWDDWLNPDAP

SEQ ID NO: 1453793 - protein, 26 aa, Mycobacterium tuberculosis
EILATEILDPLGFRWTNFGVAERDVP

SEQ ID NO: 1453794 - protein, 17 aa, Mycobacterium tuberculosis
EIMGRSYGGGILELEPR

SEQ ID NO: 1453795 - protein, 19 aa, Mycobacterium tuberculosis
EIVGRFLALLELYRTRAVA

SEQ ID NO: 1453796 - protein, 24 aa, Mycobacterium tuberculosis
EIVYRAPTLMSCYWNNPEATAEAF

SEQ ID NO: 1453797 - protein, 17 aa, Mycobacterium tuberculosis
EKAMRERGLHFVGAGIS

SEQ ID NO: 1453798 - protein, 17 aa, Mycobacterium tuberculosis
EKDGCGDLDFDWLDDGW

SEQ ID NO: 1453799 - protein, 20 aa, Mycobacterium tuberculosis
EKLELRRVAIFDGTVEAYLH

SEQ ID NO: 1453800 - protein, 18 aa, Mycobacterium tuberculosis
EKLLELLPNRVITDSIGS

SEQ ID NO: 1453801 - protein, 35 aa, Mycobacterium tuberculosis; identical to SEQ ID NO: 198568

SEQ ID NO: 1453802 - protein, 22 aa, Mycobacterium tuberculosis
EKSASPVWCRVGARCDHRGKRS

SEQ ID NO: 1453803 - protein, 24 aa, Mycobacterium tuberculosis
ELAPRGVQVVGVYVGLVDTDMGRF

SEQ ID NO: 1453804 - protein, 25 aa, Mycobacterium tuberculosis
ELAYPLMSWPRRGVFGGPTPAPRGL

SEQ ID NO: 1453805 - protein, 20 aa, Mycobacterium tuberculosis
ELEAVLAAGAQRAHDVASKT

SEQ ID NO: 1453806 - protein, 22 aa, Mycobacterium tuberculosis
ELFSAVRFDIGWTASSDDGLPP

SEQ ID NO: 1453807 - protein, 36 aa, Mycobacterium tuberculosis; identical to SEQ ID NO: 198594

SEQ ID NO: 1453808 - protein, 17 aa, Mycobacterium tuberculosis
ELGEFGIRVNSIHPYSV

SEQ ID NO: 1453809 - protein, 25 aa, Mycobacterium tuberculosis
ELIDGARMEIDWTGCRDFDELIVYC

SEQ ID NO: 1453810 - protein, 24 aa, Mycobacterium tuberculosis
ELIEAIKLVALVADRGAQVRMEFA

SEQ ID NO: 1453811 - protein, 25 aa, Mycobacterium tuberculosis
ELLIKAEAIGVNFIDTYFRSGQYPR

SEQ ID NO: 1453812 - protein, 21 aa, Mycobacterium tuberculosis
ELPGDTFVLAVQWHPEKSLDD

SEQ ID NO: 1453813 - protein, 17 aa, Mycobacterium tuberculosis
ELRECVGSELLTEPEQL

SEQ ID NO: 1453814 - protein, 22 aa, Mycobacterium tuberculosis
ELRRRVKAMSYGLAYGLSAYGL

SEQ ID NO: 1453815 - protein, 25 aa, Mycobacterium tuberculosis
ELSKELRPWVPVVSLVKGLEQGTNM

SEQ ID NO: 1453816 - protein, 20 aa, Mycobacterium tuberculosis
ELTAALGIGAFADKTLVHSG

SEQ ID NO: 1453817 - protein, 20 aa, Mycobacterium tuberculosis
ELYITGRIADLLTIDGRNHY

SEQ ID NO: 1453818 - protein, 18 aa, Mycobacterium tuberculosis
EMGLLGFEEYLEAKLIAT

SEQ ID NO: 1453819 - protein, 19 aa, Mycobacterium tuberculosis
EMHSRSGLIDEVKASTVDL

SEQ ID NO: 1453820 - protein, 26 aa, Mycobacterium tuberculosis
ENLFFKEKRYDLARVGRYKVNKKLGL

SEQ ID NO: 1453821 - protein, 34 aa, Mycobacterium tuberculosis; identical to SEQ ID NO: 198682

SEQ ID NO: 1453822 - protein, 34 aa, Mycobacterium tuberculosis; identical to SEQ ID NO: 198685

SEQ ID NO: 1453823 - protein, 24 aa, Mycobacterium tuberculosis
EPKWDGFRSICFRDGDQVELGSRN

SEQ ID NO: 1453824 - protein, 24 aa, Mycobacterium tuberculosis
EPLQRPGRRRVLTIANQKGGVGKT

SEQ ID NO: 1453825 - protein, 25 aa, Mycobacterium tuberculosis
EPSEAVVAAARWARSELDYIPGTTS

SEQ ID NO: 1453826 - protein, 19 aa, Mycobacterium tuberculosis
EPVEWKRDQALKFGATHVY

SEQ ID NO: 1453827 - protein, 19 aa, Mycobacterium tuberculosis
EPYGVEWTKPVARFEEALA

SEQ ID NO: 1453828 - protein, 17 aa, Mycobacterium tuberculosis
EQDHARFAKIFDVNLWA

SEQ ID NO: 1453829 - protein, 24 aa, Mycobacterium tuberculosis
EQEYKEFYKHVAHAWDDPLEIIAM

SEQ ID NO: 1453830 - protein, 25 aa, Mycobacterium tuberculosis
EQGDPRFSDVSSRIFGTPHDVDVGA

SEQ ID NO: 1453831 - protein, 24 aa, Mycobacterium tuberculosis
EQLGWPRVRIHYRSGTRIPTGATI

SEQ ID NO: 1453832 - protein, 26 aa, Mycobacterium tuberculosis
EQLPVYRPPLDMARLFNQPELGPTDD

SEQ ID NO: 1453833 - protein, 17 aa, Mycobacterium tuberculosis
EQTFSHLDLPSWDLDPV

SEQ ID NO: 1453834 - protein, 18 aa, Mycobacterium tuberculosis
EQVMTARGLALVRDDSLT

SEQ ID NO: 1453835 - protein, 26 aa, Mycobacterium tuberculosis
ERAHLLPVFRLRYLPTPLGLHHPIWV

SEQ ID NO: 1453836 - protein, 18 aa, Mycobacterium tuberculosis
ERLALGFGSSSFRYAAPA

SEQ ID NO: 1453837 - protein, 18 aa, Mycobacterium tuberculosis
ERLISGLARANARTKGRF

SEQ ID NO: 1453838 - protein, 18 aa, Mycobacterium tuberculosis
ERLQGLFMASFEAIEHHH

SEQ ID NO: 1453839 - protein, 24 aa, Mycobacterium tuberculosis
ERLSRLGGVVGTAFQIADDIIDID

SEQ ID NO: 1453840 - protein, 27 aa, Mycobacterium tuberculosis
ERLTRAWTGLRAMRSYALATMEGPAVE

SEQ ID NO: 1453841 - protein, 21 aa, Mycobacterium tuberculosis
ERLWPTEEFELARSRIPARPP

SEQ ID NO: 1453842 - protein, 19 aa, Mycobacterium tuberculosis
ERPEPLAAKATWADLQSTA

SEQ ID NO: 1453843 - protein, 20 aa, Mycobacterium tuberculosis
ERRARWVVRMLTSLLMFPGR

SEQ ID NO: 1453844 - protein, 23 aa, Mycobacterium tuberculosis
ERRKEMLHNAALRGEQMKGHAAT

SEQ ID NO: 1453845 - protein, 29 aa, Mycobacterium tuberculosis
ERRVRDGLLEIGRALNIPPLATNDCHYVT

SEQ ID NO: 1453846 - protein, 18 aa, Mycobacterium tuberculosis
ERTLLAGDFVRSFVGLDS

SEQ ID NO: 1453847 - protein, 24 aa, Mycobacterium tuberculosis
ERTRAKARLSWAGRQMVGVGLARL

SEQ ID NO: 1453848 - protein, 17 aa, Mycobacterium tuberculosis
ERVALALLTYVEERTDG

SEQ ID NO: 1453849 - protein, 18 aa, Mycobacterium tuberculosis
ERVLPGAILRQLSDEEMN

SEQ ID NO: 1453850 - protein, 19 aa, Mycobacterium tuberculosis
ERVPGSVVDRSFVDNHCAG

SEQ ID NO: 1453851 - protein, 22 aa, Mycobacterium tuberculosis
ESADIPQFLAIAREAAERRTGL

SEQ ID NO: 1453852 - protein, 18 aa, Mycobacterium tuberculosis
ESAIKAALSNWIAGQAAV

SEQ ID NO: 1453853 - protein, 20 aa, Mycobacterium tuberculosis
ESAKFWLAVLTDLRNRGVKD

SEQ ID NO: 1453854 - protein, 30 aa, Mycobacterium tuberculosis; identical to SEQ ID NO: 198800

SEQ ID NO: 1453855 - protein, 25 aa, Mycobacterium tuberculosis
ESKASEVVEPWSLRLSHPELLYHPT

SEQ ID NO: 1453856 - protein, 29 aa, Mycobacterium tuberculosis
ESKIASWTEPKGGYFISLDVLPGTARRTV

SEQ ID NO: 1453857 - protein, 18 aa, Mycobacterium tuberculosis
ESRSWRLTATGDYQEPGL

SEQ ID NO: 1453858 - protein, 23 aa, Mycobacterium tuberculosis
ESTAGSLQGQWRGAAGTAAQAAV

SEQ ID NO: 1453859 - protein, 25 aa, Mycobacterium tuberculosis
ESWHGRFPFDWGVSAHPKVDNKTGE

SEQ ID NO: 1453860 - protein, 27 aa, Mycobacterium tuberculosis
ESYEFWREFLASLKARGLTGVHLVISD

SEQ ID NO: 1453861 - protein, 23 aa, Mycobacterium tuberculosis
ETALKFGATHAFADAASAAAKVD

SEQ ID NO: 1453862 - protein, 34 aa, Mycobacterium tuberculosis; identical to SEQ ID NO: 198834

SEQ ID NO: 1453863 - protein, 19 aa, Mycobacterium tuberculosis
ETEVLCGRPLTKLMQESRS

SEQ ID NO: 1453864 - protein, 23 aa, Mycobacterium tuberculosis
ETLNLANLPGYRVGGTIHIIVNN

SEQ ID NO: 1453865 - protein, 30 aa, Mycobacterium tuberculosis; identical to SEQ ID NO: 198850

SEQ ID NO: 1453866 - protein, 25 aa, Mycobacterium tuberculosis
ETMVKAYAGFRSFRHGTNLKAWLYR

SEQ ID NO: 1453867 - protein, 24 aa, Mycobacterium tuberculosis
ETRLLLRKSMHLLRDKQLWWRVGR

SEQ ID NO: 1453868 - protein, 23 aa, Mycobacterium tuberculosis
ETSKRYMHHYNFPPFSTGETGRV

SEQ ID NO: 1453869 - protein, 18 aa, Mycobacterium tuberculosis
EVACPFHDWRWGGDGRCK

SEQ ID NO: 1453870 - protein, 21 aa, Mycobacterium tuberculosis
EVDAIRWLSWEQFVRDVTAGV

SEQ ID NO: 1453871 - protein, 18 aa, Mycobacterium tuberculosis
EVDRLAAELADRLHTSKT

SEQ ID NO: 1453872 - protein, 26 aa, Mycobacterium tuberculosis
EVGRLRGGQTLIGFLAPRNADNSIGA

SEQ ID NO: 1453873 - protein, 24 aa, Mycobacterium tuberculosis
EVPSRAYVSAFGFKGPDQQKPAGV

SEQ ID NO: 1453874 - protein, 26 aa, Mycobacterium tuberculosis
EVQIPKLRAGSFFPSLLERRRRIDKA

SEQ ID NO: 1453875 - protein, 22 aa, Mycobacterium tuberculosis
EVSEYGGALLPRLITPGEAARL

SEQ ID NO: 1453876 - protein, 19 aa, Mycobacterium tuberculosis
EVVRRLRAAGAVIIGKTNV

SEQ ID NO: 1453877 - protein, 20 aa, Mycobacterium tuberculosis
EVWLTARWGAHTRKAGRTWW

SEQ ID NO: 1453878 - protein, 35 aa, Mycobacterium tuberculosis; identical to SEQ ID NO: 198923

SEQ ID NO: 1453879 - protein, 17 aa, Mycobacterium tuberculosis
EWAFPAWVPLPVSELAL

SEQ ID NO: 1453880 - protein, 24 aa, Mycobacterium tuberculosis
EWTQHWRVASGLGVSADDLLGVRD

SEQ ID NO: 1453881 - protein, 26 aa, Mycobacterium tuberculosis
EYDVLNRLKPGIVMCREKQDTTSAVL

SEQ ID NO: 1453882 - protein, 19 aa, Mycobacterium tuberculosis
FAAAAWRAGVLRYVVDLEN

SEQ ID NO: 1453883 - protein, 17 aa, Mycobacterium tuberculosis
FAASVFSTRGCPYRCTF

SEQ ID NO: 1453884 - protein, 36 aa, Mycobacterium tuberculosis; identical to SEQ ID NO: 198968

SEQ ID NO: 1453885 - protein, 17 aa, Mycobacterium tuberculosis
FAGANLIPLRGGPIDLN

SEQ ID NO: 1453886 - protein, 20 aa, Mycobacterium tuberculosis
FAGFRLRASGIATQVTSRSL

SEQ ID NO: 1453887 - protein, 18 aa, Mycobacterium tuberculosis
FAGLPAYQQGLGRKVRFM

SEQ ID NO: 1453888 - protein, 18 aa, Mycobacterium tuberculosis
FAGSWGYQVTSYYAPTSR

SEQ ID NO: 1453889 - protein, 18 aa, Mycobacterium tuberculosis
FAHFQWRAQHNDLKTLPF

SEQ ID NO: 1453890 - protein, 19 aa, Mycobacterium tuberculosis
FALGYSHPVVIEAPEGITF

SEQ ID NO: 1453891 - protein, 25 aa, Mycobacterium tuberculosis
FALTLRLLVIALKHNVILNSTWVDS

SEQ ID NO: 1453892 - protein, 18 aa, Mycobacterium tuberculosis
FAPLEMSAALQALATILT

SEQ ID NO: 1453893 - protein, 19 aa, Mycobacterium tuberculosis
FAQLGTWSGRIVVDGERIA

SEQ ID NO: 1453894 - protein, 19 aa, Mycobacterium tuberculosis
FARSGCRRPALLAHSVAIR

SEQ ID NO: 1453895 - protein, 20 aa, Mycobacterium tuberculosis
FASGDAWPLVPGEIARLTFD

SEQ ID NO: 1453896 - protein, 21 aa, Mycobacterium tuberculosis
FASRLPRYFPTALRERFTPEI

SEQ ID NO: 1453897 - protein, 22 aa, Mycobacterium tuberculosis
FATDHLRLVGLHSHIGSQIFDV

SEQ ID NO: 1453898 - protein, 26 aa, Mycobacterium tuberculosis
FCHNGCPLGNLIPEWNDLVRRGRWRD

SEQ ID NO: 1453899 - protein, 20 aa, Mycobacterium tuberculosis
FDAVIAVHLKGHFATMRHAA

SEQ ID NO: 1453900 - protein, 20 aa, Mycobacterium tuberculosis
FDCPGCAWPEEPGGRKLAEF

SEQ ID NO: 1453901 - protein, 17 aa, Mycobacterium tuberculosis
FDIWSYIGAEQVRLPSI

SEQ ID NO: 1453902 - protein, 20 aa, Mycobacterium tuberculosis
FDKPYLLAMANAGPGTNGSQ

SEQ ID NO: 1453903 - protein, 23 aa, Mycobacterium tuberculosis
FDLIHRLWLDLGHELHYVQNITD

SEQ ID NO: 1453904 - protein, 35 aa, Mycobacterium tuberculosis; identical to SEQ ID NO: 199042

SEQ ID NO: 1453905 - protein, 19 aa, Mycobacterium tuberculosis
FDRINYRGATDPTLDVLQD

SEQ ID NO: 1453906 - protein, 20 aa, Mycobacterium tuberculosis
FDRVIAINLRGAWLCTKHAA

SEQ ID NO: 1453907 - protein, 18 aa, Mycobacterium tuberculosis
FDSLKLFQLITELEDEFD

SEQ ID NO: 1453908 - protein, 20 aa, Mycobacterium tuberculosis
FDTVVDCAFYHTFSTAPELQ

SEQ ID NO: 1453909 - protein, 20 aa, Mycobacterium tuberculosis
FEAGKPFELMELDLDGPGPG

SEQ ID NO: 1453910 - protein, 26 aa, Mycobacterium tuberculosis
FEGELAIVIGRACKDVPAAQAVDNIL

SEQ ID NO: 1453911 - protein, 23 aa, Mycobacterium tuberculosis
FEIKEFKTGAARMAIEAGVPIVP

SEQ ID NO: 1453912 - protein, 18 aa, Mycobacterium tuberculosis
FELLRFLMRNPRRALSRT

SEQ ID NO: 1453913 - protein, 24 aa, Mycobacterium tuberculosis
FESLLPRYLTTRVYAALLESAASE

SEQ ID NO: 1453914 - protein, 18 aa, Mycobacterium tuberculosis
FFAAPLAWQERLWPTEEF

SEQ ID NO: 1453915 - protein, 17 aa, Mycobacterium tuberculosis
FFGRPLKASMFFSPGGV

SEQ ID NO: 1453916 - protein, 18 aa, Mycobacterium tuberculosis
FFNTVYLDDVFVPDELVL

SEQ ID NO: 1453917 - protein, 17 aa, Mycobacterium tuberculosis
FGALLSRGIGDTIRVSL

SEQ ID NO: 1453918 - protein, 18 aa, Mycobacterium tuberculosis
FGDRVMILMLNRTEFVES

SEQ ID NO: 1453919 - protein, 18 aa, Mycobacterium tuberculosis
FGDTEPWHVARTLTNAVL

SEQ ID NO: 1453920 - protein, 20 aa, Mycobacterium tuberculosis
FGEGVRPPWSIGEPQPELAA

SEQ ID NO: 1453921 - protein, 25 aa, Mycobacterium tuberculosis
FGEPGGRELDLWLHRAAVDLVAVHA

SEQ ID NO: 1453922 - protein, 31 aa, Mycobacterium tuberculosis; identical to SEQ ID NO: 199120

SEQ ID NO: 1453923 - protein, 25 aa, Mycobacterium tuberculosis
FGHDIGYRIAHHADLTTPPPIEVHE

SEQ ID NO: 1453924 - protein, 17 aa, Mycobacterium tuberculosis
FGLNMPIAREVDAVINH

SEQ ID NO: 1453925 - protein, 18 aa, Mycobacterium tuberculosis
FGNIIRLLPPLTIGDELL

SEQ ID NO: 1453926 - protein, 24 aa, Mycobacterium tuberculosis
FGNSGSGLSGWFNTSPVGLLAGSG

SEQ ID NO: 1453927 - protein, 17 aa, Mycobacterium tuberculosis
FGPLALASAFADRIAER

SEQ ID NO: 1453928 - protein, 26 aa, Mycobacterium tuberculosis
FGQPEIKLGVLPGMGGSQRLTRAIGK

SEQ ID NO: 1453929 - protein, 20 aa, Mycobacterium tuberculosis
FGRIDGRPVGIVANQPTHFA

SEQ ID NO: 1453930 - protein, 23 aa, Mycobacterium tuberculosis
FHRMAVDAFASLAADAIEAAQQT

SEQ ID NO: 1453931 - protein, 19 aa, Mycobacterium tuberculosis
FIADGAIEVGGRLPINTHG

SEQ ID NO: 1453932 - protein, 25 aa, Mycobacterium tuberculosis
FIAHLPGYQGWQWAVVVASYSGADH

SEQ ID NO: 1453933 - protein, 17 aa, Mycobacterium tuberculosis
FIGHTFAVHDGRKHVPV

SEQ ID NO: 1453934 - protein, 25 aa, Mycobacterium tuberculosis
FIIGRIKDLLIVYGRNHAPDDIEAT

SEQ ID NO: 1453935 - protein, 34 aa, Mycobacterium tuberculosis; identical to SEQ ID NO: 199190

SEQ ID NO: 1453936 - protein, 24 aa, Mycobacterium tuberculosis
FKAMAAGLSSLAGRGDEESGEPAA

SEQ ID NO: 1453937 - protein, 21 aa, Mycobacterium tuberculosis
FKCPRSIAFEPQLPRTDTGKL

SEQ ID NO: 1453938 - protein, 26 aa, Mycobacterium tuberculosis
FKGRNVEIPDHFRIYVSQKLARLERF

SEQ ID NO: 1453939 - protein, 18 aa, Mycobacterium tuberculosis
FKKGKLVFKQAGIANPAI

SEQ ID NO: 1453940 - protein, 23 aa, Mycobacterium tuberculosis
FKLPREGDAEFSFLPRFSPGKGL

SEQ ID NO: 1453941 - protein, 25 aa, Mycobacterium tuberculosis
FKVLLKELQSLCLNVEVLSSDGAAI

SEQ ID NO: 1453942 - protein, 22 aa, Mycobacterium tuberculosis
FKVRRGEVIGLLGPNGAGKTTM

SEQ ID NO: 1453943 - protein, 18 aa, Mycobacterium tuberculosis
FLAGFHIIDRHFATAPLE

SEQ ID NO: 1453944 - protein, 19 aa, Mycobacterium tuberculosis
FLGRLRGSDITRFRCAGRR

SEQ ID NO: 1453945 - protein, 17 aa, Mycobacterium tuberculosis
FLLQGGDCAETFMDNTE

SEQ ID NO: 1453946 - protein, 25 aa, Mycobacterium tuberculosis
FLQRPARWIQLLARNGRTISAGPNF

SEQ ID NO: 1453947 - protein, 20 aa, Mycobacterium tuberculosis
FLVERIRDGGSFCTRRVNAV

SEQ ID NO: 1453948 - protein, 24 aa, Mycobacterium tuberculosis
FNEAADLAAVWQLPVVILVENIRG

SEQ ID NO: 1453949 - protein, 21 aa, Mycobacterium tuberculosis
FPNAPMRAVPMWAHPEPLPPV

SEQ ID NO: 1453950 - protein, 25 aa, Mycobacterium tuberculosis
FPPYHPPMRTFLGVPVRVRDESFGT

SEQ ID NO: 1453951 - protein, 22 aa, Mycobacterium tuberculosis
FPQHRRAHAWWQDTVNGHTRIG

SEQ ID NO: 1453952 - protein, 20 aa, Mycobacterium tuberculosis
FPSKEAVLLTLLDRVVNQAD

SEQ ID NO: 1453953 - protein, 17 aa, Mycobacterium tuberculosis
FPTRSLSDFGFANVDRN

SEQ ID NO: 1453954 - protein, 22 aa, Mycobacterium tuberculosis
FRLRELRAAQSLTQVQVAALAH

SEQ ID NO: 1453955 - protein, 22 aa, Mycobacterium tuberculosis
FRPGDEGRLVLGDRIAAGAQLG

SEQ ID NO: 1453956 - protein, 20 aa, Mycobacterium tuberculosis
FRRFTPRARNAVVAAQNAAH

SEQ ID NO: 1453957 - protein, 28 aa, Mycobacterium tuberculosis
FRRHAGLDLLPRLLFRNGELDISVVRSI

SEQ ID NO: 1453958 - protein, 20 aa, Mycobacterium tuberculosis
FRTSLRSCPAEKRRDMLFDH

SEQ ID NO: 1453959 - protein, 23 aa, Mycobacterium tuberculosis
FSHGGALKSSWYGDCLPESDFPT

SEQ ID NO: 1453960 - protein, 30 aa, Mycobacterium tuberculosis; identical to SEQ ID NO: 199367

SEQ ID NO: 1453961 - protein, 25 aa, Mycobacterium tuberculosis
FTAAARAGLGWGMFPEKLAASPLAD

SEQ ID NO: 1453962 - protein, 25 aa, Mycobacterium tuberculosis
FTAYDCARLRFILTAQRDHYLPLKV

SEQ ID NO: 1453963 - protein, 25 aa, Mycobacterium tuberculosis
FTDPRIATPMLARIGGAALAEDVNG

SEQ ID NO: 1453964 - protein, 17 aa, Mycobacterium tuberculosis
FTHELRMTLRELGSRRV

SEQ ID NO: 1453965 - protein, 23 aa, Mycobacterium tuberculosis
FVEVRRAGIALAREVERRAPDAV

SEQ ID NO: 1453966 - protein, 18 aa, Mycobacterium tuberculosis
FVSQLGFAVAPRVRAAIE

SEQ ID NO: 1453967 - protein, 19 aa, Mycobacterium tuberculosis
FYASIAHLCVDPMIVGVLF

SEQ ID NO: 1453968 - protein, 26 aa, Mycobacterium tuberculosis
GAAEALRWAMMRGEPLVVLADALAEA

SEQ ID NO: 1453969 - protein, 25 aa, Mycobacterium tuberculosis
GAAIDYKAGELLPVEIPEIPEHTPN

SEQ ID NO: 1453970 - protein, 21 aa, Mycobacterium tuberculosis
GADGKLGAFVEVKNSTIGTGT

SEQ ID NO: 1453971 - protein, 18 aa, Mycobacterium tuberculosis
GADIVALDICAPVSGSVT

SEQ ID NO: 1453972 - protein, 23 aa, Mycobacterium tuberculosis
GADPAHQGLHMWLAEYPQPRPPR

SEQ ID NO: 1453973 - protein, 17 aa, Mycobacterium tuberculosis
GADRCFDTPLAESAIIG

SEQ ID NO: 1453974 - protein, 25 aa, Mycobacterium tuberculosis
GAELQARLRLAITRRRSTLAGTLQF

SEQ ID NO: 1453975 - protein, 18 aa, Mycobacterium tuberculosis
GAELTLYLHHCMADGHHG

SEQ ID NO: 1453976 - protein, 17 aa, Mycobacterium tuberculosis
GAGEVQLGLSMLAAAIA

SEQ ID NO: 1453977 - protein, 26 aa, Mycobacterium tuberculosis
GAGLGLRSGLSAGLAHAASAGLGQAN

SEQ ID NO: 1453978 - protein, 20 aa, Mycobacterium tuberculosis
GAIGRHIHDPYALYDALAQE

SEQ ID NO: 1453979 - protein, 25 aa, Mycobacterium tuberculosis
GAIPGGWWLTFGQILGLAQNAPGVA

SEQ ID NO: 1453980 - protein, 19 aa, Mycobacterium tuberculosis
GAIRRRLAAELGLTPDRVD

SEQ ID NO: 1453981 - protein, 20 aa, Mycobacterium tuberculosis
GALLARMIADLGIAVHVGTG

SEQ ID NO: 1453982 - protein, 18 aa, Mycobacterium tuberculosis
GANLARREIRVAFDELRR

SEQ ID NO: 1453983 - protein, 22 aa, Mycobacterium tuberculosis
GAPDVLRYVMGFGGTPDSALTG

SEQ ID NO: 1453984 - protein, 27 aa, Mycobacterium tuberculosis
GAQAFLVDCGRGVLQRAAAVGVGAAGL

SEQ ID NO: 1453985 - protein, 20 aa, Mycobacterium tuberculosis
GAQDTRLVWEERRLRREVRA

SEQ ID NO: 1453986 - protein, 18 aa, Mycobacterium tuberculosis
GAQVRERLALGFGSSSFR

SEQ ID NO: 1453987 - protein, 25 aa, Mycobacterium tuberculosis
GAQWRQAGCSMCLGMNPDQLASGER

SEQ ID NO: 1453988 - protein, 24 aa, Mycobacterium tuberculosis
GAQYSQWGALLARTDPSAPKHNGI

SEQ ID NO: 1453989 - protein, 27 aa, Mycobacterium tuberculosis
GARVVRAHVPLSEMFGYVGDLRSKTQG

SEQ ID NO: 1453990 - protein, 28 aa, Mycobacterium tuberculosis
GASRRARRAGKIPAVLYGHGAEPQHLEL

SEQ ID NO: 1453991 - protein, 23 aa, Mycobacterium tuberculosis
GATPFQRLNFMVGKLNRAMQRNP

SEQ ID NO: 1453992 - protein, 17 aa, Mycobacterium tuberculosis
GATVLAHNYQLPAIQDV

SEQ ID NO: 1453993 - protein, 19 aa, Mycobacterium tuberculosis
GAVARRWHENLAELRHHAD

SEQ ID NO: 1453994 - protein, 26 aa, Mycobacterium tuberculosis
GAVELTGAWPGLRCDVDTPADLTAAR

SEQ ID NO: 1453995 - protein, 18 aa, Mycobacterium tuberculosis
GAVLPILALYVVAAEEQG

SEQ ID NO: 1453996 - protein, 21 aa, Mycobacterium tuberculosis
GAVLREVFVNGIPRRVDRVDL

SEQ ID NO: 1453997 - protein, 19 aa, Mycobacterium tuberculosis
GAVSVELVHNFSLVHDDLM

SEQ ID NO: 1453998 - protein, 20 aa, Mycobacterium tuberculosis
GAYFKGGIAPVSVWVSTEYV

SEQ ID NO: 1453999 - protein, 23 aa, Mycobacterium tuberculosis
GCADSRVAAEIIFDQGLGDMFVV

SEQ ID NO: 1454000 - protein, 20 aa, Mycobacterium tuberculosis
GDDALKRKASSVMLESFLFY

SEQ ID NO: 1454001 - protein, 26 aa, Mycobacterium tuberculosis
GDEVQIGKFRLVFLTGPKQGEDDGST

SEQ ID NO: 1454002 - protein, 18 aa, Mycobacterium tuberculosis
GDFARRGLDPDLAPLYAQ

SEQ ID NO: 1454003 - protein, 25 aa, Mycobacterium tuberculosis
GDGRFALVLCRLFWHPPTFRQACEA

SEQ ID NO: 1454004 - protein, 21 aa, Mycobacterium tuberculosis
GDGRMRGCPFHNAAVEAAGEM

SEQ ID NO: 1454005 - protein, 25 aa, Mycobacterium tuberculosis
GDKSNWWAAYALWVFTLFGHADVRL

SEQ ID NO: 1454006 - protein, 19 aa, Mycobacterium tuberculosis
GDLAPLWSDDVLKAAIDTA

SEQ ID NO: 1454007 - protein, 29 aa, Mycobacterium tuberculosis
GDLDFDWLDDGWLTLLRRWLNDAQRAGVS

SEQ ID NO: 1454008 - protein, 22 aa, Mycobacterium tuberculosis
GDMPARYVIHAATMELGGPTSG

SEQ ID NO: 1454009 - protein, 24 aa, Mycobacterium tuberculosis
GDPDWQRFHLIGATNTVYFALLAR

SEQ ID NO: 1454010 - protein, 19 aa, Mycobacterium tuberculosis
GDRMWEFLDRLTSIALPRI

SEQ ID NO: 1454011 - protein, 21 aa, Mycobacterium tuberculosis
GDRVLLCLPDSPDLVQLLLAC

SEQ ID NO: 1454012 - protein, 28 aa, Mycobacterium tuberculosis
GDSRDGLLRFCRYMEALAAYKKYLDPKD

SEQ ID NO: 1454013 - protein, 19 aa, Mycobacterium tuberculosis
GDTPLPVRTPLPVHLPEPM

SEQ ID NO: 1454014 - protein, 19 aa, Mycobacterium tuberculosis
GEAGRTLRIPSPRLCTDNG

SEQ ID NO: 1454015 - protein, 31 aa, Mycobacterium tuberculosis; identical to SEQ ID NO: 199688

SEQ ID NO: 1454016 - protein, 22 aa, Mycobacterium tuberculosis
GEGWFINQHIVWQVGDEDVAEM

SEQ ID NO: 1454017 - protein, 21 aa, Mycobacterium tuberculosis
GEGYAEDWDLDALWTALKTLY

SEQ ID NO: 1454018 - protein, 24 aa, Mycobacterium tuberculosis
GELGEPFTTAGLCYYRDGSDSVAW

SEQ ID NO: 1454019 - protein, 23 aa, Mycobacterium tuberculosis
GELTQLAGVFGFADCIDLLANYT

SEQ ID NO: 1454020 - protein, 22 aa, Mycobacterium tuberculosis
GENLFRPLLMRVTSEGVGKGIS

SEQ ID NO: 1454021 - protein, 23 aa, Mycobacterium tuberculosis
GEPQEFFQYLPSTGMAPQPREWF

SEQ ID NO: 1454022 - protein, 19 aa, Mycobacterium tuberculosis
GEPSLGFTTYGKVKLGNLR

SEQ ID NO: 1454023 - protein, 24 aa, Mycobacterium tuberculosis
GERRRVALCKLLLSKPDLLLLDEP

SEQ ID NO: 1454024 - protein, 36 aa, Mycobacterium tuberculosis; identical to SEQ ID NO: 199734

SEQ ID NO: 1454025 - protein, 26 aa, Mycobacterium tuberculosis
GESVTEGTVIRWLKKIGDSVQVDEPL

SEQ ID NO: 1454026 - protein, 19 aa, Mycobacterium tuberculosis
GEVQTRLRLGQDREALEAA

SEQ ID NO: 1454027 - protein, 22 aa, Mycobacterium tuberculosis
GEWRYFPGDNYRYPHWDYNPHD

SEQ ID NO: 1454028 - protein, 17 aa, Mycobacterium tuberculosis
GEYASWLDSERVVVNVY

SEQ ID NO: 1454029 - protein, 24 aa, Mycobacterium tuberculosis
GEYVFWPDPRLVFQSLAQKYGAIV

SEQ ID NO: 1454030 - protein, 20 aa, Mycobacterium tuberculosis
GFETKVCWFPDSGNPGLVAE

SEQ ID NO: 1454031 - protein, 25 aa, Mycobacterium tuberculosis
GFGEQKARIFLALLGKQYGVTPKGW

SEQ ID NO: 1454032 - protein, 17 aa, Mycobacterium tuberculosis
GFGRIGRNFYRALLAQQ

SEQ ID NO: 1454033 - protein, 28 aa, Mycobacterium tuberculosis
GFHVYARIAPCWSFPQVRLAAQTVAREV

SEQ ID NO: 1454034 - protein, 25 aa, Mycobacterium tuberculosis
GFKRDDWSLPLAVLVDGRAVGVQAL

SEQ ID NO: 1454035 - protein, 20 aa, Mycobacterium tuberculosis
GFNIARVVAVALGYDFLPGT

SEQ ID NO: 1454036 - protein, 25 aa, Mycobacterium tuberculosis
GFQVPEFRRKAVVIAVGGVYDPRIH

SEQ ID NO: 1454037 - protein, 20 aa, Mycobacterium tuberculosis
GFRRSHLEALITQRTLSRLR

SEQ ID NO: 1454038 - protein, 23 aa, Mycobacterium tuberculosis
GFSHFTLLLVHALRQQFSRVRVF

SEQ ID NO: 1454039 - protein, 29 aa, Mycobacterium tuberculosis
GGAELRITLPTPRPPFHEELPRITSSDTK

SEQ ID NO: 1454040 - protein, 18 aa, Mycobacterium tuberculosis
GGATAFWDAAAFGLIDKR

SEQ ID NO: 1454041 - protein, 26 aa, Mycobacterium tuberculosis
GGAVEWHKMGAGWSWTRTSRKAGTDV

SEQ ID NO: 1454042 - protein, 19 aa, Mycobacterium tuberculosis
GGCELAMMCDVLIAADTAK

SEQ ID NO: 1454043 - protein, 22 aa, Mycobacterium tuberculosis
GGDGRCKLVPYARRTPRMARTR

SEQ ID NO: 1454044 - protein, 20 aa, Mycobacterium tuberculosis
GGDLRRMGISAATVAALGQA

SEQ ID NO: 1454045 - protein, 23 aa, Mycobacterium tuberculosis
GGDSDWSHGMWKGEKFVERRTYD

SEQ ID NO: 1454046 - protein, 20 aa, Mycobacterium tuberculosis
GGELAVALHASFPPERITLH

SEQ ID NO: 1454047 - protein, 23 aa, Mycobacterium tuberculosis
GGERNRLNLALTLKQGGNLILLD

SEQ ID NO: 1454048 - protein, 22 aa, Mycobacterium tuberculosis
GGLKVTTANAWFAARPSGTEDV

SEQ ID NO: 1454049 - protein, 22 aa, Mycobacterium tuberculosis
GGMRRRVRLASVLRRCTVLDAH

SEQ ID NO: 1454050 - protein, 25 aa, Mycobacterium tuberculosis
GGRRICIGQSFALMEMVLMAAIMSQ

SEQ ID NO: 1454051 - protein, 19 aa, Mycobacterium tuberculosis
GGVPVGWEVASALGAELDV

SEQ ID NO: 1454052 - protein, 20 aa, Mycobacterium tuberculosis
GGVVPPDLTVVSWLPLYHDM

SEQ ID NO: 1454053 - protein, 22 aa, Mycobacterium tuberculosis
GHAVLCGLSALPDDYAGNVVVT

SEQ ID NO: 1454054 - protein, 17 aa, Mycobacterium tuberculosis
GHAYEYIATDAIARFKR

SEQ ID NO: 1454055 - protein, 24 aa, Mycobacterium tuberculosis
GHDHQRIAPLVGELADTLGRTIDV

SEQ ID NO: 1454056 - protein, 23 aa, Mycobacterium tuberculosis
GHDLPACHVYRTFDDLDAIRAGA

SEQ ID NO: 1454057 - protein, 19 aa, Mycobacterium tuberculosis
GHEVLRCRFDRDAMALVAQ

SEQ ID NO: 1454058 - protein, 19 aa, Mycobacterium tuberculosis
GHFATMRHAASHWRGLSKA

SEQ ID NO: 1454059 - protein, 17 aa, Mycobacterium tuberculosis
GHREALVDMVARRRFNY

SEQ ID NO: 1454060 - protein, 24 aa, Mycobacterium tuberculosis
GIDPDLYSGFAFGMGLERTLQFRN

SEQ ID NO: 1454061 - protein, 18 aa, Mycobacterium tuberculosis
GIDTETWYPAGPARTGSV

SEQ ID NO: 1454062 - protein, 18 aa, Mycobacterium tuberculosis
GIERPDYSITGWVILTLI

SEQ ID NO: 1454063 - protein, 25 aa, Mycobacterium tuberculosis
GIKECQQRFPFPMTVFDSDCGGEFI

SEQ ID NO: 1454064 - protein, 20 aa, Mycobacterium tuberculosis
GIPLLRLAAQTALLESEALA

SEQ ID NO: 1454065 - protein, 18 aa, Mycobacterium tuberculosis
GKANRWHTDVTFAANYPA

SEQ ID NO: 1454066 - protein, 19 aa, Mycobacterium tuberculosis
GKDISCNLGSLNIAKTMDS

SEQ ID NO: 1454067 - protein, 20 aa, Mycobacterium tuberculosis
GKGFAGTMKRHGFRGQGASH

SEQ ID NO: 1454068 - protein, 33 aa, Mycobacterium tuberculosis; identical to SEQ ID NO: 199982

SEQ ID NO: 1454069 - protein, 33 aa, Mycobacterium tuberculosis; identical to SEQ ID NO: 199994

SEQ ID NO: 1454070 - protein, 26 aa, Mycobacterium tuberculosis
GKVTKLVPFGAFVRVEEGIEGLVHIS

SEQ ID NO: 1454071 - protein, 19 aa, Mycobacterium tuberculosis
GLAGQRCVDRLVMGASRST

SEQ ID NO: 1454072 - protein, 20 aa, Mycobacterium tuberculosis
GLAGRPRLLIADEPTSALDV

SEQ ID NO: 1454073 - protein, 26 aa, Mycobacterium tuberculosis
GLASPVRSAGPWAAWAATARSAQLAG

SEQ ID NO: 1454074 - protein, 26 aa, Mycobacterium tuberculosis
GLDRVRGPIPFSLRKFLAGKQVVPHQ

SEQ ID NO: 1454075 - protein, 25 aa, Mycobacterium tuberculosis
GLEGGRFAIYIKMHHSLIDGYTGQK

SEQ ID NO: 1454076 - protein, 27 aa, Mycobacterium tuberculosis
GLEKCIGCELCAWACPADAIYVEGADN

SEQ ID NO: 1454077 - protein, 17 aa, Mycobacterium tuberculosis
GLGEKDLSLALALGEVV

SEQ ID NO: 1454078 - protein, 20 aa, Mycobacterium tuberculosis
GLGFSMKWNMGWMHDTLDYV

SEQ ID NO: 1454079 - protein, 18 aa, Mycobacterium tuberculosis
GLPILGHMIEMLRGGPDY

SEQ ID NO: 1454080 - protein, 26 aa, Mycobacterium tuberculosis
GLTRFAEAMAPFGFDAGAVLPSYGLA

SEQ ID NO: 1454081 - protein, 21 aa, Mycobacterium tuberculosis
GLVAGALRLTADYVANRKQFG

SEQ ID NO: 1454082 - protein, 19 aa, Mycobacterium tuberculosis
GLVGLPWHAAYSASKYGLR

SEQ ID NO: 1454083 - protein, 18 aa, Mycobacterium tuberculosis
GMRSHPGVTATFCEALAA

SEQ ID NO: 1454084 - protein, 21 aa, Mycobacterium tuberculosis
GMSLRSPARFLASAERLVQLW

SEQ ID NO: 1454085 - protein, 26 aa, Mycobacterium tuberculosis
GMVFQRPNPFPAMSIRNNVVAGLKLQ

SEQ ID NO: 1454086 - protein, 26 aa, Mycobacterium tuberculosis
GNELLRRLKGLPGFGEQKARIFLALL

SEQ ID NO: 1454087 - protein, 32 aa, Mycobacterium tuberculosis; identical to SEQ ID NO: 200139

SEQ ID NO: 1454088 - protein, 31 aa, Mycobacterium tuberculosis; identical to SEQ ID NO: 200141

SEQ ID NO: 1454089 - protein, 22 aa, Mycobacterium tuberculosis
GNPDEYGALVLHIIENPMLNGE

SEQ ID NO: 1454090 - protein, 26 aa, Mycobacterium tuberculosis
GNPEGGWTLVSWDGIPVGPASLPTAL

SEQ ID NO: 1454091 - protein, 21 aa, Mycobacterium tuberculosis
GNRSLPFPTLVSILLTDIRVE

SEQ ID NO: 1454092 - protein, 18 aa, Mycobacterium tuberculosis
GNTFEWDPNSTYVRKPPY

SEQ ID NO: 1454093 - protein, 17 aa, Mycobacterium tuberculosis
GPACPQPAIPNMPLDLG

SEQ ID NO: 1454094 - protein, 25 aa, Mycobacterium tuberculosis
GPARTGCLECGCCMTGCRHGAKNTL

SEQ ID NO: 1454095 - protein, 17 aa, Mycobacterium tuberculosis
GPDLALVVHWYAGDLDR

SEQ ID NO: 1454096 - protein, 26 aa, Mycobacterium tuberculosis
GPGFADHFLPVAFDRFTRADTARGGR

SEQ ID NO: 1454097 - protein, 23 aa, Mycobacterium tuberculosis
GPGTRLDGAVIFDGVRVEAGCVI

SEQ ID NO: 1454098 - protein, 22 aa, Mycobacterium tuberculosis
GPHGLLRGLPLGSRITRRSGAF

SEQ ID NO: 1454099 - protein, 22 aa, Mycobacterium tuberculosis
GPHKNFAVGLGCDLAHAHKLVY

SEQ ID NO: 1454100 - protein, 25 aa, Mycobacterium tuberculosis
GPLDWAVELDERWVIVGPNGAGKTS

SEQ ID NO: 1454101 - protein, 24 aa, Mycobacterium tuberculosis
GPLLDAMGLTVGWITADSTPDERR

SEQ ID NO: 1454102 - protein, 20 aa, Mycobacterium tuberculosis
GPLTECLADVVARFLPYFTD

SEQ ID NO: 1454103 - protein, 22 aa, Mycobacterium tuberculosis
GPPGCGKTLIAKAVANSLAKKM

SEQ ID NO: 1454104 - protein, 24 aa, Mycobacterium tuberculosis
GPWIADRLLELGVELAHITICGDR

SEQ ID NO: 1454105 - protein, 17 aa, Mycobacterium tuberculosis
GQAAWAMDQIMTGNARP

SEQ ID NO: 1454106 - protein, 25 aa, Mycobacterium tuberculosis
GQGFGRAVPQYGFRPNFVARPPAAG

SEQ ID NO: 1454107 - protein, 19 aa, Mycobacterium tuberculosis
GQLSKWSRMDAELIAEHAE

SEQ ID NO: 1454108 - protein, 22 aa, Mycobacterium tuberculosis
GQQQLLCLARTLAVNPEVLLLD

SEQ ID NO: 1454109 - protein, 19 aa, Mycobacterium tuberculosis
GQYAAGWQGGEKVVGLLDE

SEQ ID NO: 1454110 - protein, 18 aa, Mycobacterium tuberculosis
GRANRFGWRAYLGDADAR

SEQ ID NO: 1454111 - protein, 21 aa, Mycobacterium tuberculosis
GRAPLDLAVFRAWKLHDELGL

SEQ ID NO: 1454112 - protein, 25 aa, Mycobacterium tuberculosis
GRFLPDRWVYEFGRRRNIAIQRKLY

SEQ ID NO: 1454113 - protein, 21 aa, Mycobacterium tuberculosis
GRKVLGEGWGDVLVGAVGRGE

SEQ ID NO: 1454114 - protein, 21 aa, Mycobacterium tuberculosis
GRLAVRPGRCVVVSAHSAGVT

SEQ ID NO: 1454115 - protein, 21 aa, Mycobacterium tuberculosis
GRLILADAIVRACEDKPDYLI

SEQ ID NO: 1454116 - protein, 20 aa, Mycobacterium tuberculosis
GRNDIRIEAALAKLWSSEMA

SEQ ID NO: 1454117 - protein, 19 aa, Mycobacterium tuberculosis
GRNQLRVAMFPAVEPDDVS

SEQ ID NO: 1454118 - protein, 18 aa, Mycobacterium tuberculosis
GRPDRRITAMRARELGRT

SEQ ID NO: 1454119 - protein, 29 aa, Mycobacterium tuberculosis
GRSGEPFPYPVTVGYMYIMKLHHLVDDKI

SEQ ID NO: 1454120 - protein, 20 aa, Mycobacterium tuberculosis
GRSGTALGLAAAGRCVTAID

SEQ ID NO: 1454121 - protein, 20 aa, Mycobacterium tuberculosis
GRSLRACIDLAALGENTIAI

SEQ ID NO: 1454122 - protein, 19 aa, Mycobacterium tuberculosis
GRVGPHLEIKVVDPATGET

SEQ ID NO: 1454123 - protein, 18 aa, Mycobacterium tuberculosis
GRVITCPFIPGRVPEDLL

SEQ ID NO: 1454124 - protein, 19 aa, Mycobacterium tuberculosis
GRVTYPLSTMVGRFDETAA

SEQ ID NO: 1454125 - protein, 19 aa, Mycobacterium tuberculosis
GRWGCVLGGRPDRRITAMR

SEQ ID NO: 1454126 - protein, 24 aa, Mycobacterium tuberculosis
GRYDEPRKGMAVLLDALPKVVQRF

SEQ ID NO: 1454127 - protein, 24 aa, Mycobacterium tuberculosis
GSDAWKAYMRRATNTVNYSSELPL

SEQ ID NO: 1454128 - protein, 24 aa, Mycobacterium tuberculosis
GSEFAFSLVYEVSFGTPGEEQKAS

SEQ ID NO: 1454129 - protein, 20 aa, Mycobacterium tuberculosis
GSIDRCGQVLFIDARELGDL

SEQ ID NO: 1454130 - protein, 19 aa, Mycobacterium tuberculosis
GSLRARMFAANLGVTEDEA

SEQ ID NO: 1454131 - protein, 25 aa, Mycobacterium tuberculosis
GSNSLPELLVFGARAGRAAADYAAR

SEQ ID NO: 1454132 - protein, 26 aa, Mycobacterium tuberculosis
GSQALRPAMFSTFLMWVLADLFTFLP

SEQ ID NO: 1454133 - protein, 18 aa, Mycobacterium tuberculosis
GSSIQLLGKEASYASLRM

SEQ ID NO: 1454134 - protein, 20 aa, Mycobacterium tuberculosis
GSSRPPRLVRLIHRGSRLAK

SEQ ID NO: 1454135 - protein, 20 aa, Mycobacterium tuberculosis
GSWLTMIRLAKCGPWHRGGW

SEQ ID NO: 1454136 - protein, 23 aa, Mycobacterium tuberculosis
GTAFPRLYGVQTRFFDDFFNCAD

SEQ ID NO: 1454137 - protein, 19 aa, Mycobacterium tuberculosis
GTEMGRAPLDLAVFRAWKL

SEQ ID NO: 1454138 - protein, 22 aa, Mycobacterium tuberculosis
GTEMRAAVLYFAFAELEAQVAT

SEQ ID NO: 1454139 - protein, 26 aa, Mycobacterium tuberculosis
GTEPLRMARDLVRRGLDTVAFNIYRT

SEQ ID NO: 1454140 - protein, 20 aa, Mycobacterium tuberculosis
GTIGCPSFWNPIATGGASRQ

SEQ ID NO: 1454141 - protein, 25 aa, Mycobacterium tuberculosis
GTKGKRYALPHARILMHQPLGGVTG

SEQ ID NO: 1454142 - protein, 18 aa, Mycobacterium tuberculosis
GTKILNFLADVTVNNPYG

SEQ ID NO: 1454143 - protein, 18 aa, Mycobacterium tuberculosis
GTLLRRDLPLIAEAAQQV

SEQ ID NO: 1454144 - protein, 17 aa, Mycobacterium tuberculosis
GTLNFGFIGCRDTLPHL

SEQ ID NO: 1454145 - protein, 25 aa, Mycobacterium tuberculosis
GTPTFSRYVEIGVDFEAHRPVVESV

SEQ ID NO: 1454146 - protein, 18 aa, Mycobacterium tuberculosis
GTSLGEGPARAWERGRFA

SEQ ID NO: 1454147 - protein, 25 aa, Mycobacterium tuberculosis
GTTKGEAECARWVAEQLAEVGYQPE

SEQ ID NO: 1454148 - protein, 20 aa, Mycobacterium tuberculosis
GVDQVRYFLLREVPFGQDGS

SEQ ID NO: 1454149 - protein, 23 aa, Mycobacterium tuberculosis
GVGRAKTGYFLELEDPVKISLMR

SEQ ID NO: 1454150 - protein, 18 aa, Mycobacterium tuberculosis
GVHTLPMLYALRESGPDC

SEQ ID NO: 1454151 - protein, 18 aa, Mycobacterium tuberculosis
GVPLIEIVTKPIVGAGAR

SEQ ID NO: 1454152 - protein, 26 aa, Mycobacterium tuberculosis
GVTGRLRPAMLEFMDSVAINAVEDTL

SEQ ID NO: 1454153 - protein, 23 aa, Mycobacterium tuberculosis
GVVWGIDSFDQWGVELGKTQAKA

SEQ ID NO: 1454154 - protein, 18 aa, Mycobacterium tuberculosis
GVWYCADAPFGGYKQSGI

SEQ ID NO: 1454155 - protein, 18 aa, Mycobacterium tuberculosis
GWGLPYAALMAGADLVLP

SEQ ID NO: 1454156 - protein, 27 aa, Mycobacterium tuberculosis
GYDESLWRLLCEQVGAAALVIPEELGG

SEQ ID NO: 1454157 - protein, 39 aa, Mycobacterium tuberculosis; identical to SEQ ID NO: 200609

SEQ ID NO: 1454158 - protein, 18 aa, Mycobacterium tuberculosis
GYIVISAYVPKHWQKLCY

SEQ ID NO: 1454159 - protein, 26 aa, Mycobacterium tuberculosis
GYLQRMSTVLSRRLWENAGSPEVDTN

SEQ ID NO: 1454160 - protein, 20 aa, Mycobacterium tuberculosis
GYLTAKWPLGQWEFVDPEAS

SEQ ID NO: 1454161 - protein, 18 aa, Mycobacterium tuberculosis
GYTYGGRIAALADAAREN

SEQ ID NO: 1454162 - protein, 18 aa, Mycobacterium tuberculosis
HAASHWRGLSKAGKAPKD

SEQ ID NO: 1454163 - protein, 20 aa, Mycobacterium tuberculosis
HAASRASIRRRFERIDRTFD

SEQ ID NO: 1454164 - protein, 33 aa, Mycobacterium tuberculosis; identical to SEQ ID NO: 200637

SEQ ID NO: 1454165 - protein, 23 aa, Mycobacterium tuberculosis
HAAVLWRYALRLTGDAAQAEDVV

SEQ ID NO: 1454166 - protein, 18 aa, Mycobacterium tuberculosis
HAEACRWEHVMSEDVERR

SEQ ID NO: 1454167 - protein, 23 aa, Mycobacterium tuberculosis
HAEGDRVAAFWAQAMRLRDLLKF

SEQ ID NO: 1454168 - protein, 25 aa, Mycobacterium tuberculosis
HAGLSSRAEWLPAWEEGLRRASAAI

SEQ ID NO: 1454169 - protein, 24 aa, Mycobacterium tuberculosis
HAKAEVLKLINWELASSQSGPKDA

SEQ ID NO: 1454170 - protein, 24 aa, Mycobacterium tuberculosis
HAKDSKFPPVRVRGNLSLDALILM

SEQ ID NO: 1454171 - protein, 21 aa, Mycobacterium tuberculosis
HAKGKLTARERIYALLDEDSF

SEQ ID NO: 1454172 - protein, 22 aa, Mycobacterium tuberculosis
HALAQGADWVWLADDDGHAQDA

SEQ ID NO: 1454173 - protein, 21 aa, Mycobacterium tuberculosis
HARSRAAVVLRALERERRRRL

SEQ ID NO: 1454174 - protein, 20 aa, Mycobacterium tuberculosis
HAYRNALRYVELEYHGEVQL

SEQ ID NO: 1454175 - protein, 23 aa, Mycobacterium tuberculosis
HDDWRWVIDVDLWGSIHTVEAFL

SEQ ID NO: 1454176 - protein, 17 aa, Mycobacterium tuberculosis
HDLRRWTHDVHHSVDDA

SEQ ID NO: 1454177 - protein, 24 aa, Mycobacterium tuberculosis
HEGKPFFGSLLEFITSGPVVAAIV

SEQ ID NO: 1454178 - protein, 19 aa, Mycobacterium tuberculosis
HEGLRRWGVDAEVRDRFLG

SEQ ID NO: 1454179 - protein, 21 aa, Mycobacterium tuberculosis
HERAESIALPVVYVNVPEMSV

SEQ ID NO: 1454180 - protein, 21 aa, Mycobacterium tuberculosis
HETGETFIFVEQWADAEALKA

SEQ ID NO: 1454181 - protein, 22 aa, Mycobacterium tuberculosis
HFFVCSTHDLILFFTTQGRVYR

SEQ ID NO: 1454182 - protein, 24 aa, Mycobacterium tuberculosis
HFGARRKAFNWGLAQVKADLDAKA

SEQ ID NO: 1454183 - protein, 18 aa, Mycobacterium tuberculosis
HGHFSRAVITRWVQLPLA

SEQ ID NO: 1454184 - protein, 18 aa, Mycobacterium tuberculosis
HGIRVTWAVLNDGQMSAS

SEQ ID NO: 1454185 - protein, 25 aa, Mycobacterium tuberculosis
HGKNTVLWCGYTWQYWLTTRSVNPA

SEQ ID NO: 1454186 - protein, 24 aa, Mycobacterium tuberculosis
HGLRSKVIRCLYRVSEGGAGLAAA

SEQ ID NO: 1454187 - protein, 21 aa, Mycobacterium tuberculosis
HGLSWGFDRIFAASANHSVWF

SEQ ID NO: 1454188 - protein, 17 aa, Mycobacterium tuberculosis
HGMPIGNVMPGFGHVGL

SEQ ID NO: 1454189 - protein, 24 aa, Mycobacterium tuberculosis
HGTNLKAWLYRILTNTYINSYRKK

SEQ ID NO: 1454190 - protein, 18 aa, Mycobacterium tuberculosis
HHGCTSPDGTPCRLQGKG

SEQ ID NO: 1454191 - protein, 22 aa, Mycobacterium tuberculosis
HKLPPRILAAVVEFAFGDLSRE

SEQ ID NO: 1454192 - protein, 24 aa, Mycobacterium tuberculosis
HLADEAFRLLGHVDVVFSNAGIVV

SEQ ID NO: 1454193 - protein, 19 aa, Mycobacterium tuberculosis
HLATRLSAMFRTRRFRVYT

SEQ ID NO: 1454194 - protein, 18 aa, Mycobacterium tuberculosis
HLCVDPMIVGVLFIEIHM

SEQ ID NO: 1454195 - protein, 23 aa, Mycobacterium tuberculosis
HLGSWRPGLSYRQLARELTDYIV

SEQ ID NO: 1454196 - protein, 18 aa, Mycobacterium tuberculosis
HNSQPWRWIAEDHTVALF

SEQ ID NO: 1454197 - protein, 20 aa, Mycobacterium tuberculosis
HPFDLLARARFRVTVNTDNR

SEQ ID NO: 1454198 - protein, 24 aa, Mycobacterium tuberculosis
HPMAVPAFALALMRRSLAGSNIGG

SEQ ID NO: 1454199 - protein, 24 aa, Mycobacterium tuberculosis
HPRPGRDAWEFALLRGALQRGMPV

SEQ ID NO: 1454200 - protein, 18 aa, Mycobacterium tuberculosis
HPVDAIIYGTGFAIADQV

SEQ ID NO: 1454201 - protein, 25 aa, Mycobacterium tuberculosis
HPWERDWSYGWSLMRIGALLRRTNM

SEQ ID NO: 1454202 - protein, 25 aa, Mycobacterium tuberculosis
HPYFPRLRLELDKGLGWKAEVEAAL

SEQ ID NO: 1454203 - protein, 23 aa, Mycobacterium tuberculosis
HPYRVRHLLDRYGSLISDVLAMA

SEQ ID NO: 1454204 - protein, 23 aa, Mycobacterium tuberculosis
HQPGARLFLHYGDLIDGTRLVTL

SEQ ID NO: 1454205 - protein, 23 aa, Mycobacterium tuberculosis
HRLSKLGEWEAMGGLIDDEMLGA

SEQ ID NO: 1454206 - protein, 21 aa, Mycobacterium tuberculosis
HRPCNSAEWTAAVAGFAGSSA

SEQ ID NO: 1454207 - protein, 25 aa, Mycobacterium tuberculosis
HSIRLAKACAAEGAHGLLVVTPYYS

SEQ ID NO: 1454208 - protein, 19 aa, Mycobacterium tuberculosis
HSSIGRWWLFGKRDDRGLG

SEQ ID NO: 1454209 - protein, 21 aa, Mycobacterium tuberculosis
HSSVRFNTPFGGFKQSGVGRE

SEQ ID NO: 1454210 - protein, 18 aa, Mycobacterium tuberculosis
HTHELRQTVLALLAGHDL

SEQ ID NO: 1454211 - protein, 26 aa, Mycobacterium tuberculosis
HTVEMWCPVIGDGAFQRVLDVEVTSE

SEQ ID NO: 1454212 - protein, 22 aa, Mycobacterium tuberculosis
HWVDELRPLTGQHPAVRDYVLH

SEQ ID NO: 1454213 - protein, 23 aa, Mycobacterium tuberculosis
HYLESWLLPSLGLRATVFHFNPS

SEQ ID NO: 1454214 - protein, 28 aa, Mycobacterium tuberculosis
IAAACTLRGWLGMWSLRVAQTRAAPHLA

SEQ ID NO: 1454215 - protein, 26 aa, Mycobacterium tuberculosis
IAAALALGAEGVWCGSVWLTTEEAET

SEQ ID NO: 1454216 - protein, 19 aa, Mycobacterium tuberculosis
IAADQEFILRAALVCEPVT

SEQ ID NO: 1454217 - protein, 24 aa, Mycobacterium tuberculosis
IAAIGPRAEQRWGVSAGDRVAVEV

SEQ ID NO: 1454218 - protein, 25 aa, Mycobacterium tuberculosis
IAATEARYGEMWAQDASAMYGYAAA

SEQ ID NO: 1454219 - protein, 23 aa, Mycobacterium tuberculosis
IADGCMRAGCALLGGETAEHPGL

SEQ ID NO: 1454220 - protein, 21 aa, Mycobacterium tuberculosis
IADRELETWLVVDMSASLDFG

SEQ ID NO: 1454221 - protein, 23 aa, Mycobacterium tuberculosis
IAEELWLRLGNTTSLAHGPFPKA

SEQ ID NO: 1454222 - protein, 25 aa, Mycobacterium tuberculosis
IAGLLRPDAGLVRLGDRVLTDTEAG

SEQ ID NO: 1454223 - protein, 17 aa, Mycobacterium tuberculosis
IAGQRWIAAGLFDPAVR

SEQ ID NO: 1454224 - protein, 25 aa, Mycobacterium tuberculosis
IAGVKLLPTLMAFKKGKLVFKQAGI

SEQ ID NO: 1454225 - protein, 21 aa, Mycobacterium tuberculosis
IAMNMGMDGAWGQWVNRWTAE

SEQ ID NO: 1454226 - protein, 23 aa, Mycobacterium tuberculosis
IAPEELCALPGIQEVLGLHAVGE

SEQ ID NO: 1454227 - protein, 23 aa, Mycobacterium tuberculosis
IAQTVVVAFDYSCIVSLELLARR

SEQ ID NO: 1454228 - protein, 26 aa, Mycobacterium tuberculosis
IASEIYPVLCGSAFKNKGVQPMLDAV

SEQ ID NO: 1454229 - protein, 17 aa, Mycobacterium tuberculosis
IASGYLLHRHERLEQIR

SEQ ID NO: 1454230 - protein, 20 aa, Mycobacterium tuberculosis
IASNTLWPRTMVATAAVQNL

SEQ ID NO: 1454231 - protein, 25 aa, Mycobacterium tuberculosis
IAVPDRHTAGWAMRELVVLHEVAHH

SEQ ID NO: 1454232 - protein, 23 aa, Mycobacterium tuberculosis
IAVTRLGVTSVRFTGGEPLLAHH

SEQ ID NO: 1454233 - protein, 19 aa, Mycobacterium tuberculosis
ICTGSRPALPDLPGITEAR

SEQ ID NO: 1454234 - protein, 24 aa, Mycobacterium tuberculosis
IDALRWLAANVPIYAVNVLLSTAT

SEQ ID NO: 1454235 - protein, 21 aa, Mycobacterium tuberculosis
IDERALAIGLRVMVNIIEQAA

SEQ ID NO: 1454236 - protein, 25 aa, Mycobacterium tuberculosis
IDMLRGGFELAYRLLSYPKPVVMAC

SEQ ID NO: 1454237 - protein, 24 aa, Mycobacterium tuberculosis
IDNRLQWYIDLGIRRENLRLWEHP

SEQ ID NO: 1454238 - protein, 33 aa, Mycobacterium tuberculosis; identical to SEQ ID NO: 201043

SEQ ID NO: 1454239 - protein, 25 aa, Mycobacterium tuberculosis
IDPQQRLLLETSWEAMEHAGLTQQT

SEQ ID NO: 1454240 - protein, 22 aa, Mycobacterium tuberculosis
IDPRTRWLLRELVYALLVKKDH

SEQ ID NO: 1454241 - protein, 18 aa, Mycobacterium tuberculosis
IDRATLQPGPTFVRQFRE

SEQ ID NO: 1454242 - protein, 23 aa, Mycobacterium tuberculosis
IDRRPDLPTGKALVIAEGVLVVQ

SEQ ID NO: 1454243 - protein, 17 aa, Mycobacterium tuberculosis
IDSTRGTVHLVIGGGGT

SEQ ID NO: 1454244 - protein, 23 aa, Mycobacterium tuberculosis
IDTKLEGGQAFTAEDQPRLLDEP

SEQ ID NO: 1454245 - protein, 19 aa, Mycobacterium tuberculosis
IDVAYRYFATPKRKFIIAD

SEQ ID NO: 1454246 - protein, 18 aa, Mycobacterium tuberculosis
IDVRGRRSAVSAQPGTLG

SEQ ID NO: 1454247 - protein, 25 aa, Mycobacterium tuberculosis
IEAQLRFMAEQGVDLIVTSGGLGPT

SEQ ID NO: 1454248 - protein, 24 aa, Mycobacterium tuberculosis
IEARCVSMVADLFHAEGLRDHDPT

SEQ ID NO: 1454249 - protein, 26 aa, Mycobacterium tuberculosis
IEDFSGSMSLSFSDPRFDDVKAPVDE

SEQ ID NO: 1454250 - protein, 18 aa, Mycobacterium tuberculosis
IEGVKRFISGGDVGNTAE

SEQ ID NO: 1454251 - protein, 25 aa, Mycobacterium tuberculosis
IEGVLGRDCLLSWCMTSNQLPGAVA

SEQ ID NO: 1454252 - protein, 24 aa, Mycobacterium tuberculosis
IEHAELPPGWVLTTSGRISGVTEP

SEQ ID NO: 1454253 - protein, 23 aa, Mycobacterium tuberculosis
IEKMLACGAAYVIDREMGEYQDI

SEQ ID NO: 1454254 - protein, 25 aa, Mycobacterium tuberculosis
IELDGLRLITWRGASRAEQGLPFAR

SEQ ID NO: 1454255 - protein, 25 aa, Mycobacterium tuberculosis
IESAGLRPGADVALALDAAATEFFT

SEQ ID NO: 1454256 - protein, 21 aa, Mycobacterium tuberculosis
IESYAPLMAYLVRSMQSGGEL

SEQ ID NO: 1454257 - protein, 33 aa, Mycobacterium tuberculosis; identical to SEQ ID NO: 81075

SEQ ID NO: 1454258 - protein, 17 aa, Mycobacterium tuberculosis
IFDSVYDIYRGVVTYVR

SEQ ID NO: 1454259 - protein, 17 aa, Mycobacterium tuberculosis
IFHRACEAVMPGGVLAW

SEQ ID NO: 1454260 - protein, 19 aa, Mycobacterium tuberculosis
IGAGDGFSAIGAVDKPVVR

SEQ ID NO: 1454261 - protein, 28 aa, Mycobacterium tuberculosis
IGDTARPARAWLFTVARNMIIDERRSAR

SEQ ID NO: 1454262 - protein, 22 aa, Mycobacterium tuberculosis
IGGGLRRFLDELGELPNKSLIV

SEQ ID NO: 1454263 - protein, 24 aa, Mycobacterium tuberculosis
IGGMPAPPPLAWAVNEMIYCANPS

SEQ ID NO: 1454264 - protein, 18 aa, Mycobacterium tuberculosis
IGKDIIRFHAVYWPAFLM

SEQ ID NO: 1454265 - protein, 18 aa, Mycobacterium tuberculosis
IGLGRGYRWLQLFDAAGL

SEQ ID NO: 1454266 - protein, 27 aa, Mycobacterium tuberculosis
IGQRSWRMFAPFLRPVFSRGYPLSAAE

SEQ ID NO: 1454267 - protein, 18 aa, Mycobacterium tuberculosis
IGSPASWTSAVEAQQQSK

SEQ ID NO: 1454268 - protein, 17 aa, Mycobacterium tuberculosis
IGTMIKQLLEEVRAAPL

SEQ ID NO: 1454269 - protein, 18 aa, Mycobacterium tuberculosis
IGTTCCFATQDKVWVTGP

SEQ ID NO: 1454270 - protein, 23 aa, Mycobacterium tuberculosis
IGVKNYPFYFGFLKSKLRTGGLL

SEQ ID NO: 1454271 - protein, 20 aa, Mycobacterium tuberculosis
IHIRAGSLFVDRPLGDTRAR

SEQ ID NO: 1454272 - protein, 24 aa, Mycobacterium tuberculosis
IIADHSRTAAILIGDGVSPGNDGR

SEQ ID NO: 1454273 - protein, 19 aa, Mycobacterium tuberculosis
IIAGHCVGGAPSVRSQAHM

SEQ ID NO: 1454274 - protein, 28 aa, Mycobacterium tuberculosis
IIRFHAVYWPAFLMSAGIELPRRIFAHG

SEQ ID NO: 1454275 - protein, 25 aa, Mycobacterium tuberculosis
IKKHARLNMMAHLLSTIDYADVEKP

SEQ ID NO: 1454276 - protein, 18 aa, Mycobacterium tuberculosis
IKPPADPDIVGWEVDEFV

SEQ ID NO: 1454277 - protein, 27 aa, Mycobacterium tuberculosis
IKPQRGRISTWPLPEAFNGVTVNGVLA

SEQ ID NO: 1454278 - protein, 19 aa, Mycobacterium tuberculosis
IKSAGTRLVCQIQNRTQAE

SEQ ID NO: 1454279 - protein, 18 aa, Mycobacterium tuberculosis
IKTRARIGPEYTELKNLV

SEQ ID NO: 1454280 - protein, 19 aa, Mycobacterium tuberculosis
IKTWSRRSTIIPDFIGHTF

SEQ ID NO: 1454281 - protein, 27 aa, Mycobacterium tuberculosis
ILATGRPPRWVRPIVDALGFAPMAVCA

SEQ ID NO: 1454282 - protein, 34 aa, Mycobacterium tuberculosis; identical to SEQ ID NO: 201246

SEQ ID NO: 1454283 - protein, 24 aa, Mycobacterium tuberculosis
ILERRARIGGTWDLFRYPGVRSDS

SEQ ID NO: 1454284 - protein, 17 aa, Mycobacterium tuberculosis
ILGEVFRRVTGRTVGQY

SEQ ID NO: 1454285 - protein, 21 aa, Mycobacterium tuberculosis
ILGSYRFSAFRSDKTAPKDAG

SEQ ID NO: 1454286 - protein, 28 aa, Mycobacterium tuberculosis
ILLEKKWLRPTAYMMAKYGMTLCALGIA

SEQ ID NO: 1454287 - protein, 25 aa, Mycobacterium tuberculosis
ILLNSKTRRPSVCNAAETLLVDAAI

SEQ ID NO: 1454288 - protein, 24 aa, Mycobacterium tuberculosis
ILNDFPLFWDPRLLERDVHLPRFY

SEQ ID NO: 1454289 - protein, 17 aa, Mycobacterium tuberculosis
INAEPGAIITGRIRDYV

SEQ ID NO: 1454290 - protein, 23 aa, Mycobacterium tuberculosis
INDEYPFLLGHEAAGIIEAVGPG

SEQ ID NO: 1454291 - protein, 22 aa, Mycobacterium tuberculosis
INPEAWRWYRDVIGGGRTPLVD

SEQ ID NO: 1454292 - protein, 26 aa, Mycobacterium tuberculosis
IPDFVKLAEALGCVGLRCEREEDVVD

SEQ ID NO: 1454293 - protein, 29 aa, Mycobacterium tuberculosis
IPEAASDEWTDWRWNRILIEGSNCRDIID

SEQ ID NO: 1454294 - protein, 18 aa, Mycobacterium tuberculosis
IPERVNVIRVLMMELNRI

SEQ ID NO: 1454295 - protein, 19 aa, Mycobacterium tuberculosis
IPFENLDPLLGVPVDDLSP

SEQ ID NO: 1454296 - protein, 19 aa, Mycobacterium tuberculosis
IPLGLRLGSDTTLLDAALA

SEQ ID NO: 1454297 - protein, 24 aa, Mycobacterium tuberculosis
IPTPRRVQLPLVHCGGAATREQEM

SEQ ID NO: 1454298 - protein, 18 aa, Mycobacterium tuberculosis
IPVGVGLGVRSRAQAAQI

SEQ ID NO: 1454299 - protein, 21 aa, Mycobacterium tuberculosis
IPWSDPRLRRAATLHLGGTRD

SEQ ID NO: 1454300 - protein, 25 aa, Mycobacterium tuberculosis
IQIPVGPRLGNVVVEVDHLDKGYDG

SEQ ID NO: 1454301 - protein, 20 aa, Mycobacterium tuberculosis
IQLAEWEWPANPRFLMCTPL

SEQ ID NO: 1454302 - protein, 25 aa, Mycobacterium tuberculosis
IQPDLRVLVDLGYGYGYADVPTPAS

SEQ ID NO: 1454303 - protein, 23 aa, Mycobacterium tuberculosis
IQREVVARTGLRDCRVHGRTWDL

SEQ ID NO: 1454304 - protein, 20 aa, Mycobacterium tuberculosis
IRALAARAAPLVAILWGRDA

SEQ ID NO: 1454305 - protein, 23 aa, Mycobacterium tuberculosis
IRDMAKVPSAIWVVDTNKEHIAV

SEQ ID NO: 1454306 - protein, 26 aa, Mycobacterium tuberculosis
IRFSDAFDIPLVFVVDTPGFLPGVEQ

SEQ ID NO: 1454307 - protein, 18 aa, Mycobacterium tuberculosis
IRGEVLRILAGVDGEIRR

SEQ ID NO: 1454308 - protein, 18 aa, Mycobacterium tuberculosis
IRIAPSFPSVPDLRNAVD

SEQ ID NO: 1454309 - protein, 21 aa, Mycobacterium tuberculosis
IRLARLSWRIQGLKITVTGVD

SEQ ID NO: 1454310 - protein, 17 aa, Mycobacterium tuberculosis
IRLFEIGSSAGLNLRPD

SEQ ID NO: 1454311 - protein, 20 aa, Mycobacterium tuberculosis
IRLQPQVGWEVNDPDGDLRK

SEQ ID NO: 1454312 - protein, 19 aa, Mycobacterium tuberculosis
IRWNWAPGDVAIWDNRATQ

SEQ ID NO: 1454313 - protein, 26 aa, Mycobacterium tuberculosis
ISAYVPKHWQKLCYLIGRPDLVEDQR

SEQ ID NO: 1454314 - protein, 20 aa, Mycobacterium tuberculosis
ISDRAALFFDGRLVEEGPTE

SEQ ID NO: 1454315 - protein, 19 aa, Mycobacterium tuberculosis
ISELARRGLMPGRVEADDG

SEQ ID NO: 1454316 - protein, 18 aa, Mycobacterium tuberculosis
ISHDRWFLDRTCTHILAW

SEQ ID NO: 1454317 - protein, 20 aa, Mycobacterium tuberculosis
ISNVPGAREPLYFNGARMVG

SEQ ID NO: 1454318 - protein, 26 aa, Mycobacterium tuberculosis
ISRMHMPGVSICYGMTETSPVSTQTR

SEQ ID NO: 1454319 - protein, 22 aa, Mycobacterium tuberculosis
ISTLKRNYGWNRSCIDGTEGTR

SEQ ID NO: 1454320 - protein, 19 aa, Mycobacterium tuberculosis
ISTVRCFQDNALLKSVLSQ

SEQ ID NO: 1454321 - protein, 25 aa, Mycobacterium tuberculosis
ITARGPAVVEFNCRFGDPETQAVLA

SEQ ID NO: 1454322 - protein, 19 aa, Mycobacterium tuberculosis
ITATPAWDALRRHHDQIGN

SEQ ID NO: 1454323 - protein, 26 aa, Mycobacterium tuberculosis
ITEVPMKRFDLMNGIQVRGTYAVSQA

SEQ ID NO: 1454324 - protein, 24 aa, Mycobacterium tuberculosis
ITGWDYPACEAIGLLKMDFLGLRN

SEQ ID NO: 1454325 - protein, 23 aa, Mycobacterium tuberculosis
ITLEAAVGLGAMPIYRFGTEEQK

SEQ ID NO: 1454326 - protein, 18 aa, Mycobacterium tuberculosis
ITPFNFPAMIPLWKAGPA

SEQ ID NO: 1454327 - protein, 25 aa, Mycobacterium tuberculosis
ITPWNFPMVIASWAIAPALAAGNAV

SEQ ID NO: 1454328 - protein, 23 aa, Mycobacterium tuberculosis
IVDEFTGRVLIGRRYNEGMHQAI

SEQ ID NO: 1454329 - protein, 24 aa, Mycobacterium tuberculosis
IVNGRGGPQFLPLGPSSAGGDTIA

SEQ ID NO: 1454330 - protein, 23 aa, Mycobacterium tuberculosis
IVNRLKIACGHKALRVDHIGSTA

SEQ ID NO: 1454331 - protein, 26 aa, Mycobacterium tuberculosis
IWFGRAHLREGLSWFNSILEDQRFHR

SEQ ID NO: 1454332 - protein, 19 aa, Mycobacterium tuberculosis
IWGFPKIMADFNVTDGRRF

SEQ ID NO: 1454333 - protein, 23 aa, Mycobacterium tuberculosis
IYDEGRVSHQVSMWVNRYQHQTT

SEQ ID NO: 1454334 - protein, 17 aa, Mycobacterium tuberculosis
KALPPKTSHLIVRMYNA

SEQ ID NO: 1454335 - protein, 17 aa, Mycobacterium tuberculosis
KAVGIADLVPHGLRHTT

SEQ ID NO: 1454336 - protein, 17 aa, Mycobacterium tuberculosis
KCPSCQAGMRNLCDLGA

SEQ ID NO: 1454337 - protein, 22 aa, Mycobacterium tuberculosis
KDGKNVFLRDIWPSQQDVSDTI

SEQ ID NO: 1454338 - protein, 21 aa, Mycobacterium tuberculosis
KDIAKQRLVWRLCQRYPRAAR

SEQ ID NO: 1454339 - protein, 20 aa, Mycobacterium tuberculosis
KDLADAFAFNVGTAHALTVA

SEQ ID NO: 1454340 - protein, 18 aa, Mycobacterium tuberculosis
KDLSLALALGEVVSVDLP

SEQ ID NO: 1454341 - protein, 17 aa, Mycobacterium tuberculosis
KDQVVAHILNLLLTGKL

SEQ ID NO: 1454342 - protein, 18 aa, Mycobacterium tuberculosis
KDVAPSKELREWYHHQPE

SEQ ID NO: 1454343 - protein, 19 aa, Mycobacterium tuberculosis
KDVVIDMLCYRRRGHNEGD

SEQ ID NO: 1454344 - protein, 21 aa, Mycobacterium tuberculosis
KEESVGFLFNVTVEAVPAPPV

SEQ ID NO: 1454345 - protein, 21 aa, Mycobacterium tuberculosis
KEIQARIRAGASVEQVAAASG

SEQ ID NO: 1454346 - protein, 27 aa, Mycobacterium tuberculosis
KELFLGRFPLGLIHPFPKPSDAEEART

SEQ ID NO: 1454347 - protein, 27 aa, Mycobacterium tuberculosis
KEVLEYHWGPDWVCWDADQTFQQHGQH

SEQ ID NO: 1454348 - protein, 19 aa, Mycobacterium tuberculosis
KEYLGWVTGPISWDHNTDL

SEQ ID NO: 1454349 - protein, 24 aa, Mycobacterium tuberculosis
KFGKSTGGGSLWLDPQMTSPYAWY

SEQ ID NO: 1454350 - protein, 18 aa, Mycobacterium tuberculosis
KGAISSWKAFAPAHAGKV

SEQ ID NO: 1454351 - protein, 20 aa, Mycobacterium tuberculosis
KGGGHKRAYRMIDFRRNDKD

SEQ ID NO: 1454352 - protein, 22 aa, Mycobacterium tuberculosis
KGMPNRIKWTIVRYKPPEGMTL

SEQ ID NO: 1454353 - protein, 22 aa, Mycobacterium tuberculosis
KGSPQRRGVCTRVYTTTPKKPN

SEQ ID NO: 1454354 - protein, 18 aa, Mycobacterium tuberculosis
KHMGVMFGAPGGDYCHAL

SEQ ID NO: 1454355 - protein, 19 aa, Mycobacterium tuberculosis
KHRMADLYVTIAAARAVVA

SEQ ID NO: 1454356 - protein, 21 aa, Mycobacterium tuberculosis
KHYRSRFVFFGSGYYNYDEGY

SEQ ID NO: 1454357 - protein, 20 aa, Mycobacterium tuberculosis
KIGQAFGRDHTTVMYAQRKI

SEQ ID NO: 1454358 - protein, 25 aa, Mycobacterium tuberculosis
KINEPRFPSFKGIMAAKKKEVTVLT

SEQ ID NO: 1454359 - protein, 19 aa, Mycobacterium tuberculosis
KITVLCCAKDAKKRALHGA

SEQ ID NO: 1454360 - protein, 24 aa, Mycobacterium tuberculosis
KLAQEYTYRYLAAALTWFVDDADA

SEQ ID NO: 1454361 - protein, 18 aa, Mycobacterium tuberculosis
KLAWPADLQVGPDGLGNS

SEQ ID NO: 1454362 - protein, 24 aa, Mycobacterium tuberculosis
KLQLWVAACLYRYFVDQHEFLYGP

SEQ ID NO: 1454363 - protein, 20 aa, Mycobacterium tuberculosis
KLRGEGMVGLEPHRGHVVLP

SEQ ID NO: 1454364 - protein, 25 aa, Mycobacterium tuberculosis
KLYGYKWPTLDGMFAPHASDVVFDI

SEQ ID NO: 1454365 - protein, 21 aa, Mycobacterium tuberculosis
KNGTRKGRRVGFPRFKSGRRD

SEQ ID NO: 1454366 - protein, 26 aa, Mycobacterium tuberculosis
KNVAFGPQCRRGMFGSGRARTRASAL

SEQ ID NO: 1454367 - protein, 24 aa, Mycobacterium tuberculosis
KNYVSRLLAKLGMERRTQAAVFAT

SEQ ID NO: 1454368 - protein, 20 aa, Mycobacterium tuberculosis
KPGDHVVCSFIPNCGTCRYC

SEQ ID NO: 1454369 - protein, 28 aa, Mycobacterium tuberculosis
KPGVLARVAALFSRRGFNIESLAVGATE

SEQ ID NO: 1454370 - protein, 20 aa, Mycobacterium tuberculosis
KPPWPYTFNLCVSNVPGPED

SEQ ID NO: 1454371 - protein, 33 aa, Mycobacterium tuberculosis; identical to SEQ ID NO: 201723

SEQ ID NO: 1454372 - protein, 20 aa, Mycobacterium tuberculosis
KPVRLCLDFDAGYWRAGGRI

SEQ ID NO: 1454373 - protein, 27 aa, Mycobacterium tuberculosis
KQAEAYRAISLLLRRPPGREAYPGDVF

SEQ ID NO: 1454374 - protein, 22 aa, Mycobacterium tuberculosis
KQPDAVRHWNVDKADLDGLLDR

SEQ ID NO: 1454375 - protein, 21 aa, Mycobacterium tuberculosis
KQYKVAVGDVVKVEKLESEQG

SEQ ID NO: 1454376 - protein, 19 aa, Mycobacterium tuberculosis
KRAGTVLTLDDLVEAIGVD

SEQ ID NO: 1454377 - protein, 26 aa, Mycobacterium tuberculosis
KRCLVPMDGWYEWRVDPDATPGRPNA

SEQ ID NO: 1454378 - protein, 19 aa, Mycobacterium tuberculosis
KRLGDGIMAVFRNPTVALR

SEQ ID NO: 1454379 - protein, 25 aa, Mycobacterium tuberculosis
KRPPECLYGSLKMWAHLQRQGFRWP

SEQ ID NO: 1454380 - protein, 19 aa, Mycobacterium tuberculosis
KRWRNLRKITIAQVHGAVL

SEQ ID NO: 1454381 - protein, 17 aa, Mycobacterium tuberculosis
KSAKWKVGEEAAFRQLG

SEQ ID NO: 1454382 - protein, 23 aa, Mycobacterium tuberculosis
KSLDDLRLFKALVDAASGYAGRQ

SEQ ID NO: 1454383 - protein, 18 aa, Mycobacterium tuberculosis
KSLPAVLRVTARTSSGVI

SEQ ID NO: 1454384 - protein, 18 aa, Mycobacterium tuberculosis
KSLYEKSGSVLIEEHKHS

SEQ ID NO: 1454385 - protein, 19 aa, Mycobacterium tuberculosis
KSRRFAYPPNLYVVDGGAP

SEQ ID NO: 1454386 - protein, 26 aa, Mycobacterium tuberculosis
KTAHFCSMCGPKFCSMRITQDVREYA

SEQ ID NO: 1454387 - protein, 23 aa, Mycobacterium tuberculosis
KTEPALDVLAGWLASRIEGPVRR

SEQ ID NO: 1454388 - protein, 25 aa, Mycobacterium tuberculosis
KTGKAEKCTLCYPRIEVGLPTVCSE

SEQ ID NO: 1454389 - protein, 19 aa, Mycobacterium tuberculosis
KTTVCFHPVRVIWEDGHAK

SEQ ID NO: 1454390 - protein, 23 aa, Mycobacterium tuberculosis
KTVGETWGLPSPEEAAAAEAEVF

SEQ ID NO: 1454391 - protein, 17 aa, Mycobacterium tuberculosis
KTVKALLDVAGVTVTRF

SEQ ID NO: 1454392 - protein, 19 aa, Mycobacterium tuberculosis
KVAVASFFAKNFLPLLTST

SEQ ID NO: 1454393 - protein, 26 aa, Mycobacterium tuberculosis
KVSARPSDSVAIALRVGVPIYVEEAV

SEQ ID NO: 1454394 - protein, 19 aa, Mycobacterium tuberculosis
KVSIEGGKITGERETDEGV

SEQ ID NO: 1454395 - protein, 19 aa, Mycobacterium tuberculosis
KVWRGETKLGETYDTVEIP

SEQ ID NO: 1454396 - protein, 22 aa, Mycobacterium tuberculosis
KVYLDLRVKVAKNWQRDPKQLG

SEQ ID NO: 1454397 - protein, 24 aa, Mycobacterium tuberculosis
KYKSQPWARLGVNVDADFEPLYII

SEQ ID NO: 1454398 - protein, 17 aa, Mycobacterium tuberculosis
LAAAIDSDAAWQAPAND

SEQ ID NO: 1454399 - protein, 24 aa, Mycobacterium tuberculosis
LAAEAPGALFGEMALSSLAGRALA

SEQ ID NO: 1454400 - protein, 27 aa, Mycobacterium tuberculosis
LAALDLCPRVRVNAIAPGSILTSALEV

SEQ ID NO: 1454401 - protein, 25 aa, Mycobacterium tuberculosis
LAAVADLFAAFGMLPVGYYDLRTAE

SEQ ID NO: 1454402 - protein, 25 aa, Mycobacterium tuberculosis
LADLERRVADFLGFATVFNSVGQVY

SEQ ID NO: 1454403 - protein, 30 aa, Mycobacterium tuberculosis
LADVGCLEGGYAVGFARMGFQVLGIEVREL

SEQ ID NO: 1454404 - protein, 18 aa, Mycobacterium tuberculosis
LAELTVRAVGGCHAVIHP

SEQ ID NO: 1454405 - protein, 24 aa, Mycobacterium tuberculosis
LAERKRLASLAFQHIAEYDIAVAS

SEQ ID NO: 1454406 - protein, 18 aa, Mycobacterium tuberculosis
LAGAQPILLGAGWEGGWR

SEQ ID NO: 1454407 - protein, 19 aa, Mycobacterium tuberculosis
LAGAWAAVRTFGWETRRLG

SEQ ID NO: 1454408 - protein, 24 aa, Mycobacterium tuberculosis
LAGLRTVGDVVAYIQKLEEENPEA

SEQ ID NO: 1454409 - protein, 17 aa, Mycobacterium tuberculosis
LAGPLVRSSYRAGRLYE

SEQ ID NO: 1454410 - protein, 28 aa, Mycobacterium tuberculosis
LAKAMDRKVWLPSGGTLVIDRTEAMTVI

SEQ ID NO: 1454411 - protein, 19 aa, Mycobacterium tuberculosis
LAKSLRIAAKIYSEADEAW

SEQ ID NO: 1454412 - protein, 26 aa, Mycobacterium tuberculosis
LALAAGERFGPDRVRTAENLRDAIDV

SEQ ID NO: 1454413 - protein, 19 aa, Mycobacterium tuberculosis
LALACDFILASDSAFFMLA

SEQ ID NO: 1454414 - protein, 17 aa, Mycobacterium tuberculosis
LALPRLVRSRIVKRRGH

SEQ ID NO: 1454415 - protein, 33 aa, Mycobacterium tuberculosis; identical to SEQ ID NO: 201940

SEQ ID NO: 1454416 - protein, 27 aa, Mycobacterium tuberculosis
LAMLQRLVADGALWPVNGTAFAVTPTL

SEQ ID NO: 1454417 - protein, 21 aa, Mycobacterium tuberculosis
LAPEFRAMMQLEWSQAQQRRF

SEQ ID NO: 1454418 - protein, 17 aa, Mycobacterium tuberculosis
LAPEVPGELHAMMLDMR

SEQ ID NO: 1454419 - protein, 17 aa, Mycobacterium tuberculosis
LAPLQCYVSVDIEDGYS

SEQ ID NO: 1454420 - protein, 21 aa, Mycobacterium tuberculosis
LAQTEVIRLPDRITRERLDAV

SEQ ID NO: 1454421 - protein, 22 aa, Mycobacterium tuberculosis
LARALFGPGHPVPWERFADDYD

SEQ ID NO: 1454422 - protein, 24 aa, Mycobacterium tuberculosis
LARPKRYIAGFAVELEDESQLPAA

SEQ ID NO: 1454423 - protein, 18 aa, Mycobacterium tuberculosis
LASLHLVHDWNREFVRTS

SEQ ID NO: 1454424 - protein, 24 aa, Mycobacterium tuberculosis
LATMAGYHLGWWNADRSTAAGSSG

SEQ ID NO: 1454425 - protein, 21 aa, Mycobacterium tuberculosis
LATRRKIFIPILRVAAIEPHA

SEQ ID NO: 1454426 - protein, 32 aa, Mycobacterium tuberculosis; identical to SEQ ID NO: 209647

SEQ ID NO: 1454427 - protein, 25 aa, Mycobacterium tuberculosis
LAVLTARHLDCWVLGTVCKGGKQGP

SEQ ID NO: 1454428 - protein, 23 aa, Mycobacterium tuberculosis
LAYGDMGLALPILAPGGVASALT

SEQ ID NO: 1454429 - protein, 30 aa, Mycobacterium tuberculosis; identical to SEQ ID NO: 202035

SEQ ID NO: 1454430 - protein, 24 aa, Mycobacterium tuberculosis
LDAVAEHYLHFGGVSPINGINRTL

SEQ ID NO: 1454431 - protein, 19 aa, Mycobacterium tuberculosis
LDDEVRWVLTKGKLPTSLW

SEQ ID NO: 1454432 - protein, 18 aa, Mycobacterium tuberculosis
LDDGASWRRLLGPLVAHS

SEQ ID NO: 1454433 - protein, 26 aa, Mycobacterium tuberculosis
LDDKGRLTLPAKFRDALAGGLMVTKS

SEQ ID NO: 1454434 - protein, 37 aa, Mycobacterium tuberculosis; identical to SEQ ID NO: 202060

SEQ ID NO: 1454435 - protein, 21 aa, Mycobacterium tuberculosis
LDFAGNADFAIAIRTALMRNG

SEQ ID NO: 1454436 - protein, 21 aa, Mycobacterium tuberculosis
LDGFCSASLLVDRTSGRAVSS

SEQ ID NO: 1454437 - protein, 24 aa, Mycobacterium tuberculosis
LDGLLELLPAGAWLDHTSDHAQAS

SEQ ID NO: 1454438 - protein, 24 aa, Mycobacterium tuberculosis
LDGQLRLSVRQVMWGADAGLLEST

SEQ ID NO: 1454439 - protein, 25 aa, Mycobacterium tuberculosis
LDGRADPGEIVWTWVAYEQDPTRGK

SEQ ID NO: 1454440 - protein, 22 aa, Mycobacterium tuberculosis
LDHELRPVIITRGFTENPAGSV

SEQ ID NO: 1454441 - protein, 23 aa, Mycobacterium tuberculosis
LDHSLPYIFAVALQDGCWHHERS

SEQ ID NO: 1454442 - protein, 34 aa, Mycobacterium tuberculosis; identical to SEQ ID NO: 202088

SEQ ID NO: 1454443 - protein, 17 aa, Mycobacterium tuberculosis
LDICAPVSGSVTYPPAT

SEQ ID NO: 1454444 - protein, 23 aa, Mycobacterium tuberculosis
LDILRTEIWPLLADRSPITKLER

SEQ ID NO: 1454445 - protein, 23 aa, Mycobacterium tuberculosis
LDINVFGRRAGIAAASYAQGHDF

SEQ ID NO: 1454446 - protein, 18 aa, Mycobacterium tuberculosis
LDLAAGMDSAREWLRDRI

SEQ ID NO: 1454447 - protein, 26 aa, Mycobacterium tuberculosis
LDLPVDWEPLGAIAIGYADEPSGLRD

SEQ ID NO: 1454448 - protein, 26 aa, Mycobacterium tuberculosis
LDLSKLARPTSTWTYMVNDNPLSDDT

SEQ ID NO: 1454449 - protein, 25 aa, Mycobacterium tuberculosis
LDLVKARFAGPVVVIELDMMFGSLE

SEQ ID NO: 1454450 - protein, 21 aa, Mycobacterium tuberculosis
LDPPWSFGPAGERYEIEVRGS

SEQ ID NO: 1454451 - protein, 26 aa, Mycobacterium tuberculosis
LDPRGRGLMCAFSLPTTADRDELIRQ

SEQ ID NO: 1454452 - protein, 23 aa, Mycobacterium tuberculosis
LDRFVQQRVDGVTLREEHIAGKP

SEQ ID NO: 1454453 - protein, 25 aa, Mycobacterium tuberculosis
LDRRGDGAPEFHLRSKRIRAHSTHL

SEQ ID NO: 1454454 - protein, 17 aa, Mycobacterium tuberculosis
LDSLGPIFSELRDTGRE

SEQ ID NO: 1454455 - protein, 29 aa, Mycobacterium tuberculosis
LDTCLDKYARLFAWLGLWERHTDLAVIPV

SEQ ID NO: 1454456 - protein, 18 aa, Mycobacterium tuberculosis
LDVARMVLFGQVGRELVN

SEQ ID NO: 1454457 - protein, 18 aa, Mycobacterium tuberculosis
LDVEFSVSAGEVLAVLGP

SEQ ID NO: 1454458 - protein, 19 aa, Mycobacterium tuberculosis
LDVGCGWGSVMKRAVERYD

SEQ ID NO: 1454459 - protein, 20 aa, Mycobacterium tuberculosis
LEAAAKWREIVGPDNYFLEL

SEQ ID NO: 1454460 - protein, 18 aa, Mycobacterium tuberculosis
LEAVRQFLNLDVPLFVES

SEQ ID NO: 1454461 - protein, 17 aa, Mycobacterium tuberculosis
LEDEFDIAISFRDAQNI

SEQ ID NO: 1454462 - protein, 29 aa, Mycobacterium tuberculosis
LEDPVKISLMRRIKQSFDPAGILNPGVVF

SEQ ID NO: 1454463 - protein, 20 aa, Mycobacterium tuberculosis
LEDYRRILAAGINIVGSGPV

SEQ ID NO: 1454464 - protein, 22 aa, Mycobacterium tuberculosis
LEEGRVVLVAGFQGVSQDTKDV

SEQ ID NO: 1454465 - protein, 22 aa, Mycobacterium tuberculosis
LEELKALWFSEAAKYNGLPLAD

SEQ ID NO: 1454466 - protein, 18 aa, Mycobacterium tuberculosis
LEERAELDALKADGGSSW

SEQ ID NO: 1454467 - protein, 20 aa, Mycobacterium tuberculosis
LELACGRSGTALGLAAAGRC

SEQ ID NO: 1454468 - protein, 25 aa, Mycobacterium tuberculosis
LELLNRLWPLVSLRCNFFTPTKKPV

SEQ ID NO: 1454469 - protein, 21 aa, Mycobacterium tuberculosis
LELPPAGSYDDFCRRQHTFSS

SEQ ID NO: 1454470 - protein, 18 aa, Mycobacterium tuberculosis
LEMEGPTLGRPVVDKVND

SEQ ID NO: 1454471 - protein, 24 aa, Mycobacterium tuberculosis
LEPGYGLRIGYFAQEHDTLDNDAT

SEQ ID NO: 1454472 - protein, 20 aa, Mycobacterium tuberculosis
LERDISWEALVCGGVTALPV

SEQ ID NO: 1454473 - protein, 21 aa, Mycobacterium tuberculosis
LERLRGAIAVARNIPADLHRQ

SEQ ID NO: 1454474 - protein, 20 aa, Mycobacterium tuberculosis
LERRERLGGTWDLFRYPGVR

SEQ ID NO: 1454475 - protein, 17 aa, Mycobacterium tuberculosis
LETLRKLAHDCGVADHV

SEQ ID NO: 1454476 - protein, 22 aa, Mycobacterium tuberculosis
LEVEPFEAMIVFVRTKQATEEI

SEQ ID NO: 1454477 - protein, 25 aa, Mycobacterium tuberculosis
LFPKLNPRIPRIWNITSLPSEMALA

SEQ ID NO: 1454478 - protein, 27 aa, Mycobacterium tuberculosis
LFRNKIPIVAAIGSPVRPEGNAEQLNA

SEQ ID NO: 1454479 - protein, 18 aa, Mycobacterium tuberculosis
LFRRYWPADLHMIGKDII

SEQ ID NO: 1454480 - protein, 23 aa, Mycobacterium tuberculosis
LFYEAYPPMVIRTLMSIIGRCED

SEQ ID NO: 1454481 - protein, 21 aa, Mycobacterium tuberculosis
LGAALGEYGRRVLLVDMDPQG

SEQ ID NO: 1454482 - protein, 20 aa, Mycobacterium tuberculosis
LGAMTPMFVGFRAREIVLTL

SEQ ID NO: 1454483 - protein, 21 aa, Mycobacterium tuberculosis
LGARWSDTFARDQHPDVQMDY

SEQ ID NO: 1454484 - protein, 18 aa, Mycobacterium tuberculosis
LGCDLDLVELAGLAHDIG

SEQ ID NO: 1454485 - protein, 32 aa, Mycobacterium tuberculosis; identical to SEQ ID NO: 202297

SEQ ID NO: 1454486 - protein, 25 aa, Mycobacterium tuberculosis
LGERPTVVCLSRLVPRKGQDTLVTA

SEQ ID NO: 1454487 - protein, 18 aa, Mycobacterium tuberculosis
LGGPSHRLELLGARCSLT

SEQ ID NO: 1454488 - protein, 17 aa, Mycobacterium tuberculosis
LGGRAGYYDGIGAARDV

SEQ ID NO: 1454489 - protein, 17 aa, Mycobacterium tuberculosis
LGGWRGASGSAYGSAWE

SEQ ID NO: 1454490 - protein, 20 aa, Mycobacterium tuberculosis
LGKQRPGSVRALRSNEIGQL

SEQ ID NO: 1454491 - protein, 18 aa, Mycobacterium tuberculosis
LGLRWPSTVAPFDVHLVI

SEQ ID NO: 1454492 - protein, 19 aa, Mycobacterium tuberculosis
LGLSGATLRRGAVAAVVAA

SEQ ID NO: 1454493 - protein, 19 aa, Mycobacterium tuberculosis
LGPCPAQWPVADDCRLPKA

SEQ ID NO: 1454494 - protein, 23 aa, Mycobacterium tuberculosis
LGPKFWAQDAIAVMDAVGCEQAT

SEQ ID NO: 1454495 - protein, 20 aa, Mycobacterium tuberculosis
LGRLVACDLIGMGASDKLSP

SEQ ID NO: 1454496 - protein, 17 aa, Mycobacterium tuberculosis
LGSDVPFALHGGTALGT

SEQ ID NO: 1454497 - protein, 18 aa, Mycobacterium tuberculosis
LGTNGYRVLDRVEDGARV

SEQ ID NO: 1454498 - protein, 20 aa, Mycobacterium tuberculosis
LGVAYGYPGAPGQWWQQQVV

SEQ ID NO: 1454499 - protein, 23 aa, Mycobacterium tuberculosis
LGVPVLGICYGFQAMAQALGGIV

SEQ ID NO: 1454500 - protein, 24 aa, Mycobacterium tuberculosis
LGVSRPAVREALKRLSAAGLVEVR

SEQ ID NO: 1454501 - protein, 21 aa, Mycobacterium tuberculosis
LGYKLPSLLLPIWDSELGAGL

SEQ ID NO: 1454502 - protein, 26 aa, Mycobacterium tuberculosis
LHAIAKLAPQRLIVVLGHDHQRIAPL

SEQ ID NO: 1454503 - protein, 18 aa, Mycobacterium tuberculosis
LHEVKPLSLVVGLIDELR

SEQ ID NO: 1454504 - protein, 22 aa, Mycobacterium tuberculosis
LHGGRISGRYALIRTNGDRWLA

SEQ ID NO: 1454505 - protein, 18 aa, Mycobacterium tuberculosis
LHGICRWGGSDSCDRTTV

SEQ ID NO: 1454506 - protein, 18 aa, Mycobacterium tuberculosis
LHGRIEVDEPYVLILPTY

SEQ ID NO: 1454507 - protein, 18 aa, Mycobacterium tuberculosis
LHGVVHCAGGSQTIGPIT

SEQ ID NO: 1454508 - protein, 25 aa, Mycobacterium tuberculosis
LHGWQWRLDDGRCLTARGHQLRSSR

SEQ ID NO: 1454509 - protein, 22 aa, Mycobacterium tuberculosis
LHPEYRTMPMVWYIPPLSPVVD

SEQ ID NO: 1454510 - protein, 21 aa, Mycobacterium tuberculosis
LHPRALAAYRRAAGRTRHDAP

SEQ ID NO: 1454511 - protein, 19 aa, Mycobacterium tuberculosis
LHQLRRAAPEVDFRAVNDR

SEQ ID NO: 1454512 - protein, 17 aa, Mycobacterium tuberculosis
LHRAVVVAVARRKDLLD

SEQ ID NO: 1454513 - protein, 23 aa, Mycobacterium tuberculosis
LHREELDAFVVRRLNLPFRDVDW

SEQ ID NO: 1454514 - protein, 25 aa, Mycobacterium tuberculosis
LHWEEVPGCDPAVFTMATVPSRLAD

SEQ ID NO: 1454515 - protein, 18 aa, Mycobacterium tuberculosis
LIDAVKFTPALTGPHARL

SEQ ID NO: 1454516 - protein, 27 aa, Mycobacterium tuberculosis
LIDGARLAELLVRYRVGVQAVQTVELL

SEQ ID NO: 1454517 - protein, 18 aa, Mycobacterium tuberculosis
LIERGHRVAVLAVDPSST

SEQ ID NO: 1454518 - protein, 24 aa, Mycobacterium tuberculosis
LIRYIDRFLIYYIRTADRLQRTAP

SEQ ID NO: 1454519 - protein, 17 aa, Mycobacterium tuberculosis
LKAARLLPAGQVDDEED

SEQ ID NO: 1454520 - protein, 18 aa, Mycobacterium tuberculosis
LKAFRPGRLPFPVMHVDT

SEQ ID NO: 1454521 - protein, 20 aa, Mycobacterium tuberculosis
LKDLEIRGAGNVLGIEQSGH

SEQ ID NO: 1454522 - protein, 22 aa, Mycobacterium tuberculosis
LKHGLTPIVCIGEHLDVREAGN

SEQ ID NO: 1454523 - protein, 19 aa, Mycobacterium tuberculosis
LKNKIALMCDVDIDGVIST

SEQ ID NO: 1454524 - protein, 25 aa, Mycobacterium tuberculosis
LKTELRLRYGACVNVERRSASAGFT

SEQ ID NO: 1454525 - protein, 18 aa, Mycobacterium tuberculosis
LLAALQHAGVTVHLDPDE

SEQ ID NO: 1454526 - protein, 25 aa, Mycobacterium tuberculosis
LLADCGHLVLVPAISPLAEHRALAR

SEQ ID NO: 1454527 - protein, 25 aa, Mycobacterium tuberculosis
LLAIPRDEVRVMRKERNGWKAEVNS

SEQ ID NO: 1454528 - protein, 19 aa, Mycobacterium tuberculosis
LLAPRARLAGASRVLASTH

SEQ ID NO: 1454529 - protein, 26 aa, Mycobacterium tuberculosis
LLDVGCGWGATMMRAVEKYDVNVVGL

SEQ ID NO: 1454530 - protein, 26 aa, Mycobacterium tuberculosis
LLDVGCGWGGALVRAVEKYDVNVIGL

SEQ ID NO: 1454531 - protein, 20 aa, Mycobacterium tuberculosis
LLDYLAGLGRSVHMVVLSAS

SEQ ID NO: 1454532 - protein, 17 aa, Mycobacterium tuberculosis
LLENFSRKTLNDDVAVG

SEQ ID NO: 1454533 - protein, 19 aa, Mycobacterium tuberculosis
LLFRDAYALGGRFEEHLGG

SEQ ID NO: 1454534 - protein, 26 aa, Mycobacterium tuberculosis
LLFSALELLHAWALVHDDLIDRSATR

SEQ ID NO: 1454535 - protein, 25 aa, Mycobacterium tuberculosis
LLGFKKACAGFRSLGRGATEEPAEM

SEQ ID NO: 1454536 - protein, 26 aa, Mycobacterium tuberculosis
LLGGKCPQCGTYVFPPRADNCPNPAC

SEQ ID NO: 1454537 - protein, 22 aa, Mycobacterium tuberculosis
LLMNSRSGYKYGDVTVLDHMAY

SEQ ID NO: 1454538 - protein, 25 aa, Mycobacterium tuberculosis
LLNNRLWSRLRRRIEEADALLYAEI

SEQ ID NO: 1454539 - protein, 19 aa, Mycobacterium tuberculosis
LLPGRDGLVHISKLGKGKR

SEQ ID NO: 1454540 - protein, 27 aa, Mycobacterium tuberculosis
LLQSSNGPLSWLWQILFGTPNFPTSIS

SEQ ID NO: 1454541 - protein, 19 aa, Mycobacterium tuberculosis
LLRDALRRHLAALAADQDV

SEQ ID NO: 1454542 - protein, 19 aa, Mycobacterium tuberculosis
LLVAGWRALHTTGPKPLVQ

SEQ ID NO: 1454543 - protein, 19 aa, Mycobacterium tuberculosis
LLVESGMAPLFPLVVVVHA

SEQ ID NO: 1454544 - protein, 19 aa, Mycobacterium tuberculosis
LLWRTDFCARLVAKGLRVI

SEQ ID NO: 1454545 - protein, 19 aa, Mycobacterium tuberculosis
LMDAVPVTLGQEFSGYARQ

SEQ ID NO: 1454546 - protein, 26 aa, Mycobacterium tuberculosis
LMERLRARLPAPDWMPPLTVAQQLGF

SEQ ID NO: 1454547 - protein, 18 aa, Mycobacterium tuberculosis
LMEWCAMVGCPIVGINDS

SEQ ID NO: 1454548 - protein, 24 aa, Mycobacterium tuberculosis
LMGIPGPGGLQFAGRVGTGLSERE

SEQ ID NO: 1454549 - protein, 20 aa, Mycobacterium tuberculosis
LMIKPPRPLASTSIPAGGID

SEQ ID NO: 1454550 - protein, 23 aa, Mycobacterium tuberculosis
LMPRTVYDTLIWCIYSGVHLPPP

SEQ ID NO: 1454551 - protein, 18 aa, Mycobacterium tuberculosis
LMPTSSVNLGNWSASRLV

SEQ ID NO: 1454552 - protein, 17 aa, Mycobacterium tuberculosis
LMRSGAKDQLRFTAPPR

SEQ ID NO: 1454553 - protein, 25 aa, Mycobacterium tuberculosis
LMVGERVLAGYGFRTDQRAHAEIAA

SEQ ID NO: 1454554 - protein, 24 aa, Mycobacterium tuberculosis
LNALERNKMRVVPGLTSKAMSVAS

SEQ ID NO: 1454555 - protein, 25 aa, Mycobacterium tuberculosis
LNDGCLRPLRIVVPEGSMLAPTHPA

SEQ ID NO: 1454556 - protein, 25 aa, Mycobacterium tuberculosis
LNLGKLLTKRARVIGTTLRARPVSG

SEQ ID NO: 1454557 - protein, 19 aa, Mycobacterium tuberculosis
LNNVPRLRKPTVLVIDQIP

SEQ ID NO: 1454558 - protein, 17 aa, Mycobacterium tuberculosis
LNPSTGVELLIPDFNGE

SEQ ID NO: 1454559 - protein, 20 aa, Mycobacterium tuberculosis
LNVGCIPTKMFVYAAEVAKT

SEQ ID NO: 1454560 - protein, 30 aa, Mycobacterium tuberculosis; identical to SEQ ID NO: 202660

SEQ ID NO: 1454561 - protein, 21 aa, Mycobacterium tuberculosis
LNYYAPLRLIRGLAPGMLERG

SEQ ID NO: 1454562 - protein, 20 aa, Mycobacterium tuberculosis
LPADDPRIWPNIVASQLDWD

SEQ ID NO: 1454563 - protein, 17 aa, Mycobacterium tuberculosis
LPDAITIYREALLDACD

SEQ ID NO: 1454564 - protein, 20 aa, Mycobacterium tuberculosis
LPDDLKFTLVEPLRLLFKDE

SEQ ID NO: 1454565 - protein, 21 aa, Mycobacterium tuberculosis
LPDGRRVVGEWVYGPHNNAIN

SEQ ID NO: 1454566 - protein, 24 aa, Mycobacterium tuberculosis
LPDLCKLLDVAPGIAIVDEAYGEF

SEQ ID NO: 1454567 - protein, 24 aa, Mycobacterium tuberculosis
LPDPRLDKLAELFGSQRVVPAPVT

SEQ ID NO: 1454568 - protein, 18 aa, Mycobacterium tuberculosis
LPDRITRERLDAVLAAVV

SEQ ID NO: 1454569 - protein, 18 aa, Mycobacterium tuberculosis
LPDSPDLVQLLLACLARG

SEQ ID NO: 1454570 - protein, 24 aa, Mycobacterium tuberculosis
LPFYHDMGLVLGIIAPILGGYRSE

SEQ ID NO: 1454571 - protein, 18 aa, Mycobacterium tuberculosis
LPGLGGMLGGGPVAAGLG

SEQ ID NO: 1454572 - protein, 18 aa, Mycobacterium tuberculosis
LPHDELAALLPEVVEVLD

SEQ ID NO: 1454573 - protein, 17 aa, Mycobacterium tuberculosis
LPIVPMFHANGWGLPYA

SEQ ID NO: 1454574 - protein, 17 aa, Mycobacterium tuberculosis
LPLRPFKTMAVNVDGRL

SEQ ID NO: 1454575 - protein, 17 aa, Mycobacterium tuberculosis
LPPARPMPFEEVRDFFY

SEQ ID NO: 1454576 - protein, 18 aa, Mycobacterium tuberculosis
LPPGGRLGLYGFGGSAHI

SEQ ID NO: 1454577 - protein, 21 aa, Mycobacterium tuberculosis
LPPSALWGREAYVTGLLGDGV

SEQ ID NO: 1454578 - protein, 17 aa, Mycobacterium tuberculosis
LPRGRRTARPSGDDREL

SEQ ID NO: 1454579 - protein, 25 aa, Mycobacterium tuberculosis
LPSERELIDRSGLSRVTVRAAVGML

SEQ ID NO: 1454580 - protein, 17 aa, Mycobacterium tuberculosis
LQAELHKTIVFVTHDID

SEQ ID NO: 1454581 - protein, 17 aa, Mycobacterium tuberculosis
LQIHPRVLRAIGDVGYE

SEQ ID NO: 1454582 - protein, 23 aa, Mycobacterium tuberculosis
LQLRRAGLVTSRRDGKRVIYALS

SEQ ID NO: 1454583 - protein, 19 aa, Mycobacterium tuberculosis
LQPYASFFYNTEGLPYFSI

SEQ ID NO: 1454584 - protein, 24 aa, Mycobacterium tuberculosis
LQSARAQILAGFCDVALVIGADTT

SEQ ID NO: 1454585 - protein, 23 aa, Mycobacterium tuberculosis
LQSRLHRWRLNMVTGAVHEEQLS

SEQ ID NO: 1454586 - protein, 25 aa, Mycobacterium tuberculosis
LQSVDGIGAMWARHVREGLSQLAES

SEQ ID NO: 1454587 - protein, 19 aa, Mycobacterium tuberculosis
LQVTIWTKRLRAVDFTLGY

SEQ ID NO: 1454588 - protein, 20 aa, Mycobacterium tuberculosis
LRAGLGVAMGNAHPDALAVA

SEQ ID NO: 1454589 - protein, 25 aa, Mycobacterium tuberculosis
LRAMLLERLPRYLVPHHIVVLDELP

SEQ ID NO: 1454590 - protein, 17 aa, Mycobacterium tuberculosis
LRAPITDALSRRLGHQI

SEQ ID NO: 1454591 - protein, 26 aa, Mycobacterium tuberculosis
LRAQGRHCVAVKWGLWQAPKAGEPAR

SEQ ID NO: 1454592 - protein, 18 aa, Mycobacterium tuberculosis
LREALGLQPGSTVEISRY

SEQ ID NO: 1454593 - protein, 26 aa, Mycobacterium tuberculosis
LREANGDRYLPIWIGQSEAAAIALEQ

SEQ ID NO: 1454594 - protein, 19 aa, Mycobacterium tuberculosis
LREAVPLMPVEQLLVETDA

SEQ ID NO: 1454595 - protein, 25 aa, Mycobacterium tuberculosis
LRERLGFGELRWALSGAAPIPKETL

SEQ ID NO: 1454596 - protein, 19 aa, Mycobacterium tuberculosis
LRFPESLMVGLAVTRLGRS

SEQ ID NO: 1454597 - protein, 18 aa, Mycobacterium tuberculosis
LRGAWLCTKHAAPRMIER

SEQ ID NO: 1454598 - protein, 17 aa, Mycobacterium tuberculosis
LRGFEVLEQLAFDERRL

SEQ ID NO: 1454599 - protein, 18 aa, Mycobacterium tuberculosis
LRGLMSHMVYADKPDDSI

SEQ ID NO: 1454600 - protein, 27 aa, Mycobacterium tuberculosis
LRKFLWAPRLGCYGIQRIHPLRNVMIL

SEQ ID NO: 1454601 - protein, 20 aa, Mycobacterium tuberculosis
LRKHRGYDFFCLNDGSFPEV

SEQ ID NO: 1454602 - protein, 18 aa, Mycobacterium tuberculosis
LRNEVGAAVAVWVDGDLV

SEQ ID NO: 1454603 - protein, 26 aa, Mycobacterium tuberculosis
LRNKTRLAALRVKDFGKREVMMVHTL

SEQ ID NO: 1454604 - protein, 23 aa, Mycobacterium tuberculosis
LRNTFPPLRMRIADASGIPYVGR

SEQ ID NO: 1454605 - protein, 21 aa, Mycobacterium tuberculosis
LRPDVDWDKGKTLLWVLDHLP

SEQ ID NO: 1454606 - protein, 17 aa, Mycobacterium tuberculosis
LRPGPTMISDRKLAWPA

SEQ ID NO: 1454607 - protein, 18 aa, Mycobacterium tuberculosis
LRPLAPVAHLDFDEPEPA

SEQ ID NO: 1454608 - protein, 17 aa, Mycobacterium tuberculosis
LRRAFAADMAFLRNCGI

SEQ ID NO: 1454609 - protein, 24 aa, Mycobacterium tuberculosis
LRRLRELIDRYPLRGIKGPMGTGQ

SEQ ID NO: 1454610 - protein, 25 aa, Mycobacterium tuberculosis
LRRRGDRWYWHWDPQFIGGIAAFPP

SEQ ID NO: 1454611 - protein, 25 aa, Mycobacterium tuberculosis
LRRRLRLRGSRPLAVVITRIGAGSL

SEQ ID NO: 1454612 - protein, 19 aa, Mycobacterium tuberculosis
LRRRMKLGVLAALDQRIGL

SEQ ID NO: 1454613 - protein, 25 aa, Mycobacterium tuberculosis
LRSDFPVLWPVGTRWADNDMFGHLN

SEQ ID NO: 1454614 - protein, 24 aa, Mycobacterium tuberculosis
LRTVPLELARTWVGLAGTMTTLSA

SEQ ID NO: 1454615 - protein, 20 aa, Mycobacterium tuberculosis
LRTYRGVLDAGRVVEFMMLD

SEQ ID NO: 1454616 - protein, 17 aa, Mycobacterium tuberculosis
LRVAMFPAVEPDDVSAL

SEQ ID NO: 1454617 - protein, 20 aa, Mycobacterium tuberculosis
LRVQMRGEIAQLQRRLGTTT

SEQ ID NO: 1454618 - protein, 19 aa, Mycobacterium tuberculosis
LRYLSAQAQQIEWSKVHLF

SEQ ID NO: 1454619 - protein, 19 aa, Mycobacterium tuberculosis
LRYPESHELYILDRRGDGA

SEQ ID NO: 1454620 - protein, 17 aa, Mycobacterium tuberculosis
LSAAVAAAAPWLRDGDV

SEQ ID NO: 1454621 - protein, 23 aa, Mycobacterium tuberculosis
LSADDVARAWSLLGLTVAGPDVP

SEQ ID NO: 1454622 - protein, 23 aa, Mycobacterium tuberculosis
LSAGHARALLSLEAGPEAQEELA

SEQ ID NO: 1454623 - protein, 20 aa, Mycobacterium tuberculosis
LSAPAIKLLIRKAGAASADM

SEQ ID NO: 1454624 - protein, 18 aa, Mycobacterium tuberculosis
LSDAASWITGQVINVDGG

SEQ ID NO: 1454625 - protein, 22 aa, Mycobacterium tuberculosis
LSDAGPTGWRIRVRLDVGADRR

SEQ ID NO: 1454626 - protein, 22 aa, Mycobacterium tuberculosis
LSEDDWDGWAALTASIGDRVQI

SEQ ID NO: 1454627 - protein, 26 aa, Mycobacterium tuberculosis
LSGADRVGFAWVPLLAFVRLATKVGL

SEQ ID NO: 1454628 - protein, 23 aa, Mycobacterium tuberculosis
LSISRTSFDWGVQVPEHPDHVMY

SEQ ID NO: 1454629 - protein, 22 aa, Mycobacterium tuberculosis
LSKAQILDRVWSYDFGGRSNIV

SEQ ID NO: 1454630 - protein, 20 aa, Mycobacterium tuberculosis
LSLPVRRWPLKPFTQRAYQL

SEQ ID NO: 1454631 - protein, 21 aa, Mycobacterium tuberculosis
LSLYFVPKFLFDVETGEPGER

SEQ ID NO: 1454632 - protein, 23 aa, Mycobacterium tuberculosis
LSMAAAVQPYLVWLTCTAESSAL

SEQ ID NO: 1454633 - protein, 19 aa, Mycobacterium tuberculosis
LSPALTFGGANLNFFPMGA

SEQ ID NO: 1454634 - protein, 22 aa, Mycobacterium tuberculosis
LSRKLGRVCPAPSPKDAARGAH

SEQ ID NO: 1454635 - protein, 18 aa, Mycobacterium tuberculosis
LSRQSAWQVLQDAAERAG

SEQ ID NO: 1454636 - protein, 17 aa, Mycobacterium tuberculosis
LSSAERRAIQSFLESGV

SEQ ID NO: 1454637 - protein, 17 aa, Mycobacterium tuberculosis
LSSDPRTGLPLVSVGTV

SEQ ID NO: 1454638 - protein, 17 aa, Mycobacterium tuberculosis
LSSEGWLGPASAAMAEA

SEQ ID NO: 1454639 - protein, 17 aa, Mycobacterium tuberculosis
LSYALAIDRREPLLWKG

SEQ ID NO: 1454640 - protein, 28 aa, Mycobacterium tuberculosis
LTAARISSIPVEYVLAFVEGSNMGQMMG

SEQ ID NO: 1454641 - protein, 26 aa, Mycobacterium tuberculosis
LTAIKRVLPGLGYRLTSRGVRVATSP

SEQ ID NO: 1454642 - protein, 19 aa, Mycobacterium tuberculosis
LTDAIALLIAEGHPVHVVV

SEQ ID NO: 1454643 - protein, 24 aa, Mycobacterium tuberculosis
LTDERIAYADGWFAEAHDDSSSIT

SEQ ID NO: 1454644 - protein, 21 aa, Mycobacterium tuberculosis
LTEPMAVGWHAVRRGEVGKGD

SEQ ID NO: 1454645 - protein, 24 aa, Mycobacterium tuberculosis
LTESLRIVTPVGISESRRLPGSGA

SEQ ID NO: 1454646 - protein, 21 aa, Mycobacterium tuberculosis
LTESPACLITDAFGMTPALAR

SEQ ID NO: 1454647 - protein, 23 aa, Mycobacterium tuberculosis
LTGCRRAVPALSILTDQLAHELE

SEQ ID NO: 1454648 - protein, 18 aa, Mycobacterium tuberculosis
LTGLQIGAGDGFSAIGAV

SEQ ID NO: 1454649 - protein, 25 aa, Mycobacterium tuberculosis
LTGQPAAVVPWDFDGDGLPMSVQLV

SEQ ID NO: 1454650 - protein, 22 aa, Mycobacterium tuberculosis
LTLDFPRQVDVLGLAAKAGNPN

SEQ ID NO: 1454651 - protein, 29 aa, Mycobacterium tuberculosis
LTLRHFPQSFGFSTLGGWLATRSGGHFAT

SEQ ID NO: 1454652 - protein, 21 aa, Mycobacterium tuberculosis
LTPLRHWRSALATALAAPANS

SEQ ID NO: 1454653 - protein, 19 aa, Mycobacterium tuberculosis
LTQQMVWDRVCSALTPGNV

SEQ ID NO: 1454654 - protein, 24 aa, Mycobacterium tuberculosis
LTRIGLGIPYAWSRMRMMRSGKHI

SEQ ID NO: 1454655 - protein, 18 aa, Mycobacterium tuberculosis
LTRMPTVQVDIGYITNPH

SEQ ID NO: 1454656 - protein, 33 aa, Mycobacterium tuberculosis; identical to SEQ ID NO: 203131

SEQ ID NO: 1454657 - protein, 26 aa, Mycobacterium tuberculosis
LTSRPCPTCRGVGVVIPDPCQQCMGD

SEQ ID NO: 1454658 - protein, 19 aa, Mycobacterium tuberculosis
LTVYFALAVRGRLQAGETV

SEQ ID NO: 1454659 - protein, 18 aa, Mycobacterium tuberculosis
LVADGVEQFGRLDIVVAN

SEQ ID NO: 1454660 - protein, 19 aa, Mycobacterium tuberculosis
LVCRSCGSTIEVGDHEVEA

SEQ ID NO: 1454661 - protein, 19 aa, Mycobacterium tuberculosis
LVDDFGINTDNMFGFWDWV

SEQ ID NO: 1454662 - protein, 18 aa, Mycobacterium tuberculosis
LVDPRIVDGTSWITGADQ

SEQ ID NO: 1454663 - protein, 23 aa, Mycobacterium tuberculosis
LVEKLVPDFLWISTEHTARVSLN

SEQ ID NO: 1454664 - protein, 22 aa, Mycobacterium tuberculosis
LVEMRRVRDLQPYIGKEIEAKI

SEQ ID NO: 1454665 - protein, 18 aa, Mycobacterium tuberculosis
LVEPLGFDLSEPKLRRAG

SEQ ID NO: 1454666 - protein, 17 aa, Mycobacterium tuberculosis
LVERGWAAALEPVADQV

SEQ ID NO: 1454667 - protein, 18 aa, Mycobacterium tuberculosis
LVFDTVITRTVRFPETSV

SEQ ID NO: 1454668 - protein, 19 aa, Mycobacterium tuberculosis
LVGDAARFLLEGMPVQVAF

SEQ ID NO: 1454669 - protein, 24 aa, Mycobacterium tuberculosis
LVGFGGTLRAMFRGDGRTIGGEAL

SEQ ID NO: 1454670 - protein, 24 aa, Mycobacterium tuberculosis
LVKKYSDFIAWPIRMDVERRTPAS

SEQ ID NO: 1454671 - protein, 20 aa, Mycobacterium tuberculosis
LVKLRPYFDHPLFVEMFADA

SEQ ID NO: 1454672 - protein, 24 aa, Mycobacterium tuberculosis
LVNSDPYGAGWLLDIQVDSSDVAA

SEQ ID NO: 1454673 - protein, 26 aa, Mycobacterium tuberculosis
LVRAVGIDFFTRWAAGNIKATDVDDP

SEQ ID NO: 1454674 - protein, 24 aa, Mycobacterium tuberculosis
LVRPEVMVGTGFLGAHAEEVYRVE

SEQ ID NO: 1454675 - protein, 18 aa, Mycobacterium tuberculosis
LVTDWQLKGEKPNTHDDA

SEQ ID NO: 1454676 - protein, 23 aa, Mycobacterium tuberculosis
LVVPGRPAVMVLPGPPRELQPIW

SEQ ID NO: 1454677 - protein, 24 aa, Mycobacterium tuberculosis
LVVRRTGIEMAWSEGRDLWWHHVV

SEQ ID NO: 1454678 - protein, 27 aa, Mycobacterium tuberculosis
LWTRRGAHESLCFAGANLIPLRGGPID

SEQ ID NO: 1454679 - protein, 20 aa, Mycobacterium tuberculosis
LYDIPGRSAVPIEPDTIRAL

SEQ ID NO: 1454680 - protein, 19 aa, Mycobacterium tuberculosis
LYELIWQRTVASQMADARG

SEQ ID NO: 1454681 - protein, 18 aa, Mycobacterium tuberculosis
LYQRGFQAGQKFLANWNY

SEQ ID NO: 1454682 - protein, 18 aa, Mycobacterium tuberculosis
LYQYTVRLLTAIASNPER

SEQ ID NO: 1454683 - protein, 18 aa, Mycobacterium tuberculosis
LYRASRAGVRIEVVVRGI

SEQ ID NO: 1454684 - protein, 20 aa, Mycobacterium tuberculosis
MAAALGADVCEIYTDVDGIF

SEQ ID NO: 1454685 - protein, 22 aa, Mycobacterium tuberculosis
MAEEVMAPLGPILVAAAGIGPG

SEQ ID NO: 1454686 - protein, 24 aa, Mycobacterium tuberculosis
MAPLTLAGVPGFLSAVPPPFNIVI

SEQ ID NO: 1454687 - protein, 18 aa, Mycobacterium tuberculosis
MATRPACVEVLFDELARS

SEQ ID NO: 1454688 - protein, 25 aa, Mycobacterium tuberculosis
MAVLREFPSYIAFRERTKAKQPVDA

SEQ ID NO: 1454689 - protein, 18 aa, Mycobacterium tuberculosis
MDAAWALYEAYIKLLTGE

SEQ ID NO: 1454690 - protein, 21 aa, Mycobacterium tuberculosis
MDARLDVYRMLGIKEGEAHVI

SEQ ID NO: 1454691 - protein, 21 aa, Mycobacterium tuberculosis
MDHDLRFYKDFTGTGNSLNAR

SEQ ID NO: 1454692 - protein, 19 aa, Mycobacterium tuberculosis
MDRMLRPGGVVDLLTQPGG

SEQ ID NO: 1454693 - protein, 24 aa, Mycobacterium tuberculosis
MDVNPCAELSMLLLDTAAMADLHM

SEQ ID NO: 1454694 - protein, 17 aa, Mycobacterium tuberculosis
MDVRFLPNPHWVDELRP

SEQ ID NO: 1454695 - protein, 23 aa, Mycobacterium tuberculosis
MEREFPEEFARTAASPFRSDTDI

SEQ ID NO: 1454696 - protein, 18 aa, Mycobacterium tuberculosis
MFGNRGIYHKGWTAVTKH

SEQ ID NO: 1454697 - protein, 20 aa, Mycobacterium tuberculosis
MGAEGLRAASLTAITSANYI

SEQ ID NO: 1454698 - protein, 25 aa, Mycobacterium tuberculosis
MGAKIALPGTEVWAIDGDGCFQMTN

SEQ ID NO: 1454699 - protein, 24 aa, Mycobacterium tuberculosis
MGALRTAAALARLNQRNGFDCPGC

SEQ ID NO: 1454700 - protein, 20 aa, Mycobacterium tuberculosis
MGFCTPQEYVLFLRQTPIFE

SEQ ID NO: 1454701 - protein, 34 aa, Mycobacterium tuberculosis; identical to SEQ ID NO: 203333

SEQ ID NO: 1454702 - protein, 20 aa, Mycobacterium tuberculosis
MKDMVGMMIVVARHLRQAAI

SEQ ID NO: 1454703 - protein, 22 aa, Mycobacterium tuberculosis
MKEGRYEVRAELPGVDPDKDVD

SEQ ID NO: 1454704 - protein, 18 aa, Mycobacterium tuberculosis
MKWNMGWMHDTLDYVSRD

SEQ ID NO: 1454705 - protein, 20 aa, Mycobacterium tuberculosis
MLAELFRRRVLVPPEGACPG

SEQ ID NO: 1454706 - protein, 18 aa, Mycobacterium tuberculosis
MLAQLAAAGLGGYVLCGL

SEQ ID NO: 1454707 - protein, 18 aa, Mycobacterium tuberculosis
MLIVPGSMRVRAQAEAEG

SEQ ID NO: 1454708 - protein, 21 aa, Mycobacterium tuberculosis
MLLMRAGREYALKRALAKFSD

SEQ ID NO: 1454709 - protein, 21 aa, Mycobacterium tuberculosis
MLRAARFVSQLGFAVAPRVRA

SEQ ID NO: 1454710 - protein, 26 aa, Mycobacterium tuberculosis
MLRMLRPDLTIGFFLHIPFPPVELFM

SEQ ID NO: 1454711 - protein, 19 aa, Mycobacterium tuberculosis
MMAAFADQAALAWQLATSQ

SEQ ID NO: 1454712 - protein, 18 aa, Mycobacterium tuberculosis
MPDLRCLILTSYTSDEAM

SEQ ID NO: 1454713 - protein, 18 aa, Mycobacterium tuberculosis
MPDPVPVILLSRLAVDRK

SEQ ID NO: 1454714 - protein, 25 aa, Mycobacterium tuberculosis
MPEKLHELQRLWLIEATRYNVLPLD

SEQ ID NO: 1454715 - protein, 21 aa, Mycobacterium tuberculosis
MPGMDGFGVLRRLRADGIDAP

SEQ ID NO: 1454716 - protein, 24 aa, Mycobacterium tuberculosis
MPIHMRLPKLKGFRNRFRTEYEIV

SEQ ID NO: 1454717 - protein, 23 aa, Mycobacterium tuberculosis
MPLLERAKFLAIFASNLDEFYMV

SEQ ID NO: 1454718 - protein, 25 aa, Mycobacterium tuberculosis
MPTLDSFLHYRMIDVSSIKELCRRW

SEQ ID NO: 1454719 - protein, 24 aa, Mycobacterium tuberculosis
MRGPSSIWYRIRINLQHVPADQRP

SEQ ID NO: 1454720 - protein, 18 aa, Mycobacterium tuberculosis
MRLGELAVEAGLDEDLLQ

SEQ ID NO: 1454721 - protein, 20 aa, Mycobacterium tuberculosis
MRLLGVTCLEELSPRHVTQL

SEQ ID NO: 1454722 - protein, 20 aa, Mycobacterium tuberculosis
MRQDETFLRELVDAYVNGDG

SEQ ID NO: 1454723 - protein, 20 aa, Mycobacterium tuberculosis
MRVRLAMGVVTSIDPEILLL

SEQ ID NO: 1454724 - protein, 24 aa, Mycobacterium tuberculosis
MSEAQLADEIFVIADLARQKARAS

SEQ ID NO: 1454725 - protein, 19 aa, Mycobacterium tuberculosis
MSGALRSGTFIRLDETAAE

SEQ ID NO: 1454726 - protein, 29 aa, Mycobacterium tuberculosis
MSGTRITLHAALQLARRGSGVGVAALCGA

SEQ ID NO: 1454727 - protein, 25 aa, Mycobacterium tuberculosis
MSKAFAFAGGRLGYLIATPAVIDAM

SEQ ID NO: 1454728 - protein, 25 aa, Mycobacterium tuberculosis
MSPTAFVRRPLRWIQALSEGSRTGR

SEQ ID NO: 1454729 - protein, 27 aa, Mycobacterium tuberculosis
MTAIVKGLRTGTDFEYELQMAQMNKHI

SEQ ID NO: 1454730 - protein, 18 aa, Mycobacterium tuberculosis
MTELPLLVIDVQRGGPST

SEQ ID NO: 1454731 - protein, 18 aa, Mycobacterium tuberculosis
MTTFGFILGEVFRRVTGR

SEQ ID NO: 1454732 - protein, 20 aa, Mycobacterium tuberculosis
MVATEAWPPNAAMATRRLHP

SEQ ID NO: 1454733 - protein, 23 aa, Mycobacterium tuberculosis
MVDVRFPVQYVIRPHTLEHQDHR

SEQ ID NO: 1454734 - protein, 20 aa, Mycobacterium tuberculosis
MVIKDGRFGPYVTDGETNAS

SEQ ID NO: 1454735 - protein, 23 aa, Mycobacterium tuberculosis
MVRNMRVARQLGFLRVADSDLID

SEQ ID NO: 1454736 - protein, 24 aa, Mycobacterium tuberculosis
MYAAGRIPGSFFRREGRPSTDAIL

SEQ ID NO: 1454737 - protein, 20 aa, Mycobacterium tuberculosis
NAAALPFRYTVNGYRGCSHA

SEQ ID NO: 1454738 - protein, 19 aa, Mycobacterium tuberculosis
NAGKLIVVVLPDFGERYLS

SEQ ID NO: 1454739 - protein, 19 aa, Mycobacterium tuberculosis
NAGTIFWNGPMGVFEFPAY

SEQ ID NO: 1454740 - protein, 19 aa, Mycobacterium tuberculosis
NAGVHACAVIMSSEPLTEA

SEQ ID NO: 1454741 - protein, 17 aa, Mycobacterium tuberculosis
NAPMLGVAYGYPGAPGQ

SEQ ID NO: 1454742 - protein, 28 aa, Mycobacterium tuberculosis
NARFTIHAGEAFGLPSIHEAIAFCGADR

SEQ ID NO: 1454743 - protein, 21 aa, Mycobacterium tuberculosis
NARGGRLSRQSAWQVLQDAAE

SEQ ID NO: 1454744 - protein, 17 aa, Mycobacterium tuberculosis
NARTRFVLVGRPGPPPA

SEQ ID NO: 1454745 - protein, 19 aa, Mycobacterium tuberculosis
NASLKRTRITIAVNADSMA

SEQ ID NO: 1454746 - protein, 19 aa, Mycobacterium tuberculosis
NCEIVPWCRFARKNYFYPD

SEQ ID NO: 1454747 - protein, 22 aa, Mycobacterium tuberculosis
NDPGTVCGPLISARQRDRVQGY

SEQ ID NO: 1454748 - protein, 25 aa, Mycobacterium tuberculosis
NDVLDRYLPVLADLRMRYLDDGDWD

SEQ ID NO: 1454749 - protein, 23 aa, Mycobacterium tuberculosis
NDYDLSSLFLLASTAALFSPSIK

SEQ ID NO: 1454750 - protein, 22 aa, Mycobacterium tuberculosis
NEDEVDAFLDLVENELTRLIEE

SEQ ID NO: 1454751 - protein, 26 aa, Mycobacterium tuberculosis
NEGDVFCSVVRRVALPDSFFAVDGQI

SEQ ID NO: 1454752 - protein, 20 aa, Mycobacterium tuberculosis
NELRFSQGRHGWRCAVTLDV

SEQ ID NO: 1454753 - protein, 23 aa, Mycobacterium tuberculosis
NERRTNWLNNFYFGGDHGVPDSV

SEQ ID NO: 1454754 - protein, 21 aa, Mycobacterium tuberculosis
NEVKPGSGMRGVIAKKGNIPV

SEQ ID NO: 1454755 - protein, 18 aa, Mycobacterium tuberculosis
NEWVRLSVRHVLDAGEAL

SEQ ID NO: 1454756 - protein, 17 aa, Mycobacterium tuberculosis
NFHPWGIAQQFSAILGS

SEQ ID NO: 1454757 - protein, 22 aa, Mycobacterium tuberculosis
NGSFPDFPLPLGDPSKPSDADI

SEQ ID NO: 1454758 - protein, 20 aa, Mycobacterium tuberculosis
NGVGPAQFPAMLTALRQAMA

SEQ ID NO: 1454759 - protein, 32 aa, Mycobacterium tuberculosis; identical to SEQ ID NO: 203581

SEQ ID NO: 1454760 - protein, 19 aa, Mycobacterium tuberculosis
NKNGMPWASAQLEDLTGGI

SEQ ID NO: 1454761 - protein, 25 aa, Mycobacterium tuberculosis
NKVPGARCALAWSVQTAALAREHNN

SEQ ID NO: 1454762 - protein, 24 aa, Mycobacterium tuberculosis
NKVSELPAGHGLNVNTLSYGDLAA

SEQ ID NO: 1454763 - protein, 23 aa, Mycobacterium tuberculosis
NLAQDRIRTWSDWFDNNTRSARY

SEQ ID NO: 1454764 - protein, 23 aa, Mycobacterium tuberculosis
NLARAKMGLPVPVTSRHTLLLGP

SEQ ID NO: 1454765 - protein, 21 aa, Mycobacterium tuberculosis
NLDEARLLVDIEVVDAESQRA

SEQ ID NO: 1454766 - protein, 25 aa, Mycobacterium tuberculosis
NLLAPGHWPMMVFRIGHARAPSVRT

SEQ ID NO: 1454767 - protein, 22 aa, Mycobacterium tuberculosis
NLVKMALHYEGWDVEVAHDGQE

SEQ ID NO: 1454768 - protein, 29 aa, Mycobacterium tuberculosis
NMKELRPAGTSIRILFAFDPARQAILLLG

SEQ ID NO: 1454769 - protein, 22 aa, Mycobacterium tuberculosis
NNVETRPGVGYPRTYEDQERWR

SEQ ID NO: 1454770 - protein, 19 aa, Mycobacterium tuberculosis
NNVVKFRWNGGGVELIGNT

SEQ ID NO: 1454771 - protein, 21 aa, Mycobacterium tuberculosis
NRPEVLMIIGAGQARGYRRTA

SEQ ID NO: 1454772 - protein, 25 aa, Mycobacterium tuberculosis
NRRRRRGRRGRGRGRGEQGGSDGDP

SEQ ID NO: 1454773 - protein, 20 aa, Mycobacterium tuberculosis
NRSACVRIPITGSNPKAKRL

SEQ ID NO: 1454774 - protein, 26 aa, Mycobacterium tuberculosis
NSAGRYRPFYLRNLLDAVQGRNLNDA

SEQ ID NO: 1454775 - protein, 30 aa, Mycobacterium tuberculosis; identical to SEQ ID NO: 203686

SEQ ID NO: 1454776 - protein, 24 aa, Mycobacterium tuberculosis
NSVTSGLVGESWLGPSSAAMAAAV

SEQ ID NO: 1454777 - protein, 22 aa, Mycobacterium tuberculosis
NSWLRETLREFLLRNRSYVATA

SEQ ID NO: 1454778 - protein, 31 aa, Mycobacterium tuberculosis; identical to SEQ ID NO: 82892

SEQ ID NO: 1454779 - protein, 28 aa, Mycobacterium tuberculosis
NTQVCPVCLGLPGSLPVLNRAAVESAIR

SEQ ID NO: 1454780 - protein, 18 aa, Mycobacterium tuberculosis
NTVQFAAAVQAAMEDGYR

SEQ ID NO: 1454781 - protein, 19 aa, Mycobacterium tuberculosis
NVKPGRVLFELSYPNEGVA

SEQ ID NO: 1454782 - protein, 25 aa, Mycobacterium tuberculosis
NVSKLLWANWHRNLGELAMDVIGKP

SEQ ID NO: 1454783 - protein, 20 aa, Mycobacterium tuberculosis
NYGDCFSYGLAKISGQPLLF

SEQ ID NO: 1454784 - protein, 18 aa, Mycobacterium tuberculosis
PAALLRCLVEGADEVHVD

SEQ ID NO: 1454785 - protein, 21 aa, Mycobacterium tuberculosis
PAAWIAEGLFGYLPPDAQNRL

SEQ ID NO: 1454786 - protein, 19 aa, Mycobacterium tuberculosis
PACVQCSATSKALDKQGIA

SEQ ID NO: 1454787 - protein, 21 aa, Mycobacterium tuberculosis
PADPDIVGWEVDEFVSLARSG

SEQ ID NO: 1454788 - protein, 25 aa, Mycobacterium tuberculosis
PADTRWHPVSSLPPMAFDHGPMVTH

SEQ ID NO: 1454789 - protein, 24 aa, Mycobacterium tuberculosis
PAEIREFLEGYVIGQDTAKRTLAV

SEQ ID NO: 1454790 - protein, 20 aa, Mycobacterium tuberculosis
PAETGLKWPNDVLARGGKLA

SEQ ID NO: 1454791 - protein, 19 aa, Mycobacterium tuberculosis
PAGIPLEPGIYEWRVEVEG

SEQ ID NO: 1454792 - protein, 26 aa, Mycobacterium tuberculosis
PAGKQAASAFAMWFPIEGGSKYGGYG

SEQ ID NO: 1454793 - protein, 19 aa, Mycobacterium tuberculosis
PALAHGPLTLKGFDAPVMA

SEQ ID NO: 1454794 - protein, 19 aa, Mycobacterium tuberculosis
PAMVFRLIAEEALTLMAGA

SEQ ID NO: 1454795 - protein, 18 aa, Mycobacterium tuberculosis
PARARAEVLAAMRAAHPY

SEQ ID NO: 1454796 - protein, 44 aa, Mycobacterium tuberculosis; identical to SEQ ID NO: 203815

SEQ ID NO: 1454797 - protein, 30 aa, Mycobacterium tuberculosis; identical to SEQ ID NO: 203817

SEQ ID NO: 1454798 - protein, 20 aa, Mycobacterium tuberculosis
PATRSYRYIDYWGTAVTAFD

SEQ ID NO: 1454799 - protein, 19 aa, Mycobacterium tuberculosis
PATSMEIAEAAGLEERYVR

SEQ ID NO: 1454800 - protein, 18 aa, Mycobacterium tuberculosis
PATVLDIAGQVGYDDLPA

SEQ ID NO: 1454801 - protein, 18 aa, Mycobacterium tuberculosis
PAVARRLLCDVGVNAAIL

SEQ ID NO: 1454802 - protein, 23 aa, Mycobacterium tuberculosis
PCSPPRRPRVCSRRRSPRAHRRH

SEQ ID NO: 1454803 - protein, 24 aa, Mycobacterium tuberculosis
PCVIKAADGRVVWDNDAYSFLDGA

SEQ ID NO: 1454804 - protein, 17 aa, Mycobacterium tuberculosis
PDARWLLAVSDRNGIVS

SEQ ID NO: 1454805 - protein, 23 aa, Mycobacterium tuberculosis
PDDIRPGDLVAVAATGAYCYSLS

SEQ ID NO: 1454806 - protein, 18 aa, Mycobacterium tuberculosis
PDDQHWAFRITQGQPVCG

SEQ ID NO: 1454807 - protein, 20 aa, Mycobacterium tuberculosis
PDGSWLRTGDLGFLSEDEMF

SEQ ID NO: 1454808 - protein, 25 aa, Mycobacterium tuberculosis
PDGTGWRWRTWHLYPSASGGTVVHT

SEQ ID NO: 1454809 - protein, 17 aa, Mycobacterium tuberculosis
PDGTPTFSRYVEIGVDF

SEQ ID NO: 1454810 - protein, 25 aa, Mycobacterium tuberculosis
PDLTSGRALAGFGLTEPGAGSDAGS

SEQ ID NO: 1454811 - protein, 24 aa, Mycobacterium tuberculosis
PDQRLGEVGRAFVVARPGTGLDEA

SEQ ID NO: 1454812 - protein, 18 aa, Mycobacterium tuberculosis
PDRRDWRLVREVLVAETD

SEQ ID NO: 1454813 - protein, 21 aa, Mycobacterium tuberculosis
PDTDSELFRRYWPADLHMIGK

SEQ ID NO: 1454814 - protein, 25 aa, Mycobacterium tuberculosis
PDTFRKLRGGFDLILNTVSANLDLG

SEQ ID NO: 1454815 - protein, 21 aa, Mycobacterium tuberculosis
PDVADALGLAVGSPVLVVDRT

SEQ ID NO: 1454816 - protein, 20 aa, Mycobacterium tuberculosis
PECSGRVGIVGFCMGGQFAL

SEQ ID NO: 1454817 - protein, 19 aa, Mycobacterium tuberculosis
PEDVMGMLAAQGIVTEVGG

SEQ ID NO: 1454818 - protein, 29 aa, Mycobacterium tuberculosis
PEHPVAAFPQWFGRSWRRVAMLRYGENPH

SEQ ID NO: 1454819 - protein, 19 aa, Mycobacterium tuberculosis
PELLACLQRLEVERRRQGA

SEQ ID NO: 1454820 - protein, 19 aa, Mycobacterium tuberculosis
PERLVRAAVDLVDHPGARA

SEQ ID NO: 1454821 - protein, 21 aa, Mycobacterium tuberculosis
PERRRGMAVIISDFLGPINWM

SEQ ID NO: 1454822 - protein, 27 aa, Mycobacterium tuberculosis
PERSASWVVPLLWRRWSPGYHAEEDLR

SEQ ID NO: 1454823 - protein, 17 aa, Mycobacterium tuberculosis
PESYVQAQFDSVLHSAL

SEQ ID NO: 1454824 - protein, 20 aa, Mycobacterium tuberculosis
PEVVIPMLVPDGAHSYPDAA

SEQ ID NO: 1454825 - protein, 27 aa, Mycobacterium tuberculosis
PEWPQMLLRALMFRLAVYALHPRSTAE

SEQ ID NO: 1454826 - protein, 19 aa, Mycobacterium tuberculosis
PFAPELPKGYPVSSAPYGS

SEQ ID NO: 1454827 - protein, 31 aa, Mycobacterium tuberculosis; identical to SEQ ID NO: 203982

SEQ ID NO: 1454828 - protein, 27 aa, Mycobacterium tuberculosis
PFPMTAWAVGLLMRLPQRGVVTVATNV

SEQ ID NO: 1454829 - protein, 18 aa, Mycobacterium tuberculosis
PGAVIGHSMGESAAAVVA

SEQ ID NO: 1454830 - protein, 25 aa, Mycobacterium tuberculosis
PGGCAGLRYNLFFDDRTLDGDQTAE

SEQ ID NO: 1454831 - protein, 19 aa, Mycobacterium tuberculosis
PGGDIKPEHLILIGQIAQD

SEQ ID NO: 1454832 - protein, 19 aa, Mycobacterium tuberculosis
PGGRCLCTYFLLNDESLAH

SEQ ID NO: 1454833 - protein, 19 aa, Mycobacterium tuberculosis
PGLQEKPLSIALREIHADL

SEQ ID NO: 1454834 - protein, 22 aa, Mycobacterium tuberculosis
PGLRWPDLALQGGRLNWSAVRA

SEQ ID NO: 1454835 - protein, 22 aa, Mycobacterium tuberculosis
PGPTALLAPDWVPWEQRVRPGD

SEQ ID NO: 1454836 - protein, 24 aa, Mycobacterium tuberculosis
PGRDDWAVHIALWRRSSNGQPEIT

SEQ ID NO: 1454837 - protein, 42 aa, Mycobacterium tuberculosis; identical to SEQ ID NO: 204066

SEQ ID NO: 1454838 - protein, 24 aa, Mycobacterium tuberculosis
PGSDFELVQGFLLAEGVVAHREDV

SEQ ID NO: 1454839 - protein, 19 aa, Mycobacterium tuberculosis
PGSGIDYGLLRYLRADTAE

SEQ ID NO: 1454840 - protein, 19 aa, Mycobacterium tuberculosis
PGYTGLHFMAAYELEECWQ

SEQ ID NO: 1454841 - protein, 27 aa, Mycobacterium tuberculosis
PHAGYRAVHVWLRLPAGRVEIQIRTIL

SEQ ID NO: 1454842 - protein, 20 aa, Mycobacterium tuberculosis
PHPKLPGTVFTAAKELEEAG

SEQ ID NO: 1454843 - protein, 19 aa, Mycobacterium tuberculosis
PHRAEAFDAARMCIELLKQ

SEQ ID NO: 1454844 - protein, 18 aa, Mycobacterium tuberculosis
PHRLPGIRMIASTYLGVV

SEQ ID NO: 1454845 - protein, 25 aa, Mycobacterium tuberculosis
PHTKPPNFWAWLIAQVKTVDPDVLF

SEQ ID NO: 1454846 - protein, 20 aa, Mycobacterium tuberculosis
PIAVTDFWTFPRSCNPTGGL

SEQ ID NO: 1454847 - protein, 18 aa, Mycobacterium tuberculosis
PIDCTLRGLTQYSRTNNA

SEQ ID NO: 1454848 - protein, 26 aa, Mycobacterium tuberculosis
PIEPRLSLQWWVRVESLAKAAGDAVR

SEQ ID NO: 1454849 - protein, 22 aa, Mycobacterium tuberculosis
PIERTCEFLEWFGENVPISPIW

SEQ ID NO: 1454850 - protein, 18 aa, Mycobacterium tuberculosis
PITVPVLLLLTERFDLSA

SEQ ID NO: 1454851 - protein, 17 aa, Mycobacterium tuberculosis
PIWEGEDGVIAWLLAGP

SEQ ID NO: 1454852 - protein, 19 aa, Mycobacterium tuberculosis
PKELVARVRARLRRNDDEP

SEQ ID NO: 1454853 - protein, 17 aa, Mycobacterium tuberculosis
PKLAPAPMLERQANQRS

SEQ ID NO: 1454854 - protein, 19 aa, Mycobacterium tuberculosis
PKLRRAGLDYHDLASVTVH

SEQ ID NO: 1454855 - protein, 20 aa, Mycobacterium tuberculosis
PKPLRLDDVSAHPASIGFPP

SEQ ID NO: 1454856 - protein, 18 aa, Mycobacterium tuberculosis
PKTSHLIVRMYNALLEAV

SEQ ID NO: 1454857 - protein, 20 aa, Mycobacterium tuberculosis
PKVEACLRAVIGGVPSAHII

SEQ ID NO: 1454858 - protein, 17 aa, Mycobacterium tuberculosis
PLDGFRVLDFTQNVAGP

SEQ ID NO: 1454859 - protein, 19 aa, Mycobacterium tuberculosis
PLGEMRYLPVASRPFVQRH

SEQ ID NO: 1454860 - protein, 27 aa, Mycobacterium tuberculosis
PLGMSYGVSKAAMWSATESMRIELAPR

SEQ ID NO: 1454861 - protein, 24 aa, Mycobacterium tuberculosis
PLPFLRRFDIPPGIEHQEDAFMSL

SEQ ID NO: 1454862 - protein, 24 aa, Mycobacterium tuberculosis
PLPGPRLPHDMAFTENYVILNDFP

SEQ ID NO: 1454863 - protein, 18 aa, Mycobacterium tuberculosis
PLWAPDYPVGAQVRRADP

SEQ ID NO: 1454864 - protein, 18 aa, Mycobacterium tuberculosis
PMAVCANGAVIYDPGTDR

SEQ ID NO: 1454865 - protein, 17 aa, Mycobacterium tuberculosis
PMGLPELTSTKWIAWGA

SEQ ID NO: 1454866 - protein, 25 aa, Mycobacterium tuberculosis
PNFAIGAVLSMHFAKQAARFFDSAE

SEQ ID NO: 1454867 - protein, 26 aa, Mycobacterium tuberculosis
PNGGVLERYVGLYLPFLDMSFNGATP

SEQ ID NO: 1454868 - protein, 21 aa, Mycobacterium tuberculosis
PNNEEWARFVAACDLVRGAHA

SEQ ID NO: 1454869 - protein, 25 aa, Mycobacterium tuberculosis
PNYLPWDERLCAVPNGDLFKTLASG

SEQ ID NO: 1454870 - protein, 24 aa, Mycobacterium tuberculosis
PPAVARFLAHWVHQAGPKILEPSC

SEQ ID NO: 1454871 - protein, 18 aa, Mycobacterium tuberculosis
PPDNWRLVVSDLADSELP

SEQ ID NO: 1454872 - protein, 26 aa, Mycobacterium tuberculosis
PPEGACPGPFGAPIPGFARSYQPSSP

SEQ ID NO: 1454873 - protein, 22 aa, Mycobacterium tuberculosis
PPFDLDGRWIGEASFVLPADLP

SEQ ID NO: 1454874 - protein, 26 aa, Mycobacterium tuberculosis
PPFRSLTPIPVHWVAAAVLDGVARRR

SEQ ID NO: 1454875 - protein, 18 aa, Mycobacterium tuberculosis
PPIAPSLPTPVPHNEKPQ

SEQ ID NO: 1454876 - protein, 20 aa, Mycobacterium tuberculosis
PPILLCHGNPTWSFLYRDII

SEQ ID NO: 1454877 - protein, 27 aa, Mycobacterium tuberculosis
PPILRLAYRLLSPMLRVLPFVHSTRVS

SEQ ID NO: 1454878 - protein, 25 aa, Mycobacterium tuberculosis
PPLPSTRQRLGWALRDLPSRLGKIA

SEQ ID NO: 1454879 - protein, 23 aa, Mycobacterium tuberculosis
PPRARAHAAAMFVSNAREAEPFV

SEQ ID NO: 1454880 - protein, 23 aa, Mycobacterium tuberculosis
PQAFDGLRLAGRRVRRPELTLAT

SEQ ID NO: 1454881 - protein, 19 aa, Mycobacterium tuberculosis
PQAGRLLSAVWLREPDGPG

SEQ ID NO: 1454882 - protein, 22 aa, Mycobacterium tuberculosis
PQAWPRWATVITKVTWTSPEPF

SEQ ID NO: 1454883 - protein, 18 aa, Mycobacterium tuberculosis
PQPGTGFVEARTVAVDVL

SEQ ID NO: 1454884 - protein, 17 aa, Mycobacterium tuberculosis
PQPIAWPGSSDRNFYDR

SEQ ID NO: 1454885 - protein, 17 aa, Mycobacterium tuberculosis
PQQRVGLRVAWRTLENS

SEQ ID NO: 1454886 - protein, 18 aa, Mycobacterium tuberculosis
PQVVKEVAPVPVLAAGGI

SEQ ID NO: 1454887 - protein, 18 aa, Mycobacterium tuberculosis
PQYDIVRLLRLYDAGQLM

SEQ ID NO: 1454888 - protein, 18 aa, Mycobacterium tuberculosis
PRADRSARENLLAVFTAN

SEQ ID NO: 1454889 - protein, 18 aa, Mycobacterium tuberculosis
PRALPAIAGLSVELGIAT

SEQ ID NO: 1454890 - protein, 20 aa, Mycobacterium tuberculosis
PRDGRFGSGPSKVRLEQLQT

SEQ ID NO: 1454891 - protein, 22 aa, Mycobacterium tuberculosis
PREAGDALAPVLDETWRGETGE

SEQ ID NO: 1454892 - protein, 18 aa, Mycobacterium tuberculosis
PREPRYLGRWRVDQWFST

SEQ ID NO: 1454893 - protein, 19 aa, Mycobacterium tuberculosis
PRERSRWRFTFKRLAAEAQ

SEQ ID NO: 1454894 - protein, 25 aa, Mycobacterium tuberculosis
PRFYPEIPSRFAVVARRGNDIRWFE

SEQ ID NO: 1454895 - protein, 20 aa, Mycobacterium tuberculosis
PRGTPWADLYALRAARGQPG

SEQ ID NO: 1454896 - protein, 22 aa, Mycobacterium tuberculosis
PRHPHLVKLVARRANVEGIGEV

SEQ ID NO: 1454897 - protein, 26 aa, Mycobacterium tuberculosis
PRIFKRIRPAFTYRRSLGVLTAARDA

SEQ ID NO: 1454898 - protein, 19 aa, Mycobacterium tuberculosis
PRLVAGCRAAWLTLRDRRT

SEQ ID NO: 1454899 - protein, 19 aa, Mycobacterium tuberculosis
PRNEWLFNDAWGVDVAVST

SEQ ID NO: 1454900 - protein, 20 aa, Mycobacterium tuberculosis
PRNSTVLVWGAVNAGMAANA

SEQ ID NO: 1454901 - protein, 17 aa, Mycobacterium tuberculosis
PRPAPTVATEHLHELMV

SEQ ID NO: 1454902 - protein, 18 aa, Mycobacterium tuberculosis
PRQKVVVEIDGRRVEVSL

SEQ ID NO: 1454903 - protein, 27 aa, Mycobacterium tuberculosis
PRSLEIVSCPSCGRAQVDVYTLANEVT

SEQ ID NO: 1454904 - protein, 29 aa, Mycobacterium tuberculosis
PRSLFPEFSELFAAFPSFAGLRPTFDTRL

SEQ ID NO: 1454905 - protein, 21 aa, Mycobacterium tuberculosis
PRVTRKLGDLITFVIHIPLSI

SEQ ID NO: 1454906 - protein, 25 aa, Mycobacterium tuberculosis
PSAAAIDRACRWGRDSVEPAIAVTS

SEQ ID NO: 1454907 - protein, 21 aa, Mycobacterium tuberculosis
PSACFFNLGPVLAQSLYIEGN

SEQ ID NO: 1454908 - protein, 25 aa, Mycobacterium tuberculosis
PSIAETIDWGRTVLALGLDTIDDAV

SEQ ID NO: 1454909 - protein, 25 aa, Mycobacterium tuberculosis
PSLRQRVIAAWLWSGRKGVIAGASA

SEQ ID NO: 1454910 - protein, 25 aa, Mycobacterium tuberculosis
PSLWMPDLFMLRQIHFAPRLTVNAA

SEQ ID NO: 1454911 - protein, 21 aa, Mycobacterium tuberculosis
PSSAELRAWAKSVGLPVSDRG

SEQ ID NO: 1454912 - protein, 20 aa, Mycobacterium tuberculosis
PSTDAILTCRLIDRPLRPSF

SEQ ID NO: 1454913 - protein, 24 aa, Mycobacterium tuberculosis
PTGDAELLLIGWGSSYGPIGEACR

SEQ ID NO: 1454914 - protein, 25 aa, Mycobacterium tuberculosis
PTMVRDFQRIIGMEARVQIQGQAGR

SEQ ID NO: 1454915 - protein, 24 aa, Mycobacterium tuberculosis
PTPDMRLDMPLVDFFSHGGALKSS

SEQ ID NO: 1454916 - protein, 17 aa, Mycobacterium tuberculosis
PTPGHAVGLSFSVAPDV

SEQ ID NO: 1454917 - protein, 20 aa, Mycobacterium tuberculosis
PTPLRPQERRTIVADHQQSG

SEQ ID NO: 1454918 - protein, 24 aa, Mycobacterium tuberculosis
PTPQARLALITAIRAAGLDCHVMV

SEQ ID NO: 1454919 - protein, 29 aa, Mycobacterium tuberculosis
PTQLFRSTGIPVCLWFFAKDKAAGKQGSI

SEQ ID NO: 1454920 - protein, 25 aa, Mycobacterium tuberculosis
PVAVDSLWFDALRSVAVDHRDGPVV

SEQ ID NO: 1454921 - protein, 18 aa, Mycobacterium tuberculosis
PVGMFRMVDEHGGDDKVL

SEQ ID NO: 1454922 - protein, 24 aa, Mycobacterium tuberculosis
PVGNAGNITAYWKGYTEYHQLGLI

SEQ ID NO: 1454923 - protein, 19 aa, Mycobacterium tuberculosis
PVHRERVIPGHEVVGEVIE

SEQ ID NO: 1454924 - protein, 26 aa, Mycobacterium tuberculosis
PVIDVKLPALAPMVAAFGKMRAVETA

SEQ ID NO: 1454925 - protein, 22 aa, Mycobacterium tuberculosis
PVMLDMLRWHGAEEVEHKAVAF

SEQ ID NO: 1454926 - protein, 19 aa, Mycobacterium tuberculosis
PVNGTAFAVTPTLRESYAE

SEQ ID NO: 1454927 - protein, 21 aa, Mycobacterium tuberculosis
PVPERLGGDGVGLFEVGALLT

SEQ ID NO: 1454928 - protein, 25 aa, Mycobacterium tuberculosis
PVPVAYHTFGGWKRSGFGDLNQHGP

SEQ ID NO: 1454929 - protein, 25 aa, Mycobacterium tuberculosis
PVRLAELFIEAGLPAGVFQVVHGDK

SEQ ID NO: 1454930 - protein, 27 aa, Mycobacterium tuberculosis
PVVDVWKGWADRAGWVPWSADSAPMVF

SEQ ID NO: 1454931 - protein, 18 aa, Mycobacterium tuberculosis
PWLPERSASWVVPLLWRR

SEQ ID NO: 1454932 - protein, 21 aa, Mycobacterium tuberculosis
PYFDDLFLMAAERRFLSVERI

SEQ ID NO: 1454933 - protein, 17 aa, Mycobacterium tuberculosis
PYHGGTHLPDITVITPV

SEQ ID NO: 1454934 - protein, 18 aa, Mycobacterium tuberculosis
PYTGAPMKQVHQGRGITM

SEQ ID NO: 1454935 - protein, 18 aa, Mycobacterium tuberculosis
PYYRRLRDEAPLYRNEER

SEQ ID NO: 1454936 - protein, 17 aa, Mycobacterium tuberculosis
QAALAWQLATSQRRMRE

SEQ ID NO: 1454937 - protein, 23 aa, Mycobacterium tuberculosis
QAAWPERMFSLLAGFVEAGESFE

SEQ ID NO: 1454938 - protein, 19 aa, Mycobacterium tuberculosis
QAIGVAFGATVDRAPELLH

SEQ ID NO: 1454939 - protein, 27 aa, Mycobacterium tuberculosis
QALLSGLPVRRLWGIGPVAEEKLHRLG

SEQ ID NO: 1454940 - protein, 23 aa, Mycobacterium tuberculosis
QALSELRLAGVDGPYSVLLSADV

SEQ ID NO: 1454941 - protein, 18 aa, Mycobacterium tuberculosis
QAMRELPKALASTPKIIS

SEQ ID NO: 1454942 - protein, 25 aa, Mycobacterium tuberculosis
QAMRLRDLLKFDFYFADSTAFRANI

SEQ ID NO: 1454943 - protein, 21 aa, Mycobacterium tuberculosis
QARLTEVGLWDAVKDRLSDSP

SEQ ID NO: 1454944 - protein, 25 aa, Mycobacterium tuberculosis
QATRCMDCGIPFCHNGCPLGNLIPE

SEQ ID NO: 1454945 - protein, 24 aa, Mycobacterium tuberculosis
QAWTNRSGTEYVWFNNVETRPGVG

SEQ ID NO: 1454946 - protein, 33 aa, Mycobacterium tuberculosis; identical to SEQ ID NO: 204624

SEQ ID NO: 1454947 - protein, 24 aa, Mycobacterium tuberculosis
QEIDLRFADALSMADNVMTFRYVI

SEQ ID NO: 1454948 - protein, 20 aa, Mycobacterium tuberculosis
QELRGSGIAVSVIHPALTQT

SEQ ID NO: 1454949 - protein, 24 aa, Mycobacterium tuberculosis
QEVCALLAGGGYAEYVAVPADQVL

SEQ ID NO: 1454950 - protein, 26 aa, Mycobacterium tuberculosis
QFADSGLRTSVQFVGPLSVVDSALAD

SEQ ID NO: 1454951 - protein, 23 aa, Mycobacterium tuberculosis
QFARFAEGLGFAGVLAGPLVRSS

SEQ ID NO: 1454952 - protein, 21 aa, Mycobacterium tuberculosis
QFVSSPGYEHAWLNPDNTEVS

SEQ ID NO: 1454953 - protein, 24 aa, Mycobacterium tuberculosis
QGAWPRFGLELPELLPDKLAGIKR

SEQ ID NO: 1454954 - protein, 23 aa, Mycobacterium tuberculosis
QGVWVHPEWRGIGLGTAGTATLA

SEQ ID NO: 1454955 - protein, 21 aa, Mycobacterium tuberculosis
QHLRMLLKQQRAVSVPERNQP

SEQ ID NO: 1454956 - protein, 21 aa, Mycobacterium tuberculosis
QHPIEGVSMAYSFDDAQAPDR

SEQ ID NO: 1454957 - protein, 18 aa, Mycobacterium tuberculosis
QIADLAVRATFLAGRQVY

SEQ ID NO: 1454958 - protein, 18 aa, Mycobacterium tuberculosis
QIDLKVASWYASTHPASK

SEQ ID NO: 1454959 - protein, 26 aa, Mycobacterium tuberculosis
QINYLRCIGCGLCIEACPTRALTMTY

SEQ ID NO: 1454960 - protein, 24 aa, Mycobacterium tuberculosis
QKVIRCFREGGGVPYSEYPRFHKL

SEQ ID NO: 1454961 - protein, 26 aa, Mycobacterium tuberculosis
QLAGLKLLAFRGRFVEIGKRDIYGDT

SEQ ID NO: 1454962 - protein, 24 aa, Mycobacterium tuberculosis
QLAPLPRRRLRETLDRYENVKEFF

SEQ ID NO: 1454963 - protein, 18 aa, Mycobacterium tuberculosis
QLEARIDSLAARNSKLME

SEQ ID NO: 1454964 - protein, 19 aa, Mycobacterium tuberculosis
QLGGLPFSGPIGGVRVALI

SEQ ID NO: 1454965 - protein, 19 aa, Mycobacterium tuberculosis
QLGSMWYISLDYINHQTSL

SEQ ID NO: 1454966 - protein, 21 aa, Mycobacterium tuberculosis
QLRLQHALVLLAERHDVTSVA

SEQ ID NO: 1454967 - protein, 27 aa, Mycobacterium tuberculosis
QLSGGMCQRALIAIGLAGRPRLLIADE

SEQ ID NO: 1454968 - protein, 18 aa, Mycobacterium tuberculosis
QLTMRVFTGLTMLDTIQG

SEQ ID NO: 1454969 - protein, 24 aa, Mycobacterium tuberculosis
QMRIPKPRFVLMPTPIWDQLFKPL

SEQ ID NO: 1454970 - protein, 19 aa, Mycobacterium tuberculosis
QNVDPALFGRVMSVSQLIG

SEQ ID NO: 1454971 - protein, 21 aa, Mycobacterium tuberculosis
QPEPTRWGLPVDQLRYPVFSW

SEQ ID NO: 1454972 - protein, 26 aa, Mycobacterium tuberculosis
QPESPKPLGMPLQYMVSGMAVKATHK

SEQ ID NO: 1454973 - protein, 24 aa, Mycobacterium tuberculosis
QPGEIYFEGGYPFEYLNDPAKTAA

SEQ ID NO: 1454974 - protein, 26 aa, Mycobacterium tuberculosis
QPGVPGRTVCKWGGFLDNPADFDCEF

SEQ ID NO: 1454975 - protein, 25 aa, Mycobacterium tuberculosis
QPKPLTFSALTGWEAPDPAWWTAQG

SEQ ID NO: 1454976 - protein, 22 aa, Mycobacterium tuberculosis
QPLATRLVRSWLGLPSQAAYTL

SEQ ID NO: 1454977 - protein, 17 aa, Mycobacterium tuberculosis
QPPALRAICPWEGFTDA

SEQ ID NO: 1454978 - protein, 19 aa, Mycobacterium tuberculosis
QPTIPGWRAETLGDDIAWM

SEQ ID NO: 1454979 - protein, 22 aa, Mycobacterium tuberculosis
QQRVRLLPCLDAVAVDSAAGNF

SEQ ID NO: 1454980 - protein, 25 aa, Mycobacterium tuberculosis
QRAEGRYALMPGIIGALAASGTPLS

SEQ ID NO: 1454981 - protein, 19 aa, Mycobacterium tuberculosis
QRAVRELVDQVALPSSILG

SEQ ID NO: 1454982 - protein, 19 aa, Mycobacterium tuberculosis
QRITATMLVPSMLYALLDH

SEQ ID NO: 1454983 - protein, 18 aa, Mycobacterium tuberculosis
QRLLPRPLDHTSVHVAVA

SEQ ID NO: 1454984 - protein, 19 aa, Mycobacterium tuberculosis
QRPVIMAGTNVWWGHAEAA

SEQ ID NO: 1454985 - protein, 23 aa, Mycobacterium tuberculosis
QRTMYDRVHWSLTHMSQAGLLDR

SEQ ID NO: 1454986 - protein, 20 aa, Mycobacterium tuberculosis
QRWIAAGLFDPAVREKAGMH

SEQ ID NO: 1454987 - protein, 18 aa, Mycobacterium tuberculosis
QRYPRAARRLIRHLNAKQ

SEQ ID NO: 1454988 - protein, 23 aa, Mycobacterium tuberculosis
QSLRTRFGTLTAVDRPVAVGDVV

SEQ ID NO: 1454989 - protein, 23 aa, Mycobacterium tuberculosis
QSQAPIDLACRLRERIGDLDQIA

SEQ ID NO: 1454990 - protein, 24 aa, Mycobacterium tuberculosis
QTEGAGFDWVSWVTALGSAPDAMT

SEQ ID NO: 1454991 - protein, 25 aa, Mycobacterium tuberculosis
QTENYRGAMGLNWYLTDPTLQFIMA

SEQ ID NO: 1454992 - protein, 29 aa, Mycobacterium tuberculosis
QTGKAALYRRWAGKRELVLAAVQYALPPV

SEQ ID NO: 1454993 - protein, 25 aa, Mycobacterium tuberculosis
QTLAATHRAMWALGDYALMAEEVMA

SEQ ID NO: 1454994 - protein, 27 aa, Mycobacterium tuberculosis
QTLAHEFDFRFLVGVLSVLGDKDVDGI

SEQ ID NO: 1454995 - protein, 24 aa, Mycobacterium tuberculosis
QTNRLPAYRNIAAPVLVIGFADDV

SEQ ID NO: 1454996 - protein, 31 aa, Mycobacterium tuberculosis; identical to SEQ ID NO: 204889

SEQ ID NO: 1454997 - protein, 22 aa, Mycobacterium tuberculosis
QVAEGYLRIAVANMANAVKKIS

SEQ ID NO: 1454998 - protein, 18 aa, Mycobacterium tuberculosis
QVDWTWQLVRDAVLDRVW

SEQ ID NO: 1454999 - protein, 20 aa, Mycobacterium tuberculosis
QVGNFPGLWTEWNGKYRDTV

SEQ ID NO: 1455000 - protein, 24 aa, Mycobacterium tuberculosis
QVIEHLWDQARFVRECARVLRGSG

SEQ ID NO: 1455001 - protein, 29 aa, Mycobacterium tuberculosis
QVPAHTQLAWVLGCFTGFGQASRMTQFKD

SEQ ID NO: 1455002 - protein, 21 aa, Mycobacterium tuberculosis
QVVLQRRLPVVVVDQPKDLSG

SEQ ID NO: 1455003 - protein, 19 aa, Mycobacterium tuberculosis
QWALAGLTPLRHWRSALAT

SEQ ID NO: 1455004 - protein, 21 aa, Mycobacterium tuberculosis
QWRHPELKAAGAAMATTALAS

SEQ ID NO: 1455005 - protein, 18 aa, Mycobacterium tuberculosis
QYGKTWRTLAKLSLPDKY

SEQ ID NO: 1455006 - protein, 25 aa, Mycobacterium tuberculosis
RAADFANAVLRRGISVNFMVDIRLD

SEQ ID NO: 1455007 - protein, 22 aa, Mycobacterium tuberculosis
RADYSARGWAMNSLFDGIGPLL

SEQ ID NO: 1455008 - protein, 25 aa, Mycobacterium tuberculosis
RAEEGNLWFEWSRSLDDPAEYVLVE

SEQ ID NO: 1455009 - protein, 24 aa, Mycobacterium tuberculosis
RAEMTRPRFGSWLRNSTRGALAMD

SEQ ID NO: 1455010 - protein, 26 aa, Mycobacterium tuberculosis
RAEPVGRLSVPPSWAVAAPAFAEKPE

SEQ ID NO: 1455011 - protein, 19 aa, Mycobacterium tuberculosis
RAFAADMAFLRNCGIHPVV

SEQ ID NO: 1455012 - protein, 22 aa, Mycobacterium tuberculosis
RAKIATGLAKPAGIYQLTDANW

SEQ ID NO: 1455013 - protein, 22 aa, Mycobacterium tuberculosis
RAPVPFHLLPHVARELGKHTEI

SEQ ID NO: 1455014 - protein, 19 aa, Mycobacterium tuberculosis
RAQCLRMVADYAADHPGQP

SEQ ID NO: 1455015 - protein, 24 aa, Mycobacterium tuberculosis
RAQTRFANAPIRWLHADIMTAELP

SEQ ID NO: 1455016 - protein, 20 aa, Mycobacterium tuberculosis
RARDVWNTRVQPFAHNLAQR

SEQ ID NO: 1455017 - protein, 17 aa, Mycobacterium tuberculosis
RARFRPILRPQFTLGDG

SEQ ID NO: 1455018 - protein, 20 aa, Mycobacterium tuberculosis
RARPRIKGLRLRATDLDWTI

SEQ ID NO: 1455019 - protein, 19 aa, Mycobacterium tuberculosis
RARYEEAVAIAAATMSSIR

SEQ ID NO: 1455020 - protein, 18 aa, Mycobacterium tuberculosis
RASQYTFMVENIGELTDE

SEQ ID NO: 1455021 - protein, 24 aa, Mycobacterium tuberculosis
RATDFSLPLARMVLTSAPVTVLEV

SEQ ID NO: 1455022 - protein, 28 aa, Mycobacterium tuberculosis
RATSVEVAELWSTFMQKWIAYTAAVIDA

SEQ ID NO: 1455023 - protein, 18 aa, Mycobacterium tuberculosis
RATTAGIPLLRLAAQTAL

SEQ ID NO: 1455024 - protein, 26 aa, Mycobacterium tuberculosis
RAVLRAEERWRPGLPPPPEQFYRVLA

SEQ ID NO: 1455025 - protein, 20 aa, Mycobacterium tuberculosis
RAWITGQIERGWASCAITQN

SEQ ID NO: 1455026 - protein, 25 aa, Mycobacterium tuberculosis
RCDCGPQLDAALAMVAREGRGVVLY

SEQ ID NO: 1455027 - protein, 23 aa, Mycobacterium tuberculosis
RDDAASVAVLWGAGGTFCAGADL

SEQ ID NO: 1455028 - protein, 23 aa, Mycobacterium tuberculosis
RDGEAIGALLTRMGAQDTRLVWE

SEQ ID NO: 1455029 - protein, 19 aa, Mycobacterium tuberculosis
RDIPLSGLVRAHRLGHARF

SEQ ID NO: 1455030 - protein, 25 aa, Mycobacterium tuberculosis
RDLGAELRKCWNIDFDDAGAIGRRY

SEQ ID NO: 1455031 - protein, 20 aa, Mycobacterium tuberculosis
RDLLHLACCQRRGVTRIKTF

SEQ ID NO: 1455032 - protein, 17 aa, Mycobacterium tuberculosis
RDQALKFGATHVYPDIN

SEQ ID NO: 1455033 - protein, 19 aa, Mycobacterium tuberculosis
RDQARAFARSGCRRPALLA

SEQ ID NO: 1455034 - protein, 26 aa, Mycobacterium tuberculosis
RDRMAFRSAAYWDILAKLDASVSDPD

SEQ ID NO: 1455035 - protein, 18 aa, Mycobacterium tuberculosis
RDRMPVFPVPDGHDQASW

SEQ ID NO: 1455036 - protein, 23 aa, Mycobacterium tuberculosis
RDYKRVLQAIALAERDGVDVDKA

SEQ ID NO: 1455037 - protein, 23 aa, Mycobacterium tuberculosis
REAKLRQAPILALGGRPEELREI

SEQ ID NO: 1455038 - protein, 22 aa, Mycobacterium tuberculosis
REGRPRSDILAFALPGFATGEH

SEQ ID NO: 1455039 - protein, 17 aa, Mycobacterium tuberculosis
REGWLALMADDVVIEDP

SEQ ID NO: 1455040 - protein, 20 aa, Mycobacterium tuberculosis
REIADALLAALERRHEVADA

SEQ ID NO: 1455041 - protein, 24 aa, Mycobacterium tuberculosis
REKASEGTPVIVFFDEMDSIFRTR

SEQ ID NO: 1455042 - protein, 25 aa, Mycobacterium tuberculosis
RELGASFAEFGGWLMPVSYAGTVSE

SEQ ID NO: 1455043 - protein, 19 aa, Mycobacterium tuberculosis
RELGIPVSRLHSHALDLRR

SEQ ID NO: 1455044 - protein, 22 aa, Mycobacterium tuberculosis
RELRENPAWITGIEHRIESPAL

SEQ ID NO: 1455045 - protein, 23 aa, Mycobacterium tuberculosis
RENMWRTGINVFFETFGSHKAVT

SEQ ID NO: 1455046 - protein, 23 aa, Mycobacterium tuberculosis
REPRPYPKLLLADRDSIFEYTYE

SEQ ID NO: 1455047 - protein, 17 aa, Mycobacterium tuberculosis
RERLDAVLAAVVDGHEV

SEQ ID NO: 1455048 - protein, 23 aa, Mycobacterium tuberculosis
REVAAEFERPVLLFSGGKDSIVM

SEQ ID NO: 1455049 - protein, 25 aa, Mycobacterium tuberculosis
RFAPELHISCGLSFDDVVDTVLTGF

SEQ ID NO: 1455050 - protein, 23 aa, Mycobacterium tuberculosis
RFAPRSLLLPAIRIGNRLRGGPS

SEQ ID NO: 1455051 - protein, 18 aa, Mycobacterium tuberculosis
RFEIAVAADHVWLMSTAS

SEQ ID NO: 1455052 - protein, 19 aa, Mycobacterium tuberculosis
RFETGRLALQAAGAVVAYL

SEQ ID NO: 1455053 - protein, 26 aa, Mycobacterium tuberculosis
RFFLPRIAAGDLHFSIGYSEPGAGTD

SEQ ID NO: 1455054 - protein, 24 aa, Mycobacterium tuberculosis
RFIVTDIFPGGRLPTIETIEEHVT

SEQ ID NO: 1455055 - protein, 20 aa, Mycobacterium tuberculosis
RFLMRNPRRALSRTEILDRV

SEQ ID NO: 1455056 - protein, 25 aa, Mycobacterium tuberculosis
RFTPGGLVLTEWQGAAVYRELQPGK

SEQ ID NO: 1455057 - protein, 19 aa, Mycobacterium tuberculosis
RGAQRYVGRWSMISEYIGS

SEQ ID NO: 1455058 - protein, 19 aa, Mycobacterium tuberculosis
RGASGSAYGSAWELWHRGA

SEQ ID NO: 1455059 - protein, 22 aa, Mycobacterium tuberculosis
RGEAEAMLLAGFVIPVRKKGVR

SEQ ID NO: 1455060 - protein, 21 aa, Mycobacterium tuberculosis
RGELLKEVWGPAYATETHYLR

SEQ ID NO: 1455061 - protein, 24 aa, Mycobacterium tuberculosis
RGGLADCVLALGFEKMQPGALGGG

SEQ ID NO: 1455062 - protein, 25 aa, Mycobacterium tuberculosis
RGHLRKFGLSRVRVRQLAHDGHLPG

SEQ ID NO: 1455063 - protein, 20 aa, Mycobacterium tuberculosis
RGKPAIPAWEDVLLGVRSGG

SEQ ID NO: 1455064 - protein, 21 aa, Mycobacterium tuberculosis
RGKWPEIWVAAHGPRMLRATG

SEQ ID NO: 1455065 - protein, 17 aa, Mycobacterium tuberculosis
RGLLLTTLWYIREVDPT

SEQ ID NO: 1455066 - protein, 22 aa, Mycobacterium tuberculosis
RGLSMAHLRGTLDAFARAEFGP

SEQ ID NO: 1455067 - protein, 19 aa, Mycobacterium tuberculosis
RGPAGAYLVGWDPLLQSGL

SEQ ID NO: 1455068 - protein, 25 aa, Mycobacterium tuberculosis
RGPEHLPEDLVFRVNYLGGDMPTFT

SEQ ID NO: 1455069 - protein, 19 aa, Mycobacterium tuberculosis
RGRELTVSVGDLYIDYSKH

SEQ ID NO: 1455070 - protein, 21 aa, Mycobacterium tuberculosis
RGRGAMIAVELVKSGTTEPDA

SEQ ID NO: 1455071 - protein, 30 aa, Mycobacterium tuberculosis; identical to SEQ ID NO: 205331

SEQ ID NO: 1455072 - protein, 28 aa, Mycobacterium tuberculosis
RGRVQSVLLPRLLDWMSYAPDPDGGLLA

SEQ ID NO: 1455073 - protein, 24 aa, Mycobacterium tuberculosis
RGTGGFTPRTWVALATEYFLAGRA

SEQ ID NO: 1455074 - protein, 23 aa, Mycobacterium tuberculosis
RGVDGSVCKWARVLVYEPPSRVL

SEQ ID NO: 1455075 - protein, 19 aa, Mycobacterium tuberculosis
RGWEHRWALSVLHTALGGG

SEQ ID NO: 1455076 - protein, 17 aa, Mycobacterium tuberculosis
RHARVFLDSVLPALGEE

SEQ ID NO: 1455077 - protein, 17 aa, Mycobacterium tuberculosis
RHGHPAAVLISADDLAS

SEQ ID NO: 1455078 - protein, 24 aa, Mycobacterium tuberculosis
RHLLDMRSGVAFSENYDDPAAEIH

SEQ ID NO: 1455079 - protein, 29 aa, Mycobacterium tuberculosis
RHPFDAELVSYVRGVLYFRTKRWPDVLAQ

SEQ ID NO: 1455080 - protein, 26 aa, Mycobacterium tuberculosis
RHPRWRGKKALLLQGRLWQGNVVATL

SEQ ID NO: 1455081 - protein, 27 aa, Mycobacterium tuberculosis
RIARFKIPRYLWIVDEFPMTVTGKVRK

SEQ ID NO: 1455082 - protein, 18 aa, Mycobacterium tuberculosis
RIAVPLPVPHAGAHDERT

SEQ ID NO: 1455083 - protein, 26 aa, Mycobacterium tuberculosis
RIDGTDSIELWAWVGAYDHVALCQLW

SEQ ID NO: 1455084 - protein, 25 aa, Mycobacterium tuberculosis
RIGHLPKGLGVIGLLIEDPKPLRLD

SEQ ID NO: 1455085 - protein, 19 aa, Mycobacterium tuberculosis
RIHPLRNVMILAGAGVGGG

SEQ ID NO: 1455086 - protein, 20 aa, Mycobacterium tuberculosis
RIHQGWILTVLWVIDTGVTA

SEQ ID NO: 1455087 - protein, 19 aa, Mycobacterium tuberculosis
RILGEPITLLGYAPETIIA

SEQ ID NO: 1455088 - protein, 17 aa, Mycobacterium tuberculosis
RILGHKSAKVTLDTYAD

SEQ ID NO: 1455089 - protein, 18 aa, Mycobacterium tuberculosis
RILVSGIITDSSIAFHIA

SEQ ID NO: 1455090 - protein, 30 aa, Mycobacterium tuberculosis; identical to SEQ ID NO: 205415

SEQ ID NO: 1455091 - protein, 24 aa, Mycobacterium tuberculosis
RIQEGVVSLGLYSRIFRNNILASG

SEQ ID NO: 1455092 - protein, 21 aa, Mycobacterium tuberculosis
RIQLEPVRPFVALRHIRFSSL

SEQ ID NO: 1455093 - protein, 21 aa, Mycobacterium tuberculosis
RIQPTQLLRVWVRDVRRLTPG

SEQ ID NO: 1455094 - protein, 25 aa, Mycobacterium tuberculosis
RIRARSTGLLSAWVATGFDVLASRV

SEQ ID NO: 1455095 - protein, 18 aa, Mycobacterium tuberculosis
RIRERLGLRGNDQVEITE

SEQ ID NO: 1455096 - protein, 27 aa, Mycobacterium tuberculosis
RIVPLKRRRQWLPAAEVIGELVRLGPD

SEQ ID NO: 1455097 - protein, 20 aa, Mycobacterium tuberculosis
RIVTIEAIEHFGFERYDDFF

SEQ ID NO: 1455098 - protein, 22 aa, Mycobacterium tuberculosis
RKCSVPYLYRFELMGTEDDVAA

SEQ ID NO: 1455099 - protein, 20 aa, Mycobacterium tuberculosis
RKLYQACRRWPKLMRRLLLW

SEQ ID NO: 1455100 - protein, 26 aa, Mycobacterium tuberculosis
RKMLRFGRVTVRFGKPMDFSRFEGLA

SEQ ID NO: 1455101 - protein, 24 aa, Mycobacterium tuberculosis
RKRAAELLEQFSLVHAGKRRVGTY

SEQ ID NO: 1455102 - protein, 20 aa, Mycobacterium tuberculosis
RKTPVFVKWLLRRTAIKNLP

SEQ ID NO: 1455103 - protein, 36 aa, Mycobacterium tuberculosis; identical to SEQ ID NO: 17410

SEQ ID NO: 1455104 - protein, 25 aa, Mycobacterium tuberculosis
RKVMPRLLNVGPWATLALANPSLLN

SEQ ID NO: 1455105 - protein, 25 aa, Mycobacterium tuberculosis
RKVVEWARGRGVLVVSDECYLGLGW

SEQ ID NO: 1455106 - protein, 21 aa, Mycobacterium tuberculosis
RLAEERVLDALGLDVLPAEWL

SEQ ID NO: 1455107 - protein, 19 aa, Mycobacterium tuberculosis
RLAHLRGATVLAHNYQLPA

SEQ ID NO: 1455108 - protein, 19 aa, Mycobacterium tuberculosis
RLAPEPVYTDAEWVSNYRI

SEQ ID NO: 1455109 - protein, 19 aa, Mycobacterium tuberculosis
RLDDLPVLYELAAEEAGAA

SEQ ID NO: 1455110 - protein, 29 aa, Mycobacterium tuberculosis
RLGELRPLYRPGLVHIYHALTWGPLMREI

SEQ ID NO: 1455111 - protein, 19 aa, Mycobacterium tuberculosis
RLGVTDLQFRPEVSDGLFL

SEQ ID NO: 1455112 - protein, 21 aa, Mycobacterium tuberculosis
RLIPHLDRRSAACCAAMSGIY

SEQ ID NO: 1455113 - protein, 24 aa, Mycobacterium tuberculosis
RLKNEYPGKIFAILDSDHSMNHVL

SEQ ID NO: 1455114 - protein, 19 aa, Mycobacterium tuberculosis
RLLGGELRQGAKGGIMADA

SEQ ID NO: 1455115 - protein, 25 aa, Mycobacterium tuberculosis
RLLGKSAYHALTFGWLMSGLARAVT

SEQ ID NO: 1455116 - protein, 17 aa, Mycobacterium tuberculosis
RLLPKLRKHRGYDFFCL

SEQ ID NO: 1455117 - protein, 25 aa, Mycobacterium tuberculosis
RLLPPTFRGDIFWCQLFSEPGAGSD

SEQ ID NO: 1455118 - protein, 24 aa, Mycobacterium tuberculosis
RLLQRLGADVADYGFIETSAKQDG

SEQ ID NO: 1455119 - protein, 25 aa, Mycobacterium tuberculosis
RLLRESFADAVSWVAKNLPARPAVP

SEQ ID NO: 1455120 - protein, 22 aa, Mycobacterium tuberculosis
RLMTLIHLWLVHRFKAQAVHYV

SEQ ID NO: 1455121 - protein, 19 aa, Mycobacterium tuberculosis
RLPKPEPLRTFVARLEAAL

SEQ ID NO: 1455122 - protein, 19 aa, Mycobacterium tuberculosis
RLRELTGAGMLACKNALAE

SEQ ID NO: 1455123 - protein, 20 aa, Mycobacterium tuberculosis
RLRPSGRGTDVWADLHPTAD

SEQ ID NO: 1455124 - protein, 21 aa, Mycobacterium tuberculosis
RLRRHTRLRKKLSGTAERPRL

SEQ ID NO: 1455125 - protein, 26 aa, Mycobacterium tuberculosis
RLVDGDIIWAPAIDGAFVLTTRGGDF

SEQ ID NO: 1455126 - protein, 18 aa, Mycobacterium tuberculosis
RLVDLGVIRGFYTDIDPV

SEQ ID NO: 1455127 - protein, 28 aa, Mycobacterium tuberculosis
RMEADWEASYLLSLRAAWQADNNIPNSK

SEQ ID NO: 1455128 - protein, 19 aa, Mycobacterium tuberculosis
RMRCAHVLTDDSGYLYTRY

SEQ ID NO: 1455129 - protein, 22 aa, Mycobacterium tuberculosis
RMTILANRWRAYGFDLDMNELV

SEQ ID NO: 1455130 - protein, 26 aa, Mycobacterium tuberculosis
RNEDSRWTVQLAWKAGRSDNLAHFRF

SEQ ID NO: 1455131 - protein, 17 aa, Mycobacterium tuberculosis
RNFRDWPADVCALADAF

SEQ ID NO: 1455132 - protein, 24 aa, Mycobacterium tuberculosis
RNNIERMTWRSCRAGDFIDICNLK

SEQ ID NO: 1455133 - protein, 19 aa, Mycobacterium tuberculosis
RNNVVLSRRAWLEQTQSEV

SEQ ID NO: 1455134 - protein, 22 aa, Mycobacterium tuberculosis
RPAEEMLYLAMEDFRVDVVVGK

SEQ ID NO: 1455135 - protein, 19 aa, Mycobacterium tuberculosis
RPDVLVAMNPAALKANIGD

SEQ ID NO: 1455136 - protein, 21 aa, Mycobacterium tuberculosis
RPEDLRFLVRLARQQGERLGR

SEQ ID NO: 1455137 - protein, 19 aa, Mycobacterium tuberculosis
RPFGVPFIHIPATRDTRTE

SEQ ID NO: 1455138 - protein, 26 aa, Mycobacterium tuberculosis
RPGEVQRFPADISLAKSIGFQPQVEI

SEQ ID NO: 1455139 - protein, 25 aa, Mycobacterium tuberculosis
RPGNYRYAINNSFGFGGHNVAIAFG

SEQ ID NO: 1455140 - protein, 28 aa, Mycobacterium tuberculosis
RPHIEKRFSMPWGHPARRMREFVAALRA

SEQ ID NO: 1455141 - protein, 24 aa, Mycobacterium tuberculosis
RPLSCAIAAVSVGVVDGRIRVDLP

SEQ ID NO: 1455142 - protein, 19 aa, Mycobacterium tuberculosis
RPPGRKDPAAFVLENFTPA

SEQ ID NO: 1455143 - protein, 18 aa, Mycobacterium tuberculosis
RPPRETWESNPLYRQLDA

SEQ ID NO: 1455144 - protein, 24 aa, Mycobacterium tuberculosis
RPRLHSISFIFKGRPGEVYLTVTG

SEQ ID NO: 1455145 - protein, 22 aa, Mycobacterium tuberculosis
RPYLQLCDEMRALPVPREVLED

SEQ ID NO: 1455146 - protein, 17 aa, Mycobacterium tuberculosis
RQLFQDIYVWAGDLRTV

SEQ ID NO: 1455147 - protein, 24 aa, Mycobacterium tuberculosis
RQLPIVCGLDLTRRVAMTPDILAR

SEQ ID NO: 1455148 - protein, 25 aa, Mycobacterium tuberculosis
RQPQAIGCAGWRAIDAAEIARGSAD

SEQ ID NO: 1455149 - protein, 24 aa, Mycobacterium tuberculosis
RRAEKLERLGLWGLMPRTVYDTLI

SEQ ID NO: 1455150 - protein, 18 aa, Mycobacterium tuberculosis
RRAGIGVAVVSGDRSHAV

SEQ ID NO: 1455151 - protein, 25 aa, Mycobacterium tuberculosis
RRARKGEFRKLWIARINAAARLNDI

SEQ ID NO: 1455152 - protein, 24 aa, Mycobacterium tuberculosis
RRDHGGVIFIDLRDASGIAQVVFR

SEQ ID NO: 1455153 - protein, 23 aa, Mycobacterium tuberculosis
RRFDRSIGYFWTATHQQIYRTLR

SEQ ID NO: 1455154 - protein, 17 aa, Mycobacterium tuberculosis
RRGSHFAELDRERSGVR

SEQ ID NO: 1455155 - protein, 17 aa, Mycobacterium tuberculosis
RRGVFGGPTPAPRGLAT

SEQ ID NO: 1455156 - protein, 27 aa, Mycobacterium tuberculosis
RRHLSYKTGWYGSALVVADRWFPSLSV

SEQ ID NO: 1455157 - protein, 19 aa, Mycobacterium tuberculosis
RRIDPRNSTVLVWGAVNAG

SEQ ID NO: 1455158 - protein, 19 aa, Mycobacterium tuberculosis
RRKAMEELHRIRKEGEAGE

SEQ ID NO: 1455159 - protein, 20 aa, Mycobacterium tuberculosis
RRKLISVLRHRGRILQSAPD

SEQ ID NO: 1455160 - protein, 23 aa, Mycobacterium tuberculosis
RRLAECYRRTRAVRRDAIHCCCR

SEQ ID NO: 1455161 - protein, 20 aa, Mycobacterium tuberculosis
RRPPWEVHFIEGLEGGRFAI

SEQ ID NO: 1455162 - protein, 17 aa, Mycobacterium tuberculosis
RRSEIIAAVSGDAVVVE

SEQ ID NO: 1455163 - protein, 19 aa, Mycobacterium tuberculosis
RRTPADAMTQGWFTGLIPI

SEQ ID NO: 1455164 - protein, 24 aa, Mycobacterium tuberculosis
RRVFGCFPCGVIAVCAMVDDQPVG

SEQ ID NO: 1455165 - protein, 18 aa, Mycobacterium tuberculosis
RRYDWSVVASQIMRVYET

SEQ ID NO: 1455166 - protein, 24 aa, Mycobacterium tuberculosis
RSADLPPAVGVLVEYRGDDAAAAH

SEQ ID NO: 1455167 - protein, 19 aa, Mycobacterium tuberculosis
RSAEPRWIAAKDVAEGDFL

SEQ ID NO: 1455168 - protein, 18 aa, Mycobacterium tuberculosis
RSDALAWSVKLVGEHTEE

SEQ ID NO: 1455169 - protein, 20 aa, Mycobacterium tuberculosis
RSEGDAFGRLIMLYDPDGSD

SEQ ID NO: 1455170 - protein, 18 aa, Mycobacterium tuberculosis
RSEQDVIDVLDWCAREGI

SEQ ID NO: 1455171 - protein, 23 aa, Mycobacterium tuberculosis
RSGKHLRRLAALAAELEAVEVIV

SEQ ID NO: 1455172 - protein, 25 aa, Mycobacterium tuberculosis
RSLAEVGIGFCFAPRFHPSYRHAAA

SEQ ID NO: 1455173 - protein, 26 aa, Mycobacterium tuberculosis
RSMVKRLPLARALRTAQRHDYLGHYV

SEQ ID NO: 1455174 - protein, 18 aa, Mycobacterium tuberculosis
RSPVLVDCLGTWLTAIMD

SEQ ID NO: 1455175 - protein, 22 aa, Mycobacterium tuberculosis
RSQLKAIHAWGTQKPSDLTSIG

SEQ ID NO: 1455176 - protein, 21 aa, Mycobacterium tuberculosis
RSRPLITNMIRLLKLPIPVQR

SEQ ID NO: 1455177 - protein, 19 aa, Mycobacterium tuberculosis
RSRRFSCESFPLAEVREVS

SEQ ID NO: 1455178 - protein, 18 aa, Mycobacterium tuberculosis
RSRVPDLSAIKVPMLVCG

SEQ ID NO: 1455179 - protein, 19 aa, Mycobacterium tuberculosis
RSSAYAEFFDIDWELGDGR

SEQ ID NO: 1455180 - protein, 24 aa, Mycobacterium tuberculosis
RSTAHAAEALECLGGNGYVEDSGM

SEQ ID NO: 1455181 - protein, 23 aa, Mycobacterium tuberculosis
RSTCSRLPVIASVDERLSVLKPV

SEQ ID NO: 1455182 - protein, 20 aa, Mycobacterium tuberculosis
RSVALRWAQRASFPGEPMWR

SEQ ID NO: 1455183 - protein, 22 aa, Mycobacterium tuberculosis
RTADQMTEFYAGLLGAYPLVSI

SEQ ID NO: 1455184 - protein, 21 aa, Mycobacterium tuberculosis
RTAGSGEAWLAICPATPQLVQ

SEQ ID NO: 1455185 - protein, 17 aa, Mycobacterium tuberculosis
RTAKQYRFVLPGPSLTV

SEQ ID NO: 1455186 - protein, 25 aa, Mycobacterium tuberculosis
RTDEARQILGHRAMIVAGGSNRTDT

SEQ ID NO: 1455187 - protein, 23 aa, Mycobacterium tuberculosis
RTEKSVMFVIPWGSHWIIGTTDT

SEQ ID NO: 1455188 - protein, 20 aa, Mycobacterium tuberculosis
RTGEKFVPFDPAADYHTYVD

SEQ ID NO: 1455189 - protein, 18 aa, Mycobacterium tuberculosis
RTILTLDRRHFSALRPIG

SEQ ID NO: 1455190 - protein, 25 aa, Mycobacterium tuberculosis
RTKLYKAMNARGWKTKEPGIESIVR

SEQ ID NO: 1455191 - protein, 23 aa, Mycobacterium tuberculosis
RTNGDRWLAHRLKNQKDQKVFEF

SEQ ID NO: 1455192 - protein, 17 aa, Mycobacterium tuberculosis
RTPDRFVAGTVGQPGNR

SEQ ID NO: 1455193 - protein, 19 aa, Mycobacterium tuberculosis
RTPGFTGWLQEEWLHHCGD

SEQ ID NO: 1455194 - protein, 24 aa, Mycobacterium tuberculosis
RTPRGRVATALAWTHLGMTPPVGA

SEQ ID NO: 1455195 - protein, 21 aa, Mycobacterium tuberculosis
RTRPVRIAPRVAVAVNALDSI

SEQ ID NO: 1455196 - protein, 24 aa, Mycobacterium tuberculosis
RTSDLIPLCHQLALTGVDVDFTVG

SEQ ID NO: 1455197 - protein, 25 aa, Mycobacterium tuberculosis
RTSVPPFTWWRGLRARELLENYFTA

SEQ ID NO: 1455198 - protein, 27 aa, Mycobacterium tuberculosis
RTTEHRPEILLSFGFVPKVETRIGLIN

SEQ ID NO: 1455199 - protein, 21 aa, Mycobacterium tuberculosis
RTYALLKRRGTQFVVVSAAEP

SEQ ID NO: 1455200 - protein, 17 aa, Mycobacterium tuberculosis
RVADHGWGLGYMLNQRG

SEQ ID NO: 1455201 - protein, 27 aa, Mycobacterium tuberculosis
RVAGGFTLDGLGGWFIDGVQGNPSNVI

SEQ ID NO: 1455202 - protein, 26 aa, Mycobacterium tuberculosis
RVAHWLMPGQRAFQIATQLALVGQSD

SEQ ID NO: 1455203 - protein, 19 aa, Mycobacterium tuberculosis
RVALSALTMAEWFRDEQGQ

SEQ ID NO: 1455204 - protein, 25 aa, Mycobacterium tuberculosis
RVDNDPDIRCCILTGAGGYFCAGMD

SEQ ID NO: 1455205 - protein, 18 aa, Mycobacterium tuberculosis
RVGVRIVARRTRSWDHRK

SEQ ID NO: 1455206 - protein, 27 aa, Mycobacterium tuberculosis
RVHGWPNQQFALLFVDWLAANPGARED

SEQ ID NO: 1455207 - protein, 20 aa, Mycobacterium tuberculosis
RVISDVWLSNLLAWLTRRAS

SEQ ID NO: 1455208 - protein, 25 aa, Mycobacterium tuberculosis
RVKGPDFPTAGLIVGSQGTADAYKT

SEQ ID NO: 1455209 - protein, 17 aa, Mycobacterium tuberculosis
RVLDGVADLGFPLSIHL

SEQ ID NO: 1455210 - protein, 26 aa, Mycobacterium tuberculosis
RVMFKIKHLRTADCVVAGYRVHKSGS

SEQ ID NO: 1455211 - protein, 25 aa, Mycobacterium tuberculosis
RVPPQRRGIGFVFQHYAAFKHLTVR

SEQ ID NO: 1455212 - protein, 24 aa, Mycobacterium tuberculosis
RVRAGELTPALAAQQILEIANLTD

SEQ ID NO: 1455213 - protein, 20 aa, Mycobacterium tuberculosis
RVRIGTTWGARCGTVTICSA

SEQ ID NO: 1455214 - protein, 17 aa, Mycobacterium tuberculosis
RVRTRWINFATRGKPTG

SEQ ID NO: 1455215 - protein, 17 aa, Mycobacterium tuberculosis
RVSFVGRSMVRNMRVAR

SEQ ID NO: 1455216 - protein, 18 aa, Mycobacterium tuberculosis
RVTLELGGKSANIVFHDC

SEQ ID NO: 1455217 - protein, 23 aa, Mycobacterium tuberculosis
RVVPEVLETVGLSGKANRLPDEL

SEQ ID NO: 1455218 - protein, 21 aa, Mycobacterium tuberculosis
RWFLDRTCTHILAWEGDDDNE

SEQ ID NO: 1455219 - protein, 19 aa, Mycobacterium tuberculosis
RWNSIAEVIGRSWDDVLAA

SEQ ID NO: 1455220 - protein, 17 aa, Mycobacterium tuberculosis
RYCCTGRQNLCDMGATI

SEQ ID NO: 1455221 - protein, 24 aa, Mycobacterium tuberculosis
RYNPWDQRLCLIPDADLYNAITSG

SEQ ID NO: 1455222 - protein, 20 aa, Mycobacterium tuberculosis
RYRQRCWLRQLTPHANRDQE

SEQ ID NO: 1455223 - protein, 20 aa, Mycobacterium tuberculosis
SAAASLRYSDPDSVAVENIS

SEQ ID NO: 1455224 - protein, 18 aa, Mycobacterium tuberculosis
SAALLTRVIASAVAEGLQ

SEQ ID NO: 1455225 - protein, 26 aa, Mycobacterium tuberculosis
SAANSWLDAFAHWRQAQGLPATAIAW

SEQ ID NO: 1455226 - protein, 25 aa, Mycobacterium tuberculosis
SADGSPPYVVRWLVNGHETTVYPGS

SEQ ID NO: 1455227 - protein, 25 aa, Mycobacterium tuberculosis
SAENGRSWSRWSFIGAGAPTALTVR

SEQ ID NO: 1455228 - protein, 24 aa, Mycobacterium tuberculosis
SAIHTGARVHAHWADQPVGAITDI

SEQ ID NO: 1455229 - protein, 29 aa, Mycobacterium tuberculosis
SALIKSIGLRLGVPWYAYDTVTFSGEVTA

SEQ ID NO: 1455230 - protein, 17 aa, Mycobacterium tuberculosis
SAMFRTRRFRVYTTDDV

SEQ ID NO: 1455231 - protein, 27 aa, Mycobacterium tuberculosis
SAQAWVPRSRSHAVTFPRDLTCRSEME

SEQ ID NO: 1455232 - protein, 21 aa, Mycobacterium tuberculosis
SARTRSCPRLTDSIEHAVAEG

SEQ ID NO: 1455233 - protein, 20 aa, Mycobacterium tuberculosis
SARVRRWVEFAANNDGTLPH

SEQ ID NO: 1455234 - protein, 17 aa, Mycobacterium tuberculosis
SATARRALAEGADVVIS

SEQ ID NO: 1455235 - protein, 27 aa, Mycobacterium tuberculosis
SAVRRLAQRLALAAGRRLDDAQPWVDG

SEQ ID NO: 1455236 - protein, 17 aa, Mycobacterium tuberculosis
SCRGGCMAAKFFTGLPL

SEQ ID NO: 1455237 - protein, 24 aa, Mycobacterium tuberculosis
SDAERLRVDLGRDFPVRSYQNRRA

SEQ ID NO: 1455238 - protein, 20 aa, Mycobacterium tuberculosis
SDEFGALPGRVAVGGDSAGG

SEQ ID NO: 1455239 - protein, 23 aa, Mycobacterium tuberculosis
SDFWGGAGSAACQGFITQLGRNF

SEQ ID NO: 1455240 - protein, 22 aa, Mycobacterium tuberculosis
SDGKPTRIGYRVDEETGKRVRI

SEQ ID NO: 1455241 - protein, 21 aa, Mycobacterium tuberculosis
SDIAGAYLCRLLRHMADNGYT

SEQ ID NO: 1455242 - protein, 24 aa, Mycobacterium tuberculosis
SDTALAAYLVRPGQRSFTLDDLSL

SEQ ID NO: 1455243 - protein, 18 aa, Mycobacterium tuberculosis
SDTLELLLRSTGYNDDVT

SEQ ID NO: 1455244 - protein, 21 aa, Mycobacterium tuberculosis
SDVALAGGVALMLEPRKAAAG

SEQ ID NO: 1455245 - protein, 21 aa, Mycobacterium tuberculosis
SDVVFDIDMVFSWVDGSDPEF

SEQ ID NO: 1455246 - protein, 21 aa, Mycobacterium tuberculosis
SDYRTRWEIPIGLRETDLTPA

SEQ ID NO: 1455247 - protein, 21 aa, Mycobacterium tuberculosis
SEADPPLWTQMNFAAAQANFL

SEQ ID NO: 1455248 - protein, 22 aa, Mycobacterium tuberculosis
SEALKRRCLYLHIDFPTPELER

SEQ ID NO: 1455249 - protein, 24 aa, Mycobacterium tuberculosis
SEIAILDRHAHGFDPRDLSAINPV

SEQ ID NO: 1455250 - protein, 19 aa, Mycobacterium tuberculosis
SELAPLLCAGIIGYRSLLR

SEQ ID NO: 1455251 - protein, 20 aa, Mycobacterium tuberculosis
SELILPIAVAVQNRITVNEL

SEQ ID NO: 1455252 - protein, 24 aa, Mycobacterium tuberculosis
SELIRLARYPLLVVDEVGYIPFEP

SEQ ID NO: 1455253 - protein, 20 aa, Mycobacterium tuberculosis
SELRARVGLSSSALAERVPG

SEQ ID NO: 1455254 - protein, 25 aa, Mycobacterium tuberculosis
SEPLTEAIPLWKRPQDGAIITGWDY

SEQ ID NO: 1455255 - protein, 19 aa, Mycobacterium tuberculosis
SFGVIQRADSFTFYASIDH

SEQ ID NO: 1455256 - protein, 23 aa, Mycobacterium tuberculosis
SFIEGRAAMFAGLADSTLLRDDG

SEQ ID NO: 1455257 - protein, 24 aa, Mycobacterium tuberculosis
SGAFLAKLGCSYVVVGHSERRTYH

SEQ ID NO: 1455258 - protein, 26 aa, Mycobacterium tuberculosis
SGAIGPRGRLGWEQVADWDFVCEQLA

SEQ ID NO: 1455259 - protein, 23 aa, Mycobacterium tuberculosis
SGDARRLATMVLLIAQSTIQSAD

SEQ ID NO: 1455260 - protein, 19 aa, Mycobacterium tuberculosis
SGIGFGLGVDRTVLALRAE

SEQ ID NO: 1455261 - protein, 24 aa, Mycobacterium tuberculosis
SGLDSRAYRLAWPAQTVVYEIDQP

SEQ ID NO: 1455262 - protein, 28 aa, Mycobacterium tuberculosis
SGPFYDGAVFHRVIQGFMIQGGDPTGTG

SEQ ID NO: 1455263 - protein, 24 aa, Mycobacterium tuberculosis
SGQYPRELPFVIGSEVCGTVEAVG

SEQ ID NO: 1455264 - protein, 19 aa, Mycobacterium tuberculosis
SGREVLYRLADHHLAHIVL

SEQ ID NO: 1455265 - protein, 24 aa, Mycobacterium tuberculosis
SGRSELRLAAEAVLDALADAGLSP

SEQ ID NO: 1455266 - protein, 19 aa, Mycobacterium tuberculosis
SGTASWTLIELMRHRDAYA

SEQ ID NO: 1455267 - protein, 18 aa, Mycobacterium tuberculosis
SHALRPGDQLVLGASNPV

SEQ ID NO: 1455268 - protein, 23 aa, Mycobacterium tuberculosis
SHCSWSVAGTGQFLAHDGASPAI

SEQ ID NO: 1455269 - protein, 24 aa, Mycobacterium tuberculosis
SHDRLKAELDQLIANRPVIAAEIN

SEQ ID NO: 1455270 - protein, 22 aa, Mycobacterium tuberculosis
SIATERLLRPIGRVSAAELAQL

SEQ ID NO: 1455271 - protein, 25 aa, Mycobacterium tuberculosis
SIEEIRARQPVALVLSGGPASVYAD

SEQ ID NO: 1455272 - protein, 18 aa, Mycobacterium tuberculosis
SIVLWPQVVKEVAPVPVL

SEQ ID NO: 1455273 - protein, 20 aa, Mycobacterium tuberculosis
SKCGTERGLASAMNVLTYQS

SEQ ID NO: 1455274 - protein, 23 aa, Mycobacterium tuberculosis
SKDSTRYLVHFTQSGIGLPDESY

SEQ ID NO: 1455275 - protein, 22 aa, Mycobacterium tuberculosis
SKLPKVFFVNWFRRGDDGRFLW

SEQ ID NO: 1455276 - protein, 23 aa, Mycobacterium tuberculosis
SLAGYRAGFVVGDLEIVAELLAV

SEQ ID NO: 1455277 - protein, 17 aa, Mycobacterium tuberculosis
SLASPRIADTVRVLYGG

SEQ ID NO: 1455278 - protein, 21 aa, Mycobacterium tuberculosis
SLDPRLPVFDLIAEPLQANGF

SEQ ID NO: 1455279 - protein, 20 aa, Mycobacterium tuberculosis
SLDRIKSVKQAAGVTVNDAV

SEQ ID NO: 1455280 - protein, 22 aa, Mycobacterium tuberculosis
SLGHARKGLFLVHSDAVDSVLG

SEQ ID NO: 1455281 - protein, 17 aa, Mycobacterium tuberculosis
SLIGAGMRSHPGVTATF

SEQ ID NO: 1455282 - protein, 18 aa, Mycobacterium tuberculosis
SLPACEWVAPHVRAALVG

SEQ ID NO: 1455283 - protein, 21 aa, Mycobacterium tuberculosis
SLRLVACGGSAVPESLMRTFE

SEQ ID NO: 1455284 - protein, 22 aa, Mycobacterium tuberculosis
SLRTLGLRRIRHSVIREDNAAT

SEQ ID NO: 1455285 - protein, 18 aa, Mycobacterium tuberculosis
SLRYLRRELRAETPQQQQ

SEQ ID NO: 1455286 - protein, 19 aa, Mycobacterium tuberculosis
SMGGMLAFEVALRYQSAGH

SEQ ID NO: 1455287 - protein, 19 aa, Mycobacterium tuberculosis
SMLELLLRELDVHPGDVIE

SEQ ID NO: 1455288 - protein, 19 aa, Mycobacterium tuberculosis
SMLSHVLHAIAKLAPQRLI

SEQ ID NO: 1455289 - protein, 21 aa, Mycobacterium tuberculosis
SMSLAAWLHTRIVDRATREGN

SEQ ID NO: 1455290 - protein, 23 aa, Mycobacterium tuberculosis
SMWPIKSTPGLRCQLDCAPQTNR

SEQ ID NO: 1455291 - protein, 20 aa, Mycobacterium tuberculosis
SNKPFGRWGEVFGDDVVAAA

SEQ ID NO: 1455292 - protein, 17 aa, Mycobacterium tuberculosis
SNQLPGAVAQRLHCDDE

SEQ ID NO: 1455293 - protein, 17 aa, Mycobacterium tuberculosis
SNTEPLLRLNVEGRSVG

SEQ ID NO: 1455294 - protein, 19 aa, Mycobacterium tuberculosis
SPDGTPCRLQGKGRIDKHL

SEQ ID NO: 1455295 - protein, 18 aa, Mycobacterium tuberculosis
SPEPFGAGTTRIVEMRGG

SEQ ID NO: 1455296 - protein, 26 aa, Mycobacterium tuberculosis
SPFGPGRPGWHVECAAIALSRIGSGL

SEQ ID NO: 1455297 - protein, 19 aa, Mycobacterium tuberculosis
SPLAAARWGLAALADGVVD

SEQ ID NO: 1455298 - protein, 17 aa, Mycobacterium tuberculosis
SPLALARQALAVLPKEQ

SEQ ID NO: 1455299 - protein, 28 aa, Mycobacterium tuberculosis
SPRERPGRLLGFHWTKVHPDHPGLGEVY

SEQ ID NO: 1455300 - protein, 25 aa, Mycobacterium tuberculosis
SPTTSICPWKGLAHYYNVVVDGPYG

SEQ ID NO: 1455301 - protein, 26 aa, Mycobacterium tuberculosis
SQAAKDWLCLLEAFDAPQRSGLVRAA

SEQ ID NO: 1455302 - protein, 24 aa, Mycobacterium tuberculosis
SQALRAGMSLGIMADLAVGVHPNG

SEQ ID NO: 1455303 - protein, 19 aa, Mycobacterium tuberculosis
SQFAGPISTVRCFQDNALL

SEQ ID NO: 1455304 - protein, 18 aa, Mycobacterium tuberculosis
SQRLYSWAQERPYTTPFV

SEQ ID NO: 1455305 - protein, 25 aa, Mycobacterium tuberculosis
SQSSWRCVQAHDREGWLALMADDVV

SEQ ID NO: 1455306 - protein, 18 aa, Mycobacterium tuberculosis
SRALQALRADLAAAQQAL

SEQ ID NO: 1455307 - protein, 20 aa, Mycobacterium tuberculosis
SRAYASWMSSVGYRPVTTRH

SEQ ID NO: 1455308 - protein, 23 aa, Mycobacterium tuberculosis
SRDIPLRLLYAIEPDDPGYAAHG

SEQ ID NO: 1455309 - protein, 19 aa, Mycobacterium tuberculosis
SRFWMGGPHIAVRKAPEVA

SEQ ID NO: 1455310 - protein, 24 aa, Mycobacterium tuberculosis
SRGPFPGALWLQVRDLEATQTELV

SEQ ID NO: 1455311 - protein, 19 aa, Mycobacterium tuberculosis
SRILSEFNVKITAARADQR

SEQ ID NO: 1455312 - protein, 23 aa, Mycobacterium tuberculosis
SRPEPPIGHAMVRRSGTDVTVVT

SEQ ID NO: 1455313 - protein, 20 aa, Mycobacterium tuberculosis
SRPVIPPAILASGVDYHTSD

SEQ ID NO: 1455314 - protein, 21 aa, Mycobacterium tuberculosis
SRWWKEEREGVFVDFNQNAKD

SEQ ID NO: 1455315 - protein, 21 aa, Mycobacterium tuberculosis
SRYPVKLRAALDKVKAGDIAW

SEQ ID NO: 1455316 - protein, 24 aa, Mycobacterium tuberculosis
SSDGSPPYVVRWLETDHVATVIPG

SEQ ID NO: 1455317 - protein, 21 aa, Mycobacterium tuberculosis
SSGNPYLAFSAMLMAGLDGIK

SEQ ID NO: 1455318 - protein, 19 aa, Mycobacterium tuberculosis
SSIGSGVRRVEAYVGLDSF

SEQ ID NO: 1455319 - protein, 18 aa, Mycobacterium tuberculosis
SSNGALFLVLRPLLVDYV

SEQ ID NO: 1455320 - protein, 25 aa, Mycobacterium tuberculosis
SSRACQVRFAIYLGDLGRDTAARAR

SEQ ID NO: 1455321 - protein, 36 aa, Mycobacterium tuberculosis; identical to SEQ ID NO: 206713

SEQ ID NO: 1455322 - protein, 19 aa, Mycobacterium tuberculosis
STAEAFPGLAHTAALVRLV

SEQ ID NO: 1455323 - protein, 19 aa, Mycobacterium tuberculosis
STAVAHGIRVTWAVLNDGQ

SEQ ID NO: 1455324 - protein, 19 aa, Mycobacterium tuberculosis
STEALVRVVREFRPHVMTT

SEQ ID NO: 1455325 - protein, 17 aa, Mycobacterium tuberculosis
STEEIFTYWSMRPRGAQ

SEQ ID NO: 1455326 - protein, 22 aa, Mycobacterium tuberculosis
STFLPTLGEFVDFVRDYRFEGQ

SEQ ID NO: 1455327 - protein, 19 aa, Mycobacterium tuberculosis
STPLLKLLLVRAAHATELP

SEQ ID NO: 1455328 - protein, 18 aa, Mycobacterium tuberculosis
STVLAAAYRDFRSVNADF

SEQ ID NO: 1455329 - protein, 23 aa, Mycobacterium tuberculosis
SVKGEVIASTFDRPPSDHTSVAE

SEQ ID NO: 1455330 - protein, 20 aa, Mycobacterium tuberculosis
SVVATSLYSRLNCSIVNTGA

SEQ ID NO: 1455331 - protein, 17 aa, Mycobacterium tuberculosis
SWSRLFTGATFPGASKA

SEQ ID NO: 1455332 - protein, 24 aa, Mycobacterium tuberculosis
SYIDYAMSVIVGRALPEVRDGLKP

SEQ ID NO: 1455333 - protein, 19 aa, Mycobacterium tuberculosis
SYNHYSVGWAHAMDTPYQW

SEQ ID NO: 1455334 - protein, 18 aa, Mycobacterium tuberculosis
TADARLSTNFTELDSSTA

SEQ ID NO: 1455335 - protein, 20 aa, Mycobacterium tuberculosis
TAEAVVDCRVLPGRRAAFEA

SEQ ID NO: 1455336 - protein, 25 aa, Mycobacterium tuberculosis
TAEQMKMFLTRLGFGSKVVVTGDVT

SEQ ID NO: 1455337 - protein, 24 aa, Mycobacterium tuberculosis
TAESSLRGANLWDEVKDRLDKPGG

SEQ ID NO: 1455338 - protein, 18 aa, Mycobacterium tuberculosis
TAGDRPDVLVAMNPAALK

SEQ ID NO: 1455339 - protein, 20 aa, Mycobacterium tuberculosis
TAGVIAPVSPWCRSQLGYLT

SEQ ID NO: 1455340 - protein, 25 aa, Mycobacterium tuberculosis
TAKSMPYKSGFGPFAPEIYRAPLSY

SEQ ID NO: 1455341 - protein, 18 aa, Mycobacterium tuberculosis
TALARRVRRGELAAPDDD

SEQ ID NO: 1455342 - protein, 22 aa, Mycobacterium tuberculosis
TALRLPRDAELVVDGQDVVTDV

SEQ ID NO: 1455343 - protein, 19 aa, Mycobacterium tuberculosis
TARCRRLLDLDADPEAIVE

SEQ ID NO: 1455344 - protein, 19 aa, Mycobacterium tuberculosis
TATVIERWVQEYLEATARL

SEQ ID NO: 1455345 - protein, 20 aa, Mycobacterium tuberculosis
TAVICARAGLNVQVVEAQAT

SEQ ID NO: 1455346 - protein, 23 aa, Mycobacterium tuberculosis
TAVQARAAWDAVNADIARYNARC

SEQ ID NO: 1455347 - protein, 23 aa, Mycobacterium tuberculosis
TAVSGFPDFLAKDVIDIQVTVES

SEQ ID NO: 1455348 - protein, 24 aa, Mycobacterium tuberculosis
TAVYVCGPPGMLEAVRVARNQHAD

SEQ ID NO: 1455349 - protein, 26 aa, Mycobacterium tuberculosis
TCIECPAGTIGEIWVKGDNVAEGYWN

SEQ ID NO: 1455350 - protein, 17 aa, Mycobacterium tuberculosis
TCQTGGKALADRRMSRL

SEQ ID NO: 1455351 - protein, 24 aa, Mycobacterium tuberculosis
TDAPRPALTINFCVGFVRQQVNQQ

SEQ ID NO: 1455352 - protein, 25 aa, Mycobacterium tuberculosis
TDGDLPPRFPIVGGHEGSGVIEEVG

SEQ ID NO: 1455353 - protein, 22 aa, Mycobacterium tuberculosis
TDIANAVAWLASEEARYVTGVT

SEQ ID NO: 1455354 - protein, 21 aa, Mycobacterium tuberculosis
TDLRTRLDAALAKPAAQQPTW

SEQ ID NO: 1455355 - protein, 24 aa, Mycobacterium tuberculosis
TDPDGWSWPKARQMFEERAHLLPV

SEQ ID NO: 1455356 - protein, 23 aa, Mycobacterium tuberculosis
TDVAHGWIPPGIALPEGVRLLAP

SEQ ID NO: 1455357 - protein, 20 aa, Mycobacterium tuberculosis
TDVRSGLLFVWHDHEGNPPD

SEQ ID NO: 1455358 - protein, 30 aa, Mycobacterium tuberculosis; identical to SEQ ID NO: 206930

SEQ ID NO: 1455359 - protein, 23 aa, Mycobacterium tuberculosis
TEARGLFPRHLDTIVNVPAPSWD

SEQ ID NO: 1455360 - protein, 28 aa, Mycobacterium tuberculosis
TEAVARGDFRAALVVGDRLDTDIEGANA

SEQ ID NO: 1455361 - protein, 31 aa, Mycobacterium tuberculosis; identical to SEQ ID NO: 206933

SEQ ID NO: 1455362 - protein, 33 aa, Mycobacterium tuberculosis; identical to SEQ ID NO: 206934

SEQ ID NO: 1455363 - protein, 22 aa, Mycobacterium tuberculosis
TEFVKLQEWARHSGARLVVIFE

SEQ ID NO: 1455364 - protein, 24 aa, Mycobacterium tuberculosis
TEGTRIWTRHGILTHNLIKISSLA

SEQ ID NO: 1455365 - protein, 28 aa, Mycobacterium tuberculosis
TEGVPRWRKATGLGWLTAEYAMLPSATH

SEQ ID NO: 1455366 - protein, 25 aa, Mycobacterium tuberculosis
TELLEYHWGPDWVVWDAAKTAQQHG

SEQ ID NO: 1455367 - protein, 23 aa, Mycobacterium tuberculosis
TELRVRCVRQLRDAMQQHVEELR

SEQ ID NO: 1455368 - protein, 21 aa, Mycobacterium tuberculosis
TEPQLRELAARGAAELDGATA

SEQ ID NO: 1455369 - protein, 21 aa, Mycobacterium tuberculosis
TERHIRLIFQRAREKASEGTP

SEQ ID NO: 1455370 - protein, 25 aa, Mycobacterium tuberculosis
TERILFRRLAVFVGGFDLTAASEVA

SEQ ID NO: 1455371 - protein, 22 aa, Mycobacterium tuberculosis
TERLPGKWGEYLLASRATTIYG

SEQ ID NO: 1455372 - protein, 18 aa, Mycobacterium tuberculosis
TERVRLAPEPVYTDAEWV

SEQ ID NO: 1455373 - protein, 19 aa, Mycobacterium tuberculosis
TETADRWEDVFLQMRNQAH

SEQ ID NO: 1455374 - protein, 26 aa, Mycobacterium tuberculosis
TETFDAVVCSLVLCSVSDPGAVLAHL

SEQ ID NO: 1455375 - protein, 20 aa, Mycobacterium tuberculosis
TEVIVAPGYAPGALDVLARK

SEQ ID NO: 1455376 - protein, 36 aa, Mycobacterium tuberculosis; identical to SEQ ID NO: 206980

SEQ ID NO: 1455377 - protein, 27 aa, Mycobacterium tuberculosis
TEVPRKLLEEWLAMWSGHYQLKDKLRV

SEQ ID NO: 1455378 - protein, 20 aa, Mycobacterium tuberculosis
TEYNVRFTAVVPVPNDGKGA

SEQ ID NO: 1455379 - protein, 18 aa, Mycobacterium tuberculosis
TFAPILYVLTYDDLDEAI

SEQ ID NO: 1455380 - protein, 24 aa, Mycobacterium tuberculosis
TFARRHLRGLVGLMIDPIADVTAA

SEQ ID NO: 1455381 - protein, 20 aa, Mycobacterium tuberculosis
TFETACTWDGFDTLHAAVTD

SEQ ID NO: 1455382 - protein, 37 aa, Mycobacterium tuberculosis; identical to SEQ ID NO: 207003

SEQ ID NO: 1455383 - protein, 23 aa, Mycobacterium tuberculosis
TGAKEILCIRVLGGSSRRYAGIG

SEQ ID NO: 1455384 - protein, 18 aa, Mycobacterium tuberculosis
TGFEDGLFAGWRSDPAFV

SEQ ID NO: 1455385 - protein, 18 aa, Mycobacterium tuberculosis
TGGFTEFVPLPFVHQNSP

SEQ ID NO: 1455386 - protein, 24 aa, Mycobacterium tuberculosis
TGGQRIDLFGARVDQLPLIWQRLV

SEQ ID NO: 1455387 - protein, 23 aa, Mycobacterium tuberculosis
TGKPDALVPLARRVTGECLAEDL

SEQ ID NO: 1455388 - protein, 21 aa, Mycobacterium tuberculosis
TGLLAPHWPAPYGRGASPAEQ

SEQ ID NO: 1455389 - protein, 24 aa, Mycobacterium tuberculosis
TGNARPAQIAAFAVAMTMKAPTAD

SEQ ID NO: 1455390 - protein, 19 aa, Mycobacterium tuberculosis
TGVAFALVHNRLLSPLVMT

SEQ ID NO: 1455391 - protein, 21 aa, Mycobacterium tuberculosis
TGVAPRIPAIPGIDHPMVLTY

SEQ ID NO: 1455392 - protein, 23 aa, Mycobacterium tuberculosis
THKHFDHVLGSSVFDQAEVFCAP

SEQ ID NO: 1455393 - protein, 19 aa, Mycobacterium tuberculosis
THLGWCAHSGWKVDAAKGV

SEQ ID NO: 1455394 - protein, 31 aa, Mycobacterium tuberculosis; identical to SEQ ID NO: 207080

SEQ ID NO: 1455395 - protein, 18 aa, Mycobacterium tuberculosis
TIMDRYGAVWQREDVGVI

SEQ ID NO: 1455396 - protein, 18 aa, Mycobacterium tuberculosis
TIRGDFALETQFNLVHGS

SEQ ID NO: 1455397 - protein, 30 aa, Mycobacterium tuberculosis; identical to SEQ ID NO: 207103

SEQ ID NO: 1455398 - protein, 25 aa, Mycobacterium tuberculosis
TLEDRLRTRFEWGLITDVQPPELET

SEQ ID NO: 1455399 - protein, 36 aa, Mycobacterium tuberculosis; identical to SEQ ID NO: 207128

SEQ ID NO: 1455400 - protein, 20 aa, Mycobacterium tuberculosis
TLESGMVPKVEACLRAVIGG

SEQ ID NO: 1455401 - protein, 25 aa, Mycobacterium tuberculosis
TLHSVKVIPSRGAWLEFDVDKRDTV

SEQ ID NO: 1455402 - protein, 21 aa, Mycobacterium tuberculosis
TLNSMKALWARPKEEVSEQEY

SEQ ID NO: 1455403 - protein, 22 aa, Mycobacterium tuberculosis
TLPAGAPHEVWWGSEDYVSGLF

SEQ ID NO: 1455404 - protein, 21 aa, Mycobacterium tuberculosis
TLPHLQRLAVYTGEALDQLAA

SEQ ID NO: 1455405 - protein, 20 aa, Mycobacterium tuberculosis
TLSQIDYWQVVGIFISGQPI

SEQ ID NO: 1455406 - protein, 25 aa, Mycobacterium tuberculosis
TMLGVALSAYEHWLRDESVSLTEAL

SEQ ID NO: 1455407 - protein, 23 aa, Mycobacterium tuberculosis
TMVDLLATVLMSWEHEDAVHAVV

SEQ ID NO: 1455408 - protein, 17 aa, Mycobacterium tuberculosis
TNHLAFRAQTYGQLDDA

SEQ ID NO: 1455409 - protein, 20 aa, Mycobacterium tuberculosis
TNLWGAFGLLAEMVKQGRSG

SEQ ID NO: 1455410 - protein, 24 aa, Mycobacterium tuberculosis
TPHFDGYPAVLVRLAEIEVRDLEE

SEQ ID NO: 1455411 - protein, 18 aa, Mycobacterium tuberculosis
TPHVPIPYVYPVDLRFVL

SEQ ID NO: 1455412 - protein, 21 aa, Mycobacterium tuberculosis
TPKGVLVHRLIRTGRSLFTAH

SEQ ID NO: 1455413 - protein, 22 aa, Mycobacterium tuberculosis
TPLAGQRSFIALEFLLDEPASY

SEQ ID NO: 1455414 - protein, 18 aa, Mycobacterium tuberculosis
TPLHLAFSSYVFDLHDQL

SEQ ID NO: 1455415 - protein, 18 aa, Mycobacterium tuberculosis
TPSGYRLDGVKSLIPAAA

SEQ ID NO: 1455416 - protein, 27 aa, Mycobacterium tuberculosis
TPVQVLGFREHASWALASDTLEFVDLE

SEQ ID NO: 1455417 - protein, 25 aa, Mycobacterium tuberculosis
TPWGRGRPGWHLECSAMARSYLGPE

SEQ ID NO: 1455418 - protein, 18 aa, Mycobacterium tuberculosis
TQAALGFLLDNGCHHLQL

SEQ ID NO: 1455419 - protein, 22 aa, Mycobacterium tuberculosis
TQQDVWRFVAYLSDVGSADDLT

SEQ ID NO: 1455420 - protein, 17 aa, Mycobacterium tuberculosis
TQVPLLLDEYTRNASTG

SEQ ID NO: 1455421 - protein, 22 aa, Mycobacterium tuberculosis
TRALKAPTLRGAIEQLADRART

SEQ ID NO: 1455422 - protein, 20 aa, Mycobacterium tuberculosis
TRASALRWLREVNAEQFADR

SEQ ID NO: 1455423 - protein, 24 aa, Mycobacterium tuberculosis
TRDILDREILGIAEAIRASGLSAG

SEQ ID NO: 1455424 - protein, 18 aa, Mycobacterium tuberculosis
TREFFDLLLSERGSGLDW

SEQ ID NO: 1455425 - protein, 24 aa, Mycobacterium tuberculosis
TRFDPDRFAGYEWGVSVVTLGELR

SEQ ID NO: 1455426 - protein, 18 aa, Mycobacterium tuberculosis
TRHPRVSSALARAEVMRA

SEQ ID NO: 1455427 - protein, 21 aa, Mycobacterium tuberculosis
TRIGLTYPALFGFLRIATSAR

SEQ ID NO: 1455428 - protein, 17 aa, Mycobacterium tuberculosis
TRIPLHGRIEVDEPYVL

SEQ ID NO: 1455429 - protein, 20 aa, Mycobacterium tuberculosis
TRLAREIADHFGADQPAIHD

SEQ ID NO: 1455430 - protein, 23 aa, Mycobacterium tuberculosis
TRLDPKMCDAWLARLLAGDQSIE

SEQ ID NO: 1455431 - protein, 23 aa, Mycobacterium tuberculosis
TRMARLAVHPNAYIRPSPTSGTL

SEQ ID NO: 1455432 - protein, 18 aa, Mycobacterium tuberculosis
TRMGAQDTRLVWEERRLR

SEQ ID NO: 1455433 - protein, 20 aa, Mycobacterium tuberculosis
TRNPWCLNRTPGGSSGGSAA

SEQ ID NO: 1455434 - protein, 17 aa, Mycobacterium tuberculosis
TRPGLVVAAEFRGPDEA

SEQ ID NO: 1455435 - protein, 27 aa, Mycobacterium tuberculosis
TRRVRLMRWGLIPSWIKAGPGGAPDAK

SEQ ID NO: 1455436 - protein, 20 aa, Mycobacterium tuberculosis
TRSLSDFGFANVDRNPSPGS

SEQ ID NO: 1455437 - protein, 21 aa, Mycobacterium tuberculosis
TRTALAIAAGHSFVIFLREGF

SEQ ID NO: 1455438 - protein, 18 aa, Mycobacterium tuberculosis
TRTELGTYLFFVDCVGHI

SEQ ID NO: 1455439 - protein, 20 aa, Mycobacterium tuberculosis
TRVDGGWRITGQKIWTTGAQ

SEQ ID NO: 1455440 - protein, 19 aa, Mycobacterium tuberculosis
TRVGERLTELPLTLFTDPA

SEQ ID NO: 1455441 - protein, 18 aa, Mycobacterium tuberculosis
TRVPRPAPSELLVAVHAC

SEQ ID NO: 1455442 - protein, 29 aa, Mycobacterium tuberculosis
TSARIERFLQLWAEGSMTIAMPSTPSNYF

SEQ ID NO: 1455443 - protein, 23 aa, Mycobacterium tuberculosis
TSCPGCRATVIVRDWYSIRHYAL

SEQ ID NO: 1455444 - protein, 21 aa, Mycobacterium tuberculosis
TSRTFKDGWLHTGDLAREDSD

SEQ ID NO: 1455445 - protein, 22 aa, Mycobacterium tuberculosis
TSVLSRGVCGVAGRTLIINLPG

SEQ ID NO: 1455446 - protein, 21 aa, Mycobacterium tuberculosis
TTAEGFSWTPVHTMAGPDTSA

SEQ ID NO: 1455447 - protein, 23 aa, Mycobacterium tuberculosis
TTANAMSWFWYLMALNPQARDHM

SEQ ID NO: 1455448 - protein, 23 aa, Mycobacterium tuberculosis
TTFTKRGKLGIRWYSSKQGHGEP

SEQ ID NO: 1455449 - protein, 26 aa, Mycobacterium tuberculosis
TTSWCGYCLRLKTALTANRIAYDEVD

SEQ ID NO: 1455450 - protein, 23 aa, Mycobacterium tuberculosis
TVDFKRFARDGIVAMSSADALQL

SEQ ID NO: 1455451 - protein, 25 aa, Mycobacterium tuberculosis
TVEERARNGLSIVIAPEGTRLDTTE

SEQ ID NO: 1455452 - protein, 25 aa, Mycobacterium tuberculosis
TVEGRPKHYWSIYQKMIVKGRDFDD

SEQ ID NO: 1455453 - protein, 21 aa, Mycobacterium tuberculosis
TVGRGEIFGLLGPSGAGKSTT

SEQ ID NO: 1455454 - protein, 24 aa, Mycobacterium tuberculosis
TVITRKAYGGAYCVMGSKDMGCDV

SEQ ID NO: 1455455 - protein, 24 aa, Mycobacterium tuberculosis
TVSPQLYIALGISGAIQHRAGMQT

SEQ ID NO: 1455456 - protein, 23 aa, Mycobacterium tuberculosis
TVSWPRTAKLLDVLLAAGLDAPF

SEQ ID NO: 1455457 - protein, 30 aa, Mycobacterium tuberculosis; identical to SEQ ID NO: 207407

SEQ ID NO: 1455458 - protein, 23 aa, Mycobacterium tuberculosis
TWNGTRLAAAIMRERKRGAIVNM

SEQ ID NO: 1455459 - protein, 23 aa, Mycobacterium tuberculosis
TWPPMPYPETWGVWQEDEGRQIV

SEQ ID NO: 1455460 - protein, 18 aa, Mycobacterium tuberculosis
TWQPEPLAGQPLDRPFAW

SEQ ID NO: 1455461 - protein, 23 aa, Mycobacterium tuberculosis
TWRRLELSVPLVVDPVCASMHGD

SEQ ID NO: 1455462 - protein, 24 aa, Mycobacterium tuberculosis
TYAVPRLLARNGLSLQDFDFYEIH

SEQ ID NO: 1455463 - protein, 23 aa, Mycobacterium tuberculosis
TYGFARQRFWLGDNGELSVDQTG

SEQ ID NO: 1455464 - protein, 24 aa, Mycobacterium tuberculosis
TYLARAPVAPGLALPRLVRSRIVK

SEQ ID NO: 1455465 - protein, 18 aa, Mycobacterium tuberculosis
TYRCPGCDHEIRSGTAHV

SEQ ID NO: 1455466 - protein, 25 aa, Mycobacterium tuberculosis
VAAEIARLALFLTTPAARHITGQTL

SEQ ID NO: 1455467 - protein, 19 aa, Mycobacterium tuberculosis
VAAELDYPALTLAQLRARL

SEQ ID NO: 1455468 - protein, 17 aa, Mycobacterium tuberculosis
VACDGRWSIARHEAGLK

SEQ ID NO: 1455469 - protein, 23 aa, Mycobacterium tuberculosis
VADFPRYPLNFVSTLNAIAGTYY

SEQ ID NO: 1455470 - protein, 25 aa, Mycobacterium tuberculosis
VADKLKACPDARVTINGYTDNTGSE

SEQ ID NO: 1455471 - protein, 28 aa, Mycobacterium tuberculosis
VADMTYLQWLRRYVELAIGEGNSTADTA

SEQ ID NO: 1455472 - protein, 26 aa, Mycobacterium tuberculosis
VAGALKLGVELGRGAVIVVNLSGRGD

SEQ ID NO: 1455473 - protein, 25 aa, Mycobacterium tuberculosis
VALHASFPPERITLHGNNKSVSELT

SEQ ID NO: 1455474 - protein, 24 aa, Mycobacterium tuberculosis
VALLSRGKLLYGVIDDENQPPGSR

SEQ ID NO: 1455475 - protein, 18 aa, Mycobacterium tuberculosis
VAMFPAVEPDDVSALTEC

SEQ ID NO: 1455476 - protein, 26 aa, Mycobacterium tuberculosis
VAQLCTELKLPLVVDAAQGLGHVDCA

SEQ ID NO: 1455477 - protein, 24 aa, Mycobacterium tuberculosis
VASERRIAEETARAEGKPEQALPK

SEQ ID NO: 1455478 - protein, 26 aa, Mycobacterium tuberculosis
VASVSWPNPNDWWLVRLLGSITPTER

SEQ ID NO: 1455479 - protein, 23 aa, Mycobacterium tuberculosis
VATKLFAARGYHGTRMDDVADVI

SEQ ID NO: 1455480 - protein, 17 aa, Mycobacterium tuberculosis
VATRVIPGAGLAVERIG

SEQ ID NO: 1455481 - protein, 26 aa, Mycobacterium tuberculosis
VATTCGRPFADFELRIADDGEVLLRG

SEQ ID NO: 1455482 - protein, 17 aa, Mycobacterium tuberculosis
VATVAATWRRLELSVPL

SEQ ID NO: 1455483 - protein, 22 aa, Mycobacterium tuberculosis
VAVHGFPNYFFITGPDTAAQAR

SEQ ID NO: 1455484 - protein, 24 aa, Mycobacterium tuberculosis
VAVLRTALVGLELPADAVQLLSAA

SEQ ID NO: 1455485 - protein, 19 aa, Mycobacterium tuberculosis
VAVQRLRAGELVGLHPEAT

SEQ ID NO: 1455486 - protein, 23 aa, Mycobacterium tuberculosis
VAVRRISMSFVNVAPQLVSTAAA

SEQ ID NO: 1455487 - protein, 18 aa, Mycobacterium tuberculosis
VCGAELIRGLVTAYEIHI

SEQ ID NO: 1455488 - protein, 23 aa, Mycobacterium tuberculosis
VDAEFRVGTMGLGWDSEAQSVVV

SEQ ID NO: 1455489 - protein, 23 aa, Mycobacterium tuberculosis
VDAVVGIYGRYDWEDRSTPERAR

SEQ ID NO: 1455490 - protein, 23 aa, Mycobacterium tuberculosis
VDDLCLPDMLLLLATDVAAVDHH

SEQ ID NO: 1455491 - protein, 23 aa, Mycobacterium tuberculosis
VDDLEAAITFYSRLFNAEPAKRK

SEQ ID NO: 1455492 - protein, 17 aa, Mycobacterium tuberculosis
VDELIWLPVPDAMNKLD

SEQ ID NO: 1455493 - protein, 17 aa, Mycobacterium tuberculosis
VDFTLGYEVRSVNAEPD

SEQ ID NO: 1455494 - protein, 19 aa, Mycobacterium tuberculosis
VDGDERWAAEIRRLAHLRG

SEQ ID NO: 1455495 - protein, 20 aa, Mycobacterium tuberculosis
VDKGVKWDPAELGPVVSDLL

SEQ ID NO: 1455496 - protein, 17 aa, Mycobacterium tuberculosis
VDLDPMPGVAWQRVVEV

SEQ ID NO: 1455497 - protein, 25 aa, Mycobacterium tuberculosis
VDLLRFCLERGYQLRVIEQMPLDAG

SEQ ID NO: 1455498 - protein, 29 aa, Mycobacterium tuberculosis
VDQDRCRGWRMCVSGCPYKKVYFNHKTGK

SEQ ID NO: 1455499 - protein, 22 aa, Mycobacterium tuberculosis
VDRDEVLLDIGYKTEGVIPARE

SEQ ID NO: 1455500 - protein, 23 aa, Mycobacterium tuberculosis
VDSEAGWPLYLRRYTDLLCIQVQ

SEQ ID NO: 1455501 - protein, 20 aa, Mycobacterium tuberculosis
VDTKAGYAFERIPKAEVEDL

SEQ ID NO: 1455502 - protein, 20 aa, Mycobacterium tuberculosis
VEALVGLGFAAKQAEEATDT

SEQ ID NO: 1455503 - protein, 19 aa, Mycobacterium tuberculosis
VEATLRWAGNSMTTNGVSH

SEQ ID NO: 1455504 - protein, 19 aa, Mycobacterium tuberculosis
VEDSQLWLLQTRGAERSAQ

SEQ ID NO: 1455505 - protein, 22 aa, Mycobacterium tuberculosis
VEHCIIDANFLMDVGFVVVAPH

SEQ ID NO: 1455506 - protein, 29 aa, Mycobacterium tuberculosis
VEIAEMFQLPPALQRAWHTHGYYGSVSHN

SEQ ID NO: 1455507 - protein, 19 aa, Mycobacterium tuberculosis
VEINEAFAAVALASIRELG

SEQ ID NO: 1455508 - protein, 23 aa, Mycobacterium tuberculosis
VEITTCLRRGEIEMVTRFEPNAA

SEQ ID NO: 1455509 - protein, 22 aa, Mycobacterium tuberculosis
VEIYRPRVAGPVPQAEDVVAMA

SEQ ID NO: 1455510 - protein, 25 aa, Mycobacterium tuberculosis
VENYNLNMAIPWIAAERGFIDAVID

SEQ ID NO: 1455511 - protein, 25 aa, Mycobacterium tuberculosis
VEQIKRFRILPTLWEPGGDEITLTM

SEQ ID NO: 1455512 - protein, 25 aa, Mycobacterium tuberculosis
VESFGFKYGLPMDADMVMDVRFLPN

SEQ ID NO: 1455513 - protein, 25 aa, Mycobacterium tuberculosis
VETARGAVCAAEIAAADPTVGMMWG

SEQ ID NO: 1455514 - protein, 19 aa, Mycobacterium tuberculosis
VETERRFYLANSVEMVPRN

SEQ ID NO: 1455515 - protein, 17 aa, Mycobacterium tuberculosis
VEYARKYRQTIAAAAVV

SEQ ID NO: 1455516 - protein, 25 aa, Mycobacterium tuberculosis
VFEGLKAYRWADGSIVSFRADANAA

SEQ ID NO: 1455517 - protein, 18 aa, Mycobacterium tuberculosis
VFITYPLWIGTRQADRLR

SEQ ID NO: 1455518 - protein, 26 aa, Mycobacterium tuberculosis
VFREPLPRIGLDSLPEQGAWLQPFRP

SEQ ID NO: 1455519 - protein, 23 aa, Mycobacterium tuberculosis
VFTRAQLLHEVWGYDFFGGTRTV

SEQ ID NO: 1455520 - protein, 23 aa, Mycobacterium tuberculosis
VGDALKAVAAFRLALPRTMLRFA

SEQ ID NO: 1455521 - protein, 18 aa, Mycobacterium tuberculosis
VGEGDLAGQVAYRYDYVN

SEQ ID NO: 1455522 - protein, 25 aa, Mycobacterium tuberculosis
VGEICVSGPLLAGGYWNLPDETSRT

SEQ ID NO: 1455523 - protein, 24 aa, Mycobacterium tuberculosis
VGEMRAGTVALVIREDRGWAVREI

SEQ ID NO: 1455524 - protein, 21 aa, Mycobacterium tuberculosis
VGFACQSFAALSLEPPLVLFC

SEQ ID NO: 1455525 - protein, 25 aa, Mycobacterium tuberculosis
VGGLRRCVTALKARFGDNPATRRIV

SEQ ID NO: 1455526 - protein, 24 aa, Mycobacterium tuberculosis
VGGSCPLWVVHDAFAQPERIVRQV

SEQ ID NO: 1455527 - protein, 26 aa, Mycobacterium tuberculosis
VGITRARVHLALSWALSRSPGGRQSR

SEQ ID NO: 1455528 - protein, 25 aa, Mycobacterium tuberculosis
VGIVGFCMGGQFALVLSPRGFGATA

SEQ ID NO: 1455529 - protein, 21 aa, Mycobacterium tuberculosis
VGLFRHVLRPAFLQAETAARQ

SEQ ID NO: 1455530 - protein, 19 aa, Mycobacterium tuberculosis
VGLSSRLAAITTLGPKFWA

SEQ ID NO: 1455531 - protein, 27 aa, Mycobacterium tuberculosis
VGPQVARAALLFGMCFDAESAVRHGLA

SEQ ID NO: 1455532 - protein, 18 aa, Mycobacterium tuberculosis
VGSSRANLFTSISGGINA

SEQ ID NO: 1455533 - protein, 24 aa, Mycobacterium tuberculosis
VGTRLGMCGVEYFGHPWEFGPRKT

SEQ ID NO: 1455534 - protein, 20 aa, Mycobacterium tuberculosis
VGVDTSALWAALRQPDVLAE

SEQ ID NO: 1455535 - protein, 22 aa, Mycobacterium tuberculosis
VGVGYAEQADWMLVTADNAVVV

SEQ ID NO: 1455536 - protein, 19 aa, Mycobacterium tuberculosis
VGVHPNGADAWALQDVLAQ

SEQ ID NO: 1455537 - protein, 24 aa, Mycobacterium tuberculosis
VHDAQCTTMSWPQRADHAAQAARL

SEQ ID NO: 1455538 - protein, 22 aa, Mycobacterium tuberculosis
VHFKSVAYELLWFLRGDSNIGW

SEQ ID NO: 1455539 - protein, 19 aa, Mycobacterium tuberculosis
VHGTWRMLRANAKLAASTG

SEQ ID NO: 1455540 - protein, 24 aa, Mycobacterium tuberculosis
VHGVLIPGGFGIRGIEGKIGAIAY

SEQ ID NO: 1455541 - protein, 25 aa, Mycobacterium tuberculosis
VHKKGSALVPSWVAFAVTGLLEQHF

SEQ ID NO: 1455542 - protein, 24 aa, Mycobacterium tuberculosis
VHRPRRASSPFGQFAAVADAVNPA

SEQ ID NO: 1455543 - protein, 27 aa, Mycobacterium tuberculosis
VICSKGFPSYFLIVADLISYARSAGIR

SEQ ID NO: 1455544 - protein, 24 aa, Mycobacterium tuberculosis
VIDSRSAAMGVGFAALAAGRAAAA

SEQ ID NO: 1455545 - protein, 21 aa, Mycobacterium tuberculosis
VIDVLDWCAREGIAVIPYGGG

SEQ ID NO: 1455546 - protein, 24 aa, Mycobacterium tuberculosis
VIIHGWLAFTFELCRQRIMDPSTD

SEQ ID NO: 1455547 - protein, 19 aa, Mycobacterium tuberculosis
VILQCARALAEYGVEPRHL

SEQ ID NO: 1455548 - protein, 27 aa, Mycobacterium tuberculosis
VISYRGGVREACLWSAGLAGSGIRRRA

SEQ ID NO: 1455549 - protein, 20 aa, Mycobacterium tuberculosis
VKAAVDVFKEKLIRRDISLK

SEQ ID NO: 1455550 - protein, 17 aa, Mycobacterium tuberculosis
VKALLDVAGVTVTRFVR

SEQ ID NO: 1455551 - protein, 24 aa, Mycobacterium tuberculosis
VKDKPAWLDRAWRRIIEEAAAGRQ

SEQ ID NO: 1455552 - protein, 20 aa, Mycobacterium tuberculosis
VKLRFFGRVRRCGMVSPTVF

SEQ ID NO: 1455553 - protein, 22 aa, Mycobacterium tuberculosis
VKSRLHYAVRALRLTLQELGVT

SEQ ID NO: 1455554 - protein, 17 aa, Mycobacterium tuberculosis
VKVAKNWQRDPKQLGRL

SEQ ID NO: 1455555 - protein, 19 aa, Mycobacterium tuberculosis
VKVDDWLPLETAVLVGCGV

SEQ ID NO: 1455556 - protein, 28 aa, Mycobacterium tuberculosis
VKVGGARRCAAQSWSLDRIKSVKQAAGV

SEQ ID NO: 1455557 - protein, 18 aa, Mycobacterium tuberculosis
VKVLPWIPTPAKRILSAG

SEQ ID NO: 1455558 - protein, 19 aa, Mycobacterium tuberculosis
VLDELCLTIAPYVVGGLAR

SEQ ID NO: 1455559 - protein, 18 aa, Mycobacterium tuberculosis
VLDSVNWLVEHEGAHVTW

SEQ ID NO: 1455560 - protein, 25 aa, Mycobacterium tuberculosis
VLEAFRPGTMEKLGLGPDDLRSRNP

SEQ ID NO: 1455561 - protein, 30 aa, Mycobacterium tuberculosis; identical to SEQ ID NO: 207920

SEQ ID NO: 1455562 - protein, 24 aa, Mycobacterium tuberculosis
VLREAGWRPSIALRDGIEATVAWY

SEQ ID NO: 1455563 - protein, 20 aa, Mycobacterium tuberculosis
VMASQMLWDPIRFDETCPSS

SEQ ID NO: 1455564 - protein, 18 aa, Mycobacterium tuberculosis
VMYFKDFNSGAMIQNVVD

SEQ ID NO: 1455565 - protein, 27 aa, Mycobacterium tuberculosis
VNALNCGRPPRFCRRVGVRPPAPAALP

SEQ ID NO: 1455566 - protein, 26 aa, Mycobacterium tuberculosis
VNGYRGCSHACRYCFARPTHEYLDFN

SEQ ID NO: 1455567 - protein, 18 aa, Mycobacterium tuberculosis
VNMPVNFRPTAWSTEVIS

SEQ ID NO: 1455568 - protein, 25 aa, Mycobacterium tuberculosis
VNPTGKFVLGGPMGDAGLTGRKIIV

SEQ ID NO: 1455569 - protein, 23 aa, Mycobacterium tuberculosis
VNRDIPLRLVYVIDPSQLSAAGE

SEQ ID NO: 1455570 - protein, 17 aa, Mycobacterium tuberculosis
VPADHRLAFSRARSKAL

SEQ ID NO: 1455571 - protein, 24 aa, Mycobacterium tuberculosis
VPAELRPALERAFASGLPAVVNVL

SEQ ID NO: 1455572 - protein, 23 aa, Mycobacterium tuberculosis
VPARPRRVRKPGEPLRIGVGGPV

SEQ ID NO: 1455573 - protein, 20 aa, Mycobacterium tuberculosis
VPGELHAMMLDMRRTFDEMV

SEQ ID NO: 1455574 - protein, 19 aa, Mycobacterium tuberculosis
VPMLLRAGLGVAMGNAHPD

SEQ ID NO: 1455575 - protein, 21 aa, Mycobacterium tuberculosis
VPSERTGSVARCYSLCSSPYT

SEQ ID NO: 1455576 - protein, 19 aa, Mycobacterium tuberculosis
VPTAFPVEFLSLGASGVGV

SEQ ID NO: 1455577 - protein, 20 aa, Mycobacterium tuberculosis
VPYDRVVELSSTLTMPRPNF

SEQ ID NO: 1455578 - protein, 19 aa, Mycobacterium tuberculosis
VQEDWNFEFGWQATEAIVD

SEQ ID NO: 1455579 - protein, 18 aa, Mycobacterium tuberculosis
VQLGLSMLAAAIAHAGAG

SEQ ID NO: 1455580 - protein, 24 aa, Mycobacterium tuberculosis
VQLKGSNLEFALGYSHPVVIEAPE

SEQ ID NO: 1455581 - protein, 25 aa, Mycobacterium tuberculosis
VQSGKYRRVLALAWEKQSESNAMWA

SEQ ID NO: 1455582 - protein, 26 aa, Mycobacterium tuberculosis
VQTGFARTGAMFACEHEGPDGLEPDL

SEQ ID NO: 1455583 - protein, 19 aa, Mycobacterium tuberculosis
VRACLPRLGELAIGGTAVG

SEQ ID NO: 1455584 - protein, 20 aa, Mycobacterium tuberculosis
VRADGGWLLTGQKVWTSAAH

SEQ ID NO: 1455585 - protein, 18 aa, Mycobacterium tuberculosis
VRAIWNLPPRPRTRPPSD

SEQ ID NO: 1455586 - protein, 17 aa, Mycobacterium tuberculosis
VRALEAFGRTPAATDLQ

SEQ ID NO: 1455587 - protein, 19 aa, Mycobacterium tuberculosis
VRAQLGITINWRFFSLEEI

SEQ ID NO: 1455588 - protein, 23 aa, Mycobacterium tuberculosis
VRDELPHSLAVVIDEVSPREGRD

SEQ ID NO: 1455589 - protein, 19 aa, Mycobacterium tuberculosis
VRDGLKPVHRRVLYAMFDS

SEQ ID NO: 1455590 - protein, 24 aa, Mycobacterium tuberculosis
VREGGVGVHSIFGGAFTVEAQANG

SEQ ID NO: 1455591 - protein, 26 aa, Mycobacterium tuberculosis
VRELMPRTPFIGGLGIVFERYEPDDV

SEQ ID NO: 1455592 - protein, 22 aa, Mycobacterium tuberculosis
VRESLRRSLSFNGYSVELAHDG

SEQ ID NO: 1455593 - protein, 19 aa, Mycobacterium tuberculosis
VRGPWIAGSYYGGRDESKF

SEQ ID NO: 1455594 - protein, 21 aa, Mycobacterium tuberculosis
VRIKRGEVVVIYLAAANRDPA

SEQ ID NO: 1455595 - protein, 33 aa, Mycobacterium tuberculosis; identical to SEQ ID NO: 208144

SEQ ID NO: 1455596 - protein, 23 aa, Mycobacterium tuberculosis
VRMLKAGELVGVYPEATISRSFE

SEQ ID NO: 1455597 - protein, 20 aa, Mycobacterium tuberculosis
VRNGNRWRVIAVDTEHHRIA

SEQ ID NO: 1455598 - protein, 17 aa, Mycobacterium tuberculosis
VRPWPRSLANIFDEYTA

SEQ ID NO: 1455599 - protein, 28 aa, Mycobacterium tuberculosis
VRQLRLRDIGGIVVIDFIDMVLESNRDL

SEQ ID NO: 1455600 - protein, 29 aa, Mycobacterium tuberculosis
VRTCDCFNIPIVMLVDVPGFLPGTDQEYN

SEQ ID NO: 1455601 - protein, 24 aa, Mycobacterium tuberculosis
VRTWQGFCYTAFVTDVCTRKIVVW

SEQ ID NO: 1455602 - protein, 17 aa, Mycobacterium tuberculosis
VRVIVAGTWGFASHAEL

SEQ ID NO: 1455603 - protein, 21 aa, Mycobacterium tuberculosis
VSADTGEIFWGEPGTNGQHAF

SEQ ID NO: 1455604 - protein, 23 aa, Mycobacterium tuberculosis
VSEAWALLVSKLRAAKLRVPIND

SEQ ID NO: 1455605 - protein, 19 aa, Mycobacterium tuberculosis
VSEICRRLDGMPLAIELAA

SEQ ID NO: 1455606 - protein, 24 aa, Mycobacterium tuberculosis
VSEKAATFLVEYARKYRQTIAAAA

SEQ ID NO: 1455607 - protein, 20 aa, Mycobacterium tuberculosis
VSKTLGVTINDVFLACVAGA

SEQ ID NO: 1455608 - protein, 20 aa, Mycobacterium tuberculosis
VSMALRYEGWNITTAGDGSS

SEQ ID NO: 1455609 - protein, 18 aa, Mycobacterium tuberculosis
VSPVLWKKVAPKLSAGRV

SEQ ID NO: 1455610 - protein, 25 aa, Mycobacterium tuberculosis
VSSYTRSRFASAFGPAASLEYLPPG

SEQ ID NO: 1455611 - protein, 24 aa, Mycobacterium tuberculosis
VTALCPGPVPTEWAEIASAERFSI

SEQ ID NO: 1455612 - protein, 23 aa, Mycobacterium tuberculosis
VTDMAHFFYIHFGLPTYFKNVFE

SEQ ID NO: 1455613 - protein, 31 aa, Mycobacterium tuberculosis; identical to SEQ ID NO: 208243

SEQ ID NO: 1455614 - protein, 21 aa, Mycobacterium tuberculosis
VTELFPLLLSVMSTGVTFVRS

SEQ ID NO: 1455615 - protein, 21 aa, Mycobacterium tuberculosis
VTFPRDLTCRSEMESAVTELA

SEQ ID NO: 1455616 - protein, 24 aa, Mycobacterium tuberculosis
VTILEEARVPFLKDAFGADITSTG

SEQ ID NO: 1455617 - protein, 22 aa, Mycobacterium tuberculosis
VTKSGLSIREWLIGLREAGLDT

SEQ ID NO: 1455618 - protein, 25 aa, Mycobacterium tuberculosis
VTLAARLRLPIDVIATVPMAENMPS

SEQ ID NO: 1455619 - protein, 24 aa, Mycobacterium tuberculosis
VTPICCYHPPCGGGVQKMLSRKLG

SEQ ID NO: 1455620 - protein, 20 aa, Mycobacterium tuberculosis
VTPLRARIAERLDQSGPTVS

SEQ ID NO: 1455621 - protein, 29 aa, Mycobacterium tuberculosis
VTQRVGLPGIWYAGSHGFELTAPDGTHHQ

SEQ ID NO: 1455622 - protein, 27 aa, Mycobacterium tuberculosis
VTTTSWLKSRHSFSFGDHYDPDNTHHG

SEQ ID NO: 1455623 - protein, 19 aa, Mycobacterium tuberculosis
VVADRRLDVEFSVSAGEVL

SEQ ID NO: 1455624 - protein, 27 aa, Mycobacterium tuberculosis
VVAGVLRRLAAMRCYMRDINLGRETQP

SEQ ID NO: 1455625 - protein, 22 aa, Mycobacterium tuberculosis
VVARFQPVLGLEVHVELSTATK

SEQ ID NO: 1455626 - protein, 23 aa, Mycobacterium tuberculosis
VVDGAGAPLGWIDADGRRRHRGG

SEQ ID NO: 1455627 - protein, 28 aa, Mycobacterium tuberculosis
VVGHDWGAPVAWTFAWLHPDRCAGVVGI

SEQ ID NO: 1455628 - protein, 23 aa, Mycobacterium tuberculosis
VVKVARIAGQYAKPRSADIDALG

SEQ ID NO: 1455629 - protein, 24 aa, Mycobacterium tuberculosis
VVLKPAPDTPWCAAALGEIIVEHT

SEQ ID NO: 1455630 - protein, 18 aa, Mycobacterium tuberculosis
VVLRLRGVCKRYGSITAV

SEQ ID NO: 1455631 - protein, 22 aa, Mycobacterium tuberculosis
VVQRVPYFQVWNLTGQPAAVVP

SEQ ID NO: 1455632 - protein, 21 aa, Mycobacterium tuberculosis
VVRMLTSLLMFPGRDEADERA

SEQ ID NO: 1455633 - protein, 17 aa, Mycobacterium tuberculosis
VVRVRLVPGTGKFDLNG

SEQ ID NO: 1455634 - protein, 25 aa, Mycobacterium tuberculosis
VVVFKELRVLGALGVDATAYRAALD

SEQ ID NO: 1455635 - protein, 25 aa, Mycobacterium tuberculosis
VVVNCAGTGNAIRVLSRDGVFPLAA

SEQ ID NO: 1455636 - protein, 26 aa, Mycobacterium tuberculosis
VVVVGHSFGGAVAMHLAAARPDQVAA

SEQ ID NO: 1455637 - protein, 21 aa, Mycobacterium tuberculosis
VWAKEFFAEFARDGGEIRNGS

SEQ ID NO: 1455638 - protein, 20 aa, Mycobacterium tuberculosis
VWDRVCSALTPGNVVLADQG

SEQ ID NO: 1455639 - protein, 23 aa, Mycobacterium tuberculosis
VWGGWRTECWEDRFEEQLIRCNG

SEQ ID NO: 1455640 - protein, 20 aa, Mycobacterium tuberculosis
VWLSNLLAWLTRRASATDVS

SEQ ID NO: 1455641 - protein, 18 aa, Mycobacterium tuberculosis
VYCYGVLYHLSRPAEALA

SEQ ID NO: 1455642 - protein, 25 aa, Mycobacterium tuberculosis
VYEPPSRVLFTWDIGPTWRPETDLA

SEQ ID NO: 1455643 - protein, 29 aa, Mycobacterium tuberculosis
VYGIGGSWFRYAGGGKWNWQRDFFDFGHV

SEQ ID NO: 1455644 - protein, 25 aa, Mycobacterium tuberculosis
VYLLSRAPGALGLHAALTGAPFSGA

SEQ ID NO: 1455645 - protein, 26 aa, Mycobacterium tuberculosis
VYSDGRYSYQLSIYVIRVEQGTAVAV

SEQ ID NO: 1455646 - protein, 18 aa, Mycobacterium tuberculosis
VYVLSGLVDDFADGPDAV

SEQ ID NO: 1455647 - protein, 24 aa, Mycobacterium tuberculosis
WAAALRLAALSLRGGGDATQLLRG

SEQ ID NO: 1455648 - protein, 24 aa, Mycobacterium tuberculosis
WAAKRAALKLVHRVPRSAGRELAY

SEQ ID NO: 1455649 - protein, 21 aa, Mycobacterium tuberculosis
WAPLCAPCDLFTPTYEASSRK

SEQ ID NO: 1455650 - protein, 19 aa, Mycobacterium tuberculosis
WARSELDYIPGTTSVHSSG

SEQ ID NO: 1455651 - protein, 18 aa, Mycobacterium tuberculosis
WATPVTAFQRTALRDYEL

SEQ ID NO: 1455652 - protein, 19 aa, Mycobacterium tuberculosis
WDMVRPRPSSRPAAASLPD

SEQ ID NO: 1455653 - protein, 20 aa, Mycobacterium tuberculosis
WDRRPSWFRAVARMATGVKD

SEQ ID NO: 1455654 - protein, 17 aa, Mycobacterium tuberculosis
WEAFLGKDDDLYGFESV

SEQ ID NO: 1455655 - protein, 24 aa, Mycobacterium tuberculosis
WEAGHVRDVLAFYAASPERLSGRQ

SEQ ID NO: 1455656 - protein, 18 aa, Mycobacterium tuberculosis
WEALVCGGVTALPVPERL

SEQ ID NO: 1455657 - protein, 20 aa, Mycobacterium tuberculosis
WEFLDRLTSIALPRIRDFRG

SEQ ID NO: 1455658 - protein, 18 aa, Mycobacterium tuberculosis
WEFNQPWSVEEIEIGDPR

SEQ ID NO: 1455659 - protein, 17 aa, Mycobacterium tuberculosis
WFFEPDIAADIVGNLLF

SEQ ID NO: 1455660 - protein, 25 aa, Mycobacterium tuberculosis
WGAWSDIGQLGWWSASPARASALEE

SEQ ID NO: 1455661 - protein, 19 aa, Mycobacterium tuberculosis
WGGPISMAVAVERADRVRG

SEQ ID NO: 1455662 - protein, 24 aa, Mycobacterium tuberculosis
WHERETYDFFGIIFDGHPALTRIE

SEQ ID NO: 1455663 - protein, 18 aa, Mycobacterium tuberculosis
WIAAERGFIDAVIDPHET

SEQ ID NO: 1455664 - protein, 21 aa, Mycobacterium tuberculosis
WIVFEEEYFRAGAPGRASANG

SEQ ID NO: 1455665 - protein, 20 aa, Mycobacterium tuberculosis
WKIDEIRPAFIHVNPVTIPP

SEQ ID NO: 1455666 - protein, 22 aa, Mycobacterium tuberculosis
WKVCGTGVVTCRFTHVYPDGPA

SEQ ID NO: 1455667 - protein, 23 aa, Mycobacterium tuberculosis
WLDPQMTSPYAWYQYFVNTADAD

SEQ ID NO: 1455668 - protein, 17 aa, Mycobacterium tuberculosis
WLHRAAVDLVAVHADQA

SEQ ID NO: 1455669 - protein, 22 aa, Mycobacterium tuberculosis
WLTCTAESSALAAAQAMASAAA

SEQ ID NO: 1455670 - protein, 19 aa, Mycobacterium tuberculosis
WLVHRFKAQAVHYVTPTDD

SEQ ID NO: 1455671 - protein, 19 aa, Mycobacterium tuberculosis
WLVRQLAALLPELARYPST

SEQ ID NO: 1455672 - protein, 26 aa, Mycobacterium tuberculosis
WMCDRAVDLLLLETCVSYSGEDEPFL

SEQ ID NO: 1455673 - protein, 17 aa, Mycobacterium tuberculosis
WMGPSSITMAAAVAPYV

SEQ ID NO: 1455674 - protein, 20 aa, Mycobacterium tuberculosis
WMRELFPFDRVVHLANENPQ

SEQ ID NO: 1455675 - protein, 24 aa, Mycobacterium tuberculosis
WMVTAAKFEVEWPADPQRAGLVRS

SEQ ID NO: 1455676 - protein, 19 aa, Mycobacterium tuberculosis
WNFEFGWQATEAIVDTGRG

SEQ ID NO: 1455677 - protein, 20 aa, Mycobacterium tuberculosis
WPADVCALADAFELEEFGVV

SEQ ID NO: 1455678 - protein, 31 aa, Mycobacterium tuberculosis; identical to SEQ ID NO: 208557

SEQ ID NO: 1455679 - protein, 18 aa, Mycobacterium tuberculosis
WPVLVAAIAEWAKRGGRR

SEQ ID NO: 1455680 - protein, 24 aa, Mycobacterium tuberculosis
WQAGDPEAAFAHFGRRFDDLSTEI

SEQ ID NO: 1455681 - protein, 19 aa, Mycobacterium tuberculosis
WQALVNWSGTDPVAGELVA

SEQ ID NO: 1455682 - protein, 17 aa, Mycobacterium tuberculosis
WQHGVFIGATLGSEQTA

SEQ ID NO: 1455683 - protein, 21 aa, Mycobacterium tuberculosis
WRAACRSNPALAKGLSTHEGA

SEQ ID NO: 1455684 - protein, 17 aa, Mycobacterium tuberculosis
WRADTFVAGAPEPRHDE

SEQ ID NO: 1455685 - protein, 25 aa, Mycobacterium tuberculosis
WRQADKYDVPRICFVNKMDKIGADF

SEQ ID NO: 1455686 - protein, 26 aa, Mycobacterium tuberculosis
WRQLEARLNLLRVHASFLFEEVAINS

SEQ ID NO: 1455687 - protein, 27 aa, Mycobacterium tuberculosis
WSDVDVSEWPGIDWPATQSMAEQVLAE

SEQ ID NO: 1455688 - protein, 18 aa, Mycobacterium tuberculosis
WSKVHLFWGDERYVPEDD

SEQ ID NO: 1455689 - protein, 21 aa, Mycobacterium tuberculosis
WSLAGLRVGYALGSPDVLARL

SEQ ID NO: 1455690 - protein, 20 aa, Mycobacterium tuberculosis
WTGCRDFDELIVYCRRGAGT

SEQ ID NO: 1455691 - protein, 22 aa, Mycobacterium tuberculosis
WTKRLRAVDFTLGYEVRSVNAE

SEQ ID NO: 1455692 - protein, 18 aa, Mycobacterium tuberculosis
WTLADGRDLLFFSLPGHV

SEQ ID NO: 1455693 - protein, 19 aa, Mycobacterium tuberculosis
WTNPDCRFESGLGVFATTS

SEQ ID NO: 1455694 - protein, 24 aa, Mycobacterium tuberculosis
WTRVPYEVLERISTRITNEVAEVN

SEQ ID NO: 1455695 - protein, 17 aa, Mycobacterium tuberculosis
WVEFAANNDGTLPHFPL

SEQ ID NO: 1455696 - protein, 24 aa, Mycobacterium tuberculosis
WVNMLRCTLAAFGAGVGGADTVLV

SEQ ID NO: 1455697 - protein, 24 aa, Mycobacterium tuberculosis
WVPAHFPKDAWALGRFDGTPLYEH

SEQ ID NO: 1455698 - protein, 18 aa, Mycobacterium tuberculosis
WWAAPTILEHGTPEQIER

SEQ ID NO: 1455699 - protein, 17 aa, Mycobacterium tuberculosis
WYAARTLLRTEFGITRM

SEQ ID NO: 1455700 - protein, 20 aa, Mycobacterium tuberculosis
WYDHVFFISVWWGWQDHFRE

SEQ ID NO: 1455701 - protein, 20 aa, Mycobacterium tuberculosis
WYGQRFPKPLARTREYIDIV

SEQ ID NO: 1455702 - protein, 20 aa, Mycobacterium tuberculosis
WYIREVDPTTLLLTGLTRDG

SEQ ID NO: 1455703 - protein, 21 aa, Mycobacterium tuberculosis
YAAAGRYVLDRAIFDALRRID

SEQ ID NO: 1455704 - protein, 33 aa, Mycobacterium tuberculosis; identical to SEQ ID NO: 208695

SEQ ID NO: 1455705 - protein, 19 aa, Mycobacterium tuberculosis
YAAVGFEYGYTVGNPDAVV

SEQ ID NO: 1455706 - protein, 20 aa, Mycobacterium tuberculosis
YADAAAVCGCPVGTIRSRVA

SEQ ID NO: 1455707 - protein, 18 aa, Mycobacterium tuberculosis
YADLRPNNEIAAWEADLA

SEQ ID NO: 1455708 - protein, 22 aa, Mycobacterium tuberculosis
YAGAFPAWLAPVQVVGIPVADE

SEQ ID NO: 1455709 - protein, 27 aa, Mycobacterium tuberculosis
YALRSVNMFAPWIRRIFIATDSTPPPW

SEQ ID NO: 1455710 - protein, 18 aa, Mycobacterium tuberculosis
YALTEWQRILDVNLTGVF

SEQ ID NO: 1455711 - protein, 25 aa, Mycobacterium tuberculosis
YAMWERRLGVRIAQATHEIHAAGAS

SEQ ID NO: 1455712 - protein, 25 aa, Mycobacterium tuberculosis
YASREARAAYRWMRANQPVFRDRNG

SEQ ID NO: 1455713 - protein, 20 aa, Mycobacterium tuberculosis
YAVIDGEIWLETKAKSQKAV

SEQ ID NO: 1455714 - protein, 26 aa, Mycobacterium tuberculosis
YDDIPADVMPLDWYLHVRHAVHGDIA

SEQ ID NO: 1455715 - protein, 23 aa, Mycobacterium tuberculosis
YDDLKFSCGCREIRHFYHDGSMR

SEQ ID NO: 1455716 - protein, 21 aa, Mycobacterium tuberculosis
YDIYRGVVTYVRVVDGKISPR

SEQ ID NO: 1455717 - protein, 21 aa, Mycobacterium tuberculosis
YDLSAGFPLLTTKKVHFKSVA

SEQ ID NO: 1455718 - protein, 17 aa, Mycobacterium tuberculosis
YDRAIGYEAAYAGTSFA

SEQ ID NO: 1455719 - protein, 24 aa, Mycobacterium tuberculosis
YDVKRAETGIIYIDEVDKIARKSE

SEQ ID NO: 1455720 - protein, 25 aa, Mycobacterium tuberculosis
YELVDARLSAAGFAWYEVSNWCRPG

SEQ ID NO: 1455721 - protein, 17 aa, Mycobacterium tuberculosis
YEPEPGKPAPAAVSAGM

SEQ ID NO: 1455722 - protein, 21 aa, Mycobacterium tuberculosis
YEPWTMLGNLAFGLPSRLRLG

SEQ ID NO: 1455723 - protein, 25 aa, Mycobacterium tuberculosis
YFGDLRTGMMGVWIGAIQNMYPELG

SEQ ID NO: 1455724 - protein, 20 aa, Mycobacterium tuberculosis
YFLSRLDEWENVIAGRIAEA

SEQ ID NO: 1455725 - protein, 18 aa, Mycobacterium tuberculosis
YGAVWQREDVGVITTMID

SEQ ID NO: 1455726 - protein, 24 aa, Mycobacterium tuberculosis
YGEMWAQDTMAMFGYASSSATASR

SEQ ID NO: 1455727 - protein, 17 aa, Mycobacterium tuberculosis
YGLAEATLYVASRNSGD

SEQ ID NO: 1455728 - protein, 17 aa, Mycobacterium tuberculosis
YGMPRIAVYSATKHAVK

SEQ ID NO: 1455729 - protein, 24 aa, Mycobacterium tuberculosis
YGVVADPFGHHWSLGQPVREVNMD

SEQ ID NO: 1455730 - protein, 18 aa, Mycobacterium tuberculosis
YHALTWGPLMREIVYAAT

SEQ ID NO: 1455731 - protein, 24 aa, Mycobacterium tuberculosis
YHDHPRFQVPHVVASAPKVVIQEW

SEQ ID NO: 1455732 - protein, 23 aa, Mycobacterium tuberculosis
YHDVLRLPVDLVVTEKFAADSPP

SEQ ID NO: 1455733 - protein, 25 aa, Mycobacterium tuberculosis
YHSVRRWPRRGLRSLLTITIGDLVE

SEQ ID NO: 1455734 - protein, 23 aa, Mycobacterium tuberculosis
YHYYASKSLILFDIYRQAAEGTL

SEQ ID NO: 1455735 - protein, 17 aa, Mycobacterium tuberculosis
YISYLRKKIDSDREPMI

SEQ ID NO: 1455736 - protein, 20 aa, Mycobacterium tuberculosis
YKLWHPRAHLSARWKDGDQD

SEQ ID NO: 1455737 - protein, 19 aa, Mycobacterium tuberculosis
YLDAASLSPFVTWGTNPGQ

SEQ ID NO: 1455738 - protein, 18 aa, Mycobacterium tuberculosis
YLLEETYELLDAVRSGSV

SEQ ID NO: 1455739 - protein, 23 aa, Mycobacterium tuberculosis
YLMVSLRSLPLVMLIGRPEAQIP

SEQ ID NO: 1455740 - protein, 18 aa, Mycobacterium tuberculosis
YLTDMAHKYGIDRHIEFN

SEQ ID NO: 1455741 - protein, 17 aa, Mycobacterium tuberculosis
YNTFGFFAPHHQYASTR

SEQ ID NO: 1455742 - protein, 23 aa, Mycobacterium tuberculosis
YPERPGPVAARYHGRHQLNRYPD

SEQ ID NO: 1455743 - protein, 27 aa, Mycobacterium tuberculosis
YPFASLPRRCVRLEGAEDLLATMAGER

SEQ ID NO: 1455744 - protein, 19 aa, Mycobacterium tuberculosis
YPGDIKSVLLTAEQIQARI

SEQ ID NO: 1455745 - protein, 17 aa, Mycobacterium tuberculosis
YPGGVVMAGDRRSTQGN

SEQ ID NO: 1455746 - protein, 22 aa, Mycobacterium tuberculosis
YPGVRYRAFDLFEAGPDRIAQI

SEQ ID NO: 1455747 - protein, 24 aa, Mycobacterium tuberculosis
YPTASALAECLGQLLGGQHESSDD

SEQ ID NO: 1455748 - protein, 20 aa, Mycobacterium tuberculosis
YPVDLRFVLAPPVAPTEATN

SEQ ID NO: 1455749 - protein, 23 aa, Mycobacterium tuberculosis
YPVEVWGWDEAYLAVAPGTPDDP

SEQ ID NO: 1455750 - protein, 29 aa, Mycobacterium tuberculosis
YQHPTRLHWYVPRSIRWIDRLKGVSPEFV

SEQ ID NO: 1455751 - protein, 18 aa, Mycobacterium tuberculosis
YQPKVWAACRARGQDPDK

SEQ ID NO: 1455752 - protein, 19 aa, Mycobacterium tuberculosis
YQSAGHRVLAFFVSACSAP

SEQ ID NO: 1455753 - protein, 24 aa, Mycobacterium tuberculosis
YRAFNERSGMRFGQVQTRLTENAD

SEQ ID NO: 1455754 - protein, 20 aa, Mycobacterium tuberculosis
YRFNFGVAYDRSLLFGYALD

SEQ ID NO: 1455755 - protein, 20 aa, Mycobacterium tuberculosis
YRLDGVKSLIPAAADAELFI

SEQ ID NO: 1455756 - protein, 18 aa, Mycobacterium tuberculosis
YRRLDLWLDDYLGTHNDT

SEQ ID NO: 1455757 - protein, 21 aa, Mycobacterium tuberculosis
YRYFPEPDLEPVAPSRELVER

SEQ ID NO: 1455758 - protein, 23 aa, Mycobacterium tuberculosis
YSDSPSVEAFSRMFERDKNELRD

SEQ ID NO: 1455759 - protein, 24 aa, Mycobacterium tuberculosis
YSEYPRFHKLMAEMSGMVFDAALI

SEQ ID NO: 1455760 - protein, 17 aa, Mycobacterium tuberculosis
YSRDAKFTPAREALDNP

SEQ ID NO: 1455761 - protein, 19 aa, Mycobacterium tuberculosis
YSVAMARFVETFARVLGDP

SEQ ID NO: 1455762 - protein, 22 aa, Mycobacterium tuberculosis
YSVRSRQSWGIGDLTDLANLAL

SEQ ID NO: 1455763 - protein, 25 aa, Mycobacterium tuberculosis
YTSADIRALYAFKRYAWWPYTLVMR

SEQ ID NO: 1455764 - protein, 18 aa, Mycobacterium tuberculosis
YVDHGWPTTDPDDHAVSE

SEQ ID NO: 1455765 - protein, 17 aa, Mycobacterium tuberculosis
YVEGCLPAGELITTADG

SEQ ID NO: 1455766 - protein, 25 aa, Mycobacterium tuberculosis
YVINPRMVRGLDYYTKTAFEFVHDG

SEQ ID NO: 1455767 - protein, 18 aa, Mycobacterium tuberculosis
YVRDRTGDPNAWQTGLTP

SEQ ID NO: 1455768 - protein, 20 aa, Mycobacterium tuberculosis
YVVAELDYLVATRVGVDAEL

SEQ ID NO: 1455769 - protein, 20 aa, Mycobacterium tuberculosis
YWDKISVDLKPIYTAASAAE

SEQ ID NO: 1455770 - protein, 26 aa, Mycobacterium tuberculosis
YYHAELEWWTSPFVLAHGVPPDTLAS

SEQ ID NO: 1455771 - protein, 20 aa, Mycobacterium tuberculosis
YYRPELDGLPEMGLVGRQLW

SEQ ID NO: 1455772 - protein, 19 aa, Mycobacterium tuberculosis
YYTKTAFEFVHDGLGAQSG

SEQ ID NO: 1455773 - protein, 33 aa, Mycobacterium tuberculosis; identical to SEQ ID NO: 195708

SEQ ID NO: 1455774 - protein, 26 aa, Mycobacterium tuberculosis
AAADEIAELLLKWKKTPQRPVSLPLQ

SEQ ID NO: 1455775 - protein, 24 aa, Mycobacterium tuberculosis
AAAEAFGTAFAMTVPPSLVAANRS

SEQ ID NO: 1455776 - protein, 17 aa, Mycobacterium tuberculosis
AAAEVLAAAGFSVLLLP

SEQ ID NO: 1455777 - protein, 23 aa, Mycobacterium tuberculosis
AAAKAAILASIAFHTRVTADDVY

SEQ ID NO: 1455778 - protein, 20 aa, Mycobacterium tuberculosis
AAAKAMGIDKLRVIHTGMDP

SEQ ID NO: 1455779 - protein, 27 aa, Mycobacterium tuberculosis
AAANSWVDVFAHWRRAQGLPVSAIAWG

SEQ ID NO: 1455780 - protein, 24 aa, Mycobacterium tuberculosis
AAAQFPFDIIPTLLQGLATLSTQY

SEQ ID NO: 1455781 - protein, 23 aa, Mycobacterium tuberculosis
AAAQRLPFLPIRAGLGSSVPQFW

SEQ ID NO: 1455782 - protein, 24 aa, Mycobacterium tuberculosis
AAASEFRDGLCFVDLAPIADPGMV

SEQ ID NO: 1455783 - protein, 24 aa, Mycobacterium tuberculosis
AADDCGFATLWVGEHVVMVDRPAS

SEQ ID NO: 1455784 - protein, 25 aa, Mycobacterium tuberculosis
AADGKAKWSAPLGFLAQTPPALTPH

SEQ ID NO: 1455785 - protein, 18 aa, Mycobacterium tuberculosis
AADITVLCVVAAPEGIAA

SEQ ID NO: 1455786 - protein, 18 aa, Mycobacterium tuberculosis
AAFEISRDIIAISGDSAT

SEQ ID NO: 1455787 - protein, 18 aa, Mycobacterium tuberculosis
AAGDGMRSAYQGVQAGST

SEQ ID NO: 1455788 - protein, 22 aa, Mycobacterium tuberculosis
AAGHLPGAVSIPLDELAERLDE

SEQ ID NO: 1455789 - protein, 18 aa, Mycobacterium tuberculosis
AAGIGELTFFSKIHYGGG

SEQ ID NO: 1455790 - protein, 26 aa, Mycobacterium tuberculosis
AAGNYAQRLFPGMRVKYVSTEEFTND

SEQ ID NO: 1455791 - protein, 23 aa, Mycobacterium tuberculosis
AAHLVHPGDLVILIAYATMDDAR

SEQ ID NO: 1455792 - protein, 17 aa, Mycobacterium tuberculosis
AAIRLIYPREALWRPPV

SEQ ID NO: 1455793 - protein, 22 aa, Mycobacterium tuberculosis
AAKAEALKCAKGFRYYAENAEA

SEQ ID NO: 1455794 - protein, 27 aa, Mycobacterium tuberculosis
AALAMELGCDAVLLASAVTRAADPPAM

SEQ ID NO: 1455795 - protein, 23 aa, Mycobacterium tuberculosis
AALEAHPAVLLFSHRSYIDGVVV

SEQ ID NO: 1455796 - protein, 21 aa, Mycobacterium tuberculosis
AALRAALRASAARSLMNRMAE

SEQ ID NO: 1455797 - protein, 20 aa, Mycobacterium tuberculosis
AALREWRGPVLDDLRDFQFV

SEQ ID NO: 1455798 - protein, 25 aa, Mycobacterium tuberculosis
AALRRRLLQRFAIEPLAPVRDAEDA

SEQ ID NO: 1455799 - protein, 24 aa, Mycobacterium tuberculosis
AAMAEAVAPYVAWMSAAAAQAEQA

SEQ ID NO: 1455800 - protein, 17 aa, Mycobacterium tuberculosis
AAPTLGAGLDWKTSLQE

SEQ ID NO: 1455801 - protein, 23 aa, Mycobacterium tuberculosis
AAQASGIRYIGFRHEASAGNAAA

SEQ ID NO: 1455802 - protein, 19 aa, Mycobacterium tuberculosis
AAQCLAPGARLVFNAFLAN

SEQ ID NO: 1455803 - protein, 25 aa, Mycobacterium tuberculosis
AAQIRSIPTIMAFKNGKLLFNQAGA

SEQ ID NO: 1455804 - protein, 25 aa, Mycobacterium tuberculosis
AAQRAGLELLAFGGRFVEIGKADVY

SEQ ID NO: 1455805 - protein, 25 aa, Mycobacterium tuberculosis
AARKFGCGFAPSGWDSLTKHLQRKG

SEQ ID NO: 1455806 - protein, 18 aa, Mycobacterium tuberculosis
AASDVVAWVRSQLAADGV

SEQ ID NO: 1455807 - protein, 19 aa, Mycobacterium tuberculosis
AASIMAIVADIERYPEWNE

SEQ ID NO: 1455808 - protein, 19 aa, Mycobacterium tuberculosis
AATAARYGHREALVDMVAR

SEQ ID NO: 1455809 - protein, 25 aa, Mycobacterium tuberculosis
AATFGVAYLTAWHSLCEVGRLSPGE

SEQ ID NO: 1455810 - protein, 26 aa, Mycobacterium tuberculosis
AATIKRFADRFARFNLQERVIRPSYG

SEQ ID NO: 1455811 - protein, 18 aa, Mycobacterium tuberculosis
AATLERTGYSWGPLSLML

SEQ ID NO: 1455812 - protein, 26 aa, Mycobacterium tuberculosis
AAVGRRRLRGTINVVLPVPGDVRGLA

SEQ ID NO: 1455813 - protein, 19 aa, Mycobacterium tuberculosis
AAVKGIMYEDVPGFCKSAT

SEQ ID NO: 1455814 - protein, 26 aa, Mycobacterium tuberculosis
AAVTGLRYGNQVPLTYPFALTFPSVM

SEQ ID NO: 1455815 - protein, 17 aa, Mycobacterium tuberculosis
AAYGEWMATPPPTWEDI

SEQ ID NO: 1455816 - protein, 18 aa, Mycobacterium tuberculosis
ACALVGRPQLVFLDEPTA

SEQ ID NO: 1455817 - protein, 26 aa, Mycobacterium tuberculosis
ACERADAVLVLTEWREFIDLEPADLA

SEQ ID NO: 1455818 - protein, 31 aa, Mycobacterium tuberculosis; identical to SEQ ID NO: 195938

SEQ ID NO: 1455819 - protein, 25 aa, Mycobacterium tuberculosis
ACSTLRLTDLLPYVGPDYLVPKPLH

SEQ ID NO: 1455820 - protein, 17 aa, Mycobacterium tuberculosis
ACTHCNQCMATIYRRTH

SEQ ID NO: 1455821 - protein, 18 aa, Mycobacterium tuberculosis
ADAARLAVRMENDGATAW

SEQ ID NO: 1455822 - protein, 23 aa, Mycobacterium tuberculosis
ADDIRLRRMAVFDVLINNADRKG

SEQ ID NO: 1455823 - protein, 31 aa, Mycobacterium tuberculosis; identical to SEQ ID NO: 195980

SEQ ID NO: 1455824 - protein, 20 aa, Mycobacterium tuberculosis
ADGDHWILNGAKCWITNGGK

SEQ ID NO: 1455825 - protein, 25 aa, Mycobacterium tuberculosis
ADGGRAVLVLSDWPAPQAPQSASGE

SEQ ID NO: 1455826 - protein, 26 aa, Mycobacterium tuberculosis
ADGLDDCFRLLAGGVRGAVQRQQTLR

SEQ ID NO: 1455827 - protein, 19 aa, Mycobacterium tuberculosis
ADGRRPRILIAKMGQDGHD

SEQ ID NO: 1455828 - protein, 24 aa, Mycobacterium tuberculosis
ADGSYSLTGHKWFTSAPMCDIFLV

SEQ ID NO: 1455829 - protein, 17 aa, Mycobacterium tuberculosis
ADHRLPQGVTFIGQPLW

SEQ ID NO: 1455830 - protein, 27 aa, Mycobacterium tuberculosis
ADIARYNARCGRTFVLPNEQAAYDACI

SEQ ID NO: 1455831 - protein, 27 aa, Mycobacterium tuberculosis
ADLFHARVALWFIREVFEVMRATPQHT

SEQ ID NO: 1455832 - protein, 19 aa, Mycobacterium tuberculosis
ADLHMIGKDIIRFHAVYWP

SEQ ID NO: 1455833 - protein, 21 aa, Mycobacterium tuberculosis
ADLPEITHFVAGLGTTGTLMG

SEQ ID NO: 1455834 - protein, 22 aa, Mycobacterium tuberculosis
ADLSLLGKARKVVVTKDETTIV

SEQ ID NO: 1455835 - protein, 18 aa, Mycobacterium tuberculosis
ADPPDRPWNLLAGANALM

SEQ ID NO: 1455836 - protein, 22 aa, Mycobacterium tuberculosis
ADPRAPSLFIHRPDALARRIGR

SEQ ID NO: 1455837 - protein, 21 aa, Mycobacterium tuberculosis
ADRKGGHILCGIDGQVYGVDH

SEQ ID NO: 1455838 - protein, 22 aa, Mycobacterium tuberculosis
ADRRADGELARYVTAKEPWFLD

SEQ ID NO: 1455839 - protein, 25 aa, Mycobacterium tuberculosis
ADSRGQFPGRYRLAVLEKLSRVSSR

SEQ ID NO: 1455840 - protein, 18 aa, Mycobacterium tuberculosis
ADTWISTDYLFWRDDDGD

SEQ ID NO: 1455841 - protein, 19 aa, Mycobacterium tuberculosis
ADVGYRWFASTNQTPMFAF

SEQ ID NO: 1455842 - protein, 17 aa, Mycobacterium tuberculosis
AEARAILTAGLLGEEVP

SEQ ID NO: 1455843 - protein, 23 aa, Mycobacterium tuberculosis
AECLLDRNALIMGYSGVYSSFLK

SEQ ID NO: 1455844 - protein, 25 aa, Mycobacterium tuberculosis
AEFAELRSAAPIWWNGQDPGKGGGF

SEQ ID NO: 1455845 - protein, 22 aa, Mycobacterium tuberculosis
AEGDGGWDLTLRNMAKGYPHLT

SEQ ID NO: 1455846 - protein, 24 aa, Mycobacterium tuberculosis
AEGELYFPGSPVLSVRGSFAECVL

SEQ ID NO: 1455847 - protein, 18 aa, Mycobacterium tuberculosis
AEHLHVHVVPRWGGDANF

SEQ ID NO: 1455848 - protein, 24 aa, Mycobacterium tuberculosis
AEIDARLRLVVGRRGDLADQESLG

SEQ ID NO: 1455849 - protein, 18 aa, Mycobacterium tuberculosis
AEIVNAWNLQNHEVTAIV

SEQ ID NO: 1455850 - protein, 17 aa, Mycobacterium tuberculosis
AELARLAGRLDDATAQR

SEQ ID NO: 1455851 - protein, 26 aa, Mycobacterium tuberculosis
AELAYFEVLHELKLIVDLMYEGGLAR

SEQ ID NO: 1455852 - protein, 21 aa, Mycobacterium tuberculosis
AELLPELTLAQRWDLTASELA

SEQ ID NO: 1455853 - protein, 19 aa, Mycobacterium tuberculosis
AELLRACGDIDGLERVRFT

SEQ ID NO: 1455854 - protein, 19 aa, Mycobacterium tuberculosis
AEPGWARERGWPQFADRLL

SEQ ID NO: 1455855 - protein, 25 aa, Mycobacterium tuberculosis
AEPLPRTLVWSAAWEMTREAELRAR

SEQ ID NO: 1455856 - protein, 17 aa, Mycobacterium tuberculosis
AEPRYRDRIPILIGGGG

SEQ ID NO: 1455857 - protein, 21 aa, Mycobacterium tuberculosis
AEPTGVAAWQLARMNLARMTH

SEQ ID NO: 1455858 - protein, 22 aa, Mycobacterium tuberculosis
AEQEYRPFRALIQAALRHAGAV

SEQ ID NO: 1455859 - protein, 27 aa, Mycobacterium tuberculosis
AEQVGPMLADWAKWGQARHNYFLRPSD

SEQ ID NO: 1455860 - protein, 19 aa, Mycobacterium tuberculosis
AEREARLQRPLYVMPTKGI

SEQ ID NO: 1455861 - protein, 32 aa, Mycobacterium tuberculosis; identical to SEQ ID NO: 196207

SEQ ID NO: 1455862 - protein, 20 aa, Mycobacterium tuberculosis
AESGRRVRINDLWIAAVAAS

SEQ ID NO: 1455863 - protein, 21 aa, Mycobacterium tuberculosis
AESVAAWLLDHDRPAAVGLVG

SEQ ID NO: 1455864 - protein, 20 aa, Mycobacterium tuberculosis
AETVGPRLGVKASGGIRTAA

SEQ ID NO: 1455865 - protein, 34 aa, Mycobacterium tuberculosis; identical to SEQ ID NO: 196229

SEQ ID NO: 1455866 - protein, 19 aa, Mycobacterium tuberculosis
AEYTRVVLINGPRQAGKTT

SEQ ID NO: 1455867 - protein, 23 aa, Mycobacterium tuberculosis
AFAGPRFLMRIAELEMHPLDTRD

SEQ ID NO: 1455868 - protein, 24 aa, Mycobacterium tuberculosis
AFARAEQAVRCGIDIQDALRNSAK

SEQ ID NO: 1455869 - protein, 20 aa, Mycobacterium tuberculosis
AFATMGCLYPNRVFLGVGTG

SEQ ID NO: 1455870 - protein, 24 aa, Mycobacterium tuberculosis
AFDAGDFRWAATLLDHAVFADSEH

SEQ ID NO: 1455871 - protein, 21 aa, Mycobacterium tuberculosis
AFERDRIPLGASVLLVSGRAS

SEQ ID NO: 1455872 - protein, 23 aa, Mycobacterium tuberculosis
AFGASPRASLGIIAAARSLALVR

SEQ ID NO: 1455873 - protein, 19 aa, Mycobacterium tuberculosis
AFIAARRFAIPAVESKGAL

SEQ ID NO: 1455874 - protein, 19 aa, Mycobacterium tuberculosis
AFLATRLGGQWGGAYGTMP

SEQ ID NO: 1455875 - protein, 19 aa, Mycobacterium tuberculosis
AFQSVVWGLTTGSWIGSSA

SEQ ID NO: 1455876 - protein, 18 aa, Mycobacterium tuberculosis
AGAAAPYVGWLSAAAGQA

SEQ ID NO: 1455877 - protein, 26 aa, Mycobacterium tuberculosis
AGAFLRAGAINRILAYVAPILLGGPV

SEQ ID NO: 1455878 - protein, 21 aa, Mycobacterium tuberculosis
AGAVLKVIVESAVLLGQSNAH

SEQ ID NO: 1455879 - protein, 17 aa, Mycobacterium tuberculosis
AGDDEWCVISIRSDDEW

SEQ ID NO: 1455880 - protein, 22 aa, Mycobacterium tuberculosis
AGDKLWARMDIHSVDERFGADI

SEQ ID NO: 1455881 - protein, 20 aa, Mycobacterium tuberculosis
AGELALLRLACEAADAALTD

SEQ ID NO: 1455882 - protein, 20 aa, Mycobacterium tuberculosis
AGERGLCAGGDVVAVYHSAR

SEQ ID NO: 1455883 - protein, 23 aa, Mycobacterium tuberculosis
AGETLSALALRFYGDAELYRLIA

SEQ ID NO: 1455884 - protein, 17 aa, Mycobacterium tuberculosis
AGFRSLGLDGFRLEITS

SEQ ID NO: 1455885 - protein, 26 aa, Mycobacterium tuberculosis
AGGGGRGMRVVHELSALPAEVEAARR

SEQ ID NO: 1455886 - protein, 18 aa, Mycobacterium tuberculosis
AGGRGVGSAENFSVVEAL

SEQ ID NO: 1455887 - protein, 17 aa, Mycobacterium tuberculosis
AGGTLWVELTGMGVTWM

SEQ ID NO: 1455888 - protein, 25 aa, Mycobacterium tuberculosis
AGHFELRPGQALVITVPVSDAPYLG

SEQ ID NO: 1455889 - protein, 24 aa, Mycobacterium tuberculosis
AGHGRSGFLLAPWTAEQIVSELVS

SEQ ID NO: 1455890 - protein, 23 aa, Mycobacterium tuberculosis
AGMARLAVIAAKVITGRKLSRRP

SEQ ID NO: 1455891 - protein, 19 aa, Mycobacterium tuberculosis
AGMHPWGKWGNDFTEYGVV

SEQ ID NO: 1455892 - protein, 24 aa, Mycobacterium tuberculosis
AGMPGMPFGTMGGQGFGRAVPQYG

SEQ ID NO: 1455893 - protein, 19 aa, Mycobacterium tuberculosis
AGPADWALLGAALLGVGGS

SEQ ID NO: 1455894 - protein, 18 aa, Mycobacterium tuberculosis
AGPEIGVASTKTFLAQIA

SEQ ID NO: 1455895 - protein, 27 aa, Mycobacterium tuberculosis
AGPFDNWPLGWGFDHFWGFPSGAAGQY

SEQ ID NO: 1455896 - protein, 29 aa, Mycobacterium tuberculosis
AGPFGTTIAHGFMTLALLPRLQHQMYTVK

SEQ ID NO: 1455897 - protein, 24 aa, Mycobacterium tuberculosis
AGPRVRTAVLTKLYPTRSHTGAAQ

SEQ ID NO: 1455898 - protein, 28 aa, Mycobacterium tuberculosis
AGQGCAITTRLVVPRARYEEAVAIAAAT

SEQ ID NO: 1455899 - protein, 24 aa, Mycobacterium tuberculosis
AGQIAHCLAELVTLDTPTVSILLG

SEQ ID NO: 1455900 - protein, 21 aa, Mycobacterium tuberculosis
AGRDFTVDWVHLKLNDQAQRT

SEQ ID NO: 1455901 - protein, 24 aa, Mycobacterium tuberculosis
AGRIGFPAIVGIIADVLHAADQWA

SEQ ID NO: 1455902 - protein, 20 aa, Mycobacterium tuberculosis
AGSRATHIVVWATLDKSLGR

SEQ ID NO: 1455903 - protein, 41 aa, Mycobacterium tuberculosis; identical to SEQ ID NO: 196407

SEQ ID NO: 1455904 - protein, 20 aa, Mycobacterium tuberculosis
AGVARWTLDTAVAYAKVREQ

SEQ ID NO: 1455905 - protein, 18 aa, Mycobacterium tuberculosis
AGVGLAIGLFSPALLASA

SEQ ID NO: 1455906 - protein, 17 aa, Mycobacterium tuberculosis
AGYKVPRSLWFVDEVKR

SEQ ID NO: 1455907 - protein, 19 aa, Mycobacterium tuberculosis
AGYRLGEMVQVESWSHEWR

SEQ ID NO: 1455908 - protein, 20 aa, Mycobacterium tuberculosis
AHATAWYGLHELARIRAGDT

SEQ ID NO: 1455909 - protein, 26 aa, Mycobacterium tuberculosis
AHGIDTVVVGWGYGRADFIDKTSTTV

SEQ ID NO: 1455910 - protein, 17 aa, Mycobacterium tuberculosis
AHLRGGELTVRFRPNPE

SEQ ID NO: 1455911 - protein, 24 aa, Mycobacterium tuberculosis
AHLRNMAFYNFGLRLLKRARDADR

SEQ ID NO: 1455912 - protein, 21 aa, Mycobacterium tuberculosis
AHPAMKALVVCIELCSVNAVF

SEQ ID NO: 1455913 - protein, 24 aa, Mycobacterium tuberculosis
AHRFAEAVTAIWHGRVEIDRFNEL

SEQ ID NO: 1455914 - protein, 21 aa, Mycobacterium tuberculosis
AHVDGVPCCTHIGPDGSGHFV

SEQ ID NO: 1455915 - protein, 20 aa, Mycobacterium tuberculosis
AHWKAHKLDLAPVLHEPESA

SEQ ID NO: 1455916 - protein, 25 aa, Mycobacterium tuberculosis
AHYHKIHLYDAFGFTESRTVAPGRE

SEQ ID NO: 1455917 - protein, 18 aa, Mycobacterium tuberculosis
AIAQTWWSERFIAVLEDI

SEQ ID NO: 1455918 - protein, 24 aa, Mycobacterium tuberculosis
AIASCPPGRVEVVANYTAFLQLQR

SEQ ID NO: 1455919 - protein, 33 aa, Mycobacterium tuberculosis; identical to SEQ ID NO: 196473

SEQ ID NO: 1455920 - protein, 18 aa, Mycobacterium tuberculosis
AIDAERWLAEHAATGEAD

SEQ ID NO: 1455921 - protein, 33 aa, Mycobacterium tuberculosis; identical to SEQ ID NO: 196479

SEQ ID NO: 1455922 - protein, 19 aa, Mycobacterium tuberculosis
AIGCPLINIHHSFLPAFTG

SEQ ID NO: 1455923 - protein, 19 aa, Mycobacterium tuberculosis
AIGCVPWLSSEAVAETLLA

SEQ ID NO: 1455924 - protein, 18 aa, Mycobacterium tuberculosis
AILTAGLLGEEVPMPVLL

SEQ ID NO: 1455925 - protein, 26 aa, Mycobacterium tuberculosis
AINGHVRAGGFGLVGACDMVVAGPES

SEQ ID NO: 1455926 - protein, 20 aa, Mycobacterium tuberculosis
AIRVAGWIDKLGAVWVEGQL

SEQ ID NO: 1455927 - protein, 28 aa, Mycobacterium tuberculosis
AISDELWDLLPGYLIFRSIIPNRPPTQD

SEQ ID NO: 1455928 - protein, 18 aa, Mycobacterium tuberculosis
AITIGFDAGDGFLGRLRG

SEQ ID NO: 1455929 - protein, 17 aa, Mycobacterium tuberculosis
AIVGNCYIEIMPMGTRV

SEQ ID NO: 1455930 - protein, 21 aa, Mycobacterium tuberculosis
AKANEVALILVGHVTKDGAIA

SEQ ID NO: 1455931 - protein, 26 aa, Mycobacterium tuberculosis
AKFRPGPRRRLGVLVDHLVAGSKEAR

SEQ ID NO: 1455932 - protein, 28 aa, Mycobacterium tuberculosis
AKGESYPTAMLMVFKLHRDFDIAEALKH

SEQ ID NO: 1455933 - protein, 24 aa, Mycobacterium tuberculosis
AKKGLEFVRPVAVDLTYIPVVGHA

SEQ ID NO: 1455934 - protein, 20 aa, Mycobacterium tuberculosis
AKLRDELALVIKDLELACDK

SEQ ID NO: 1455935 - protein, 28 aa, Mycobacterium tuberculosis
AKPEYWLSQQGRLAHPMVLRPGDDHYRP

SEQ ID NO: 1455936 - protein, 26 aa, Mycobacterium tuberculosis
AKRASRLSAVVVRWSRARKRYERQGI

SEQ ID NO: 1455937 - protein, 21 aa, Mycobacterium tuberculosis
AKVPTMAALLIKESVNQTVDA

SEQ ID NO: 1455938 - protein, 24 aa, Mycobacterium tuberculosis
AKVVSERRLWLAVLRAQAELGVAV

SEQ ID NO: 1455939 - protein, 24 aa, Mycobacterium tuberculosis
AKYRRDKVGIVFQAFNLVSSLTAL

SEQ ID NO: 1455940 - protein, 20 aa, Mycobacterium tuberculosis
ALARRGCVYVSVNYRLGALG

SEQ ID NO: 1455941 - protein, 20 aa, Mycobacterium tuberculosis
ALCSPTRQALLTGRNHHSAG

SEQ ID NO: 1455942 - protein, 26 aa, Mycobacterium tuberculosis
ALDIYRIGQNVAWRRWTDIAFGLTSD

SEQ ID NO: 1455943 - protein, 23 aa, Mycobacterium tuberculosis
ALDKRLGADFELLDFDCGHMVPQ

SEQ ID NO: 1455944 - protein, 20 aa, Mycobacterium tuberculosis
ALDQRIGLRYAMPPMTDTNT

SEQ ID NO: 1455945 - protein, 25 aa, Mycobacterium tuberculosis
ALDRLRPMLDRALTVLIDAPEPLPA

SEQ ID NO: 1455946 - protein, 19 aa, Mycobacterium tuberculosis
ALESLPRGLALQISLDSAT

SEQ ID NO: 1455947 - protein, 20 aa, Mycobacterium tuberculosis
ALEVSGRLLLAGSSRRLAWW

SEQ ID NO: 1455948 - protein, 23 aa, Mycobacterium tuberculosis
ALGAGARAAHLVDWADDIDSAWL

SEQ ID NO: 1455949 - protein, 24 aa, Mycobacterium tuberculosis
ALGDCYSALTWLASLPAVDPARVA

SEQ ID NO: 1455950 - protein, 23 aa, Mycobacterium tuberculosis
ALGDLPLIYPFLVNDPGEGTQAK

SEQ ID NO: 1455951 - protein, 20 aa, Mycobacterium tuberculosis
ALGLSRAWDKATLRIVSKAR

SEQ ID NO: 1455952 - protein, 24 aa, Mycobacterium tuberculosis
ALGNEIVAFVLKNATRFGMQDVIW

SEQ ID NO: 1455953 - protein, 24 aa, Mycobacterium tuberculosis
ALLFPQPRCQVITGVGDFDPAIRR

SEQ ID NO: 1455954 - protein, 23 aa, Mycobacterium tuberculosis
ALLGDARWLASIATPGRDEVGEA

SEQ ID NO: 1455955 - protein, 18 aa, Mycobacterium tuberculosis
ALLHHARCPVAIIHSGNG

SEQ ID NO: 1455956 - protein, 24 aa, Mycobacterium tuberculosis
ALNNTRFWAPLSLTAEQKHSIDDP

SEQ ID NO: 1455957 - protein, 19 aa, Mycobacterium tuberculosis
ALPAIVARFAVGRPVRAVW

SEQ ID NO: 1455958 - protein, 24 aa, Mycobacterium tuberculosis
ALPAWVYIDHRVMPGRPRPGYLPR

SEQ ID NO: 1455959 - protein, 29 aa, Mycobacterium tuberculosis
ALPRPGDEAELFRAIALALERPLDPDRPL

SEQ ID NO: 1455960 - protein, 24 aa, Mycobacterium tuberculosis
ALQKMSFEVAWRILQATPVTATGL

SEQ ID NO: 1455961 - protein, 19 aa, Mycobacterium tuberculosis
ALQKYHWVEKINHVHTGGN

SEQ ID NO: 1455962 - protein, 23 aa, Mycobacterium tuberculosis
ALQRGMPVLGICRGTQVLNVALG

SEQ ID NO: 1455963 - protein, 17 aa, Mycobacterium tuberculosis
ALRDAGVDWRHVQLVAG

SEQ ID NO: 1455964 - protein, 19 aa, Mycobacterium tuberculosis
ALRSLCFDVLAVGEPGESS

SEQ ID NO: 1455965 - protein, 26 aa, Mycobacterium tuberculosis
ALTRIPRVGVDWSQTTSFDEDTTAML

SEQ ID NO: 1455966 - protein, 22 aa, Mycobacterium tuberculosis
ALWTALKTLYPVGITADSLTRK

SEQ ID NO: 1455967 - protein, 21 aa, Mycobacterium tuberculosis
ALYRVAFECAQDLAADSVVYA

SEQ ID NO: 1455968 - protein, 17 aa, Mycobacterium tuberculosis
AMFPHAIGLSAGMSNDL

SEQ ID NO: 1455969 - protein, 21 aa, Mycobacterium tuberculosis
AMGARATAFVVGFGAPAETPA

SEQ ID NO: 1455970 - protein, 26 aa, Mycobacterium tuberculosis
AMLMASQRTVICWAMGLTQHAHAVAT

SEQ ID NO: 1455971 - protein, 22 aa, Mycobacterium tuberculosis
ANASNARRIWAHAGVDDRVVCV

SEQ ID NO: 1455972 - protein, 17 aa, Mycobacterium tuberculosis
ANAVTVFFDGATLHALI

SEQ ID NO: 1455973 - protein, 23 aa, Mycobacterium tuberculosis
ANIEKYLGWSRRQIDLHNQGLRN

SEQ ID NO: 1455974 - protein, 18 aa, Mycobacterium tuberculosis
ANLTTLFFGPTGIPLPPP

SEQ ID NO: 1455975 - protein, 26 aa, Mycobacterium tuberculosis
ANPRTRSGIMALELLDGTPDWDRFRT

SEQ ID NO: 1455976 - protein, 18 aa, Mycobacterium tuberculosis
ANRLGLIDPDAWAFVWVV

SEQ ID NO: 1455977 - protein, 25 aa, Mycobacterium tuberculosis
APDIPRERFSALTRLDHNRAISQLA

SEQ ID NO: 1455978 - protein, 18 aa, Mycobacterium tuberculosis
APFSLSWMTAVGERTNRL

SEQ ID NO: 1455979 - protein, 22 aa, Mycobacterium tuberculosis
APNARPPVCKIMDYGKYKYEAA

SEQ ID NO: 1455980 - protein, 25 aa, Mycobacterium tuberculosis
APPPDVVQRLSALGLLVSITVTSVY

SEQ ID NO: 1455981 - protein, 19 aa, Mycobacterium tuberculosis
APRDELIAFFVASDVMLVT

SEQ ID NO: 1455982 - protein, 26 aa, Mycobacterium tuberculosis
APYVSSRWRPVFARLPFDEAVLLTKA

SEQ ID NO: 1455983 - protein, 20 aa, Mycobacterium tuberculosis
AQARAARPQFVVKDEAFTTV

SEQ ID NO: 1455984 - protein, 19 aa, Mycobacterium tuberculosis
AQLAPLVFEGTSFGGALMT

SEQ ID NO: 1455985 - protein, 17 aa, Mycobacterium tuberculosis
AQLRAKALWLRSRRRGV

SEQ ID NO: 1455986 - protein, 19 aa, Mycobacterium tuberculosis
AQRMVPRGRGHVINVASLA

SEQ ID NO: 1455987 - protein, 21 aa, Mycobacterium tuberculosis
ARADEALPFAAIAVGAALVRD

SEQ ID NO: 1455988 - protein, 17 aa, Mycobacterium tuberculosis
ARAFDALDALVASAAAR

SEQ ID NO: 1455989 - protein, 18 aa, Mycobacterium tuberculosis
ARAFFDFAAQHHIEVTTP

SEQ ID NO: 1455990 - protein, 24 aa, Mycobacterium tuberculosis
ARALIAVRGLHRFAAAEGLAELDV

SEQ ID NO: 1455991 - protein, 19 aa, Mycobacterium tuberculosis
ARALSLPSLPCEVAVNEPE

SEQ ID NO: 1455992 - protein, 24 aa, Mycobacterium tuberculosis
ARAPELHRSPVFAVAVVRETVGDR

SEQ ID NO: 1455993 - protein, 28 aa, Mycobacterium tuberculosis
ARARRLYASRGWLPWHGPTSVLAPTGPV

SEQ ID NO: 1455994 - protein, 21 aa, Mycobacterium tuberculosis
ARATQPLSVFFFDILHRDGTD

SEQ ID NO: 1455995 - protein, 24 aa, Mycobacterium tuberculosis
ARDRRQPLRFALGIMDEPRRHLQD

SEQ ID NO: 1455996 - protein, 25 aa, Mycobacterium tuberculosis
ARDWAPKVHGAWELHEATSGQPLDW

SEQ ID NO: 1455997 - protein, 17 aa, Mycobacterium tuberculosis
AREGFPAGTGWDQIPDD

SEQ ID NO: 1455998 - protein, 19 aa, Mycobacterium tuberculosis
ARESLDWLDAHLGRAPALR

SEQ ID NO: 1455999 - protein, 20 aa, Mycobacterium tuberculosis
ARFGPSVLYGVPNFFARVID

SEQ ID NO: 1456000 - protein, 25 aa, Mycobacterium tuberculosis
ARFPDAVRYSVRFAKPVLLPATAGL

SEQ ID NO: 1456001 - protein, 19 aa, Mycobacterium tuberculosis
ARGGSFVRISFAGPSGDIE

SEQ ID NO: 1456002 - protein, 19 aa, Mycobacterium tuberculosis
ARHSSGLSVQTFLRGIHVV

SEQ ID NO: 1456003 - protein, 18 aa, Mycobacterium tuberculosis
ARHWRRALAGAGLVAVSW

SEQ ID NO: 1456004 - protein, 17 aa, Mycobacterium tuberculosis
ARIDSLAARNSKLMETL

SEQ ID NO: 1456005 - protein, 26 aa, Mycobacterium tuberculosis
ARINNERIRLGIALPAAVAADLLAPR

SEQ ID NO: 1456006 - protein, 26 aa, Mycobacterium tuberculosis
ARIVKALGGRGVFGVELMINGDEVYF

SEQ ID NO: 1456007 - protein, 19 aa, Mycobacterium tuberculosis
ARKLWGLRGYAEVGTPEIA

SEQ ID NO: 1456008 - protein, 17 aa, Mycobacterium tuberculosis
ARLHRWRTATALPAGPA

SEQ ID NO: 1456009 - protein, 23 aa, Mycobacterium tuberculosis
ARLRPAPLRNPRFVVDVNLGQLA

SEQ ID NO: 1456010 - protein, 21 aa, Mycobacterium tuberculosis
ARLWFSPAPTRAFAPSRIRAA

SEQ ID NO: 1456011 - protein, 20 aa, Mycobacterium tuberculosis
ARPADIGWAAAFLASDAASY

SEQ ID NO: 1456012 - protein, 22 aa, Mycobacterium tuberculosis
ARPAGLPGSLATEFTLDLNPPE

SEQ ID NO: 1456013 - protein, 18 aa, Mycobacterium tuberculosis
ARPDLPPTPWLIPESAGL

SEQ ID NO: 1456014 - protein, 20 aa, Mycobacterium tuberculosis
ARPEFKAMFLDDLLNGSRKQ

SEQ ID NO: 1456015 - protein, 19 aa, Mycobacterium tuberculosis
ARPGVCLTTSGPGFLNGLP

SEQ ID NO: 1456016 - protein, 26 aa, Mycobacterium tuberculosis
ARQRAHAAWLWSRRRAVVAGNSAAAL

SEQ ID NO: 1456017 - protein, 25 aa, Mycobacterium tuberculosis
ARRAPELAGRGHLVRLWALPDGPDG

SEQ ID NO: 1456018 - protein, 20 aa, Mycobacterium tuberculosis
ARRIGRWRFVTLHHQVDTSR

SEQ ID NO: 1456019 - protein, 22 aa, Mycobacterium tuberculosis
ARSNHGTCANQCPIVDAGDRVE

SEQ ID NO: 1456020 - protein, 23 aa, Mycobacterium tuberculosis
ARVDQLPLIWQRLVDGGMESGHA

SEQ ID NO: 1456021 - protein, 18 aa, Mycobacterium tuberculosis
ASAEGAWIADIDGLRYLD

SEQ ID NO: 1456022 - protein, 21 aa, Mycobacterium tuberculosis
ASAGHIYAVIGLKDTTTGDTL

SEQ ID NO: 1456023 - protein, 23 aa, Mycobacterium tuberculosis
ASAWEIWGALLGGGRLVIVPESV

SEQ ID NO: 1456024 - protein, 19 aa, Mycobacterium tuberculosis
ASHQDRGWAVIDVETSGFR

SEQ ID NO: 1456025 - protein, 26 aa, Mycobacterium tuberculosis
ASIPVKRLRQAGVLDLLLALANETET

SEQ ID NO: 1456026 - protein, 25 aa, Mycobacterium tuberculosis
ASKNPKEHFDFFPLTVDVEERMYAA

SEQ ID NO: 1456027 - protein, 17 aa, Mycobacterium tuberculosis
ASLKQAERVKALALAGG

SEQ ID NO: 1456028 - protein, 19 aa, Mycobacterium tuberculosis
ASLPARLSAAQVWSQCHSY

SEQ ID NO: 1456029 - protein, 17 aa, Mycobacterium tuberculosis
ASMGGMIAQIFAARFAQ

SEQ ID NO: 1456030 - protein, 24 aa, Mycobacterium tuberculosis
ASRALAAAVGISWTSELLTVTGVD

SEQ ID NO: 1456031 - protein, 24 aa, Mycobacterium tuberculosis
ASSSRAGLGYEVIVSRLDDEANIA

SEQ ID NO: 1456032 - protein, 23 aa, Mycobacterium tuberculosis
ASVGKLSVPPVWSGPLPGSVTPG

SEQ ID NO: 1456033 - protein, 23 aa, Mycobacterium tuberculosis
ATAAFGRGECYVERYLDKPRHVE

SEQ ID NO: 1456034 - protein, 17 aa, Mycobacterium tuberculosis
ATACADCGVTVDRMPRV

SEQ ID NO: 1456035 - protein, 20 aa, Mycobacterium tuberculosis
ATASALGLVGVRELIQMRRP

SEQ ID NO: 1456036 - protein, 31 aa, Mycobacterium tuberculosis; identical to SEQ ID NO: 197142

SEQ ID NO: 1456037 - protein, 24 aa, Mycobacterium tuberculosis
ATDRFRLAVRELKWSASSPDIEAA

SEQ ID NO: 1456038 - protein, 27 aa, Mycobacterium tuberculosis
ATDVGCSWLPLYHDMGLAFVLSAALAG

SEQ ID NO: 1456039 - protein, 24 aa, Mycobacterium tuberculosis
ATHATELFAVFDIYRTRFGALLTA

SEQ ID NO: 1456040 - protein, 20 aa, Mycobacterium tuberculosis
ATMRGEFLWCQLFSEPGAGS

SEQ ID NO: 1456041 - protein, 28 aa, Mycobacterium tuberculosis
ATPELMPLPIALAHRLSRRLTEVRKNGV

SEQ ID NO: 1456042 - protein, 24 aa, Mycobacterium tuberculosis
ATPKRPVIFECVGVPGIIDGIIAS

SEQ ID NO: 1456043 - protein, 18 aa, Mycobacterium tuberculosis
ATPPPTWEDIGWLRELWG

SEQ ID NO: 1456044 - protein, 18 aa, Mycobacterium tuberculosis
ATPPRPGPQPPRIEPPES

SEQ ID NO: 1456045 - protein, 18 aa, Mycobacterium tuberculosis
ATPSRRGLVDVWPSRLRR

SEQ ID NO: 1456046 - protein, 24 aa, Mycobacterium tuberculosis
ATRPPAVLHRIRQTLAIQPVSIGS

SEQ ID NO: 1456047 - protein, 19 aa, Mycobacterium tuberculosis
ATRRLALTGTPFRSDDSPI

SEQ ID NO: 1456048 - protein, 25 aa, Mycobacterium tuberculosis
ATTDEPFAALAFKIATHPFFGKLTY

SEQ ID NO: 1456049 - protein, 18 aa, Mycobacterium tuberculosis
ATTNCFPMIQISGSSSRP

SEQ ID NO: 1456050 - protein, 24 aa, Mycobacterium tuberculosis
AVAAIRVAPFAAWCAEQGQEPDSP

SEQ ID NO: 1456051 - protein, 28 aa, Mycobacterium tuberculosis
AVAEGGRFACGGARPADREVGFYIEPTV

SEQ ID NO: 1456052 - protein, 20 aa, Mycobacterium tuberculosis
AVALGYDFLPGTTVNRYCSS

SEQ ID NO: 1456053 - protein, 17 aa, Mycobacterium tuberculosis
AVATSMPKRGVGAAVLI

SEQ ID NO: 1456054 - protein, 24 aa, Mycobacterium tuberculosis
AVCALEPYWEALRKVYAPFESGLP

SEQ ID NO: 1456055 - protein, 25 aa, Mycobacterium tuberculosis
AVDLRYLGSLTHGFLNLFQLGGGSA

SEQ ID NO: 1456056 - protein, 22 aa, Mycobacterium tuberculosis
AVDPYAIGVPGVYLCSQSAPPG

SEQ ID NO: 1456057 - protein, 26 aa, Mycobacterium tuberculosis
AVDTDLRWRIVTALATAGAIDADGPE

SEQ ID NO: 1456058 - protein, 20 aa, Mycobacterium tuberculosis
AVEEIVRFNPATEIEHLRVV

SEQ ID NO: 1456059 - protein, 18 aa, Mycobacterium tuberculosis
AVERVMVVRDRVRTEPPL

SEQ ID NO: 1456060 - protein, 20 aa, Mycobacterium tuberculosis
AVFERIWLRTTLLGAELQPF

SEQ ID NO: 1456061 - protein, 19 aa, Mycobacterium tuberculosis
AVFNGFLPAVARMRALDPV

SEQ ID NO: 1456062 - protein, 19 aa, Mycobacterium tuberculosis
AVHNAEFARGVAFAEERAE

SEQ ID NO: 1456063 - protein, 25 aa, Mycobacterium tuberculosis
AVIPRTRLAFVGALGPWGPLATPDI

SEQ ID NO: 1456064 - protein, 29 aa, Mycobacterium tuberculosis
AVLAHPGLPQAVPVTRLWLSKQQTSDLMA

SEQ ID NO: 1456065 - protein, 22 aa, Mycobacterium tuberculosis
AVLDRNGLRPSRIWVTDDGLVV

SEQ ID NO: 1456066 - protein, 24 aa, Mycobacterium tuberculosis
AVLGRLPMRAWLIGLRPMEGSPEG

SEQ ID NO: 1456067 - protein, 20 aa, Mycobacterium tuberculosis
AVLPGYGWIFPLGNGEVNIG

SEQ ID NO: 1456068 - protein, 18 aa, Mycobacterium tuberculosis
AVMLVCPDPAPLLDTVLK

SEQ ID NO: 1456069 - protein, 21 aa, Mycobacterium tuberculosis
AVPRRPVIRPIPVDDSGFTVE

SEQ ID NO: 1456070 - protein, 17 aa, Mycobacterium tuberculosis
AVQLACRAPSLHNSQPW

SEQ ID NO: 1456071 - protein, 18 aa, Mycobacterium tuberculosis
AVRADWRGQRLVSALLDA

SEQ ID NO: 1456072 - protein, 25 aa, Mycobacterium tuberculosis
AVRSYELPTRVLLISAHDEPAIVYQ

SEQ ID NO: 1456073 - protein, 17 aa, Mycobacterium tuberculosis
AVTEIRAALTALGMLDH

SEQ ID NO: 1456074 - protein, 20 aa, Mycobacterium tuberculosis
AVTGQFLWQNVFGVWPVSGE

SEQ ID NO: 1456075 - protein, 24 aa, Mycobacterium tuberculosis
AVTNPARWALLYGSPVPGYHAPPD

SEQ ID NO: 1456076 - protein, 25 aa, Mycobacterium tuberculosis
AVTPAVGALLCLLAKLSGGKAVAEV

SEQ ID NO: 1456077 - protein, 22 aa, Mycobacterium tuberculosis
AVVGGALAYLVVKTLINATQLL

SEQ ID NO: 1456078 - protein, 23 aa, Mycobacterium tuberculosis
AVVPRAHGSALFERGETQILGVT

SEQ ID NO: 1456079 - protein, 23 aa, Mycobacterium tuberculosis
AVYLADCRKLGITVLPPDVNESG

SEQ ID NO: 1456080 - protein, 37 aa, Mycobacterium tuberculosis; identical to SEQ ID NO: 197338

SEQ ID NO: 1456081 - protein, 23 aa, Mycobacterium tuberculosis
AWEPKTGAVGSLWDVVRDRRLNH

SEQ ID NO: 1456082 - protein, 23 aa, Mycobacterium tuberculosis
AYAEGLRALYLYTATFQDAAVAE

SEQ ID NO: 1456083 - protein, 20 aa, Mycobacterium tuberculosis
AYFNRLRCGTGDYIDFSRFD

SEQ ID NO: 1456084 - protein, 17 aa, Mycobacterium tuberculosis
AYRKLRGLVEPFAAQLG

SEQ ID NO: 1456085 - protein, 25 aa, Mycobacterium tuberculosis
AYVMDSWLRPVPDGVAGELYLAGAQ

SEQ ID NO: 1456086 - protein, 17 aa, Mycobacterium tuberculosis
CAIIPNPTVEQLADIAI

SEQ ID NO: 1456087 - protein, 18 aa, Mycobacterium tuberculosis
CALADAFELEEFGVVGHS

SEQ ID NO: 1456088 - protein, 22 aa, Mycobacterium tuberculosis
CALLGLDCVIYMGGIDTARQAL

SEQ ID NO: 1456089 - protein, 22 aa, Mycobacterium tuberculosis
CAREVAEVVAPVLGWTAADIDR

SEQ ID NO: 1456090 - protein, 24 aa, Mycobacterium tuberculosis
CCAPDDVLPAIAFAVAHTGKPVIV

SEQ ID NO: 1456091 - protein, 24 aa, Mycobacterium tuberculosis
CDQLMPEYLRFVKGVVDAQDMSLN

SEQ ID NO: 1456092 - protein, 17 aa, Mycobacterium tuberculosis
CDVCEALQVMVERTRAV

SEQ ID NO: 1456093 - protein, 27 aa, Mycobacterium tuberculosis
CESLYHFAWDEFCDWYLELAKTQLAQG

SEQ ID NO: 1456094 - protein, 20 aa, Mycobacterium tuberculosis
CGLAGLAVDTDLRWRIVTAL

SEQ ID NO: 1456095 - protein, 18 aa, Mycobacterium tuberculosis
CLTLDYDTMRGMDSGEYR

SEQ ID NO: 1456096 - protein, 19 aa, Mycobacterium tuberculosis
CLTRTLSCRIFRRRRELPV

SEQ ID NO: 1456097 - protein, 18 aa, Mycobacterium tuberculosis
CNAMSRLGGVTLSKAGLR

SEQ ID NO: 1456098 - protein, 19 aa, Mycobacterium tuberculosis
CPFIPGRVPEDLLAMVVAV

SEQ ID NO: 1456099 - protein, 29 aa, Mycobacterium tuberculosis
CPGVVRTRLAEALWKDHEDPLAATIALGR

SEQ ID NO: 1456100 - protein, 21 aa, Mycobacterium tuberculosis
CQTFRRNRRWALLENAPVMNE

SEQ ID NO: 1456101 - protein, 17 aa, Mycobacterium tuberculosis
CRAGALLLRGSPCAIGW

SEQ ID NO: 1456102 - protein, 19 aa, Mycobacterium tuberculosis
CRLIRRHGRVMVICSDPRH

SEQ ID NO: 1456103 - protein, 19 aa, Mycobacterium tuberculosis
CTAGHPPPLLVTADASARY

SEQ ID NO: 1456104 - protein, 17 aa, Mycobacterium tuberculosis
CTNRASYVVHLHAVDEC

SEQ ID NO: 1456105 - protein, 25 aa, Mycobacterium tuberculosis
CVGMQILFACGVEFGVQTPGCGHWP

SEQ ID NO: 1456106 - protein, 25 aa, Mycobacterium tuberculosis
CVLERFRAIKPWLVGGRVHAPFWEV

SEQ ID NO: 1456107 - protein, 18 aa, Mycobacterium tuberculosis
CVTACPVSAIAPNTRLDF

SEQ ID NO: 1456108 - protein, 17 aa, Mycobacterium tuberculosis
DAARVSAAVADRCSWRR

SEQ ID NO: 1456109 - protein, 28 aa, Mycobacterium tuberculosis
DAAVLPSHYEPFGLVALEAAAAGTPLVT

SEQ ID NO: 1456110 - protein, 18 aa, Mycobacterium tuberculosis
DADWFRTYFHEVGPSIST

SEQ ID NO: 1456111 - protein, 24 aa, Mycobacterium tuberculosis
DAEGLLPAITFVFSRAGCDAAVTQ

SEQ ID NO: 1456112 - protein, 23 aa, Mycobacterium tuberculosis
DAEKYRRLHVIVGDSNMSETTTM

SEQ ID NO: 1456113 - protein, 27 aa, Mycobacterium tuberculosis
DAHGFAAFYRRCRLVTARLWPTLIEPL

SEQ ID NO: 1456114 - protein, 26 aa, Mycobacterium tuberculosis
DAKRLVDFAAGLAFALRGSFDKVATK

SEQ ID NO: 1456115 - protein, 18 aa, Mycobacterium tuberculosis
DALIGPDVTREWVSDLPS

SEQ ID NO: 1456116 - protein, 24 aa, Mycobacterium tuberculosis
DAMGHPRWWFDLLTTEPLAFASLD

SEQ ID NO: 1456117 - protein, 17 aa, Mycobacterium tuberculosis
DAPVPGTGAGVFTGIAG

SEQ ID NO: 1456118 - protein, 19 aa, Mycobacterium tuberculosis
DAQRRVHRVWADIRNEVLG

SEQ ID NO: 1456119 - protein, 19 aa, Mycobacterium tuberculosis
DASERTLRLLVPADGVPRV

SEQ ID NO: 1456120 - protein, 24 aa, Mycobacterium tuberculosis
DATVEVAIRLGVDPRKADQMVRGT

SEQ ID NO: 1456121 - protein, 25 aa, Mycobacterium tuberculosis
DAVAEMTVALLLAVARHLIPADADV

SEQ ID NO: 1456122 - protein, 18 aa, Mycobacterium tuberculosis
DAVALRQALADGIIDCVA

SEQ ID NO: 1456123 - protein, 23 aa, Mycobacterium tuberculosis
DAVTGMAGLLAWSQAPTRALGRF

SEQ ID NO: 1456124 - protein, 19 aa, Mycobacterium tuberculosis
DAYFARFGGVRDYLRAVVE

SEQ ID NO: 1456125 - protein, 20 aa, Mycobacterium tuberculosis
DAYGRYMIRVKEMWESMKIV

SEQ ID NO: 1456126 - protein, 17 aa, Mycobacterium tuberculosis
DAYRFLPTLGEVDLHLF

SEQ ID NO: 1456127 - protein, 26 aa, Mycobacterium tuberculosis
DCGAELLVEIARFWVGLAKLDDSRGR

SEQ ID NO: 1456128 - protein, 22 aa, Mycobacterium tuberculosis
DCTGLLPLASVAAMQGRIAMYH

SEQ ID NO: 1456129 - protein, 18 aa, Mycobacterium tuberculosis
DDAVALYVKAMTRLPQLT

SEQ ID NO: 1456130 - protein, 18 aa, Mycobacterium tuberculosis
DDCVFDYEAQLLAAPELD

SEQ ID NO: 1456131 - protein, 23 aa, Mycobacterium tuberculosis
DDEQRKRLLAGLLTGARIGTIAV

SEQ ID NO: 1456132 - protein, 22 aa, Mycobacterium tuberculosis
DDEWPVLAFAAFSGAGARARPC

SEQ ID NO: 1456133 - protein, 24 aa, Mycobacterium tuberculosis
DDEYRRIRQILGRRPTDTELAMYS

SEQ ID NO: 1456134 - protein, 19 aa, Mycobacterium tuberculosis
DDGDIGLIIAVKRLAAAKT

SEQ ID NO: 1456135 - protein, 24 aa, Mycobacterium tuberculosis
DDGIGLDEYVDWLIEAGYPIRRID

SEQ ID NO: 1456136 - protein, 17 aa, Mycobacterium tuberculosis
DDGLPVIRVPAGTPPIT

SEQ ID NO: 1456137 - protein, 17 aa, Mycobacterium tuberculosis
DDLLLPIVKGVGSERAY

SEQ ID NO: 1456138 - protein, 32 aa, Mycobacterium tuberculosis; identical to SEQ ID NO: 197653

SEQ ID NO: 1456139 - protein, 19 aa, Mycobacterium tuberculosis
DDPRSWIAQPMMELSTVPT

SEQ ID NO: 1456140 - protein, 26 aa, Mycobacterium tuberculosis
DDVYDAAAAWARRFLDGPPHALAAAK

SEQ ID NO: 1456141 - protein, 20 aa, Mycobacterium tuberculosis
DEDAARRCVDLTLERFGSVD

SEQ ID NO: 1456142 - protein, 25 aa, Mycobacterium tuberculosis
DEGFHAATVRRIRPGEQLVLGDGVG

SEQ ID NO: 1456143 - protein, 20 aa, Mycobacterium tuberculosis
DEIFGPVVVVLTFDDEADAI

SEQ ID NO: 1456144 - protein, 17 aa, Mycobacterium tuberculosis
DELCAPGSRVALGALGS

SEQ ID NO: 1456145 - protein, 24 aa, Mycobacterium tuberculosis
DELDAIRIGRRIVARLNWIKQGPA

SEQ ID NO: 1456146 - protein, 18 aa, Mycobacterium tuberculosis
DELDRLGVRLRLDDTGAL

SEQ ID NO: 1456147 - protein, 17 aa, Mycobacterium tuberculosis
DELGRILGVKGRVLPMC

SEQ ID NO: 1456148 - protein, 19 aa, Mycobacterium tuberculosis
DELKRVLEALLLVIDTPVT

SEQ ID NO: 1456149 - protein, 24 aa, Mycobacterium tuberculosis
DELPLPRPRYEIFVYSPRVEGVHL

SEQ ID NO: 1456150 - protein, 21 aa, Mycobacterium tuberculosis
DENRIAALLAARCPIDGFGVG

SEQ ID NO: 1456151 - protein, 22 aa, Mycobacterium tuberculosis
DEPCSSLDPISTMAIEDLISEL

SEQ ID NO: 1456152 - protein, 25 aa, Mycobacterium tuberculosis
DEQMSALLMAIVWRGMDRGEIARWT

SEQ ID NO: 1456153 - protein, 27 aa, Mycobacterium tuberculosis
DEVICAFGRIGSMFACEDLGYVPDMIT

SEQ ID NO: 1456154 - protein, 19 aa, Mycobacterium tuberculosis
DEVKIQMEAAGMCRSDHHL

SEQ ID NO: 1456155 - protein, 27 aa, Mycobacterium tuberculosis
DEWCVISIRSDDEWRRATSVFGQPELA

SEQ ID NO: 1456156 - protein, 25 aa, Mycobacterium tuberculosis
DFAQYWSEICQIPISFITETVKRAQ

SEQ ID NO: 1456157 - protein, 26 aa, Mycobacterium tuberculosis
DFCDKALEGFTMFALNQGEVCTCPSR

SEQ ID NO: 1456158 - protein, 19 aa, Mycobacterium tuberculosis
DFESIRWRLDVWNASAQVS

SEQ ID NO: 1456159 - protein, 18 aa, Mycobacterium tuberculosis
DFFAELTIYTSSACLIGK

SEQ ID NO: 1456160 - protein, 24 aa, Mycobacterium tuberculosis
DFGAAGPRSSWRATDPVLYAMSGA

SEQ ID NO: 1456161 - protein, 20 aa, Mycobacterium tuberculosis
DFGKREVMMVHTLLWPDEIR

SEQ ID NO: 1456162 - protein, 28 aa, Mycobacterium tuberculosis
DFISEKRFDFAFSLNVMEHIDLPDEAVR

SEQ ID NO: 1456163 - protein, 17 aa, Mycobacterium tuberculosis
DFRLYELIWQRTVASQM

SEQ ID NO: 1456164 - protein, 22 aa, Mycobacterium tuberculosis
DGALDRCVLCDLTGKRVDVKEA

SEQ ID NO: 1456165 - protein, 18 aa, Mycobacterium tuberculosis
DGAVFRKRVPGPHFDAGI

SEQ ID NO: 1456166 - protein, 18 aa, Mycobacterium tuberculosis
DGGFLQSVRLCVDRLGFA

SEQ ID NO: 1456167 - protein, 18 aa, Mycobacterium tuberculosis
DGGLACWTTALLHSRLVR

SEQ ID NO: 1456168 - protein, 19 aa, Mycobacterium tuberculosis
DGGQGWPAAALGPAQRAVA

SEQ ID NO: 1456169 - protein, 21 aa, Mycobacterium tuberculosis
DGLYDLLGIGIPNQGGILYSS

SEQ ID NO: 1456170 - protein, 17 aa, Mycobacterium tuberculosis
DGMEPYLGVAVHGFPNY

SEQ ID NO: 1456171 - protein, 40 aa, Mycobacterium tuberculosis; identical to SEQ ID NO: 197783

SEQ ID NO: 1456172 - protein, 23 aa, Mycobacterium tuberculosis
DGSHAAITAALWGVDEAISRAVP

SEQ ID NO: 1456173 - protein, 18 aa, Mycobacterium tuberculosis
DGSVWARVRLSDGEVIDA

SEQ ID NO: 1456174 - protein, 18 aa, Mycobacterium tuberculosis
DGSWHIDGVKRFITSGDS

SEQ ID NO: 1456175 - protein, 22 aa, Mycobacterium tuberculosis
DGTELPADLVVVGIGSTPATEW

SEQ ID NO: 1456176 - protein, 20 aa, Mycobacterium tuberculosis
DGTVIWTLPGDQTYVTTPGS

SEQ ID NO: 1456177 - protein, 17 aa, Mycobacterium tuberculosis
DGYEWSQVYEKSEPLGL

SEQ ID NO: 1456178 - protein, 25 aa, Mycobacterium tuberculosis
DHELDVWSLTDLVAFSTNSQGGSSI

SEQ ID NO: 1456179 - protein, 27 aa, Mycobacterium tuberculosis
DHPGDPWTVPKFYWTVLGLSALISGAR

SEQ ID NO: 1456180 - protein, 23 aa, Mycobacterium tuberculosis
DHRRIPGPLPLHPSADRRGIHSA

SEQ ID NO: 1456181 - protein, 19 aa, Mycobacterium tuberculosis
DIEDVFAGLGLSLFPGTAR

SEQ ID NO: 1456182 - protein, 30 aa, Mycobacterium tuberculosis; identical to SEQ ID NO: 197836

SEQ ID NO: 1456183 - protein, 33 aa, Mycobacterium tuberculosis; identical to SEQ ID NO: 197843

SEQ ID NO: 1456184 - protein, 25 aa, Mycobacterium tuberculosis
DILQKEGLNWVTWVVGETTYSPLPA

SEQ ID NO: 1456185 - protein, 25 aa, Mycobacterium tuberculosis
DINVKIDKGEFVFLIGPSGSGKSTF

SEQ ID NO: 1456186 - protein, 26 aa, Mycobacterium tuberculosis
DIPDNEFRVVLARRGQHWVSAVRVGN

SEQ ID NO: 1456187 - protein, 23 aa, Mycobacterium tuberculosis
DITKEVLGALGITVLSEPGFEAD

SEQ ID NO: 1456188 - protein, 17 aa, Mycobacterium tuberculosis
DITPGDLATIWRGGCII

SEQ ID NO: 1456189 - protein, 24 aa, Mycobacterium tuberculosis
DIVAYCRGAYCVMAPDAVRIARDA

SEQ ID NO: 1456190 - protein, 25 aa, Mycobacterium tuberculosis
DIWGKRRLAYEIAKHAEGIYVVIDV

SEQ ID NO: 1456191 - protein, 18 aa, Mycobacterium tuberculosis
DIYDEFLELAAIRTKAVR

SEQ ID NO: 1456192 - protein, 24 aa, Mycobacterium tuberculosis
DKGDRLAYNRVWVKALGEMPDDPV

SEQ ID NO: 1456193 - protein, 17 aa, Mycobacterium tuberculosis
DKLRPGPTMISDRKLAW

SEQ ID NO: 1456194 - protein, 24 aa, Mycobacterium tuberculosis
DKPDLRFGLELVECTDFFSDTTFR

SEQ ID NO: 1456195 - protein, 21 aa, Mycobacterium tuberculosis
DKPLMRRKLAEMVVDVEAALA

SEQ ID NO: 1456196 - protein, 21 aa, Mycobacterium tuberculosis
DKRIPLELCPSSNVQTGAVAS

SEQ ID NO: 1456197 - protein, 22 aa, Mycobacterium tuberculosis
DKTGHPFLQHLLAHRDVTRLKV

SEQ ID NO: 1456198 - protein, 19 aa, Mycobacterium tuberculosis
DKVVLGFLGCRDTLPHLQR

SEQ ID NO: 1456199 - protein, 19 aa, Mycobacterium tuberculosis
DLADEVFTWARAVSAEVDP

SEQ ID NO: 1456200 - protein, 25 aa, Mycobacterium tuberculosis
DLDDALRSWLAFGAEKVREVVVLAR

SEQ ID NO: 1456201 - protein, 18 aa, Mycobacterium tuberculosis
DLDFARSIAEQGHLPAEV

SEQ ID NO: 1456202 - protein, 18 aa, Mycobacterium tuberculosis
DLDHPPVLLIMGLGAQML

SEQ ID NO: 1456203 - protein, 21 aa, Mycobacterium tuberculosis
DLFRYPGIRSDSDMYTLGFRF

SEQ ID NO: 1456204 - protein, 20 aa, Mycobacterium tuberculosis
DLGALAWRGLLDRTDIDPAA

SEQ ID NO: 1456205 - protein, 32 aa, Mycobacterium tuberculosis; identical to SEQ ID NO: 197905

SEQ ID NO: 1456206 - protein, 38 aa, Mycobacterium tuberculosis; identical to SEQ ID NO: 197909

SEQ ID NO: 1456207 - protein, 20 aa, Mycobacterium tuberculosis
DLLIGWRLLVLAGVAHAALA

SEQ ID NO: 1456208 - protein, 17 aa, Mycobacterium tuberculosis
DLLRPVLNMPRHPIRLA

SEQ ID NO: 1456209 - protein, 25 aa, Mycobacterium tuberculosis
DLMRRLREDPPRRLAGFPATVTDIG

SEQ ID NO: 1456210 - protein, 18 aa, Mycobacterium tuberculosis
DLQPGSSIMPGKVNPVLP

SEQ ID NO: 1456211 - protein, 21 aa, Mycobacterium tuberculosis
DLRGLLGAFMFTGPQLEQPAG

SEQ ID NO: 1456212 - protein, 22 aa, Mycobacterium tuberculosis
DLRGRFRWWGLYTQREQGYDGT

SEQ ID NO: 1456213 - protein, 20 aa, Mycobacterium tuberculosis
DLRHDWPDALRRGGFDAAEP

SEQ ID NO: 1456214 - protein, 17 aa, Mycobacterium tuberculosis
DLRRIAVVTPRQLVGPR

SEQ ID NO: 1456215 - protein, 23 aa, Mycobacterium tuberculosis
DLSTLRLIPWLPGTALVIADLVW

SEQ ID NO: 1456216 - protein, 26 aa, Mycobacterium tuberculosis
DMIMELLDAFGIAMAGAPGFEADDVL

SEQ ID NO: 1456217 - protein, 22 aa, Mycobacterium tuberculosis
DNGIKIFGPGGHKLDDDTEDQI

SEQ ID NO: 1456218 - protein, 24 aa, Mycobacterium tuberculosis
DNGRIRYKRVCEACGEVVDYRDLA

SEQ ID NO: 1456219 - protein, 17 aa, Mycobacterium tuberculosis
DNSGLDWGALGECDYLY

SEQ ID NO: 1456220 - protein, 40 aa, Mycobacterium tuberculosis; identical to SEQ ID NO: 197971

SEQ ID NO: 1456221 - protein, 25 aa, Mycobacterium tuberculosis
DNVIREFVEHTGIPFLPMSMAKGLL

SEQ ID NO: 1456222 - protein, 26 aa, Mycobacterium tuberculosis
DPADPRLSPLLAESLSGLAPALIAVA

SEQ ID NO: 1456223 - protein, 24 aa, Mycobacterium tuberculosis
DPAEWKVFLNLLRTRFETDKDKWT

SEQ ID NO: 1456224 - protein, 22 aa, Mycobacterium tuberculosis
DPAIRRKPSIFVLEDAPWSAFR

SEQ ID NO: 1456225 - protein, 26 aa, Mycobacterium tuberculosis
DPDGRLAALLRFSADRAADWYSLGLR

SEQ ID NO: 1456226 - protein, 23 aa, Mycobacterium tuberculosis
DPDLTPALASMVFVARPPTATPT

SEQ ID NO: 1456227 - protein, 25 aa, Mycobacterium tuberculosis
DPGPACYRGGGPLCVTDANVMLGRI

SEQ ID NO: 1456228 - protein, 25 aa, Mycobacterium tuberculosis
DPIDIAYPVLWRNLTAIVASVLDAI

SEQ ID NO: 1456229 - protein, 24 aa, Mycobacterium tuberculosis
DPKFSGQLALHFKATIGEDVLSRL

SEQ ID NO: 1456230 - protein, 19 aa, Mycobacterium tuberculosis
DPQVPLPGFVLKRAIKGTI

SEQ ID NO: 1456231 - protein, 17 aa, Mycobacterium tuberculosis
DPRHPVTVDARRIGRWR

SEQ ID NO: 1456232 - protein, 21 aa, Mycobacterium tuberculosis
DPSGNCLEVFHGTALEHRRVV

SEQ ID NO: 1456233 - protein, 24 aa, Mycobacterium tuberculosis
DQLDALCALGLQSRIVAAALPNSS

SEQ ID NO: 1456234 - protein, 26 aa, Mycobacterium tuberculosis
DQRWPETRIDPSLTRISALMDLLGSP

SEQ ID NO: 1456235 - protein, 18 aa, Mycobacterium tuberculosis
DQVRCLLAGELGPELGPV

SEQ ID NO: 1456236 - protein, 27 aa, Mycobacterium tuberculosis
DRAIPRGVGTAGVWRLPDRNTLQEVLT

SEQ ID NO: 1456237 - protein, 20 aa, Mycobacterium tuberculosis
DREGELFVPVELDIDAVSHL

SEQ ID NO: 1456238 - protein, 19 aa, Mycobacterium tuberculosis
DREKHGALRGSMTVLAVNT

SEQ ID NO: 1456239 - protein, 24 aa, Mycobacterium tuberculosis
DRGRPLWEVWVIEGLADSKWAILT

SEQ ID NO: 1456240 - protein, 20 aa, Mycobacterium tuberculosis
DRIVSFEAFDAFKKERYLTF

SEQ ID NO: 1456241 - protein, 25 aa, Mycobacterium tuberculosis
DRIVSIGAFEAFKMERYAAFFERSY

SEQ ID NO: 1456242 - protein, 20 aa, Mycobacterium tuberculosis
DRIVSLGAFEHFADGAGDAG

SEQ ID NO: 1456243 - protein, 18 aa, Mycobacterium tuberculosis
DRLGYVVGLILAGANEPS

SEQ ID NO: 1456244 - protein, 18 aa, Mycobacterium tuberculosis
DRMLARLSSTVAVVPELR

SEQ ID NO: 1456245 - protein, 31 aa, Mycobacterium tuberculosis; identical to SEQ ID NO: 198107

SEQ ID NO: 1456246 - protein, 21 aa, Mycobacterium tuberculosis
DRPVMPARFLILGSASPDLVG

SEQ ID NO: 1456247 - protein, 20 aa, Mycobacterium tuberculosis
DRRSALLPLLHLVQGEDSYL

SEQ ID NO: 1456248 - protein, 23 aa, Mycobacterium tuberculosis
DRRVEFWPTVAIRSALESGDIAT

SEQ ID NO: 1456249 - protein, 19 aa, Mycobacterium tuberculosis
DRRVLADAVDVLRRLLDHA

SEQ ID NO: 1456250 - protein, 17 aa, Mycobacterium tuberculosis
DRSRINPVVAQLMEDPN

SEQ ID NO: 1456251 - protein, 18 aa, Mycobacterium tuberculosis
DRVARADEALPFAAIAVG

SEQ ID NO: 1456252 - protein, 25 aa, Mycobacterium tuberculosis
DRVGIWAPNRWEWVLVQYATAEIGA

SEQ ID NO: 1456253 - protein, 21 aa, Mycobacterium tuberculosis
DRYRHLVALSITDFGAAGPRS

SEQ ID NO: 1456254 - protein, 23 aa, Mycobacterium tuberculosis
DRYSEIFAHSFARPTAIADGLAE

SEQ ID NO: 1456255 - protein, 21 aa, Mycobacterium tuberculosis
DSAFDGYEFSRACESLYHFAW

SEQ ID NO: 1456256 - protein, 20 aa, Mycobacterium tuberculosis
DSQLAGFMRNAAGGTLFNFG

SEQ ID NO: 1456257 - protein, 25 aa, Mycobacterium tuberculosis
DSRGRYLIRGVIGPDEFHSGYPGNE

SEQ ID NO: 1456258 - protein, 23 aa, Mycobacterium tuberculosis
DSTTETFAAITLEVDTRRWAGVP

SEQ ID NO: 1456259 - protein, 23 aa, Mycobacterium tuberculosis
DSVKRLVGEIGERHGRLDMLVNN

SEQ ID NO: 1456260 - protein, 24 aa, Mycobacterium tuberculosis
DTGVPRPGLSTIFSPSRSTFGVDL

SEQ ID NO: 1456261 - protein, 27 aa, Mycobacterium tuberculosis
DTNVYYRRALMLAACFGRGSEYPQRVV

SEQ ID NO: 1456262 - protein, 21 aa, Mycobacterium tuberculosis
DTPTIASLVAWANEADLGRTV

SEQ ID NO: 1456263 - protein, 24 aa, Mycobacterium tuberculosis
DTRAGRRLWVYGRAGQGCRRCGTL

SEQ ID NO: 1456264 - protein, 20 aa, Mycobacterium tuberculosis
DTSNCGTCVVEVDGVPVKSC

SEQ ID NO: 1456265 - protein, 17 aa, Mycobacterium tuberculosis
DVAELLPELTLAQRWDL

SEQ ID NO: 1456266 - protein, 18 aa, Mycobacterium tuberculosis
DVAFRPKTIIPRLSATFP

SEQ ID NO: 1456267 - protein, 20 aa, Mycobacterium tuberculosis
DVARLRERWEQIEAKAQETK

SEQ ID NO: 1456268 - protein, 22 aa, Mycobacterium tuberculosis
DVDAALHYLARMLVAGEDPRFI

SEQ ID NO: 1456269 - protein, 26 aa, Mycobacterium tuberculosis
DVDFYRWTQWIFLQIYNAWFDTTANK

SEQ ID NO: 1456270 - protein, 19 aa, Mycobacterium tuberculosis
DVEGFPYKEIAEIMDTPIG

SEQ ID NO: 1456271 - protein, 17 aa, Mycobacterium tuberculosis
DVGCGEAAISLALAERG

SEQ ID NO: 1456272 - protein, 20 aa, Mycobacterium tuberculosis
DVLIAFGRYPSFEGHLPQLG

SEQ ID NO: 1456273 - protein, 20 aa, Mycobacterium tuberculosis
DVLLRAGIQGADAFAAVSSG

SEQ ID NO: 1456274 - protein, 22 aa, Mycobacterium tuberculosis
DVLRAGDVLIVIGTEDGIAGVE

SEQ ID NO: 1456275 - protein, 23 aa, Mycobacterium tuberculosis
DVMPARGVGVIELRGESLTPGYL

SEQ ID NO: 1456276 - protein, 24 aa, Mycobacterium tuberculosis
DVNYRLTLRNGVLIHRKLPADPAT

SEQ ID NO: 1456277 - protein, 23 aa, Mycobacterium tuberculosis
DVSNNFYEWVLGPSMTYTCAVFP

SEQ ID NO: 1456278 - protein, 20 aa, Mycobacterium tuberculosis
DVTDRAWVTIVWDDPVNLMS

SEQ ID NO: 1456279 - protein, 24 aa, Mycobacterium tuberculosis
DVTRCPRNILTFSHGAHHCLGAAA

SEQ ID NO: 1456280 - protein, 25 aa, Mycobacterium tuberculosis
DVVFASHHWPTWGREKIVEFLSQQR

SEQ ID NO: 1456281 - protein, 17 aa, Mycobacterium tuberculosis
DVVIFGRGLGVALATAP

SEQ ID NO: 1456282 - protein, 19 aa, Mycobacterium tuberculosis
DWDRIGAAVQEAFRGGADG

SEQ ID NO: 1456283 - protein, 26 aa, Mycobacterium tuberculosis
DYWASWCGPCRAFAPTFAESSEKHPD

SEQ ID NO: 1456284 - protein, 18 aa, Mycobacterium tuberculosis
EAADKLRSPISISTGVLW

SEQ ID NO: 1456285 - protein, 18 aa, Mycobacterium tuberculosis
EAAFLIHRVPAWSTNLSR

SEQ ID NO: 1456286 - protein, 20 aa, Mycobacterium tuberculosis
EAARRLGRRSLVLVPNTAVQ

SEQ ID NO: 1456287 - protein, 20 aa, Mycobacterium tuberculosis
EAFDAARMCIELLKQEVPIW

SEQ ID NO: 1456288 - protein, 19 aa, Mycobacterium tuberculosis
EAIAARGAVPVVVGGSMLY

SEQ ID NO: 1456289 - protein, 25 aa, Mycobacterium tuberculosis
EALADGVVRPVVFLAYSGQARWRDS

SEQ ID NO: 1456290 - protein, 26 aa, Mycobacterium tuberculosis
EALARARRALNEFGVEGLATVIPFHR

SEQ ID NO: 1456291 - protein, 22 aa, Mycobacterium tuberculosis
EALRRISEGAAMIRSKGEAGTG

SEQ ID NO: 1456292 - protein, 25 aa, Mycobacterium tuberculosis
EAPARAYNPLFIWGESGLGKTHLLH

SEQ ID NO: 1456293 - protein, 26 aa, Mycobacterium tuberculosis
EAQLDRFAIRLELRYLSERDETSMLR

SEQ ID NO: 1456294 - protein, 24 aa, Mycobacterium tuberculosis
EAQNRYGRKVSWGVEVGGERILFT

SEQ ID NO: 1456295 - protein, 27 aa, Mycobacterium tuberculosis
EARGVPMTAGCVVPRGDVLELIDDIKD

SEQ ID NO: 1456296 - protein, 23 aa, Mycobacterium tuberculosis
EARRLRWAAPYLAVPRVLGVGVD

SEQ ID NO: 1456297 - protein, 17 aa, Mycobacterium tuberculosis
EATRPALRDPLILPSMC

SEQ ID NO: 1456298 - protein, 26 aa, Mycobacterium tuberculosis
EAVESGLRVARKWGADVNGLPAGRHD

SEQ ID NO: 1456299 - protein, 21 aa, Mycobacterium tuberculosis
EDERIGVLSFPLGKQQRPAAA

SEQ ID NO: 1456300 - protein, 30 aa, Mycobacterium tuberculosis; identical to SEQ ID NO: 198388

SEQ ID NO: 1456301 - protein, 19 aa, Mycobacterium tuberculosis
EDGRFVARYGPFRVEAPLS

SEQ ID NO: 1456302 - protein, 26 aa, Mycobacterium tuberculosis
EDNRAWRLYRRLGFTDIIRGYHFAGD

SEQ ID NO: 1456303 - protein, 19 aa, Mycobacterium tuberculosis
EDPAHGWQPQAGVMHTIEV

SEQ ID NO: 1456304 - protein, 30 aa, Mycobacterium tuberculosis; identical to SEQ ID NO: 209266

SEQ ID NO: 1456305 - protein, 23 aa, Mycobacterium tuberculosis
EEIPPGFSHCLLLSEARVVAAGL

SEQ ID NO: 1456306 - protein, 34 aa, Mycobacterium tuberculosis; identical to SEQ ID NO: 198411

SEQ ID NO: 1456307 - protein, 24 aa, Mycobacterium tuberculosis
EEIWDCTYDRWGVDQAEQYLRELQ

SEQ ID NO: 1456308 - protein, 17 aa, Mycobacterium tuberculosis
EELKKLLYQACMAAART

SEQ ID NO: 1456309 - protein, 21 aa, Mycobacterium tuberculosis
EEPARLLSQFIHGIKTLPVTW

SEQ ID NO: 1456310 - protein, 26 aa, Mycobacterium tuberculosis
EEVAPWLDLVRKLGVLAGVLSDELPV

SEQ ID NO: 1456311 - protein, 21 aa, Mycobacterium tuberculosis
EEYCKRRLGLDAALGSIDRSK

SEQ ID NO: 1456312 - protein, 29 aa, Mycobacterium tuberculosis
EFAAAFKPPLRWGIRMTGHRFFREYPYRD

SEQ ID NO: 1456313 - protein, 22 aa, Mycobacterium tuberculosis
EFDEHLLVRAGHAFQQVTGYHR

SEQ ID NO: 1456314 - protein, 19 aa, Mycobacterium tuberculosis
EFLALKVEGILDCAELLVV

SEQ ID NO: 1456315 - protein, 19 aa, Mycobacterium tuberculosis
EFYFLEMNTRLQVEHPVTE

SEQ ID NO: 1456316 - protein, 17 aa, Mycobacterium tuberculosis
EGARLVCGGGRPEGLDN

SEQ ID NO: 1456317 - protein, 23 aa, Mycobacterium tuberculosis
EGIIAAAAIRCMGGAIQAQLAPR

SEQ ID NO: 1456318 - protein, 18 aa, Mycobacterium tuberculosis
EGKIRTVYEPVVKTTIIA

SEQ ID NO: 1456319 - protein, 18 aa, Mycobacterium tuberculosis
EGKVKVELALARGKQARD

SEQ ID NO: 1456320 - protein, 22 aa, Mycobacterium tuberculosis
EGLPYFSIGMGNNFIQSAKTLG

SEQ ID NO: 1456321 - protein, 26 aa, Mycobacterium tuberculosis
EGPSYTRPASWRGLDVPEVLLSGDHA

SEQ ID NO: 1456322 - protein, 21 aa, Mycobacterium tuberculosis
EGPWLRTGDLGVIFEGELFIT

SEQ ID NO: 1456323 - protein, 20 aa, Mycobacterium tuberculosis
EGRLRQSSWRGLRPDKKPSE

SEQ ID NO: 1456324 - protein, 22 aa, Mycobacterium tuberculosis
EHGGKYGSHWLVDNRPDLFDGI

SEQ ID NO: 1456325 - protein, 25 aa, Mycobacterium tuberculosis
EHLSALRAIPRLSVVRPADANETAY

SEQ ID NO: 1456326 - protein, 30 aa, Mycobacterium tuberculosis; identical to SEQ ID NO: 198519

SEQ ID NO: 1456327 - protein, 29 aa, Mycobacterium tuberculosis
EIDGAAVDRIWRAARHWYRAGMHPAIQLC

SEQ ID NO: 1456328 - protein, 30 aa, Mycobacterium tuberculosis; identical to SEQ ID NO: 198526

SEQ ID NO: 1456329 - protein, 23 aa, Mycobacterium tuberculosis
EIPPRRLRYAPGQFLTLRVPSER

SEQ ID NO: 1456330 - protein, 24 aa, Mycobacterium tuberculosis
EIVCAGRPLLEWCVRRRLDDEPRI

SEQ ID NO: 1456331 - protein, 23 aa, Mycobacterium tuberculosis
EKLATLRPVFGVKAGDATMTAGN

SEQ ID NO: 1456332 - protein, 19 aa, Mycobacterium tuberculosis
ELAIKTGRPLIGINDGAGA

SEQ ID NO: 1456333 - protein, 19 aa, Mycobacterium tuberculosis
ELAPGRRALVRTGVAVAVP

SEQ ID NO: 1456334 - protein, 25 aa, Mycobacterium tuberculosis
ELASCPPILVLTGRPDDTWLASWSR

SEQ ID NO: 1456335 - protein, 20 aa, Mycobacterium tuberculosis
ELATLMAHVKLGLKEEVLAT

SEQ ID NO: 1456336 - protein, 21 aa, Mycobacterium tuberculosis
ELCDEFDALLIFDEVQTGCGL

SEQ ID NO: 1456337 - protein, 22 aa, Mycobacterium tuberculosis
ELDDCAFPLLSGVEIGSDPQKI

SEQ ID NO: 1456338 - protein, 19 aa, Mycobacterium tuberculosis
ELDIPVVAGGVLDHRTALH

SEQ ID NO: 1456339 - protein, 20 aa, Mycobacterium tuberculosis
ELDRRLRTGPTPWSGSETLP

SEQ ID NO: 1456340 - protein, 20 aa, Mycobacterium tuberculosis
ELDVAWMIFAHRVFQELAGL

SEQ ID NO: 1456341 - protein, 18 aa, Mycobacterium tuberculosis
ELEELLKERLELIRSRRR

SEQ ID NO: 1456342 - protein, 25 aa, Mycobacterium tuberculosis
ELGRSGRLKGAGFYEYADGKRSGLW

SEQ ID NO: 1456343 - protein, 29 aa, Mycobacterium tuberculosis
ELHFLGATLWRSGIQRVLRGFVERDDWCE

SEQ ID NO: 1456344 - protein, 17 aa, Mycobacterium tuberculosis
ELHRRWLQDTSITPPGG

SEQ ID NO: 1456345 - protein, 18 aa, Mycobacterium tuberculosis
ELINRGGEKISPERVEGV

SEQ ID NO: 1456346 - protein, 26 aa, Mycobacterium tuberculosis
ELKARADALGRAFIDQGITFSLSGQE

SEQ ID NO: 1456347 - protein, 19 aa, Mycobacterium tuberculosis
ELLARVGLSRANLNYSGGG

SEQ ID NO: 1456348 - protein, 29 aa, Mycobacterium tuberculosis
ELNVPRRDLRMLAARLGSDVPFALHGGTA

SEQ ID NO: 1456349 - protein, 20 aa, Mycobacterium tuberculosis
ELRSYFATLMTPERREALSS

SEQ ID NO: 1456350 - protein, 25 aa, Mycobacterium tuberculosis
ELTEKGRALAIAVMRKHRLAERLLV

SEQ ID NO: 1456351 - protein, 21 aa, Mycobacterium tuberculosis
ELTRVRFGALDLRIDTKPDLT

SEQ ID NO: 1456352 - protein, 19 aa, Mycobacterium tuberculosis
ELWFGAHPGDPAWLQTPHG

SEQ ID NO: 1456353 - protein, 21 aa, Mycobacterium tuberculosis
EMLTMGFADDVERILSETPEY

SEQ ID NO: 1456354 - protein, 20 aa, Mycobacterium tuberculosis
EMQGRIAGSRLEFFESSSHM

SEQ ID NO: 1456355 - protein, 20 aa, Mycobacterium tuberculosis
EMTVLVGGLRVLGANYKRLP

SEQ ID NO: 1456356 - protein, 24 aa, Mycobacterium tuberculosis
ENAIWKARTQGVGYLDLTGCMALG

SEQ ID NO: 1456357 - protein, 23 aa, Mycobacterium tuberculosis
ENAIWPDLFIAGGGISRKADKWV

SEQ ID NO: 1456358 - protein, 19 aa, Mycobacterium tuberculosis
ENLREHRRGLLVDLVTNVS

SEQ ID NO: 1456359 - protein, 24 aa, Mycobacterium tuberculosis
EPDLACSGLRFAYDGLIPLPDGVR

SEQ ID NO: 1456360 - protein, 30 aa, Mycobacterium tuberculosis; identical to SEQ ID NO: 198681

SEQ ID NO: 1456361 - protein, 21 aa, Mycobacterium tuberculosis
EPEMLDRLDIVVASVHSKLSM

SEQ ID NO: 1456362 - protein, 19 aa, Mycobacterium tuberculosis
EPHGAGLANSGFRRDPLVA

SEQ ID NO: 1456363 - protein, 22 aa, Mycobacterium tuberculosis
EPHRVLTLPLVRAGQPVADTSL

SEQ ID NO: 1456364 - protein, 25 aa, Mycobacterium tuberculosis
EPLTPELCALSWMVYSLPGAPVLEH

SEQ ID NO: 1456365 - protein, 31 aa, Mycobacterium tuberculosis; identical to SEQ ID NO: 198697

SEQ ID NO: 1456366 - protein, 25 aa, Mycobacterium tuberculosis
EPVLKLLKITGDWQKFKGLPGAQGR

SEQ ID NO: 1456367 - protein, 18 aa, Mycobacterium tuberculosis
EQLIRCNGALRLPELDLA

SEQ ID NO: 1456368 - protein, 19 aa, Mycobacterium tuberculosis
EQRDRWWSDFDGLAPTAVE

SEQ ID NO: 1456369 - protein, 23 aa, Mycobacterium tuberculosis
EQRPSFRRTVKWRTGSEGRISTL

SEQ ID NO: 1456370 - protein, 24 aa, Mycobacterium tuberculosis
ERATPMPIPIGLWMFQTKLHVNAG

SEQ ID NO: 1456371 - protein, 24 aa, Mycobacterium tuberculosis
ERIGVAACNTARCVDYVGAGTVEF

SEQ ID NO: 1456372 - protein, 18 aa, Mycobacterium tuberculosis
ERISEKFPTSGIAVLRVA

SEQ ID NO: 1456373 - protein, 25 aa, Mycobacterium tuberculosis
ERLAEMPRVLRLCAARTGAELNVSA

SEQ ID NO: 1456374 - protein, 18 aa, Mycobacterium tuberculosis
ERLVRRGVPAVVLNAKND

SEQ ID NO: 1456375 - protein, 18 aa, Mycobacterium tuberculosis
ERMRLGALARHIAEELPL

SEQ ID NO: 1456376 - protein, 18 aa, Mycobacterium tuberculosis
ERPFPLDLVPRVISAPEW

SEQ ID NO: 1456377 - protein, 19 aa, Mycobacterium tuberculosis
ERPIPSWLQVVGERQRVLI

SEQ ID NO: 1456378 - protein, 18 aa, Mycobacterium tuberculosis
ERPRLVVHRSARHIHVQL

SEQ ID NO: 1456379 - protein, 24 aa, Mycobacterium tuberculosis
ERQRAVGGAGRFLADAMLDLFGSH

SEQ ID NO: 1456380 - protein, 21 aa, Mycobacterium tuberculosis
ERTGYSWGPLSLMLLATAIAQ

SEQ ID NO: 1456381 - protein, 17 aa, Mycobacterium tuberculosis
ERVRAVGSGHSFTDIAC

SEQ ID NO: 1456382 - protein, 17 aa, Mycobacterium tuberculosis
ERYDAFFSLAHRLLPAD

SEQ ID NO: 1456383 - protein, 18 aa, Mycobacterium tuberculosis
ESACAELVSLLVGTAPGS

SEQ ID NO: 1456384 - protein, 22 aa, Mycobacterium tuberculosis
ESAVRSGLDLAGFNKLADELED

SEQ ID NO: 1456385 - protein, 18 aa, Mycobacterium tuberculosis
ESAYDRYYGDPSNKPNPN

SEQ ID NO: 1456386 - protein, 26 aa, Mycobacterium tuberculosis
ESFPLYCCANGKALLAALPPERQARA

SEQ ID NO: 1456387 - protein, 23 aa, Mycobacterium tuberculosis
ESNAPVLLGLIGLWYSNFFGAQS

SEQ ID NO: 1456388 - protein, 24 aa, Mycobacterium tuberculosis
ESPQETWTRLVLIDAGLPKPQTQI

SEQ ID NO: 1456389 - protein, 26 aa, Mycobacterium tuberculosis
ESSAAFQAAHARFVAAAAKVNTLLDV

SEQ ID NO: 1456390 - protein, 25 aa, Mycobacterium tuberculosis
ESTRYEAWSFPDFATGVAALRTITQ

SEQ ID NO: 1456391 - protein, 30 aa, Mycobacterium tuberculosis; identical to SEQ ID NO: 198832

SEQ ID NO: 1456392 - protein, 18 aa, Mycobacterium tuberculosis
ETAYAWRTILARRNGSGP

SEQ ID NO: 1456393 - protein, 18 aa, Mycobacterium tuberculosis
ETAYCLGVEKLLGITDEI

SEQ ID NO: 1456394 - protein, 25 aa, Mycobacterium tuberculosis
ETEGRPRLRYWLDRLSTDGILAHAA

SEQ ID NO: 1456395 - protein, 19 aa, Mycobacterium tuberculosis
ETIPEFLAALEKPRRVLIM

SEQ ID NO: 1456396 - protein, 28 aa, Mycobacterium tuberculosis
ETLAELGPWRWAPTFAFIDQQAAEVHWE

SEQ ID NO: 1456397 - protein, 25 aa, Mycobacterium tuberculosis
ETLRLHPPLIILMRVAKGEFEVQGH

SEQ ID NO: 1456398 - protein, 20 aa, Mycobacterium tuberculosis
ETREIWSYGSGYGGNALLGK

SEQ ID NO: 1456399 - protein, 21 aa, Mycobacterium tuberculosis
ETRTGDLWLFRGRSRPDRAIQ

SEQ ID NO: 1456400 - protein, 18 aa, Mycobacterium tuberculosis
ETSMLRRRLERGSADPTV

SEQ ID NO: 1456401 - protein, 23 aa, Mycobacterium tuberculosis
ETVVEARCGIGYLHTGIEKNLEY

SEQ ID NO: 1456402 - protein, 25 aa, Mycobacterium tuberculosis
ETYDIYMHYLRGCSDLFRDKYTDVC

SEQ ID NO: 1456403 - protein, 17 aa, Mycobacterium tuberculosis
EVAGYRLPAGVMVVPAI

SEQ ID NO: 1456404 - protein, 19 aa, Mycobacterium tuberculosis
EVEIKRDGYEWSQVYEKSE

SEQ ID NO: 1456405 - protein, 18 aa, Mycobacterium tuberculosis
EVGTPFCVTVDFDSLQDN

SEQ ID NO: 1456406 - protein, 24 aa, Mycobacterium tuberculosis
EVIADGPIALARLIPAGVDVRGNA

SEQ ID NO: 1456407 - protein, 24 aa, Mycobacterium tuberculosis
EVIEKMRVAGRIAAGALAEAGKAV

SEQ ID NO: 1456408 - protein, 23 aa, Mycobacterium tuberculosis
EVKEAAAEHGLWYPPDPSSFEIC

SEQ ID NO: 1456409 - protein, 23 aa, Mycobacterium tuberculosis
EVLPNYSGGLGILAGDHLKSASD

SEQ ID NO: 1456410 - protein, 19 aa, Mycobacterium tuberculosis
EVLRLRWRPGCMPLPQRVI

SEQ ID NO: 1456411 - protein, 18 aa, Mycobacterium tuberculosis
EVLSTILLECTMAGMATC

SEQ ID NO: 1456412 - protein, 19 aa, Mycobacterium tuberculosis
EVRHECLEYALAHDERFGI

SEQ ID NO: 1456413 - protein, 27 aa, Mycobacterium tuberculosis
EVSRRWSALCTMVIDILHRKLAEPGDD

SEQ ID NO: 1456414 - protein, 17 aa, Mycobacterium tuberculosis
EVTRKLDKMGWRSSDTA

SEQ ID NO: 1456415 - protein, 22 aa, Mycobacterium tuberculosis
EVVRREGASWVRIADDGDWATS

SEQ ID NO: 1456416 - protein, 24 aa, Mycobacterium tuberculosis
EWGPDYYERIGVSFELPNHYQKLT

SEQ ID NO: 1456417 - protein, 20 aa, Mycobacterium tuberculosis
EWNLDFAAALTRLLTATLLG

SEQ ID NO: 1456418 - protein, 27 aa, Mycobacterium tuberculosis
EWPANPRFLMCTPLSHAGAAFFTPTVI

SEQ ID NO: 1456419 - protein, 24 aa, Mycobacterium tuberculosis
EYAEVQPLKGARISGSLHMTVQTA

SEQ ID NO: 1456420 - protein, 17 aa, Mycobacterium tuberculosis
EYLQLACAGGFPEVVQR

SEQ ID NO: 1456421 - protein, 24 aa, Mycobacterium tuberculosis
EYRRKVRLCLDVFETMLAQTRFEA

SEQ ID NO: 1456422 - protein, 17 aa, Mycobacterium tuberculosis
FAAPVVCAFGMTEATHQ

SEQ ID NO: 1456423 - protein, 17 aa, Mycobacterium tuberculosis
FADELDVVLAAPSRILV

SEQ ID NO: 1456424 - protein, 21 aa, Mycobacterium tuberculosis
FAEGYCLPTVLNNALYMDRYP

SEQ ID NO: 1456425 - protein, 25 aa, Mycobacterium tuberculosis
FAGFRRLRALFTHRRDNGLLRECTV

SEQ ID NO: 1456426 - protein, 17 aa, Mycobacterium tuberculosis
FAGREFIGVQGTQLSRY

SEQ ID NO: 1456427 - protein, 24 aa, Mycobacterium tuberculosis
FAIAARFADHLNIVAAVDELPRKM

SEQ ID NO: 1456428 - protein, 18 aa, Mycobacterium tuberculosis
FAKEFARNATESGGRSMI

SEQ ID NO: 1456429 - protein, 17 aa, Mycobacterium tuberculosis
FANRRVDAVQDGTLLSS

SEQ ID NO: 1456430 - protein, 17 aa, Mycobacterium tuberculosis
FAPGYGVEIGLLIDTFD

SEQ ID NO: 1456431 - protein, 20 aa, Mycobacterium tuberculosis
FAQRARWANATADLLEAEAD

SEQ ID NO: 1456432 - protein, 17 aa, Mycobacterium tuberculosis
FCSTCDRTRLTADGQIR

SEQ ID NO: 1456433 - protein, 18 aa, Mycobacterium tuberculosis
FDALGRWLLARTAEIVAG

SEQ ID NO: 1456434 - protein, 23 aa, Mycobacterium tuberculosis
FDELYAAGATAIFPPGTVIADAA

SEQ ID NO: 1456435 - protein, 27 aa, Mycobacterium tuberculosis
FDFGRPEVRNFLVANALYWLQEFHIDG

SEQ ID NO: 1456436 - protein, 17 aa, Mycobacterium tuberculosis
FDFYFADSTAFRANIAQ

SEQ ID NO: 1456437 - protein, 17 aa, Mycobacterium tuberculosis
FDGQPSWSGKPEVAATT

SEQ ID NO: 1456438 - protein, 18 aa, Mycobacterium tuberculosis
FDHQLTRIELRRMGYLQR

SEQ ID NO: 1456439 - protein, 17 aa, Mycobacterium tuberculosis
FEALKAAAIVSGVAQAL

SEQ ID NO: 1456440 - protein, 25 aa, Mycobacterium tuberculosis
FEDVRASGLLPRWEQTQRFIGEMRG

SEQ ID NO: 1456441 - protein, 20 aa, Mycobacterium tuberculosis
FEEHVRWYRMYGMSMRPVPK

SEQ ID NO: 1456442 - protein, 22 aa, Mycobacterium tuberculosis
FEIDVPKVLEFKARVLSERGAV

SEQ ID NO: 1456443 - protein, 25 aa, Mycobacterium tuberculosis
FEKTLRFWLDRGVDGFRIDVAHGMA

SEQ ID NO: 1456444 - protein, 19 aa, Mycobacterium tuberculosis
FELHEELIQAVGLTRDEAA

SEQ ID NO: 1456445 - protein, 18 aa, Mycobacterium tuberculosis
FEQVAFLLWRGELPTDAE

SEQ ID NO: 1456446 - protein, 23 aa, Mycobacterium tuberculosis
FETICRYRLPVTVVILNNGGVYR

SEQ ID NO: 1456447 - protein, 17 aa, Mycobacterium tuberculosis
FEVLRAIVADFVATQEP

SEQ ID NO: 1456448 - protein, 19 aa, Mycobacterium tuberculosis
FFDGFPRNAHPMPVLSSVV

SEQ ID NO: 1456449 - protein, 18 aa, Mycobacterium tuberculosis
FFGHSMGGMLAFEVALRY

SEQ ID NO: 1456450 - protein, 18 aa, Mycobacterium tuberculosis
FFGKLTYIRVYSGTVESG

SEQ ID NO: 1456451 - protein, 25 aa, Mycobacterium tuberculosis
FGAARAELAGGWSIRDSPPQVRPLI

SEQ ID NO: 1456452 - protein, 20 aa, Mycobacterium tuberculosis
FGEGGGRLVAERLSRAVGAD

SEQ ID NO: 1456453 - protein, 20 aa, Mycobacterium tuberculosis
FGEPELRPEDLLRVDSQGRG

SEQ ID NO: 1456454 - protein, 26 aa, Mycobacterium tuberculosis
FGFSPLRLPPDLDFTSLFHGVDERVP

SEQ ID NO: 1456455 - protein, 23 aa, Mycobacterium tuberculosis
FGGPAVDSRWVWVLDPIDGTINY

SEQ ID NO: 1456456 - protein, 18 aa, Mycobacterium tuberculosis
FGIEPDLAEALVCAAARE

SEQ ID NO: 1456457 - protein, 20 aa, Mycobacterium tuberculosis
FGPKRRRPQLLAVDNVVVCA

SEQ ID NO: 1456458 - protein, 24 aa, Mycobacterium tuberculosis
FGPVARGGLRWSDRRDDFRTEILG

SEQ ID NO: 1456459 - protein, 20 aa, Mycobacterium tuberculosis
FGPYAGWSPKFLKHGQISDL

SEQ ID NO: 1456460 - protein, 25 aa, Mycobacterium tuberculosis
FGQQMYTGMCTRAEMSAAAAGLPLE

SEQ ID NO: 1456461 - protein, 27 aa, Mycobacterium tuberculosis
FGSSSFRYAAPAGRNWTTADLAGMRIA

SEQ ID NO: 1456462 - protein, 19 aa, Mycobacterium tuberculosis
FGSVCEFPGPYPGYSAVRP

SEQ ID NO: 1456463 - protein, 26 aa, Mycobacterium tuberculosis
FGTTQRFGVPMGFGGPHAGYLAVHAK

SEQ ID NO: 1456464 - protein, 17 aa, Mycobacterium tuberculosis
FGVRVVAVLVAQTGLSE

SEQ ID NO: 1456465 - protein, 17 aa, Mycobacterium tuberculosis
FHFRPHLTAASGKHGMG

SEQ ID NO: 1456466 - protein, 18 aa, Mycobacterium tuberculosis
FHRWCAALSTRWCSMRVQ

SEQ ID NO: 1456467 - protein, 18 aa, Mycobacterium tuberculosis
FIDERPQLLTARASADRG

SEQ ID NO: 1456468 - protein, 21 aa, Mycobacterium tuberculosis
FIEDVARTWHLTRYAGVADEI

SEQ ID NO: 1456469 - protein, 33 aa, Mycobacterium tuberculosis; identical to SEQ ID NO: 199186

SEQ ID NO: 1456470 - protein, 21 aa, Mycobacterium tuberculosis
FKHVAEMFAELEATALRSYPR

SEQ ID NO: 1456471 - protein, 27 aa, Mycobacterium tuberculosis
FKPLYGSSLVTGWARLHGYPLGILANA

SEQ ID NO: 1456472 - protein, 18 aa, Mycobacterium tuberculosis
FKQWGGRTPKAFGRELDG

SEQ ID NO: 1456473 - protein, 19 aa, Mycobacterium tuberculosis
FKRYAWWPYTLVMRRVNVF

SEQ ID NO: 1456474 - protein, 20 aa, Mycobacterium tuberculosis
FLAIAGRRVQLEIFTKFNIP

SEQ ID NO: 1456475 - protein, 18 aa, Mycobacterium tuberculosis
FLEGCGRTDFPGGDSDEM

SEQ ID NO: 1456476 - protein, 18 aa, Mycobacterium tuberculosis
FLELAAIRTKAVRQGDPL

SEQ ID NO: 1456477 - protein, 24 aa, Mycobacterium tuberculosis
FLESLRYDLAVQEIFVFTPKGDVI

SEQ ID NO: 1456478 - protein, 20 aa, Mycobacterium tuberculosis
FLIIDGWPGFVGEFPDLEGQ

SEQ ID NO: 1456479 - protein, 25 aa, Mycobacterium tuberculosis
FLPELGLRRENIVFISGIGCSSRFP

SEQ ID NO: 1456480 - protein, 17 aa, Mycobacterium tuberculosis
FLPRFSPGKGLGVIPRE

SEQ ID NO: 1456481 - protein, 20 aa, Mycobacterium tuberculosis
FLRWGQGAFDDFKVVPPGTG

SEQ ID NO: 1456482 - protein, 22 aa, Mycobacterium tuberculosis
FLTRNRLVAAVARAAVVVEAGL

SEQ ID NO: 1456483 - protein, 21 aa, Mycobacterium tuberculosis
FMRILGPQFLSRFYGRTLNTH

SEQ ID NO: 1456484 - protein, 26 aa, Mycobacterium tuberculosis
FNRTHPMLCALPIERAIDAAETLDAE

SEQ ID NO: 1456485 - protein, 17 aa, Mycobacterium tuberculosis
FPFPDNSGLDWGALGEC

SEQ ID NO: 1456486 - protein, 36 aa, Mycobacterium tuberculosis; identical to SEQ ID NO: 199271

SEQ ID NO: 1456487 - protein, 27 aa, Mycobacterium tuberculosis
FPLDLVPRVISAPEWTRLERGITQRVK

SEQ ID NO: 1456488 - protein, 18 aa, Mycobacterium tuberculosis
FPSACGKTNLAMLQPTIP

SEQ ID NO: 1456489 - protein, 17 aa, Mycobacterium tuberculosis
FRAMAPLDPDRCVRGQY

SEQ ID NO: 1456490 - protein, 20 aa, Mycobacterium tuberculosis
FREVSELAANFGVMNSGVAV

SEQ ID NO: 1456491 - protein, 17 aa, Mycobacterium tuberculosis
FRGSELIAEKWNLSREE

SEQ ID NO: 1456492 - protein, 17 aa, Mycobacterium tuberculosis
FRPLGRVPERGRLLREL

SEQ ID NO: 1456493 - protein, 19 aa, Mycobacterium tuberculosis
FSAASAFQSVVWGLTTGSW

SEQ ID NO: 1456494 - protein, 21 aa, Mycobacterium tuberculosis
FSAGGPVLWPDLEAILVVPNN

SEQ ID NO: 1456495 - protein, 28 aa, Mycobacterium tuberculosis
FSDELGMTFPQWRTQLRLQHALVLLAER

SEQ ID NO: 1456496 - protein, 19 aa, Mycobacterium tuberculosis
FSEGGCWRTFLTCDANLAV

SEQ ID NO: 1456497 - protein, 24 aa, Mycobacterium tuberculosis
FSEPCTDCRGSGSIIEHPCEECKG

SEQ ID NO: 1456498 - protein, 21 aa, Mycobacterium tuberculosis
FSEVHPLPGRDLMPVVDGASA

SEQ ID NO: 1456499 - protein, 18 aa, Mycobacterium tuberculosis
FSGASWQRCRVHFMRNLY

SEQ ID NO: 1456500 - protein, 24 aa, Mycobacterium tuberculosis
FSGPARKVLELTFREALRLGHNYI

SEQ ID NO: 1456501 - protein, 20 aa, Mycobacterium tuberculosis
FTAPHFASAWAHASNTPLQW

SEQ ID NO: 1456502 - protein, 25 aa, Mycobacterium tuberculosis
FTENPAGSVLIEFGHTKVLCTASVT

SEQ ID NO: 1456503 - protein, 18 aa, Mycobacterium tuberculosis
FTERAAPILADLRQLEAI

SEQ ID NO: 1456504 - protein, 25 aa, Mycobacterium tuberculosis
FTGQRFFRIRGGQLYGQLRDVAYQS

SEQ ID NO: 1456505 - protein, 23 aa, Mycobacterium tuberculosis
FTGVPCIVDLATMREAIADLGGN

SEQ ID NO: 1456506 - protein, 19 aa, Mycobacterium tuberculosis
FTHLLGYALVQAVKKFPNM

SEQ ID NO: 1456507 - protein, 27 aa, Mycobacterium tuberculosis
FTTAAWRKLLVNALAGFMVLSGRRSAM

SEQ ID NO: 1456508 - protein, 36 aa, Mycobacterium tuberculosis; identical to SEQ ID NO: 199407

SEQ ID NO: 1456509 - protein, 17 aa, Mycobacterium tuberculosis
FVLGALRDNQTWSTPAE

SEQ ID NO: 1456510 - protein, 25 aa, Mycobacterium tuberculosis
FVNVYRVVSNLGVFDFGGPDHSMRA

SEQ ID NO: 1456511 - protein, 23 aa, Mycobacterium tuberculosis
FVPLRPGHVSIYLCGATVQGLPH

SEQ ID NO: 1456512 - protein, 19 aa, Mycobacterium tuberculosis
FVQLCPSLLSIDGPQHTAA

SEQ ID NO: 1456513 - protein, 24 aa, Mycobacterium tuberculosis
FVRSEGCAMVLLKRLPDALRDGNR

SEQ ID NO: 1456514 - protein, 19 aa, Mycobacterium tuberculosis
FVSACSAPGHIRYKQLQDL

SEQ ID NO: 1456515 - protein, 21 aa, Mycobacterium tuberculosis
FVTCDARLATRLPEGLTDAQA

SEQ ID NO: 1456516 - protein, 19 aa, Mycobacterium tuberculosis
FVVGMSLGGLTAIRLAAMA

SEQ ID NO: 1456517 - protein, 20 aa, Mycobacterium tuberculosis
FYCVANMPASVPKTSTYALT

SEQ ID NO: 1456518 - protein, 19 aa, Mycobacterium tuberculosis
FYNTEGLPYFSIGMGNNFI

SEQ ID NO: 1456519 - protein, 18 aa, Mycobacterium tuberculosis
FYRGKIAVAAFFAKNMLP

SEQ ID NO: 1456520 - protein, 19 aa, Mycobacterium tuberculosis
GAAAIRITDYLSRDLTITQ

SEQ ID NO: 1456521 - protein, 19 aa, Mycobacterium tuberculosis
GAAGLARAAVSVFEEALAA

SEQ ID NO: 1456522 - protein, 22 aa, Mycobacterium tuberculosis
GAAIELMHLGTLCHDRVVDESD

SEQ ID NO: 1456523 - protein, 24 aa, Mycobacterium tuberculosis
GAAISELTNMRWWSGPASDSMVAA

SEQ ID NO: 1456524 - protein, 17 aa, Mycobacterium tuberculosis
GAAMFLLQRRSRATADR

SEQ ID NO: 1456525 - protein, 24 aa, Mycobacterium tuberculosis
GAAWIDPRVRGHVVALADPATGLA

SEQ ID NO: 1456526 - protein, 17 aa, Mycobacterium tuberculosis
GACAQVNSDLGLLAPEK

SEQ ID NO: 1456527 - protein, 24 aa, Mycobacterium tuberculosis
GACEPVCPVEAIFYEDDVPEQWSH

SEQ ID NO: 1456528 - protein, 22 aa, Mycobacterium tuberculosis
GADRKRLISRIQVRQLDSAAVA

SEQ ID NO: 1456529 - protein, 17 aa, Mycobacterium tuberculosis
GADTFFGEPELRPEDLL

SEQ ID NO: 1456530 - protein, 19 aa, Mycobacterium tuberculosis
GAEPLFLLDYIAVGRIVPE

SEQ ID NO: 1456531 - protein, 26 aa, Mycobacterium tuberculosis
GAESFPEETFPVIVALMTNVFDGAAI

SEQ ID NO: 1456532 - protein, 18 aa, Mycobacterium tuberculosis
GAGHLWKLVRTFDDPATW

SEQ ID NO: 1456533 - protein, 24 aa, Mycobacterium tuberculosis
GAKAIATEIGRPVMVKAQVKIGGR

SEQ ID NO: 1456534 - protein, 17 aa, Mycobacterium tuberculosis
GALMPFTPPSGAPPDLL

SEQ ID NO: 1456535 - protein, 18 aa, Mycobacterium tuberculosis
GALNRFETALGRAELPEA

SEQ ID NO: 1456536 - protein, 19 aa, Mycobacterium tuberculosis
GALPLLAPMSEVAGRLAAQ

SEQ ID NO: 1456537 - protein, 18 aa, Mycobacterium tuberculosis
GANLARLELRVLFEELLS

SEQ ID NO: 1456538 - protein, 22 aa, Mycobacterium tuberculosis
GAPTPVADRFVRYVNRDNTTAA

SEQ ID NO: 1456539 - protein, 21 aa, Mycobacterium tuberculosis
GAPTPVAWTRMRAPRSLMAAI

SEQ ID NO: 1456540 - protein, 24 aa, Mycobacterium tuberculosis
GASRAEQGLPFAREAALAKRLGSD

SEQ ID NO: 1456541 - protein, 18 aa, Mycobacterium tuberculosis
GATAWRAVVEHAETADDR

SEQ ID NO: 1456542 - protein, 19 aa, Mycobacterium tuberculosis
GAVAVRLGPTVLRTSTAAA

SEQ ID NO: 1456543 - protein, 28 aa, Mycobacterium tuberculosis
GAVLDHLRIAMTAAHWQANITRFPQPNQ

SEQ ID NO: 1456544 - protein, 26 aa, Mycobacterium tuberculosis
GAVMVPRLPPSQARVLLMAALAANSP

SEQ ID NO: 1456545 - protein, 25 aa, Mycobacterium tuberculosis
GAVRDWPKPLGFVWGLDDPVATTNV

SEQ ID NO: 1456546 - protein, 17 aa, Mycobacterium tuberculosis
GCAPDLIYIDLHLVHEV

SEQ ID NO: 1456547 - protein, 23 aa, Mycobacterium tuberculosis
GCGEAAISLALAERGHTTVGLDL

SEQ ID NO: 1456548 - protein, 23 aa, Mycobacterium tuberculosis
GCVQLKAALARHLGPDFAPEHVA

SEQ ID NO: 1456549 - protein, 18 aa, Mycobacterium tuberculosis
GDAAVSLMDAFRSADEVL

SEQ ID NO: 1456550 - protein, 17 aa, Mycobacterium tuberculosis
GDAKPVLMPELGESVTE

SEQ ID NO: 1456551 - protein, 17 aa, Mycobacterium tuberculosis
GDDGWRDVIDVNLTGVF

SEQ ID NO: 1456552 - protein, 19 aa, Mycobacterium tuberculosis
GDEAILFGPGIRGEPTAQD

SEQ ID NO: 1456553 - protein, 18 aa, Mycobacterium tuberculosis
GDEPLKRKVASTLLESFL

SEQ ID NO: 1456554 - protein, 23 aa, Mycobacterium tuberculosis
GDEPRPGAALDVLSEAERQVYEA

SEQ ID NO: 1456555 - protein, 21 aa, Mycobacterium tuberculosis
GDGAFGFSGMEWDTLVRHNVA

SEQ ID NO: 1456556 - protein, 24 aa, Mycobacterium tuberculosis
GDIDRGGVFAAFLGTVALLAAEDQ

SEQ ID NO: 1456557 - protein, 21 aa, Mycobacterium tuberculosis
GDLDEGFALLSNDFTYWSIVT

SEQ ID NO: 1456558 - protein, 19 aa, Mycobacterium tuberculosis
GDLLDFTALAKVFGYPTTT

SEQ ID NO: 1456559 - protein, 19 aa, Mycobacterium tuberculosis
GDNQIGFGALNSGSGNLGF

SEQ ID NO: 1456560 - protein, 27 aa, Mycobacterium tuberculosis
GDPGESRFYLSLGDELMRRFNGAALET

SEQ ID NO: 1456561 - protein, 18 aa, Mycobacterium tuberculosis
GDPLFYSSYMHLHTRLTR

SEQ ID NO: 1456562 - protein, 23 aa, Mycobacterium tuberculosis
GDPSVDLIIAWNLLSAPARAQFR

SEQ ID NO: 1456563 - protein, 23 aa, Mycobacterium tuberculosis
GDRDFWLQVGIDPIQIMTGTATF

SEQ ID NO: 1456564 - protein, 17 aa, Mycobacterium tuberculosis
GDTAVIYGVGGLGINAV

SEQ ID NO: 1456565 - protein, 18 aa, Mycobacterium tuberculosis
GDVLPELIRRAITVKAEV

SEQ ID NO: 1456566 - protein, 24 aa, Mycobacterium tuberculosis
GEDRRPTLSWPRNLPIDGEPAEVV

SEQ ID NO: 1456567 - protein, 17 aa, Mycobacterium tuberculosis
GEHRFPLSDTVVAVPAD

SEQ ID NO: 1456568 - protein, 19 aa, Mycobacterium tuberculosis
GEKLMGFGHRVYRAEDPRA

SEQ ID NO: 1456569 - protein, 20 aa, Mycobacterium tuberculosis
GELDVIALYIASIATGSIAL

SEQ ID NO: 1456570 - protein, 20 aa, Mycobacterium tuberculosis
GENIPAWLVFDQRYRDRYIF

SEQ ID NO: 1456571 - protein, 25 aa, Mycobacterium tuberculosis
GEPCRVCGGVIRTALLEGRNVFWCP

SEQ ID NO: 1456572 - protein, 27 aa, Mycobacterium tuberculosis
GERLRLLLREVFTAAGGTHDDWDEYDR

SEQ ID NO: 1456573 - protein, 17 aa, Mycobacterium tuberculosis
GESGFNIARVVAVALGY

SEQ ID NO: 1456574 - protein, 26 aa, Mycobacterium tuberculosis
GEVFDLRPGAIIRDLNLLRPIYAPTA

SEQ ID NO: 1456575 - protein, 21 aa, Mycobacterium tuberculosis
GFGALKYAAKYYGHFASASSH

SEQ ID NO: 1456576 - protein, 17 aa, Mycobacterium tuberculosis
GFSRPGIELTKRTLWSG

SEQ ID NO: 1456577 - protein, 17 aa, Mycobacterium tuberculosis
GGANGAFELNVYIPMMA

SEQ ID NO: 1456578 - protein, 24 aa, Mycobacterium tuberculosis
GGCLPKDIRAFMARAGELGADQAL

SEQ ID NO: 1456579 - protein, 33 aa, Mycobacterium tuberculosis; identical to SEQ ID NO: 199807

SEQ ID NO: 1456580 - protein, 18 aa, Mycobacterium tuberculosis
GGDLEFADELTLGRALAG

SEQ ID NO: 1456581 - protein, 18 aa, Mycobacterium tuberculosis
GGDVVELRAPDAAMVARG

SEQ ID NO: 1456582 - protein, 18 aa, Mycobacterium tuberculosis
GGGGRYDGLMHQLGGQDL

SEQ ID NO: 1456583 - protein, 29 aa, Mycobacterium tuberculosis
GGGLLRLPERIPYAIAMELALTGDNLPAE

SEQ ID NO: 1456584 - protein, 24 aa, Mycobacterium tuberculosis
GGGLPIGACLAVGPAAELLTPGLH

SEQ ID NO: 1456585 - protein, 21 aa, Mycobacterium tuberculosis
GGGSFCAGMDLKAFARGENVV

SEQ ID NO: 1456586 - protein, 21 aa, Mycobacterium tuberculosis
GGKVTAWRYIRAAVRAVLACT

SEQ ID NO: 1456587 - protein, 19 aa, Mycobacterium tuberculosis
GGLLHHAPSLLAFTNPTVN

SEQ ID NO: 1456588 - protein, 27 aa, Mycobacterium tuberculosis
GGLLIACLQFDLPIRLFEIGSSAGLNL

SEQ ID NO: 1456589 - protein, 21 aa, Mycobacterium tuberculosis
GGLLLPLGVRSLRAYGPTRNA

SEQ ID NO: 1456590 - protein, 17 aa, Mycobacterium tuberculosis
GGLPPESGFTYLDDVPA

SEQ ID NO: 1456591 - protein, 20 aa, Mycobacterium tuberculosis
GGLTPILCLTKTDLAPAEPF

SEQ ID NO: 1456592 - protein, 22 aa, Mycobacterium tuberculosis
GGMQRFAPLNSWPDNASLDKAR

SEQ ID NO: 1456593 - protein, 17 aa, Mycobacterium tuberculosis
GGPVTRWAEETDRNPPR

SEQ ID NO: 1456594 - protein, 18 aa, Mycobacterium tuberculosis
GGQLRWYGLDGVEHTGGP

SEQ ID NO: 1456595 - protein, 23 aa, Mycobacterium tuberculosis
GGRLSDAAIDWVVKAYTDGRVAD

SEQ ID NO: 1456596 - protein, 21 aa, Mycobacterium tuberculosis
GGSGRWLRRVTALTQAGVRRR

SEQ ID NO: 1456597 - protein, 17 aa, Mycobacterium tuberculosis
GGTRIALSRGLRPDRFV

SEQ ID NO: 1456598 - protein, 24 aa, Mycobacterium tuberculosis
GGTWKGQRSGFVMVPDRNFAMTVL

SEQ ID NO: 1456599 - protein, 23 aa, Mycobacterium tuberculosis
GHGRSPWAAPWTIDANVSALAAL

SEQ ID NO: 1456600 - protein, 18 aa, Mycobacterium tuberculosis
GHIEFPYVYLDATYLNVR

SEQ ID NO: 1456601 - protein, 20 aa, Mycobacterium tuberculosis
GHPTPGWWDGVAGPGAPIDT

SEQ ID NO: 1456602 - protein, 25 aa, Mycobacterium tuberculosis
GHSLGGGVAMQFAYQFPQLVDRLIL

SEQ ID NO: 1456603 - protein, 22 aa, Mycobacterium tuberculosis
GHYSFLNVFKLFGPRNQAPLSF

SEQ ID NO: 1456604 - protein, 17 aa, Mycobacterium tuberculosis
GIALLRYLSAQAQQIEW

SEQ ID NO: 1456605 - protein, 19 aa, Mycobacterium tuberculosis
GIEFCKLSFAETRVRAQHL

SEQ ID NO: 1456606 - protein, 19 aa, Mycobacterium tuberculosis
GIGEGLRFVYTGNVHDAVG

SEQ ID NO: 1456607 - protein, 18 aa, Mycobacterium tuberculosis
GIGVRRVTTDRGVPIELL

SEQ ID NO: 1456608 - protein, 24 aa, Mycobacterium tuberculosis
GIPMTARAAWAWFRHLHRLADRTL

SEQ ID NO: 1456609 - protein, 20 aa, Mycobacterium tuberculosis
GIRGFDCWLEGHLQQLRHAP

SEQ ID NO: 1456610 - protein, 18 aa, Mycobacterium tuberculosis
GIRHPRDVALALAAGASN

SEQ ID NO: 1456611 - protein, 26 aa, Mycobacterium tuberculosis
GIRIDLRKTYLFAFLDDHSRLVPGYR

SEQ ID NO: 1456612 - protein, 22 aa, Mycobacterium tuberculosis
GKGGEYFLRHLLGTDSNVQSDP

SEQ ID NO: 1456613 - protein, 18 aa, Mycobacterium tuberculosis
GKIVARMPAAELFDAICK

SEQ ID NO: 1456614 - protein, 25 aa, Mycobacterium tuberculosis
GKLEALLRVLEPFGIREIAQSGMVS

SEQ ID NO: 1456615 - protein, 17 aa, Mycobacterium tuberculosis
GKLQWILENVDGVRAAA

SEQ ID NO: 1456616 - protein, 26 aa, Mycobacterium tuberculosis
GKQSLTKLAAAWGGSGSEAYQGVQQK

SEQ ID NO: 1456617 - protein, 32 aa, Mycobacterium tuberculosis; identical to SEQ ID NO: 199989

SEQ ID NO: 1456618 - protein, 21 aa, Mycobacterium tuberculosis
GLADGCADLGIPVTGGNVSFY

SEQ ID NO: 1456619 - protein, 25 aa, Mycobacterium tuberculosis
GLAVARRLADEGCHVLCADIDGDAA

SEQ ID NO: 1456620 - protein, 24 aa, Mycobacterium tuberculosis
GLDARGYRLPWPADTTVFEVDQPR

SEQ ID NO: 1456621 - protein, 23 aa, Mycobacterium tuberculosis
GLDREADDFFAFIADVSGANNNE

SEQ ID NO: 1456622 - protein, 27 aa, Mycobacterium tuberculosis
GLFDPRLKRPIPYLPNMIGLITGRASA

SEQ ID NO: 1456623 - protein, 26 aa, Mycobacterium tuberculosis
GLGRRVRRLAVSHAFHSVLMDPMVEE

SEQ ID NO: 1456624 - protein, 25 aa, Mycobacterium tuberculosis
GLHLPGVAFGHDWLTGTSRYSGLLE

SEQ ID NO: 1456625 - protein, 27 aa, Mycobacterium tuberculosis
GLKAREFPVNFDVWWFKLPREGDAEFS

SEQ ID NO: 1456626 - protein, 25 aa, Mycobacterium tuberculosis
GLLGSLRFGNRFVHTGKPTPAGYAQ

SEQ ID NO: 1456627 - protein, 22 aa, Mycobacterium tuberculosis
GLLKRPAIDFLDALVSLDLLAR

SEQ ID NO: 1456628 - protein, 19 aa, Mycobacterium tuberculosis
GLLSGMALASLAARGTTGG

SEQ ID NO: 1456629 - protein, 25 aa, Mycobacterium tuberculosis
GLPDFSRYFGAAGFVPLANTVEGTQ

SEQ ID NO: 1456630 - protein, 24 aa, Mycobacterium tuberculosis
GLPDIPGYAAKVFRAVADADVNID

SEQ ID NO: 1456631 - protein, 18 aa, Mycobacterium tuberculosis
GLPDKLAGRRAWGLAVQL

SEQ ID NO: 1456632 - protein, 21 aa, Mycobacterium tuberculosis
GLPKPDWQVLLAVSAELAGER

SEQ ID NO: 1456633 - protein, 17 aa, Mycobacterium tuberculosis
GLTEVLRAAAQHRGAAL

SEQ ID NO: 1456634 - protein, 17 aa, Mycobacterium tuberculosis
GLTRVALVEGSRVVNSS

SEQ ID NO: 1456635 - protein, 30 aa, Mycobacterium tuberculosis; identical to SEQ ID NO: 200090

SEQ ID NO: 1456636 - protein, 26 aa, Mycobacterium tuberculosis
GLVDDIRINWVWNPPWGPDKITEDGR

SEQ ID NO: 1456637 - protein, 19 aa, Mycobacterium tuberculosis
GLVGHGFGGSAAVFAAAGL

SEQ ID NO: 1456638 - protein, 22 aa, Mycobacterium tuberculosis
GMIWRYPDYFIVGREQCREFAR

SEQ ID NO: 1456639 - protein, 24 aa, Mycobacterium tuberculosis
GMRFDKGYISGYFVTDPERQEAVL

SEQ ID NO: 1456640 - protein, 25 aa, Mycobacterium tuberculosis
GMRPYDPPWCRPLLGVRRSVTHAAC

SEQ ID NO: 1456641 - protein, 20 aa, Mycobacterium tuberculosis
GMTEFKVFWQPPPAPEIPKS

SEQ ID NO: 1456642 - protein, 19 aa, Mycobacterium tuberculosis
GNARLVLRRETVDDLLSLE

SEQ ID NO: 1456643 - protein, 23 aa, Mycobacterium tuberculosis
GNGDCVAFFWFADAPDRVPGLSS

SEQ ID NO: 1456644 - protein, 33 aa, Mycobacterium tuberculosis; identical to SEQ ID NO: 200134

SEQ ID NO: 1456645 - protein, 17 aa, Mycobacterium tuberculosis
GNLRAGDTAVIYGVGGL

SEQ ID NO: 1456646 - protein, 36 aa, Mycobacterium tuberculosis; identical to SEQ ID NO: 200150

SEQ ID NO: 1456647 - protein, 24 aa, Mycobacterium tuberculosis
GNTEVKSFVQKVCNEQLTHWFEAN

SEQ ID NO: 1456648 - protein, 31 aa, Mycobacterium tuberculosis; identical to SEQ ID NO: 200153

SEQ ID NO: 1456649 - protein, 24 aa, Mycobacterium tuberculosis
GPAPMLAAAVAWDGLAAELGMAAA

SEQ ID NO: 1456650 - protein, 27 aa, Mycobacterium tuberculosis
GPDELKARFSRPLAFGTAGLRGHLRGG

SEQ ID NO: 1456651 - protein, 21 aa, Mycobacterium tuberculosis
GPDLVLRWAALLHDIGKPATR

SEQ ID NO: 1456652 - protein, 25 aa, Mycobacterium tuberculosis
GPDPLRMARDLVRRGLDASALDVYR

SEQ ID NO: 1456653 - protein, 18 aa, Mycobacterium tuberculosis
GPDRSLIRAQSWDIDLPN

SEQ ID NO: 1456654 - protein, 28 aa, Mycobacterium tuberculosis
GPGAGRLQGHRCGACRIEIGRGELAQIS

SEQ ID NO: 1456655 - protein, 24 aa, Mycobacterium tuberculosis
GPLCLDCADLGHLVFLPSGDAALT

SEQ ID NO: 1456656 - protein, 17 aa, Mycobacterium tuberculosis
GPLEASRPWATKDVVGA

SEQ ID NO: 1456657 - protein, 17 aa, Mycobacterium tuberculosis
GPPHVQGAFTIGENIGD

SEQ ID NO: 1456658 - protein, 18 aa, Mycobacterium tuberculosis
GPVARFLGINNMLTNKFE

SEQ ID NO: 1456659 - protein, 18 aa, Mycobacterium tuberculosis
GQAVGGAFVRLLDSSDEF

SEQ ID NO: 1456660 - protein, 24 aa, Mycobacterium tuberculosis
GQFSDEFLRWLAGVRFTGDVWAAP

SEQ ID NO: 1456661 - protein, 22 aa, Mycobacterium tuberculosis
GQLRIGMAASFVRCEDPTLLAQ

SEQ ID NO: 1456662 - protein, 24 aa, Mycobacterium tuberculosis
GQRPGEFVFVLGYLGHVRAIVGNC

SEQ ID NO: 1456663 - protein, 28 aa, Mycobacterium tuberculosis
GQVLKEIRSRLGFLLDVGLEYLSLSRAA

SEQ ID NO: 1456664 - protein, 25 aa, Mycobacterium tuberculosis
GRAKIKALAVREGPAALPWGDLGVD

SEQ ID NO: 1456665 - protein, 24 aa, Mycobacterium tuberculosis
GRALGCPQPLIAVASAATRWVWVS

SEQ ID NO: 1456666 - protein, 23 aa, Mycobacterium tuberculosis
GRAPKPGELFTFPDHAATLEKIA

SEQ ID NO: 1456667 - protein, 25 aa, Mycobacterium tuberculosis
GRAYDPRFLFAWPSAKSAVMGGAQL

SEQ ID NO: 1456668 - protein, 20 aa, Mycobacterium tuberculosis
GRGAGPLKDYVYIDVRHLGE

SEQ ID NO: 1456669 - protein, 20 aa, Mycobacterium tuberculosis
GRGFDRCVAVFLNGEAITAP

SEQ ID NO: 1456670 - protein, 20 aa, Mycobacterium tuberculosis
GRGGFSGMLLGSVSSAVAHS

SEQ ID NO: 1456671 - protein, 29 aa, Mycobacterium tuberculosis
GRGGLRARVLRRWSVPPVRPPVTVVQALP

SEQ ID NO: 1456672 - protein, 18 aa, Mycobacterium tuberculosis
GRGNPGLNEVGWRQVGAA

SEQ ID NO: 1456673 - protein, 18 aa, Mycobacterium tuberculosis
GRGTDVWADLHPTADQQV

SEQ ID NO: 1456674 - protein, 22 aa, Mycobacterium tuberculosis
GRIKDLVVRGGENISPREIEEL

SEQ ID NO: 1456675 - protein, 26 aa, Mycobacterium tuberculosis
GRKPAALRFIRSCSAPLTAQAALALQ

SEQ ID NO: 1456676 - protein, 30 aa, Mycobacterium tuberculosis; identical to SEQ ID NO: 200317

SEQ ID NO: 1456677 - protein, 24 aa, Mycobacterium tuberculosis
GRRPRPTRELSWVRGAPADAGSFG

SEQ ID NO: 1456678 - protein, 17 aa, Mycobacterium tuberculosis
GRRRALLTGTVAVVGLG

SEQ ID NO: 1456679 - protein, 24 aa, Mycobacterium tuberculosis
GRRVGFPRFKSGRRDPGRVRFTTG

SEQ ID NO: 1456680 - protein, 18 aa, Mycobacterium tuberculosis
GRSGGKRVLVRDISEYTA

SEQ ID NO: 1456681 - protein, 26 aa, Mycobacterium tuberculosis
GRSLALEHPEIWGGIIDLDDSMPAEL

SEQ ID NO: 1456682 - protein, 18 aa, Mycobacterium tuberculosis
GRSPSAWTPEYFGGNAVP

SEQ ID NO: 1456683 - protein, 23 aa, Mycobacterium tuberculosis
GRTLTFPGFLKAYVETVDELVGG

SEQ ID NO: 1456684 - protein, 19 aa, Mycobacterium tuberculosis
GRVADGWQAPGVHLMARCS

SEQ ID NO: 1456685 - protein, 27 aa, Mycobacterium tuberculosis
GRVERMHRACLILTFGGGTNEVQRDII

SEQ ID NO: 1456686 - protein, 19 aa, Mycobacterium tuberculosis
GRVLPMCPVALQIEADVSG

SEQ ID NO: 1456687 - protein, 25 aa, Mycobacterium tuberculosis
GRVRSQFTHCIDIAPTVLAAIGLPE

SEQ ID NO: 1456688 - protein, 20 aa, Mycobacterium tuberculosis
GRYSPFAVYLPRGDPGRLAP

SEQ ID NO: 1456689 - protein, 19 aa, Mycobacterium tuberculosis
GSAALPVPVFDKLVQLTGH

SEQ ID NO: 1456690 - protein, 22 aa, Mycobacterium tuberculosis
GSAGRRLAAWLVDETGSQTASD

SEQ ID NO: 1456691 - protein, 20 aa, Mycobacterium tuberculosis
GSALAWLLTMAHRRAVDRVR

SEQ ID NO: 1456692 - protein, 26 aa, Mycobacterium tuberculosis
GSASRARFGDVLPFLVKVLAADEPLS

SEQ ID NO: 1456693 - protein, 21 aa, Mycobacterium tuberculosis
GSCSWKIYVKDGIITWETQQT

SEQ ID NO: 1456694 - protein, 24 aa, Mycobacterium tuberculosis
GSDRPAWATGFGRLIDHADARIAA

SEQ ID NO: 1456695 - protein, 21 aa, Mycobacterium tuberculosis
GSDSLLRMRLDLEECATGVTK

SEQ ID NO: 1456696 - protein, 24 aa, Mycobacterium tuberculosis
GSGSSWLDKLWALLDPNSNFWNTI

SEQ ID NO: 1456697 - protein, 23 aa, Mycobacterium tuberculosis
GSGVNTWTAIRWTFAEDSPYVGT

SEQ ID NO: 1456698 - protein, 20 aa, Mycobacterium tuberculosis
GSKHPWRVLMHYEKDAKILL

SEQ ID NO: 1456699 - protein, 25 aa, Mycobacterium tuberculosis
GSPLLAGDFVRWCRQVLDLLDQVRN

SEQ ID NO: 1456700 - protein, 25 aa, Mycobacterium tuberculosis
GSSCLPEGVPSNWTIFFGAEDVDET

SEQ ID NO: 1456701 - protein, 20 aa, Mycobacterium tuberculosis
GSSGEGLAGVASVGGQPSQA

SEQ ID NO: 1456702 - protein, 25 aa, Mycobacterium tuberculosis
GSVARLRFGPATHRKVKKWLAHGDF

SEQ ID NO: 1456703 - protein, 17 aa, Mycobacterium tuberculosis
GTAVRFALDYPARAGRL

SEQ ID NO: 1456704 - protein, 32 aa, Mycobacterium tuberculosis; identical to SEQ ID NO: 200458

SEQ ID NO: 1456705 - protein, 18 aa, Mycobacterium tuberculosis
GTELVSYRTGHRGDALLI

SEQ ID NO: 1456706 - protein, 24 aa, Mycobacterium tuberculosis
GTETLRAPMWLEHIRRRGWQAVAA

SEQ ID NO: 1456707 - protein, 26 aa, Mycobacterium tuberculosis
GTGAGVSGLWLLSGMRDDGVLTTIDI

SEQ ID NO: 1456708 - protein, 17 aa, Mycobacterium tuberculosis
GTGGVFVSDGFGVVHRK

SEQ ID NO: 1456709 - protein, 27 aa, Mycobacterium tuberculosis
GTLEARGKIAMLAKVRRAPALIKVESV

SEQ ID NO: 1456710 - protein, 25 aa, Mycobacterium tuberculosis
GTSGLPAGGWTRGRAVLAVVDGDGA

SEQ ID NO: 1456711 - protein, 18 aa, Mycobacterium tuberculosis
GTSTLVWRDAAQLPLALL

SEQ ID NO: 1456712 - protein, 23 aa, Mycobacterium tuberculosis
GTVDYRTAWQLQRELADARVAGG

SEQ ID NO: 1456713 - protein, 19 aa, Mycobacterium tuberculosis
GTVRAARLLAEIGDCRARF

SEQ ID NO: 1456714 - protein, 26 aa, Mycobacterium tuberculosis
GVAKQALKIAREWSVERVQWGKPVGQ

SEQ ID NO: 1456715 - protein, 24 aa, Mycobacterium tuberculosis
GVASVAFLPWPLRAVAGPFNLFAT

SEQ ID NO: 1456716 - protein, 24 aa, Mycobacterium tuberculosis
GVGRPQFSAVLECASAARQLGGHI

SEQ ID NO: 1456717 - protein, 18 aa, Mycobacterium tuberculosis
GVMNECWVRHLGTESGVG

SEQ ID NO: 1456718 - protein, 29 aa, Mycobacterium tuberculosis
GVPPPRWSISVPVLYALGALGSLRARLTG

SEQ ID NO: 1456719 - protein, 21 aa, Mycobacterium tuberculosis
GVQVWDCAAGALIAAEAGARV

SEQ ID NO: 1456720 - protein, 23 aa, Mycobacterium tuberculosis
GVRDELKLSLAAVTVLRERYLLH

SEQ ID NO: 1456721 - protein, 23 aa, Mycobacterium tuberculosis
GVRVICRRSKLMATIAGSAAMAS

SEQ ID NO: 1456722 - protein, 25 aa, Mycobacterium tuberculosis
GVSFWASLFPAVWSFCLALRSRGLG

SEQ ID NO: 1456723 - protein, 18 aa, Mycobacterium tuberculosis
GVTFRPVALESLSHFPVT

SEQ ID NO: 1456724 - protein, 24 aa, Mycobacterium tuberculosis
GVTGWPATVSHDFDAELPAADAVL

SEQ ID NO: 1456725 - protein, 28 aa, Mycobacterium tuberculosis
GVTSCLGCADLHRSDRDAAWPAIAAQLR

SEQ ID NO: 1456726 - protein, 17 aa, Mycobacterium tuberculosis
GVVARAVSRLVTIATGL

SEQ ID NO: 1456727 - protein, 21 aa, Mycobacterium tuberculosis
GVVLGNTWFWPADTLAMKAFS

SEQ ID NO: 1456728 - protein, 18 aa, Mycobacterium tuberculosis
GVWPDMTEHGWATDEWPA

SEQ ID NO: 1456729 - protein, 18 aa, Mycobacterium tuberculosis
GWAALGWDTLGNKLLIFQ

SEQ ID NO: 1456730 - protein, 24 aa, Mycobacterium tuberculosis
GWAGSLKRHGEWIVPTRLALVRRL

SEQ ID NO: 1456731 - protein, 23 aa, Mycobacterium tuberculosis
GWLRELWGGPFMLKGVMRVDDAK

SEQ ID NO: 1456732 - protein, 28 aa, Mycobacterium tuberculosis
GWVQGVGFRWWTRCRALELGLTGYAANH

SEQ ID NO: 1456733 - protein, 17 aa, Mycobacterium tuberculosis
GYAEAMRRFGTDKPDLR

SEQ ID NO: 1456734 - protein, 19 aa, Mycobacterium tuberculosis
GYGADLIACVARQVIAVDY

SEQ ID NO: 1456735 - protein, 26 aa, Mycobacterium tuberculosis
HAAADRCGRLALPRRTHVSVLTGTEA

SEQ ID NO: 1456736 - protein, 21 aa, Mycobacterium tuberculosis
HAALSRLGRPYVWGATGPNQF

SEQ ID NO: 1456737 - protein, 24 aa, Mycobacterium tuberculosis
HADFIRHRVGALLATDRDIATRVS

SEQ ID NO: 1456738 - protein, 23 aa, Mycobacterium tuberculosis
HAIRLAAAHLKAALDTELVASFA

SEQ ID NO: 1456739 - protein, 22 aa, Mycobacterium tuberculosis
HALKERYSRITVHDKGKRFNTD

SEQ ID NO: 1456740 - protein, 19 aa, Mycobacterium tuberculosis
HARFGRLPFETLFEPAISY

SEQ ID NO: 1456741 - protein, 19 aa, Mycobacterium tuberculosis
HAVVVGAGFIGCEVAASLR

SEQ ID NO: 1456742 - protein, 30 aa, Mycobacterium tuberculosis; identical to SEQ ID NO: 200673

SEQ ID NO: 1456743 - protein, 21 aa, Mycobacterium tuberculosis
HDHHSRRGLLLLVGRRRRLIK

SEQ ID NO: 1456744 - protein, 21 aa, Mycobacterium tuberculosis
HDITRLMSFDRGFDSYPGIKR

SEQ ID NO: 1456745 - protein, 17 aa, Mycobacterium tuberculosis
HDMGLAFVLSAALAGAP

SEQ ID NO: 1456746 - protein, 24 aa, Mycobacterium tuberculosis
HDSAKRICKEAHYHGAGTVEYLVG

SEQ ID NO: 1456747 - protein, 25 aa, Mycobacterium tuberculosis
HDVAVVLGSGWLPAVAALGSPTTVL

SEQ ID NO: 1456748 - protein, 23 aa, Mycobacterium tuberculosis
HEARGHGYLAYMHDPLAAAVAMD

SEQ ID NO: 1456749 - protein, 24 aa, Mycobacterium tuberculosis
HEEFPRIDPAVICLVHDGADRAVL

SEQ ID NO: 1456750 - protein, 29 aa, Mycobacterium tuberculosis
HERGLPMSFTFARFLKFIVTEIFPGGRLP

SEQ ID NO: 1456751 - protein, 25 aa, Mycobacterium tuberculosis
HGAIARLKHRGVDVVEIVGGDAHDA

SEQ ID NO: 1456752 - protein, 25 aa, Mycobacterium tuberculosis
HGANLHGRYLLPHFLIHDIADVAAD

SEQ ID NO: 1456753 - protein, 18 aa, Mycobacterium tuberculosis
HGDLSRFNILTAQGRLTG

SEQ ID NO: 1456754 - protein, 25 aa, Mycobacterium tuberculosis
HGFSRGSLNVIARRAGVAKGSLFQY

SEQ ID NO: 1456755 - protein, 23 aa, Mycobacterium tuberculosis
HGGLRYLEQLEFGLVREALYERE

SEQ ID NO: 1456756 - protein, 27 aa, Mycobacterium tuberculosis
HGLPLTLWLARFLKFIATEIFPGGQPP

SEQ ID NO: 1456757 - protein, 19 aa, Mycobacterium tuberculosis
HGMSSMFRSFVAGQLATLR

SEQ ID NO: 1456758 - protein, 26 aa, Mycobacterium tuberculosis
HGRDEIWRFTPLRRLRGLHDGSARAT

SEQ ID NO: 1456759 - protein, 20 aa, Mycobacterium tuberculosis
HGVGRLKRPWLAGYLGPDVL

SEQ ID NO: 1456760 - protein, 24 aa, Mycobacterium tuberculosis
HIDITADLGAPVYFCDSRSPWQRA

SEQ ID NO: 1456761 - protein, 23 aa, Mycobacterium tuberculosis
HIPRCVRPAFVKRVSIIGPESTG

SEQ ID NO: 1456762 - protein, 19 aa, Mycobacterium tuberculosis
HKPEESKRTFGARIVTPSA

SEQ ID NO: 1456763 - protein, 20 aa, Mycobacterium tuberculosis
HLDLPSWDLDPVLGVSVITA

SEQ ID NO: 1456764 - protein, 19 aa, Mycobacterium tuberculosis
HLQAARPGEDWTGSQQFSG

SEQ ID NO: 1456765 - protein, 19 aa, Mycobacterium tuberculosis
HNLIHGFILAAAHLVPDGT

SEQ ID NO: 1456766 - protein, 18 aa, Mycobacterium tuberculosis
HNPFRVFTSMLAIEDRRY

SEQ ID NO: 1456767 - protein, 22 aa, Mycobacterium tuberculosis
HNQARLPYLVYLRHPTTGGVFA

SEQ ID NO: 1456768 - protein, 21 aa, Mycobacterium tuberculosis
HPAIARRWLSSVAQRVSTAQI

SEQ ID NO: 1456769 - protein, 17 aa, Mycobacterium tuberculosis
HPDRCAGVVGISVPFAG

SEQ ID NO: 1456770 - protein, 21 aa, Mycobacterium tuberculosis
HPECGCATSALYLAGEGAFPA

SEQ ID NO: 1456771 - protein, 25 aa, Mycobacterium tuberculosis
HPLAHLRAFVLIPWIAVDPTAQLTV

SEQ ID NO: 1456772 - protein, 31 aa, Mycobacterium tuberculosis; identical to SEQ ID NO: 200816

SEQ ID NO: 1456773 - protein, 17 aa, Mycobacterium tuberculosis
HRAALNFGDCMTYATAQ

SEQ ID NO: 1456774 - protein, 18 aa, Mycobacterium tuberculosis
HRDRFCWFGSEYVEAALV

SEQ ID NO: 1456775 - protein, 18 aa, Mycobacterium tuberculosis
HRQECERLGLPVFVKPAR

SEQ ID NO: 1456776 - protein, 24 aa, Mycobacterium tuberculosis
HRQPRCLPQRIAVPVTKLKTCRLG

SEQ ID NO: 1456777 - protein, 18 aa, Mycobacterium tuberculosis
HRVGSIGMYRQLRDDPSQ

SEQ ID NO: 1456778 - protein, 21 aa, Mycobacterium tuberculosis
HSEAPPFFVLHGEKDPMVPSA

SEQ ID NO: 1456779 - protein, 24 aa, Mycobacterium tuberculosis
HSLWPVFADIPAGWRVVHGEASRA

SEQ ID NO: 1456780 - protein, 17 aa, Mycobacterium tuberculosis
HSYWSKFSDKGYYFAGD

SEQ ID NO: 1456781 - protein, 32 aa, Mycobacterium tuberculosis; identical to SEQ ID NO: 200863

SEQ ID NO: 1456782 - protein, 19 aa, Mycobacterium tuberculosis
HTEWLPPPHLDHGQPRTNT

SEQ ID NO: 1456783 - protein, 22 aa, Mycobacterium tuberculosis
HTVRPALEIIKTVPGISTVSSI

SEQ ID NO: 1456784 - protein, 21 aa, Mycobacterium tuberculosis
HVDVPELLRVLDFAPTPKARL

SEQ ID NO: 1456785 - protein, 36 aa, Mycobacterium tuberculosis; identical to SEQ ID NO: 200886

SEQ ID NO: 1456786 - protein, 19 aa, Mycobacterium tuberculosis
HVLTARRRARRHLAALRAL

SEQ ID NO: 1456787 - protein, 19 aa, Mycobacterium tuberculosis
HVLVAFGLAGAQPILLGAG

SEQ ID NO: 1456788 - protein, 30 aa, Mycobacterium tuberculosis; identical to SEQ ID NO: 200904

SEQ ID NO: 1456789 - protein, 25 aa, Mycobacterium tuberculosis
HYQKLTGYENLRFFASLYAGATADP

SEQ ID NO: 1456790 - protein, 19 aa, Mycobacterium tuberculosis
HYTRLAALDLCPRVRVNAI

SEQ ID NO: 1456791 - protein, 17 aa, Mycobacterium tuberculosis
IAAALAVQGLKTLVIDL

SEQ ID NO: 1456792 - protein, 25 aa, Mycobacterium tuberculosis
IAAELPMQMICILLGVPETDRHWLF

SEQ ID NO: 1456793 - protein, 25 aa, Mycobacterium tuberculosis
IAAKHAQGLNVRWWSPQQVTQRRGF

SEQ ID NO: 1456794 - protein, 25 aa, Mycobacterium tuberculosis
IADALIELCGLLGYDARRDTDPADT

SEQ ID NO: 1456795 - protein, 18 aa, Mycobacterium tuberculosis
IAEANVLALKAGWNYGET

SEQ ID NO: 1456796 - protein, 18 aa, Mycobacterium tuberculosis
IAGSQVLKKAAALAQPVI

SEQ ID NO: 1456797 - protein, 18 aa, Mycobacterium tuberculosis
IAIARAVRGWAVTNPARW

SEQ ID NO: 1456798 - protein, 19 aa, Mycobacterium tuberculosis
IAKFREVLETEYLKRPLID

SEQ ID NO: 1456799 - protein, 19 aa, Mycobacterium tuberculosis
IALTPRPAPTVATEHLHEL

SEQ ID NO: 1456800 - protein, 20 aa, Mycobacterium tuberculosis
IALTRPGGVVLYATCSPHLA

SEQ ID NO: 1456801 - protein, 27 aa, Mycobacterium tuberculosis
IAMLACARLGIMHSVVFGGFTAAALQA

SEQ ID NO: 1456802 - protein, 23 aa, Mycobacterium tuberculosis
IAQGIPRVHRWARGVDVQRFAPS

SEQ ID NO: 1456803 - protein, 18 aa, Mycobacterium tuberculosis
IAQVHGWCVGGASDYALC

SEQ ID NO: 1456804 - protein, 25 aa, Mycobacterium tuberculosis
IAREPRGDGGFGYDPVFVPYGDDRT

SEQ ID NO: 1456805 - protein, 21 aa, Mycobacterium tuberculosis
IARPRDVHVVPELPKTRSGKI

SEQ ID NO: 1456806 - protein, 24 aa, Mycobacterium tuberculosis
IARSFAAALGLDFTRVQFTPDLLP

SEQ ID NO: 1456807 - protein, 22 aa, Mycobacterium tuberculosis
IASDIPPLSWFLGNSPPPLLNS

SEQ ID NO: 1456808 - protein, 18 aa, Mycobacterium tuberculosis
IASLGRYGYGWADSDVAG

SEQ ID NO: 1456809 - protein, 18 aa, Mycobacterium tuberculosis
IASLPATAVGDGFVEGVD

SEQ ID NO: 1456810 - protein, 25 aa, Mycobacterium tuberculosis
IATDHLMRFPGRFSEQLLPEHLHKV

SEQ ID NO: 1456811 - protein, 23 aa, Mycobacterium tuberculosis
IAVESRSGIAPVTIDLSAVTHLG

SEQ ID NO: 1456812 - protein, 26 aa, Mycobacterium tuberculosis
ICGPETLRSLYFLSSRVSGGSPHAIR

SEQ ID NO: 1456813 - protein, 19 aa, Mycobacterium tuberculosis
IDARKGVVVVGADRVGPTI

SEQ ID NO: 1456814 - protein, 23 aa, Mycobacterium tuberculosis
IDCVQLPSRLGGVPVITPARVRG

SEQ ID NO: 1456815 - protein, 23 aa, Mycobacterium tuberculosis
IDELRYGRIPARVSGPDPVPGCL

SEQ ID NO: 1456816 - protein, 19 aa, Mycobacterium tuberculosis
IDGNYHWQGTVFDSLPETS

SEQ ID NO: 1456817 - protein, 22 aa, Mycobacterium tuberculosis
IDGSCRRFGAGAGNAPVEALIG

SEQ ID NO: 1456818 - protein, 23 aa, Mycobacterium tuberculosis
IDIDARPAVLLVIPADTPDKLAV

SEQ ID NO: 1456819 - protein, 19 aa, Mycobacterium tuberculosis
IDLEMRRPTYVFAAVDHTG

SEQ ID NO: 1456820 - protein, 21 aa, Mycobacterium tuberculosis
IDLERRRISLSLKQANEDYTE

SEQ ID NO: 1456821 - protein, 20 aa, Mycobacterium tuberculosis
IDLEVEWPAEELIDATIVDT

SEQ ID NO: 1456822 - protein, 20 aa, Mycobacterium tuberculosis
IDLIMPIGKGQRALIVSPPK

SEQ ID NO: 1456823 - protein, 24 aa, Mycobacterium tuberculosis
IDLQTCGLVAVGHRVVHGGTEFHQ

SEQ ID NO: 1456824 - protein, 19 aa, Mycobacterium tuberculosis
IDMGLRLVELLVSREAAEA

SEQ ID NO: 1456825 - protein, 19 aa, Mycobacterium tuberculosis
IDMVIDIGAALCGDIDAVR

SEQ ID NO: 1456826 - protein, 19 aa, Mycobacterium tuberculosis
IDPETGEVRHVPPGDMPGG

SEQ ID NO: 1456827 - protein, 25 aa, Mycobacterium tuberculosis
IDRPLRPSFVDGLRNEIQIVVTILS

SEQ ID NO: 1456828 - protein, 30 aa, Mycobacterium tuberculosis; identical to SEQ ID NO: 201055

SEQ ID NO: 1456829 - protein, 30 aa, Mycobacterium tuberculosis; identical to SEQ ID NO: 201067

SEQ ID NO: 1456830 - protein, 17 aa, Mycobacterium tuberculosis
IDWVVVCMHQTAISTAD

SEQ ID NO: 1456831 - protein, 18 aa, Mycobacterium tuberculosis
IEEIVRWTSPSPSKRRTA

SEQ ID NO: 1456832 - protein, 25 aa, Mycobacterium tuberculosis
IELAKRLGNRFDVRAVRLDSGDLDE

SEQ ID NO: 1456833 - protein, 29 aa, Mycobacterium tuberculosis
IELRVYRFGGSLHLDWWYDTRRIPAATAE

SEQ ID NO: 1456834 - protein, 18 aa, Mycobacterium tuberculosis
IEQGLKGVEFIAINTDAQ

SEQ ID NO: 1456835 - protein, 24 aa, Mycobacterium tuberculosis
IEQMPLDAGHSWRRNIALSADDVL

SEQ ID NO: 1456836 - protein, 26 aa, Mycobacterium tuberculosis
IETNVEFWAAVVLDFARVPANMMPAM

SEQ ID NO: 1456837 - protein, 26 aa, Mycobacterium tuberculosis
IEYPCVFDHRGQRFMLYSGDGYGRTG

SEQ ID NO: 1456838 - protein, 25 aa, Mycobacterium tuberculosis
IGAGTFPWVLAITMPYSDAAQRGAF

SEQ ID NO: 1456839 - protein, 18 aa, Mycobacterium tuberculosis
IGALKGRLHGGANEAVMH

SEQ ID NO: 1456840 - protein, 34 aa, Mycobacterium tuberculosis; identical to SEQ ID NO: 201133

SEQ ID NO: 1456841 - protein, 34 aa, Mycobacterium tuberculosis; identical to SEQ ID NO: 201139

SEQ ID NO: 1456842 - protein, 20 aa, Mycobacterium tuberculosis
IGFDAGDGFLGRLRGSDITR

SEQ ID NO: 1456843 - protein, 19 aa, Mycobacterium tuberculosis
IGFRGWLAAAEGWGLANEL

SEQ ID NO: 1456844 - protein, 17 aa, Mycobacterium tuberculosis
IGMGNNFIQSAKTLGLI

SEQ ID NO: 1456845 - protein, 18 aa, Mycobacterium tuberculosis
IGRLLLRCHDRPGIIAAV

SEQ ID NO: 1456846 - protein, 18 aa, Mycobacterium tuberculosis
IGSEGVFGVITRVRLRVH

SEQ ID NO: 1456847 - protein, 17 aa, Mycobacterium tuberculosis
IHASRLAVESVFDALAG

SEQ ID NO: 1456848 - protein, 19 aa, Mycobacterium tuberculosis
IHETREWILRNSPVPVGTV

SEQ ID NO: 1456849 - protein, 20 aa, Mycobacterium tuberculosis
IHFEPRIHRVIGLRDHSALT

SEQ ID NO: 1456850 - protein, 19 aa, Mycobacterium tuberculosis
IHGVQICQHHCPVSHVAEE

SEQ ID NO: 1456851 - protein, 18 aa, Mycobacterium tuberculosis
IHRVPAWSTNLSRKVIRR

SEQ ID NO: 1456852 - protein, 18 aa, Mycobacterium tuberculosis
IIELWPFSQGERAGIADG

SEQ ID NO: 1456853 - protein, 25 aa, Mycobacterium tuberculosis
IIIAGAGAIGMEFGYVLKNYGVDVT

SEQ ID NO: 1456854 - protein, 18 aa, Mycobacterium tuberculosis
IIRELRPHVVVTYDPNGG

SEQ ID NO: 1456855 - protein, 19 aa, Mycobacterium tuberculosis
IIYRMGVTPPQAKQILSTG

SEQ ID NO: 1456856 - protein, 26 aa, Mycobacterium tuberculosis
IKAGKAGLVPAHLRDGHYSGAAALGN

SEQ ID NO: 1456857 - protein, 19 aa, Mycobacterium tuberculosis
IKAQAYRLQTFGTVTRLAA

SEQ ID NO: 1456858 - protein, 24 aa, Mycobacterium tuberculosis
IKDGRPVDFGSFLIPRSEYEIKDV

SEQ ID NO: 1456859 - protein, 17 aa, Mycobacterium tuberculosis
IKGLARLAREAGAAHPR

SEQ ID NO: 1456860 - protein, 19 aa, Mycobacterium tuberculosis
IKNGLKFYEMTGFAKSNAA

SEQ ID NO: 1456861 - protein, 22 aa, Mycobacterium tuberculosis
IKPSHLAGGYGQHAFAFNYLGP

SEQ ID NO: 1456862 - protein, 24 aa, Mycobacterium tuberculosis
IKQLKYRYLRALDTKHWDDFTDTL

SEQ ID NO: 1456863 - protein, 20 aa, Mycobacterium tuberculosis
IKVIVLRGAGRAFSGGYDFG

SEQ ID NO: 1456864 - protein, 27 aa, Mycobacterium tuberculosis
ILAVMPWNFPLWQAVRFAAPALMAGNV

SEQ ID NO: 1456865 - protein, 17 aa, Mycobacterium tuberculosis
ILPYLDIRLDYYDLGIE

SEQ ID NO: 1456866 - protein, 24 aa, Mycobacterium tuberculosis
ILRAMEALDLLPLTDRRHLIEKLG

SEQ ID NO: 1456867 - protein, 19 aa, Mycobacterium tuberculosis
ILSAATVFVCPSVYEPLGI

SEQ ID NO: 1456868 - protein, 17 aa, Mycobacterium tuberculosis
IMADFNVTDGRRFGFDV

SEQ ID NO: 1456869 - protein, 18 aa, Mycobacterium tuberculosis
INAIGYPLAATVGLGTID

SEQ ID NO: 1456870 - protein, 24 aa, Mycobacterium tuberculosis
INDIYRCHPALWSLDTTPEGYSWI

SEQ ID NO: 1456871 - protein, 18 aa, Mycobacterium tuberculosis
INEAASLVQDAAHPDANI

SEQ ID NO: 1456872 - protein, 24 aa, Mycobacterium tuberculosis
INKEINLRFVLGYTPLEFRDTLHM

SEQ ID NO: 1456873 - protein, 19 aa, Mycobacterium tuberculosis
INTMPGFTTISMYPRMWAA

SEQ ID NO: 1456874 - protein, 17 aa, Mycobacterium tuberculosis
IPAIPGIDHPMVLTYAE

SEQ ID NO: 1456875 - protein, 22 aa, Mycobacterium tuberculosis
IPAVIKNAIDWLSRPFGDGALK

SEQ ID NO: 1456876 - protein, 17 aa, Mycobacterium tuberculosis
IPEADAVEQGRAVDFDD

SEQ ID NO: 1456877 - protein, 17 aa, Mycobacterium tuberculosis
IPKANFELWSFAVSAIN

SEQ ID NO: 1456878 - protein, 19 aa, Mycobacterium tuberculosis
IPLGASVLLVSGRASFELT

SEQ ID NO: 1456879 - protein, 19 aa, Mycobacterium tuberculosis
IPLTAHFLGGAVIGDDPEH

SEQ ID NO: 1456880 - protein, 34 aa, Mycobacterium tuberculosis; identical to SEQ ID NO: 201328

SEQ ID NO: 1456881 - protein, 18 aa, Mycobacterium tuberculosis
IPNPFAVTYYLIKGSLQA

SEQ ID NO: 1456882 - protein, 18 aa, Mycobacterium tuberculosis
IPPLDWDPDEAFDRLQSE

SEQ ID NO: 1456883 - protein, 21 aa, Mycobacterium tuberculosis
IPRAHRGIVAVNELPDLAERI

SEQ ID NO: 1456884 - protein, 22 aa, Mycobacterium tuberculosis
IPRTKRGVISYAARDIGERLDA

SEQ ID NO: 1456885 - protein, 20 aa, Mycobacterium tuberculosis
IPRVVGFRLTGEIQPGVTAT

SEQ ID NO: 1456886 - protein, 24 aa, Mycobacterium tuberculosis
IPTDWGRCVLTIGVFDGVHRGHAE

SEQ ID NO: 1456887 - protein, 19 aa, Mycobacterium tuberculosis
IPVMAKVRIGHFVEAQILQ

SEQ ID NO: 1456888 - protein, 21 aa, Mycobacterium tuberculosis
IPVTVKFRIGIDDAHHTHLDA

SEQ ID NO: 1456889 - protein, 29 aa, Mycobacterium tuberculosis
IQAPAALGLICPWADLAVDIEATRPALRD

SEQ ID NO: 1456890 - protein, 19 aa, Mycobacterium tuberculosis
IRAALLAHKVVFFRGQHQL

SEQ ID NO: 1456891 - protein, 21 aa, Mycobacterium tuberculosis
IRAFWPGALSLVVVQAPSLQW

SEQ ID NO: 1456892 - protein, 24 aa, Mycobacterium tuberculosis
IRAGEGVSYGHTWIAPRDTNLALL

SEQ ID NO: 1456893 - protein, 21 aa, Mycobacterium tuberculosis
IRAILRAPVDLLFNGGIGTYI

SEQ ID NO: 1456894 - protein, 18 aa, Mycobacterium tuberculosis
IRALVPRRDVNGIMDELA

SEQ ID NO: 1456895 - protein, 26 aa, Mycobacterium tuberculosis
IRAQLLERFGMFGIRMSIAVLAAGVT

SEQ ID NO: 1456896 - protein, 21 aa, Mycobacterium tuberculosis
IREGARIALNPSPEWIEELDR

SEQ ID NO: 1456897 - protein, 23 aa, Mycobacterium tuberculosis
IRELRFYRRTAFVPQPGPSTSEI

SEQ ID NO: 1456898 - protein, 19 aa, Mycobacterium tuberculosis
IRGRIKELINRGGEKISPE

SEQ ID NO: 1456899 - protein, 17 aa, Mycobacterium tuberculosis
IRKEGKIGRVYYPAPYM

SEQ ID NO: 1456900 - protein, 22 aa, Mycobacterium tuberculosis
IRLAKCGPWHRGGWDPIPEGLT

SEQ ID NO: 1456901 - protein, 18 aa, Mycobacterium tuberculosis
IRPGDIVVVNTGWHHKYA

SEQ ID NO: 1456902 - protein, 19 aa, Mycobacterium tuberculosis
IRRILRTQLGWAPDERTLQ

SEQ ID NO: 1456903 - protein, 25 aa, Mycobacterium tuberculosis
IRSGLPFGTCLDAAYLHPCGSDEFK

SEQ ID NO: 1456904 - protein, 23 aa, Mycobacterium tuberculosis
IRSKGVGVFFCTQLPTDLPNDVL

SEQ ID NO: 1456905 - protein, 17 aa, Mycobacterium tuberculosis
IRVDTRCELRAGVQKAL

SEQ ID NO: 1456906 - protein, 17 aa, Mycobacterium tuberculosis
IRVLRYGSVPGETMAAT

SEQ ID NO: 1456907 - protein, 26 aa, Mycobacterium tuberculosis
ISARWGRPGPLWSVSIERFLDTAWWV

SEQ ID NO: 1456908 - protein, 17 aa, Mycobacterium tuberculosis
ISELKQQYTIVIVTHNM

SEQ ID NO: 1456909 - protein, 33 aa, Mycobacterium tuberculosis; identical to SEQ ID NO: 201428

SEQ ID NO: 1456910 - protein, 23 aa, Mycobacterium tuberculosis
ISLELRQGRTLGIVGESGSGKST

SEQ ID NO: 1456911 - protein, 18 aa, Mycobacterium tuberculosis
ISPIARPRDVHVVPELPK

SEQ ID NO: 1456912 - protein, 21 aa, Mycobacterium tuberculosis
ISRDELIAGLAYHGPLNYRPL

SEQ ID NO: 1456913 - protein, 25 aa, Mycobacterium tuberculosis
ISTPRWTELKSRVRDYLGTKIEFRL

SEQ ID NO: 1456914 - protein, 22 aa, Mycobacterium tuberculosis
ITDGRWSCVQWGLRKPPFCPDP

SEQ ID NO: 1456915 - protein, 25 aa, Mycobacterium tuberculosis
ITDRLKDMYICGGFNVYPAEVEQVL

SEQ ID NO: 1456916 - protein, 21 aa, Mycobacterium tuberculosis
ITLRPEMWVRKIAGADVVSEL

SEQ ID NO: 1456917 - protein, 23 aa, Mycobacterium tuberculosis
ITQEFDATVCWMADNAVLEPGRD

SEQ ID NO: 1456918 - protein, 17 aa, Mycobacterium tuberculosis
ITRERLDAVLAAVVDGH

SEQ ID NO: 1456919 - protein, 19 aa, Mycobacterium tuberculosis
IVDDIALVRDCCAPGSRFA

SEQ ID NO: 1456920 - protein, 25 aa, Mycobacterium tuberculosis
IVEPKYWGGVCLNVGCIPSKALLRN

SEQ ID NO: 1456921 - protein, 25 aa, Mycobacterium tuberculosis
IVETRGRFGTFISRFDPTDAAMAAA

SEQ ID NO: 1456922 - protein, 18 aa, Mycobacterium tuberculosis
IVHDLRQPLPVKTGSIDG

SEQ ID NO: 1456923 - protein, 34 aa, Mycobacterium tuberculosis; identical to SEQ ID NO: 81328

SEQ ID NO: 1456924 - protein, 19 aa, Mycobacterium tuberculosis
IVVREGLSADLARALHDDA

SEQ ID NO: 1456925 - protein, 26 aa, Mycobacterium tuberculosis
IVVRGELFTAFVPFAARWPVEVHIYP

SEQ ID NO: 1456926 - protein, 24 aa, Mycobacterium tuberculosis
IYRALRPGGVLLMVDIKASSQLED

SEQ ID NO: 1456927 - protein, 20 aa, Mycobacterium tuberculosis
IYRTRFGALLTAAADRRAAL

SEQ ID NO: 1456928 - protein, 26 aa, Mycobacterium tuberculosis
KAAAAGRPWWEWAATHERAFTAAYDA

SEQ ID NO: 1456929 - protein, 25 aa, Mycobacterium tuberculosis
KAAAEGRLKGILKYYDAPIVSSDIV

SEQ ID NO: 1456930 - protein, 18 aa, Mycobacterium tuberculosis
KAARFVRTCDCFNIPIVM

SEQ ID NO: 1456931 - protein, 25 aa, Mycobacterium tuberculosis
KAIWWQRAVAVWPDYASYQTKTDRQ

SEQ ID NO: 1456932 - protein, 18 aa, Mycobacterium tuberculosis
KALGHAYGGGSQYFSMWV

SEQ ID NO: 1456933 - protein, 23 aa, Mycobacterium tuberculosis
KAMARPTLRHRVMLRPEAELEGA

SEQ ID NO: 1456934 - protein, 18 aa, Mycobacterium tuberculosis
KAMLQDMAILTGGQVISE

SEQ ID NO: 1456935 - protein, 20 aa, Mycobacterium tuberculosis
KANFELWSFAVSAINGCSHC

SEQ ID NO: 1456936 - protein, 24 aa, Mycobacterium tuberculosis
KAPEIPYYSATLFDPREAPACDAR

SEQ ID NO: 1456937 - protein, 21 aa, Mycobacterium tuberculosis
KAPTRGAPLCGFRQTSRILAG

SEQ ID NO: 1456938 - protein, 22 aa, Mycobacterium tuberculosis
KAREVILRLFGPLLDAAPTLGA

SEQ ID NO: 1456939 - protein, 25 aa, Mycobacterium tuberculosis
KARVRALGVAGAFHTEFMAPALDGF

SEQ ID NO: 1456940 - protein, 24 aa, Mycobacterium tuberculosis
KASAYRCGEAWSTLVHHRPSGRRL

SEQ ID NO: 1456941 - protein, 26 aa, Mycobacterium tuberculosis
KATQEDPWRHFARTHAIGQIVPGKVT

SEQ ID NO: 1456942 - protein, 24 aa, Mycobacterium tuberculosis
KAVAPRVACDVIDRAIQVHGAAGV

SEQ ID NO: 1456943 - protein, 31 aa, Mycobacterium tuberculosis; identical to SEQ ID NO: 201555

SEQ ID NO: 1456944 - protein, 24 aa, Mycobacterium tuberculosis
KAVQRSAGAIAIGPVLQGLRKPVN

SEQ ID NO: 1456945 - protein, 21 aa, Mycobacterium tuberculosis
KDLRRARAAALNIVPTSTGAA

SEQ ID NO: 1456946 - protein, 25 aa, Mycobacterium tuberculosis
KDRMPTPYLPVGLKLNALEGTGEVQ

SEQ ID NO: 1456947 - protein, 24 aa, Mycobacterium tuberculosis
KDTRGIIRVHQFDKVEGFVYCTPA

SEQ ID NO: 1456948 - protein, 19 aa, Mycobacterium tuberculosis
KEAMVRQWALRFRDDANQR

SEQ ID NO: 1456949 - protein, 22 aa, Mycobacterium tuberculosis
KEHKALVIKGGYMDGHPLTVAE

SEQ ID NO: 1456950 - protein, 22 aa, Mycobacterium tuberculosis
KEVVAAHLVNLVWNGLTHLEAD

SEQ ID NO: 1456951 - protein, 25 aa, Mycobacterium tuberculosis
KFADEFHPELQFDKPYLLAMANAGP

SEQ ID NO: 1456952 - protein, 32 aa, Mycobacterium tuberculosis; identical to SEQ ID NO: 81420

SEQ ID NO: 1456953 - protein, 33 aa, Mycobacterium tuberculosis; identical to SEQ ID NO: 201627

SEQ ID NO: 1456954 - protein, 21 aa, Mycobacterium tuberculosis
KGLPLPFGATLTFCSRADADK

SEQ ID NO: 1456955 - protein, 24 aa, Mycobacterium tuberculosis
KGLQFPIVYLPFAFNRNVRSDDIL

SEQ ID NO: 1456956 - protein, 19 aa, Mycobacterium tuberculosis
KGQVFDWAPGVTLSLGLAA

SEQ ID NO: 1456957 - protein, 23 aa, Mycobacterium tuberculosis
KGRAALQKAVPLWRGVQAEVTAS

SEQ ID NO: 1456958 - protein, 19 aa, Mycobacterium tuberculosis
KGRGRRALESLPRGLALQI

SEQ ID NO: 1456959 - protein, 20 aa, Mycobacterium tuberculosis
KGTSGMRKNELIAAIEEIRR

SEQ ID NO: 1456960 - protein, 27 aa, Mycobacterium tuberculosis
KHGAKMVTAVACARVPKLTVVIGGSYG

SEQ ID NO: 1456961 - protein, 21 aa, Mycobacterium tuberculosis
KIAAACVEFVFGPLLNNPHRL

SEQ ID NO: 1456962 - protein, 25 aa, Mycobacterium tuberculosis
KIARRIEADIVRRGWPIGASLGSES

SEQ ID NO: 1456963 - protein, 19 aa, Mycobacterium tuberculosis
KIRLGRFASGATHWAEGET

SEQ ID NO: 1456964 - protein, 20 aa, Mycobacterium tuberculosis
KIRPSDVYRPIGEVWDEINR

SEQ ID NO: 1456965 - protein, 22 aa, Mycobacterium tuberculosis
KLADLALDIGRSVGCSAYENDF

SEQ ID NO: 1456966 - protein, 23 aa, Mycobacterium tuberculosis
KLAELRERLELAKEPGGEKAAAK

SEQ ID NO: 1456967 - protein, 19 aa, Mycobacterium tuberculosis
KLGRRWHRETVYGVAVRGY

SEQ ID NO: 1456968 - protein, 24 aa, Mycobacterium tuberculosis
KLPVANWPALGGMGNASWTQLSGH

SEQ ID NO: 1456969 - protein, 22 aa, Mycobacterium tuberculosis
KLRHGLPGAVFVSARTGDGIDA

SEQ ID NO: 1456970 - protein, 18 aa, Mycobacterium tuberculosis
KLSGKRIIIDPGRGGVDH

SEQ ID NO: 1456971 - protein, 25 aa, Mycobacterium tuberculosis
KNATRFGMQDVIWRGAYYTPNGART

SEQ ID NO: 1456972 - protein, 20 aa, Mycobacterium tuberculosis
KNIDTGMGVERIALVLQDVH

SEQ ID NO: 1456973 - protein, 19 aa, Mycobacterium tuberculosis
KPRFGHGVVTELGAGVRLL

SEQ ID NO: 1456974 - protein, 22 aa, Mycobacterium tuberculosis
KPTAPYAAAVREWEKLERFVES

SEQ ID NO: 1456975 - protein, 17 aa, Mycobacterium tuberculosis
KPTEFRPSRFLDGSVAP

SEQ ID NO: 1456976 - protein, 31 aa, Mycobacterium tuberculosis; identical to SEQ ID NO: 195570

SEQ ID NO: 1456977 - protein, 21 aa, Mycobacterium tuberculosis
KPWGSRFPLISIRDQVQADVA

SEQ ID NO: 1456978 - protein, 25 aa, Mycobacterium tuberculosis
KQEPVWRARCIVSAPWMGLAGVPSA

SEQ ID NO: 1456979 - protein, 19 aa, Mycobacterium tuberculosis
KQQLDHWARVGRAVSNQHT

SEQ ID NO: 1456980 - protein, 22 aa, Mycobacterium tuberculosis
KQRAFEVLDKMRLIDISNNLGD

SEQ ID NO: 1456981 - protein, 25 aa, Mycobacterium tuberculosis
KQRGEPVSCFLLRVEDNMESIGRSI

SEQ ID NO: 1456982 - protein, 22 aa, Mycobacterium tuberculosis
KRAEDLLIRVNLGERMKHRPGD

SEQ ID NO: 1456983 - protein, 18 aa, Mycobacterium tuberculosis
KRKIIGRQFIRAFEGAVR

SEQ ID NO: 1456984 - protein, 21 aa, Mycobacterium tuberculosis
KRMALPNARVLIHQPSLSGVI

SEQ ID NO: 1456985 - protein, 24 aa, Mycobacterium tuberculosis
KRSPEEVRFLMGFNRDVVRRRRDT

SEQ ID NO: 1456986 - protein, 24 aa, Mycobacterium tuberculosis
KRWWERPYIAAGIFLYDRLGGAKS

SEQ ID NO: 1456987 - protein, 27 aa, Mycobacterium tuberculosis
KSPHLEAFKAKGYEVLLLTDPVDEVWV

SEQ ID NO: 1456988 - protein, 21 aa, Mycobacterium tuberculosis
KTGLARLALHTGVPVIPVAMI

SEQ ID NO: 1456989 - protein, 18 aa, Mycobacterium tuberculosis
KTLKAVAVKGPYFGDRRK

SEQ ID NO: 1456990 - protein, 26 aa, Mycobacterium tuberculosis
KTPEGLRWLYNFIKAQGERNFGKIYV

SEQ ID NO: 1456991 - protein, 24 aa, Mycobacterium tuberculosis
KTRARRDGPDWVITGGKMWITNGS

SEQ ID NO: 1456992 - protein, 20 aa, Mycobacterium tuberculosis
KTSFALRIAAELLRYHTVEQ

SEQ ID NO: 1456993 - protein, 26 aa, Mycobacterium tuberculosis
KVDFAKAFWNVVNWADVQSRYAAATS

SEQ ID NO: 1456994 - protein, 24 aa, Mycobacterium tuberculosis
KVDRSAAYAMRWVAKNVVAAGLAE

SEQ ID NO: 1456995 - protein, 17 aa, Mycobacterium tuberculosis
KVFRIGRLCTKRDARGQ

SEQ ID NO: 1456996 - protein, 28 aa, Mycobacterium tuberculosis
KVGLYCRNRIEIVIAMLGIVKAGAILVN

SEQ ID NO: 1456997 - protein, 18 aa, Mycobacterium tuberculosis
KVIGWAFERDRIPLGASV

SEQ ID NO: 1456998 - protein, 24 aa, Mycobacterium tuberculosis
KVLICGYGDVGKGCAEAMKGQGAR

SEQ ID NO: 1456999 - protein, 24 aa, Mycobacterium tuberculosis
KVLRLPRGEGLGVPASGYEIHHGR

SEQ ID NO: 1457000 - protein, 23 aa, Mycobacterium tuberculosis
KVVREIVSGLGLKEAKDLVDGAP

SEQ ID NO: 1457001 - protein, 19 aa, Mycobacterium tuberculosis
KYADWARSHMAAMSHLAVG

SEQ ID NO: 1457002 - protein, 20 aa, Mycobacterium tuberculosis
KYMKMITPAALLRCLVEGAD

SEQ ID NO: 1457003 - protein, 24 aa, Mycobacterium tuberculosis
LAAAFPGDGWLGSAADKYAGKNRN

SEQ ID NO: 1457004 - protein, 29 aa, Mycobacterium tuberculosis
LADGRELLFFSLPGPRTSGTAAERVARHA

SEQ ID NO: 1457005 - protein, 24 aa, Mycobacterium tuberculosis
LADLFLPRPLRWLAGATRSAVLRR

SEQ ID NO: 1457006 - protein, 18 aa, Mycobacterium tuberculosis
LAEALVCAAARETFEESG

SEQ ID NO: 1457007 - protein, 19 aa, Mycobacterium tuberculosis
LAELWSRYHNVLVEGHRQY

SEQ ID NO: 1457008 - protein, 17 aa, Mycobacterium tuberculosis
LAERVEVQVAYAIGKAA

SEQ ID NO: 1457009 - protein, 17 aa, Mycobacterium tuberculosis
LAGGCFWGLQDLIRNQP

SEQ ID NO: 1457010 - protein, 19 aa, Mycobacterium tuberculosis
LAGGWLRANLPAVDAVLCS

SEQ ID NO: 1457011 - protein, 25 aa, Mycobacterium tuberculosis
LAGLCGALRRYHEALGVPISTLPMA

SEQ ID NO: 1457012 - protein, 17 aa, Mycobacterium tuberculosis
LAGQPLDRPFAWALIKL

SEQ ID NO: 1457013 - protein, 25 aa, Mycobacterium tuberculosis
LAGSDSLREPVVWQRLHQVDPAHLW

SEQ ID NO: 1457014 - protein, 21 aa, Mycobacterium tuberculosis
LAGSVWNSGGCRSWYLDEHGK

SEQ ID NO: 1457015 - protein, 23 aa, Mycobacterium tuberculosis
LAHKLEWPSNVWMGVSVENVDAF

SEQ ID NO: 1457016 - protein, 32 aa, Mycobacterium tuberculosis; identical to SEQ ID NO: 201918

SEQ ID NO: 1457017 - protein, 18 aa, Mycobacterium tuberculosis
LALITIADLIEWRRKHEK

SEQ ID NO: 1457018 - protein, 24 aa, Mycobacterium tuberculosis
LALVAQRRGYKCVFVCPDKVSEDK

SEQ ID NO: 1457019 - protein, 28 aa, Mycobacterium tuberculosis
LALVRPTELCFVPRIWDMVFAEFHSEVD

SEQ ID NO: 1457020 - protein, 19 aa, Mycobacterium tuberculosis
LANHAFYYGALRGLSEADP

SEQ ID NO: 1457021 - protein, 18 aa, Mycobacterium tuberculosis
LANHLVDQGCDGLVVSGT

SEQ ID NO: 1457022 - protein, 22 aa, Mycobacterium tuberculosis
LAPECCAVVAYGALLGGPLLAV

SEQ ID NO: 1457023 - protein, 18 aa, Mycobacterium tuberculosis
LAPNFKGSILRYTTFTPK

SEQ ID NO: 1457024 - protein, 19 aa, Mycobacterium tuberculosis
LAQLCGKDVVLPMNSDAEA

SEQ ID NO: 1457025 - protein, 25 aa, Mycobacterium tuberculosis
LARAWLYAIWHCWQDGAAYHPANHR

SEQ ID NO: 1457026 - protein, 27 aa, Mycobacterium tuberculosis
LARGSGLLPRMEPFVGELIGRGLADAG

SEQ ID NO: 1457027 - protein, 20 aa, Mycobacterium tuberculosis
LARRTDLMFDQGLVEEVRTL

SEQ ID NO: 1457028 - protein, 18 aa, Mycobacterium tuberculosis
LASGERFAGVAIDGGVQV

SEQ ID NO: 1457029 - protein, 18 aa, Mycobacterium tuberculosis
LATGWVLEEVHDFEEGEL

SEQ ID NO: 1457030 - protein, 25 aa, Mycobacterium tuberculosis
LATVLSRNTFHWVLAFADSGLLTSA

SEQ ID NO: 1457031 - protein, 24 aa, Mycobacterium tuberculosis
LAVCGLRIGTGVSERDKHNRVLNE

SEQ ID NO: 1457032 - protein, 19 aa, Mycobacterium tuberculosis
LAVCLRALTTMPIPVIAAV

SEQ ID NO: 1457033 - protein, 33 aa, Mycobacterium tuberculosis; identical to SEQ ID NO: 202015

SEQ ID NO: 1457034 - protein, 20 aa, Mycobacterium tuberculosis
LCAMAKRYVTDTCFEVADQA

SEQ ID NO: 1457035 - protein, 21 aa, Mycobacterium tuberculosis
LCDKRKIPLLFLQNIAGFMVG

SEQ ID NO: 1457036 - protein, 18 aa, Mycobacterium tuberculosis
LCINPFFHNFGYKAGILA

SEQ ID NO: 1457037 - protein, 20 aa, Mycobacterium tuberculosis
LCPDPGIADTAAILLAAEQI

SEQ ID NO: 1457038 - protein, 27 aa, Mycobacterium tuberculosis
LCTPIPHPDCDLDWMRLMHSDLGNFQR

SEQ ID NO: 1457039 - protein, 17 aa, Mycobacterium tuberculosis
LDAPPARIVVWAHNSHV

SEQ ID NO: 1457040 - protein, 22 aa, Mycobacterium tuberculosis
LDAPVVLGWAGFRDVAQRYSLG

SEQ ID NO: 1457041 - protein, 18 aa, Mycobacterium tuberculosis
LDAQRWARERAQRAVSGM

SEQ ID NO: 1457042 - protein, 26 aa, Mycobacterium tuberculosis
LDARLRLVLEVPTLREVPTWHRLSSY

SEQ ID NO: 1457043 - protein, 30 aa, Mycobacterium tuberculosis; identical to SEQ ID NO: 202049

SEQ ID NO: 1457044 - protein, 28 aa, Mycobacterium tuberculosis
LDCPDFGLRLARWQGLGILGPVAVIARN

SEQ ID NO: 1457045 - protein, 24 aa, Mycobacterium tuberculosis
LDCSCPDYAVPCKHLAATFYLLAE

SEQ ID NO: 1457046 - protein, 21 aa, Mycobacterium tuberculosis
LDDRIRFSVFVSTDVSAKDLC

SEQ ID NO: 1457047 - protein, 18 aa, Mycobacterium tuberculosis
LDELGLWERFAALPYSEV

SEQ ID NO: 1457048 - protein, 21 aa, Mycobacterium tuberculosis
LDFYRCAMLPASPDWKPGAVP

SEQ ID NO: 1457049 - protein, 18 aa, Mycobacterium tuberculosis
LDGARKVFKLVDALEDSD

SEQ ID NO: 1457050 - protein, 18 aa, Mycobacterium tuberculosis
LDHAMWFMRPFRADEWLL

SEQ ID NO: 1457051 - protein, 18 aa, Mycobacterium tuberculosis
LDHRGVGLSSRLAAITTL

SEQ ID NO: 1457052 - protein, 19 aa, Mycobacterium tuberculosis
LDIGCGWGSTMRHAVAEYD

SEQ ID NO: 1457053 - protein, 26 aa, Mycobacterium tuberculosis
LDIWRRPDLAPGRRAPVLIQVPGGAW

SEQ ID NO: 1457054 - protein, 23 aa, Mycobacterium tuberculosis
LDKARPVLILTREVVRPHLTNVT

SEQ ID NO: 1457055 - protein, 18 aa, Mycobacterium tuberculosis
LDKLRIEALRNKDLEVDT

SEQ ID NO: 1457056 - protein, 17 aa, Mycobacterium tuberculosis
LDLAEVILQSPLDISRP

SEQ ID NO: 1457057 - protein, 22 aa, Mycobacterium tuberculosis
LDLHAPVARYWPEFGQAGKQAI

SEQ ID NO: 1457058 - protein, 19 aa, Mycobacterium tuberculosis
LDLLRLGTYQLLRTRVDAH

SEQ ID NO: 1457059 - protein, 20 aa, Mycobacterium tuberculosis
LDLQGRRAAGTGARRVAVVR

SEQ ID NO: 1457060 - protein, 21 aa, Mycobacterium tuberculosis
LDLTSRFPLDPAVAAVDALIQ

SEQ ID NO: 1457061 - protein, 18 aa, Mycobacterium tuberculosis
LDPTWAIEEIVRRYIGKP

SEQ ID NO: 1457062 - protein, 20 aa, Mycobacterium tuberculosis
LDRAADLFCHAVGSTRPLTV

SEQ ID NO: 1457063 - protein, 17 aa, Mycobacterium tuberculosis
LDRARAGGEVVITERGI

SEQ ID NO: 1457064 - protein, 21 aa, Mycobacterium tuberculosis
LDRLYGYEVSPVLWKKVAPKL

SEQ ID NO: 1457065 - protein, 23 aa, Mycobacterium tuberculosis
LDRVFKVDGFAGAQYKKLRDVLG

SEQ ID NO: 1457066 - protein, 27 aa, Mycobacterium tuberculosis
LDSIRMMSLVGRWRRKGIAVDFATLAA

SEQ ID NO: 1457067 - protein, 25 aa, Mycobacterium tuberculosis
LDVKAIAAFSRWYAGEIDLHNPPAP

SEQ ID NO: 1457068 - protein, 19 aa, Mycobacterium tuberculosis
LDVVRLGRAIGVVYLPATE

SEQ ID NO: 1457069 - protein, 21 aa, Mycobacterium tuberculosis
LEAIPRISRAQVMDALSSQAN

SEQ ID NO: 1457070 - protein, 18 aa, Mycobacterium tuberculosis
LEAVRKRPGMYIGSTGER

SEQ ID NO: 1457071 - protein, 17 aa, Mycobacterium tuberculosis
LEDLGWYVADNLPPQLI

SEQ ID NO: 1457072 - protein, 18 aa, Mycobacterium tuberculosis
LEEGARASFMPKPFGQHP

SEQ ID NO: 1457073 - protein, 21 aa, Mycobacterium tuberculosis
LEERYVREWLGGMTTGQIVEY

SEQ ID NO: 1457074 - protein, 27 aa, Mycobacterium tuberculosis
LEESFAERGVRLFKNARAASVTRTGAG

SEQ ID NO: 1457075 - protein, 20 aa, Mycobacterium tuberculosis
LEEVLQWPAGTIARIRRGEP

SEQ ID NO: 1457076 - protein, 17 aa, Mycobacterium tuberculosis
LEFVPAADVDPMMFDRS

SEQ ID NO: 1457077 - protein, 32 aa, Mycobacterium tuberculosis; identical to SEQ ID NO: 202192

SEQ ID NO: 1457078 - protein, 19 aa, Mycobacterium tuberculosis
LEGIPATGIANAFWEVLDR

SEQ ID NO: 1457079 - protein, 21 aa, Mycobacterium tuberculosis
LEGKSSLGRLGLLTHSTAGFI

SEQ ID NO: 1457080 - protein, 19 aa, Mycobacterium tuberculosis
LEGKTLPGIEVLSREQPTG

SEQ ID NO: 1457081 - protein, 26 aa, Mycobacterium tuberculosis
LEHYEKLEGVPLTFAGKINRLAIMVR

SEQ ID NO: 1457082 - protein, 17 aa, Mycobacterium tuberculosis
LEILRRVRESDVYTPTL

SEQ ID NO: 1457083 - protein, 20 aa, Mycobacterium tuberculosis
LELEGLRRWVPPHLDGYKPL

SEQ ID NO: 1457084 - protein, 33 aa, Mycobacterium tuberculosis; identical to SEQ ID NO: 202213

SEQ ID NO: 1457085 - protein, 19 aa, Mycobacterium tuberculosis
LEMNTRLQVEHPVTEETTG

SEQ ID NO: 1457086 - protein, 21 aa, Mycobacterium tuberculosis
LEPTFRRSVIYIVEHNDGGTL

SEQ ID NO: 1457087 - protein, 24 aa, Mycobacterium tuberculosis
LERLGKVWAAMAITEPEFGSDSAA

SEQ ID NO: 1457088 - protein, 17 aa, Mycobacterium tuberculosis
LERRILLSRVPELPEHF

SEQ ID NO: 1457089 - protein, 34 aa, Mycobacterium tuberculosis; identical to SEQ ID NO: 202235

SEQ ID NO: 1457090 - protein, 22 aa, Mycobacterium tuberculosis
LESRLDNVIYRAGLARTRRMAR

SEQ ID NO: 1457091 - protein, 24 aa, Mycobacterium tuberculosis
LETHRFDFCFIGAGYEDQVDEFLT

SEQ ID NO: 1457092 - protein, 17 aa, Mycobacterium tuberculosis
LEVDGGLTFPNLDLPIP

SEQ ID NO: 1457093 - protein, 17 aa, Mycobacterium tuberculosis
LEYAIGRTCSAAWSVNG

SEQ ID NO: 1457094 - protein, 24 aa, Mycobacterium tuberculosis
LFDGSDTVTLVWLGQRRIPGIDTG

SEQ ID NO: 1457095 - protein, 19 aa, Mycobacterium tuberculosis
LFHAGEPADSIYIVDSGRF

SEQ ID NO: 1457096 - protein, 25 aa, Mycobacterium tuberculosis
LFHARAKLRRKGCDLLVVNAVGEGR

SEQ ID NO: 1457097 - protein, 17 aa, Mycobacterium tuberculosis
LFLPSNTIAPFLGLLGG

SEQ ID NO: 1457098 - protein, 20 aa, Mycobacterium tuberculosis
LGAGLDWKTSLQELTAARGL

SEQ ID NO: 1457099 - protein, 22 aa, Mycobacterium tuberculosis
LGALSRRYPHRVFDSGIAEQHL

SEQ ID NO: 1457100 - protein, 20 aa, Mycobacterium tuberculosis
LGAPCWIDLTTSDVDRAQDF

SEQ ID NO: 1457101 - protein, 17 aa, Mycobacterium tuberculosis
LGATCGGIRVWSLYVPN

SEQ ID NO: 1457102 - protein, 24 aa, Mycobacterium tuberculosis
LGAVLDRLAVYRARSVDIDGCTYR

SEQ ID NO: 1457103 - protein, 19 aa, Mycobacterium tuberculosis
LGDRTELRSLAASYGTAPA

SEQ ID NO: 1457104 - protein, 17 aa, Mycobacterium tuberculosis
LGDYFLAGYAVRSGDTA

SEQ ID NO: 1457105 - protein, 19 aa, Mycobacterium tuberculosis
LGGCSTALFPAGGSTGSLL

SEQ ID NO: 1457106 - protein, 17 aa, Mycobacterium tuberculosis
LGGDGFGVLEQVAVLVA

SEQ ID NO: 1457107 - protein, 20 aa, Mycobacterium tuberculosis
LGGGAIRAALRGDLHLHSNW

SEQ ID NO: 1457108 - protein, 18 aa, Mycobacterium tuberculosis
LGGMDYLSPERVELRYTM

SEQ ID NO: 1457109 - protein, 21 aa, Mycobacterium tuberculosis
LGGTLCCALANRLRITKPDAA

SEQ ID NO: 1457110 - protein, 17 aa, Mycobacterium tuberculosis
LGLFEINEAASLVQDAA

SEQ ID NO: 1457111 - protein, 25 aa, Mycobacterium tuberculosis
LGLIDPDAWAFVWVVDPPLFEPADE

SEQ ID NO: 1457112 - protein, 21 aa, Mycobacterium tuberculosis
LGRTEIRRLAKELDFRPRKSL

SEQ ID NO: 1457113 - protein, 18 aa, Mycobacterium tuberculosis
LGTEHLVGTTLNVLAHPC

SEQ ID NO: 1457114 - protein, 20 aa, Mycobacterium tuberculosis
LGTQGAWTGSQWLMVEEAAN

SEQ ID NO: 1457115 - protein, 19 aa, Mycobacterium tuberculosis
LGVEAARVRMLRSFDPRSG

SEQ ID NO: 1457116 - protein, 17 aa, Mycobacterium tuberculosis
LGYLLYRVGAVLRPEVS

SEQ ID NO: 1457117 - protein, 19 aa, Mycobacterium tuberculosis
LHAELARRDPAAAAAILPT

SEQ ID NO: 1457118 - protein, 20 aa, Mycobacterium tuberculosis
LHAHVLLQRDVHYIVRDDAV

SEQ ID NO: 1457119 - protein, 25 aa, Mycobacterium tuberculosis
LHGNHPVRLFIGSGMPTGLWERVVE

SEQ ID NO: 1457120 - protein, 19 aa, Mycobacterium tuberculosis
LHHALALAGRHLRRHAGAQ

SEQ ID NO: 1457121 - protein, 20 aa, Mycobacterium tuberculosis
LHLDLRFVNGKSWLVFGPYA

SEQ ID NO: 1457122 - protein, 23 aa, Mycobacterium tuberculosis
LHLVDFPVTLGIRPNIPQEDLRD

SEQ ID NO: 1457123 - protein, 24 aa, Mycobacterium tuberculosis
LHPLSAPMTLRWLTDRFAGKPLTD

SEQ ID NO: 1457124 - protein, 19 aa, Mycobacterium tuberculosis
LHRHGFAGATVLLGVDGTA

SEQ ID NO: 1457125 - protein, 25 aa, Mycobacterium tuberculosis
LHRLLRRYRLELSRPDYQPRWDYSA

SEQ ID NO: 1457126 - protein, 18 aa, Mycobacterium tuberculosis
LHRRPDQRRLLLDDPEGI

SEQ ID NO: 1457127 - protein, 19 aa, Mycobacterium tuberculosis
LHTARLALCQATRQVIANG

SEQ ID NO: 1457128 - protein, 20 aa, Mycobacterium tuberculosis
LHTEECRKLGLAFAADPSQQ

SEQ ID NO: 1457129 - protein, 23 aa, Mycobacterium tuberculosis
LIALRRCPAETAFDELHNAAQRH

SEQ ID NO: 1457130 - protein, 20 aa, Mycobacterium tuberculosis
LIARRVREARVFSEVIPHTA

SEQ ID NO: 1457131 - protein, 23 aa, Mycobacterium tuberculosis
LIDCGERWAVFNAGMGVDAEVVA

SEQ ID NO: 1457132 - protein, 21 aa, Mycobacterium tuberculosis
LIDYSGLRVCEYLPGKAIVMQ

SEQ ID NO: 1457133 - protein, 21 aa, Mycobacterium tuberculosis
LIGQFGIGFYSSFMVADKVQL

SEQ ID NO: 1457134 - protein, 21 aa, Mycobacterium tuberculosis
LIKNIEVAARVGGGDPAGNPT

SEQ ID NO: 1457135 - protein, 22 aa, Mycobacterium tuberculosis
LIMDSLRYWVIEMHVDGFRFDL

SEQ ID NO: 1457136 - protein, 25 aa, Mycobacterium tuberculosis
LINPHPLFVPWLVGPLLTGEGIQLV

SEQ ID NO: 1457137 - protein, 32 aa, Mycobacterium tuberculosis; identical to SEQ ID NO: 202451

SEQ ID NO: 1457138 - protein, 18 aa, Mycobacterium tuberculosis
LIRFAEAAIQVMGKAEAR

SEQ ID NO: 1457139 - protein, 18 aa, Mycobacterium tuberculosis
LITTPGLINVDFADVKGI

SEQ ID NO: 1457140 - protein, 21 aa, Mycobacterium tuberculosis
LKENIKRQWWRSVVTGRDDVV

SEQ ID NO: 1457141 - protein, 18 aa, Mycobacterium tuberculosis
LKESGFRLLAMTPHGNAC

SEQ ID NO: 1457142 - protein, 19 aa, Mycobacterium tuberculosis
LKGKLDGYALRVPIPTGSV

SEQ ID NO: 1457143 - protein, 20 aa, Mycobacterium tuberculosis
LKGRGLGGVRLVISDQHAGL

SEQ ID NO: 1457144 - protein, 20 aa, Mycobacterium tuberculosis
LKHRAGDTFCEIVPRDLKDL

SEQ ID NO: 1457145 - protein, 27 aa, Mycobacterium tuberculosis
LKHRLARSLFLYALCNGWINENTTVVE

SEQ ID NO: 1457146 - protein, 25 aa, Mycobacterium tuberculosis
LKLTGALGACIWHYLQATGQSDFKS

SEQ ID NO: 1457147 - protein, 19 aa, Mycobacterium tuberculosis
LKTHCKTALVVRREGPTIR

SEQ ID NO: 1457148 - protein, 17 aa, Mycobacterium tuberculosis
LLAGRKVNLEFVSANPT

SEQ ID NO: 1457149 - protein, 20 aa, Mycobacterium tuberculosis
LLALLPLVGVWRGEGEGRGP

SEQ ID NO: 1457150 - protein, 25 aa, Mycobacterium tuberculosis
LLARELPVYIISIGRTFRTDELDAT

SEQ ID NO: 1457151 - protein, 17 aa, Mycobacterium tuberculosis
LLDAEGLFDPRLKRPIP

SEQ ID NO: 1457152 - protein, 19 aa, Mycobacterium tuberculosis
LLDDEFLEIQAGYAQNIVV

SEQ ID NO: 1457153 - protein, 21 aa, Mycobacterium tuberculosis
LLDIGCGWGATMRRAIEKYDV

SEQ ID NO: 1457154 - protein, 24 aa, Mycobacterium tuberculosis
LLDIGCGWGGGLQRAIENYDVNVI

SEQ ID NO: 1457155 - protein, 21 aa, Mycobacterium tuberculosis
LLDIGCGWGTTMRRAVERFDV

SEQ ID NO: 1457156 - protein, 24 aa, Mycobacterium tuberculosis
LLEVEEVYLPLARLIHLQVAARQR

SEQ ID NO: 1457157 - protein, 17 aa, Mycobacterium tuberculosis
LLFLQNIAGFMVGRDYE

SEQ ID NO: 1457158 - protein, 18 aa, Mycobacterium tuberculosis
LLGAHGGLHQKWFNLYDE

SEQ ID NO: 1457159 - protein, 24 aa, Mycobacterium tuberculosis
LLGTARSWAWLSGRDYVTPDDVKA

SEQ ID NO: 1457160 - protein, 25 aa, Mycobacterium tuberculosis
LLGVDEVWAVGGAQAVALLAYGGTD

SEQ ID NO: 1457161 - protein, 17 aa, Mycobacterium tuberculosis
LLISRGAADITVLCVVA

SEQ ID NO: 1457162 - protein, 18 aa, Mycobacterium tuberculosis
LLKIALAACSGMASDQPL

SEQ ID NO: 1457163 - protein, 30 aa, Mycobacterium tuberculosis; identical to SEQ ID NO: 100155

SEQ ID NO: 1457164 - protein, 27 aa, Mycobacterium tuberculosis
LLNDVLKGAWGYRGWVMSDWGGTPSWE

SEQ ID NO: 1457165 - protein, 19 aa, Mycobacterium tuberculosis
LLRELPHQLLRSWYILYFQ

SEQ ID NO: 1457166 - protein, 18 aa, Mycobacterium tuberculosis
LLRHAHCPVVIIHDEDSV

SEQ ID NO: 1457167 - protein, 20 aa, Mycobacterium tuberculosis
LLWGDARVGNVLYRDFQPVA

SEQ ID NO: 1457168 - protein, 18 aa, Mycobacterium tuberculosis
LMETRPSALVAIAALSRL

SEQ ID NO: 1457169 - protein, 23 aa, Mycobacterium tuberculosis
LMNHGRPAAILISAERYESLMEE

SEQ ID NO: 1457170 - protein, 19 aa, Mycobacterium tuberculosis
LMRDIPFRVGAVVQSPAYY

SEQ ID NO: 1457171 - protein, 26 aa, Mycobacterium tuberculosis
LMRPRIASRVLGKWARTRLSGQKTLI

SEQ ID NO: 1457172 - protein, 18 aa, Mycobacterium tuberculosis
LNDGRIGENVFLLEDNTI

SEQ ID NO: 1457173 - protein, 23 aa, Mycobacterium tuberculosis
LNEEIRVLRGWSIDDYCQHQLSS

SEQ ID NO: 1457174 - protein, 25 aa, Mycobacterium tuberculosis
LNGEAYRGHVFWDALFVAPVLSLRM

SEQ ID NO: 1457175 - protein, 19 aa, Mycobacterium tuberculosis
LNIKGPELLNKFVGETERH

SEQ ID NO: 1457176 - protein, 29 aa, Mycobacterium tuberculosis
LNMTLSQRWGRLFVAVCYALRTPTTRSPL

SEQ ID NO: 1457177 - protein, 24 aa, Mycobacterium tuberculosis
LNQGEVCTCPSRSLIQADIYDEFL

SEQ ID NO: 1457178 - protein, 23 aa, Mycobacterium tuberculosis
LNTQRPDGSWGFFDGQATAEETA

SEQ ID NO: 1457179 - protein, 18 aa, Mycobacterium tuberculosis
LNVGCIPSKALLRNAELV

SEQ ID NO: 1457180 - protein, 17 aa, Mycobacterium tuberculosis
LPADFLLDADGTVAAVH

SEQ ID NO: 1457181 - protein, 17 aa, Mycobacterium tuberculosis
LPAERWREYCLSSVTTH

SEQ ID NO: 1457182 - protein, 26 aa, Mycobacterium tuberculosis
LPEPLKCLTENLWALHTNRYDYVTTK

SEQ ID NO: 1457183 - protein, 20 aa, Mycobacterium tuberculosis
LPFETLFEPAISYGRNGFLV

SEQ ID NO: 1457184 - protein, 18 aa, Mycobacterium tuberculosis
LPGAQGRLKVAAPKPSKL

SEQ ID NO: 1457185 - protein, 17 aa, Mycobacterium tuberculosis
LPGDPLALIAPAGSGAG

SEQ ID NO: 1457186 - protein, 18 aa, Mycobacterium tuberculosis
LPGLRALQKYAVRTGGGV

SEQ ID NO: 1457187 - protein, 17 aa, Mycobacterium tuberculosis
LPGRGAATIDEIAVGSG

SEQ ID NO: 1457188 - protein, 17 aa, Mycobacterium tuberculosis
LPGVLSRRIDPRNSTVL

SEQ ID NO: 1457189 - protein, 24 aa, Mycobacterium tuberculosis
LPIALPRRTVVTFTPEHTGAITAR

SEQ ID NO: 1457190 - protein, 27 aa, Mycobacterium tuberculosis
LPMGSEAMALLRLPLVLPAVQIAGRIV

SEQ ID NO: 1457191 - protein, 24 aa, Mycobacterium tuberculosis
LPNLDFPTGPAYYLMGFDIASFTP

SEQ ID NO: 1457192 - protein, 19 aa, Mycobacterium tuberculosis
LPQTVPLAFTSYAGMDIGR

SEQ ID NO: 1457193 - protein, 21 aa, Mycobacterium tuberculosis
LPTAGCARHSSGLSVQTFLRG

SEQ ID NO: 1457194 - protein, 17 aa, Mycobacterium tuberculosis
LPTERWTAVTAARSLAD

SEQ ID NO: 1457195 - protein, 24 aa, Mycobacterium tuberculosis
LPTMEKAGLIQRGRQVSVREIDEM

SEQ ID NO: 1457196 - protein, 19 aa, Mycobacterium tuberculosis
LPVAEAIAYLLEILPALSY

SEQ ID NO: 1457197 - protein, 25 aa, Mycobacterium tuberculosis
LPVDQLRYPVFSWQRITLQEMTHMR

SEQ ID NO: 1457198 - protein, 25 aa, Mycobacterium tuberculosis
LPVIGTKELIAWLPTLLGLGGADLV

SEQ ID NO: 1457199 - protein, 22 aa, Mycobacterium tuberculosis
LQFRTVHGYRRAFRIAGSGPAI

SEQ ID NO: 1457200 - protein, 25 aa, Mycobacterium tuberculosis
LQGDVKRFRGFDNWEGDAATACEAS

SEQ ID NO: 1457201 - protein, 25 aa, Mycobacterium tuberculosis
LQKISELYDRVGFAAAGKFNEFDNL

SEQ ID NO: 1457202 - protein, 24 aa, Mycobacterium tuberculosis
LQLACAGGFPEVVQRPAGRARSRW

SEQ ID NO: 1457203 - protein, 18 aa, Mycobacterium tuberculosis
LQLHYARTLDMWATALEA

SEQ ID NO: 1457204 - protein, 25 aa, Mycobacterium tuberculosis
LQLSKRGGGVALLLTNIREHGAPIK

SEQ ID NO: 1457205 - protein, 25 aa, Mycobacterium tuberculosis
LQPIEWRYANDPAWIMRDKGDRLAY

SEQ ID NO: 1457206 - protein, 18 aa, Mycobacterium tuberculosis
LQPLKPTRGCSAPTDRFR

SEQ ID NO: 1457207 - protein, 18 aa, Mycobacterium tuberculosis
LQRDLAHHRGMWHRTPLP

SEQ ID NO: 1457208 - protein, 17 aa, Mycobacterium tuberculosis
LQRDVHYIVRDDAVHLI

SEQ ID NO: 1457209 - protein, 27 aa, Mycobacterium tuberculosis
LQVGDFVKIDFGALVAGYHSDMTRTFV

SEQ ID NO: 1457210 - protein, 18 aa, Mycobacterium tuberculosis
LRAAGAVIIGKLAMTEGA

SEQ ID NO: 1457211 - protein, 19 aa, Mycobacterium tuberculosis
LRAALPRGGADVEAVLPTV

SEQ ID NO: 1457212 - protein, 30 aa, Mycobacterium tuberculosis; identical to SEQ ID NO: 202820

SEQ ID NO: 1457213 - protein, 19 aa, Mycobacterium tuberculosis
LRAAVSKYWIIDEIKPARL

SEQ ID NO: 1457214 - protein, 25 aa, Mycobacterium tuberculosis
LRAKALWLRSRRRGVLAGYSASAFH

SEQ ID NO: 1457215 - protein, 17 aa, Mycobacterium tuberculosis
LRASLSDQVRQAKRAQQ

SEQ ID NO: 1457216 - protein, 19 aa, Mycobacterium tuberculosis
LRDPCRDLVAAIADERIAA

SEQ ID NO: 1457217 - protein, 37 aa, Mycobacterium tuberculosis; identical to SEQ ID NO: 202853

SEQ ID NO: 1457218 - protein, 20 aa, Mycobacterium tuberculosis
LREKFAPLRILTGIEVDILE

SEQ ID NO: 1457219 - protein, 25 aa, Mycobacterium tuberculosis
LRERYPQWDRFAAVRDRLDPDRVFL

SEQ ID NO: 1457220 - protein, 24 aa, Mycobacterium tuberculosis
LRETFRAIGVDLMFDHIKQSLHEF

SEQ ID NO: 1457221 - protein, 20 aa, Mycobacterium tuberculosis
LRGLPRLNSAGVRAMGTDLL

SEQ ID NO: 1457222 - protein, 19 aa, Mycobacterium tuberculosis
LRHYPRSYVEGAARVGIGD

SEQ ID NO: 1457223 - protein, 25 aa, Mycobacterium tuberculosis
LRILSDINAFMGYFYVHNTYPELMA

SEQ ID NO: 1457224 - protein, 23 aa, Mycobacterium tuberculosis
LRKLRYILNFARLADFEPGAAGP

SEQ ID NO: 1457225 - protein, 23 aa, Mycobacterium tuberculosis
LRKSEPYCGYQHYEFDVITDDSC

SEQ ID NO: 1457226 - protein, 20 aa, Mycobacterium tuberculosis
LRLGTSVLCNSYRHPSVLAK

SEQ ID NO: 1457227 - protein, 24 aa, Mycobacterium tuberculosis
LRLSHPELLYHPTQSWVVDDNFDL

SEQ ID NO: 1457228 - protein, 18 aa, Mycobacterium tuberculosis
LRMPPYPLILTLRTLVGS

SEQ ID NO: 1457229 - protein, 26 aa, Mycobacterium tuberculosis
LRNLRRPCFSRAEAPIGVYNGEQAII

SEQ ID NO: 1457230 - protein, 24 aa, Mycobacterium tuberculosis
LRPSDLARAIAFVAETPRGCVVVN

SEQ ID NO: 1457231 - protein, 20 aa, Mycobacterium tuberculosis
LRQLEAIAVQATRISRITPE

SEQ ID NO: 1457232 - protein, 21 aa, Mycobacterium tuberculosis
LRRAVRLLAQLTRQVAVVQYP

SEQ ID NO: 1457233 - protein, 26 aa, Mycobacterium tuberculosis
LRRIEIELDQCWDLLRQRRALRQTGG

SEQ ID NO: 1457234 - protein, 22 aa, Mycobacterium tuberculosis
LRRRSAQALRNWVSREQRAVAQ

SEQ ID NO: 1457235 - protein, 25 aa, Mycobacterium tuberculosis
LRTRKAGAVGLVMAEPLTYFFSDPA

SEQ ID NO: 1457236 - protein, 23 aa, Mycobacterium tuberculosis
LRVVQHWVNHGVKFFRVDNPHTK

SEQ ID NO: 1457237 - protein, 17 aa, Mycobacterium tuberculosis
LSAELRASALSYSSVLS

SEQ ID NO: 1457238 - protein, 17 aa, Mycobacterium tuberculosis
LSALPYPGTGRDLGALV

SEQ ID NO: 1457239 - protein, 18 aa, Mycobacterium tuberculosis
LSATFPDHVLVELPNAKH

SEQ ID NO: 1457240 - protein, 25 aa, Mycobacterium tuberculosis
LSAVEFLGSVGLKILAATSEKIGQS

SEQ ID NO: 1457241 - protein, 20 aa, Mycobacterium tuberculosis
LSAVVHAWVLARANRSNAME

SEQ ID NO: 1457242 - protein, 22 aa, Mycobacterium tuberculosis
LSDAELYLFFHLLFSAGAETTR

SEQ ID NO: 1457243 - protein, 21 aa, Mycobacterium tuberculosis
LSDLALNWLCERQLPDGSWGA

SEQ ID NO: 1457244 - protein, 23 aa, Mycobacterium tuberculosis
LSDLLSRPGVFVFGSNDYFGPRL

SEQ ID NO: 1457245 - protein, 25 aa, Mycobacterium tuberculosis
LSGAKLDVIVPMSFLCDGYGLNVTL

SEQ ID NO: 1457246 - protein, 19 aa, Mycobacterium tuberculosis
LSHDACCYFDALPEELVPV

SEQ ID NO: 1457247 - protein, 17 aa, Mycobacterium tuberculosis
LSMGVQVIAGRGELIDS

SEQ ID NO: 1457248 - protein, 32 aa, Mycobacterium tuberculosis; identical to SEQ ID NO: 203033

SEQ ID NO: 1457249 - protein, 21 aa, Mycobacterium tuberculosis
LSPVRAAIVVPAFTEPAIALS

SEQ ID NO: 1457250 - protein, 17 aa, Mycobacterium tuberculosis
LSRFSALTRDWFTSTFA

SEQ ID NO: 1457251 - protein, 17 aa, Mycobacterium tuberculosis
LSSGDRVLLCLPDSPDL

SEQ ID NO: 1457252 - protein, 23 aa, Mycobacterium tuberculosis
LSSREIASFFILLVVAGNETTRN

SEQ ID NO: 1457253 - protein, 19 aa, Mycobacterium tuberculosis
LSVPHSWTTAAPEIQLAVQ

SEQ ID NO: 1457254 - protein, 20 aa, Mycobacterium tuberculosis
LTAMWYAVIDGEIWLETKAK

SEQ ID NO: 1457255 - protein, 25 aa, Mycobacterium tuberculosis
LTARLRAAGIPILGKTNMDEFAMGS

SEQ ID NO: 1457256 - protein, 20 aa, Mycobacterium tuberculosis
LTDHSPRLTIANGLSPDRLR

SEQ ID NO: 1457257 - protein, 20 aa, Mycobacterium tuberculosis
LTDLLDGWVAYFAEHPRERA

SEQ ID NO: 1457258 - protein, 17 aa, Mycobacterium tuberculosis
LTEALSVEWQRHGVRVA

SEQ ID NO: 1457259 - protein, 17 aa, Mycobacterium tuberculosis
LTEEGHVVVCGRVKDVI

SEQ ID NO: 1457260 - protein, 21 aa, Mycobacterium tuberculosis
LTERKQVLVVIGRSDEAGAKS

SEQ ID NO: 1457261 - protein, 17 aa, Mycobacterium tuberculosis
LTETELDSFAGQLDAIL

SEQ ID NO: 1457262 - protein, 26 aa, Mycobacterium tuberculosis
LTETELMAWAIPRAANRFWMLNEPER

SEQ ID NO: 1457263 - protein, 19 aa, Mycobacterium tuberculosis
LTGCAKLFRQGYTDVDQFT

SEQ ID NO: 1457264 - protein, 24 aa, Mycobacterium tuberculosis
LTGYRIAVTSARRAEELCALLRRQ

SEQ ID NO: 1457265 - protein, 28 aa, Mycobacterium tuberculosis
LTIPEIPAHLDVNIPIDIPITGSFTDLV

SEQ ID NO: 1457266 - protein, 26 aa, Mycobacterium tuberculosis
LTLNALQFVGGMLWSTALAEAGAAEA

SEQ ID NO: 1457267 - protein, 25 aa, Mycobacterium tuberculosis
LTLRGALVRDPRAWSGYLTEAIDTF

SEQ ID NO: 1457268 - protein, 28 aa, Mycobacterium tuberculosis
LTPLEFDLLVALARKPRQVFTRDVLLEQ

SEQ ID NO: 1457269 - protein, 26 aa, Mycobacterium tuberculosis
LTSGLQPVDCRFCHVTVTVKRLGPGH

SEQ ID NO: 1457270 - protein, 17 aa, Mycobacterium tuberculosis
LTSKPWVKTTIAPGSQV

SEQ ID NO: 1457271 - protein, 20 aa, Mycobacterium tuberculosis
LTVAPWMGPSSITMAAAVAP

SEQ ID NO: 1457272 - protein, 37 aa, Mycobacterium tuberculosis; identical to SEQ ID NO: 203152

SEQ ID NO: 1457273 - protein, 18 aa, Mycobacterium tuberculosis
LVASFAIDELLDYRSRRP

SEQ ID NO: 1457274 - protein, 22 aa, Mycobacterium tuberculosis
LVDARYGALGVRGYDHRLVEFV

SEQ ID NO: 1457275 - protein, 31 aa, Mycobacterium tuberculosis; identical to SEQ ID NO: 203179

SEQ ID NO: 1457276 - protein, 20 aa, Mycobacterium tuberculosis
LVKPPSALMRPRIASRVLGK

SEQ ID NO: 1457277 - protein, 23 aa, Mycobacterium tuberculosis
LVKTYRLAKGVVLRRAIGEVRAV

SEQ ID NO: 1457278 - protein, 17 aa, Mycobacterium tuberculosis
LVLGPGMRIQAPPNLVS

SEQ ID NO: 1457279 - protein, 25 aa, Mycobacterium tuberculosis
LVMARGIEIGHIFQLGSKYTDAFTA

SEQ ID NO: 1457280 - protein, 18 aa, Mycobacterium tuberculosis
LVNLKVTLLDGAYHEVDS

SEQ ID NO: 1457281 - protein, 23 aa, Mycobacterium tuberculosis
LVPVYPTCHYLMGGIPTTVTGQV

SEQ ID NO: 1457282 - protein, 18 aa, Mycobacterium tuberculosis
LVQIIRWLRPGAVIAIAK

SEQ ID NO: 1457283 - protein, 18 aa, Mycobacterium tuberculosis
LVSADWPEPSGISVDLVA

SEQ ID NO: 1457284 - protein, 20 aa, Mycobacterium tuberculosis
LWCRHPWPEVHGLAESVAAW

SEQ ID NO: 1457285 - protein, 24 aa, Mycobacterium tuberculosis
LWGWPQLAGDIWVGAATVAEAVRR

SEQ ID NO: 1457286 - protein, 19 aa, Mycobacterium tuberculosis
LYTAVGASIGDAWAADVVV

SEQ ID NO: 1457287 - protein, 25 aa, Mycobacterium tuberculosis
LYTHRPSWPAGIAVGKTVVSSSIID

SEQ ID NO: 1457288 - protein, 18 aa, Mycobacterium tuberculosis
LYWIGRYVERADDTARIL

SEQ ID NO: 1457289 - protein, 23 aa, Mycobacterium tuberculosis
MAFLQRPARWMQLLAKHRAQISS

SEQ ID NO: 1457290 - protein, 25 aa, Mycobacterium tuberculosis
MAPRQWRGLRRWLGEPEDFQDPKYD

SEQ ID NO: 1457291 - protein, 23 aa, Mycobacterium tuberculosis
MASGELRATMALTEPGGGSDLQN

SEQ ID NO: 1457292 - protein, 25 aa, Mycobacterium tuberculosis
MDPELIPKLMSAGVIEVAPLAYMRG

SEQ ID NO: 1457293 - protein, 25 aa, Mycobacterium tuberculosis
MDPQQRLLIEVAWEALEDAGVPQHT

SEQ ID NO: 1457294 - protein, 21 aa, Mycobacterium tuberculosis
MEPYLGVAVHGFPNYFFITGP

SEQ ID NO: 1457295 - protein, 17 aa, Mycobacterium tuberculosis
MFGPESDLAIAIQRITR

SEQ ID NO: 1457296 - protein, 18 aa, Mycobacterium tuberculosis
MGARKSPRLWIVTRGAAQ

SEQ ID NO: 1457297 - protein, 17 aa, Mycobacterium tuberculosis
MGDGRIRARREISVKIP

SEQ ID NO: 1457298 - protein, 22 aa, Mycobacterium tuberculosis
MGDLHRRYPFGGRRISHAYLRG

SEQ ID NO: 1457299 - protein, 18 aa, Mycobacterium tuberculosis
MGLVPAMTVKCAVALVKS

SEQ ID NO: 1457300 - protein, 31 aa, Mycobacterium tuberculosis; identical to SEQ ID NO: 203324

SEQ ID NO: 1457301 - protein, 23 aa, Mycobacterium tuberculosis
MHGPAEVAFTCELFSRVEDVLGL

SEQ ID NO: 1457302 - protein, 23 aa, Mycobacterium tuberculosis
MIEMLRGGPDYLMFLYKTKGPVV

SEQ ID NO: 1457303 - protein, 22 aa, Mycobacterium tuberculosis
MKKLDPRGVIVVIEAEHLCMAM

SEQ ID NO: 1457304 - protein, 20 aa, Mycobacterium tuberculosis
MLAAASAWHGLSAELRASAL

SEQ ID NO: 1457305 - protein, 18 aa, Mycobacterium tuberculosis
MLASARFRAGLDRIPGAT

SEQ ID NO: 1457306 - protein, 22 aa, Mycobacterium tuberculosis
MLDLFLLILVELFRRHLSSTEQ

SEQ ID NO: 1457307 - protein, 29 aa, Mycobacterium tuberculosis
MLEMAACGAKVLMLRCVEYARRHNIPVHV

SEQ ID NO: 1457308 - protein, 26 aa, Mycobacterium tuberculosis
MLGELERIGGRYGLQTMCEGGGTANV

SEQ ID NO: 1457309 - protein, 17 aa, Mycobacterium tuberculosis
MLPPGTSTLVWRDAAQL

SEQ ID NO: 1457310 - protein, 18 aa, Mycobacterium tuberculosis
MLRANAKLAASTGVPQES

SEQ ID NO: 1457311 - protein, 24 aa, Mycobacterium tuberculosis
MLTCAIRPSGIWGNGDQTMFRKLF

SEQ ID NO: 1457312 - protein, 29 aa, Mycobacterium tuberculosis
MMLDRLFPRSVFHSLKLAEHNLAELMHNP

SEQ ID NO: 1457313 - protein, 25 aa, Mycobacterium tuberculosis
MPAYAKMVMNFGRFAMPQVGEPFYA

SEQ ID NO: 1457314 - protein, 21 aa, Mycobacterium tuberculosis
MPGVLSARWSGRYGDDAANTA

SEQ ID NO: 1457315 - protein, 21 aa, Mycobacterium tuberculosis
MPTFAGRAIAASLGLANVGGG

SEQ ID NO: 1457316 - protein, 18 aa, Mycobacterium tuberculosis
MQLDRAERGFAYATDAPL

SEQ ID NO: 1457317 - protein, 17 aa, Mycobacterium tuberculosis
MRAIVGFAAETGDANGD

SEQ ID NO: 1457318 - protein, 24 aa, Mycobacterium tuberculosis
MRRHHLPVPPAFCITTEVGVRYLA

SEQ ID NO: 1457319 - protein, 24 aa, Mycobacterium tuberculosis
MRRRIDIACGLVVQPQVAFLDEPT

SEQ ID NO: 1457320 - protein, 27 aa, Mycobacterium tuberculosis
MSIDERARAGLFLAMQYPVEVPGVSMS

SEQ ID NO: 1457321 - protein, 20 aa, Mycobacterium tuberculosis
MSRGAIFHHFRDKDALFFAL

SEQ ID NO: 1457322 - protein, 31 aa, Mycobacterium tuberculosis; identical to SEQ ID NO: 195600

SEQ ID NO: 1457323 - protein, 21 aa, Mycobacterium tuberculosis
MTEFHSGFVCLVGRPNTGKST

SEQ ID NO: 1457324 - protein, 18 aa, Mycobacterium tuberculosis
MTETSPLATMAWPPPGTP

SEQ ID NO: 1457325 - protein, 21 aa, Mycobacterium tuberculosis
MTQGSLVRFLVRSGQSAAAAR

SEQ ID NO: 1457326 - protein, 19 aa, Mycobacterium tuberculosis
MVAAASAWNGLAAELSSAA

SEQ ID NO: 1457327 - protein, 19 aa, Mycobacterium tuberculosis
MVAAVLPFVGWLSTTATLA

SEQ ID NO: 1457328 - protein, 25 aa, Mycobacterium tuberculosis
MWQTTECWRQWINIGNFPDHPWRAY

SEQ ID NO: 1457329 - protein, 20 aa, Mycobacterium tuberculosis
MYDRGNCFIFADGAAAVVVG

SEQ ID NO: 1457330 - protein, 20 aa, Mycobacterium tuberculosis
MYTLGFRFRPWTGRQAIADG

SEQ ID NO: 1457331 - protein, 22 aa, Mycobacterium tuberculosis
NAAGPYASWLTAAGAQAELAAR

SEQ ID NO: 1457332 - protein, 24 aa, Mycobacterium tuberculosis
NAHLRLHVHLEISPAYRDVFTIRV

SEQ ID NO: 1457333 - protein, 18 aa, Mycobacterium tuberculosis
NALISVCRACPRLVSWRE

SEQ ID NO: 1457334 - protein, 19 aa, Mycobacterium tuberculosis
NAPVAVPWVLAARSPQALT

SEQ ID NO: 1457335 - protein, 23 aa, Mycobacterium tuberculosis
NATLHGLAGWVDVKPAVVSTAIA

SEQ ID NO: 1457336 - protein, 23 aa, Mycobacterium tuberculosis
NDCPAELWSALDPQALATEHKAA

SEQ ID NO: 1457337 - protein, 17 aa, Mycobacterium tuberculosis
NDGRAAFQTVFHVHLHV

SEQ ID NO: 1457338 - protein, 22 aa, Mycobacterium tuberculosis
NDGRFAMYTKMHHALIDGVSAM

SEQ ID NO: 1457339 - protein, 21 aa, Mycobacterium tuberculosis
NDRDRLVVIIAGYRADLDKFL

SEQ ID NO: 1457340 - protein, 21 aa, Mycobacterium tuberculosis
NDRGACLAGVVIDDGLRPKVV

SEQ ID NO: 1457341 - protein, 24 aa, Mycobacterium tuberculosis
NEAAFKLSRLTGRTKLVAAHDAFH

SEQ ID NO: 1457342 - protein, 22 aa, Mycobacterium tuberculosis
NEAFASVVLKFQKDLNIPDEKL

SEQ ID NO: 1457343 - protein, 20 aa, Mycobacterium tuberculosis
NECWVRHLGTESGVGLLERF

SEQ ID NO: 1457344 - protein, 17 aa, Mycobacterium tuberculosis
NEGQWALGHREPLNANE

SEQ ID NO: 1457345 - protein, 26 aa, Mycobacterium tuberculosis
NELVEWSHPLGHRWRWEFESLSPTLT

SEQ ID NO: 1457346 - protein, 21 aa, Mycobacterium tuberculosis
NEVYRLPKHLDEKVARIHVEA

SEQ ID NO: 1457347 - protein, 24 aa, Mycobacterium tuberculosis
NFLNPRPGTPFADLEVMPVGDALK

SEQ ID NO: 1457348 - protein, 22 aa, Mycobacterium tuberculosis
NGESMAAVARELHYADVSALYT

SEQ ID NO: 1457349 - protein, 18 aa, Mycobacterium tuberculosis
NGFSPAAIKALWDTILPF

SEQ ID NO: 1457350 - protein, 18 aa, Mycobacterium tuberculosis
NGLAACYVSGYLATDPPP

SEQ ID NO: 1457351 - protein, 18 aa, Mycobacterium tuberculosis
NGPLIEFCAPIGHRDADA

SEQ ID NO: 1457352 - protein, 34 aa, Mycobacterium tuberculosis; identical to SEQ ID NO: 203576

SEQ ID NO: 1457353 - protein, 22 aa, Mycobacterium tuberculosis
NICYTGCRFCAFAQRKGDADAY

SEQ ID NO: 1457354 - protein, 31 aa, Mycobacterium tuberculosis; identical to SEQ ID NO: 203587

SEQ ID NO: 1457355 - protein, 26 aa, Mycobacterium tuberculosis
NKALADFAHRGWIRLEGKSVLISDSE

SEQ ID NO: 1457356 - protein, 26 aa, Mycobacterium tuberculosis
NKVRFPAPVPVGSRVRATSSLVGVED

SEQ ID NO: 1457357 - protein, 20 aa, Mycobacterium tuberculosis
NLGRCGRVVVVGGTPEAAAS

SEQ ID NO: 1457358 - protein, 18 aa, Mycobacterium tuberculosis
NLLTTKPFLYVFNADEAV

SEQ ID NO: 1457359 - protein, 25 aa, Mycobacterium tuberculosis
NPDAGMVLREVGLEVLGSARRVVVS

SEQ ID NO: 1457360 - protein, 19 aa, Mycobacterium tuberculosis
NPKLGASWEGFVLEQLAAL

SEQ ID NO: 1457361 - protein, 21 aa, Mycobacterium tuberculosis
NPNHYLAVAIEYLYTHRPSWP

SEQ ID NO: 1457362 - protein, 23 aa, Mycobacterium tuberculosis
NPQRPWEHPDFWDIWKASLQGVL

SEQ ID NO: 1457363 - protein, 22 aa, Mycobacterium tuberculosis
NPVSALLFFLASSRIFNRRKGV

SEQ ID NO: 1457364 - protein, 19 aa, Mycobacterium tuberculosis
NPYLQRKAQIIVDYYRGDD

SEQ ID NO: 1457365 - protein, 25 aa, Mycobacterium tuberculosis
NQFDRPREALALALDQERTVTDQVG

SEQ ID NO: 1457366 - protein, 27 aa, Mycobacterium tuberculosis
NQHGFCAECHLDAPMVNRALAGAPDGV

SEQ ID NO: 1457367 - protein, 25 aa, Mycobacterium tuberculosis
NRIVRRLLAAAGFPVEALVRTDIGA

SEQ ID NO: 1457368 - protein, 28 aa, Mycobacterium tuberculosis
NRMRWPHGRMRYYIAMLAELSRLRPLPF

SEQ ID NO: 1457369 - protein, 18 aa, Mycobacterium tuberculosis
NRSRLMSLVAANILGQNS

SEQ ID NO: 1457370 - protein, 23 aa, Mycobacterium tuberculosis
NRTTPPIKWPTVIRHPKTGQEIL

SEQ ID NO: 1457371 - protein, 25 aa, Mycobacterium tuberculosis
NRVKTWLQFPQWFYLNIPVNTMVAP

SEQ ID NO: 1457372 - protein, 23 aa, Mycobacterium tuberculosis
NSRFMFDYIPPVFKGQYAETEEE

SEQ ID NO: 1457373 - protein, 19 aa, Mycobacterium tuberculosis
NTPRGRFGVIASVSHAFCS

SEQ ID NO: 1457374 - protein, 24 aa, Mycobacterium tuberculosis
NTRVPEFLERLGVGAPEAEQDIIN

SEQ ID NO: 1457375 - protein, 17 aa, Mycobacterium tuberculosis
NVDADFEPLYIISPEKR

SEQ ID NO: 1457376 - protein, 23 aa, Mycobacterium tuberculosis
NVLSRAIVRLCLSYVSMPPEADH

SEQ ID NO: 1457377 - protein, 24 aa, Mycobacterium tuberculosis
NVMPQWAGSSWYELRYTDPHNSER

SEQ ID NO: 1457378 - protein, 26 aa, Mycobacterium tuberculosis
NVNDCGRYGLADCAGRVLVGEPTDPA

SEQ ID NO: 1457379 - protein, 23 aa, Mycobacterium tuberculosis
NVSRLFAQRCIAGLTANVEHLRR

SEQ ID NO: 1457380 - protein, 26 aa, Mycobacterium tuberculosis
NWETFHIAQLLPWIEANFRTYAEYDG

SEQ ID NO: 1457381 - protein, 17 aa, Mycobacterium tuberculosis
NWVRSWYDFAVEGIGRS

SEQ ID NO: 1457382 - protein, 23 aa, Mycobacterium tuberculosis
NYRAWRHFIAMRASEHADVEIRR

SEQ ID NO: 1457383 - protein, 18 aa, Mycobacterium tuberculosis
PAAEGFLAAADRVGVDPQ

SEQ ID NO: 1457384 - protein, 17 aa, Mycobacterium tuberculosis
PAAKAWIKEELKANPDG

SEQ ID NO: 1457385 - protein, 25 aa, Mycobacterium tuberculosis
PAALREARRGMALAAELCLPLVLVI

SEQ ID NO: 1457386 - protein, 24 aa, Mycobacterium tuberculosis
PADEAIGPGDRWIVEQLRSTGPAN

SEQ ID NO: 1457387 - protein, 17 aa, Mycobacterium tuberculosis
PADVALCTADRLAEADA

SEQ ID NO: 1457388 - protein, 26 aa, Mycobacterium tuberculosis
PAEGFGWPWSVCRWVAGENPSAAEFV

SEQ ID NO: 1457389 - protein, 19 aa, Mycobacterium tuberculosis
PAFYFACPSTVLGPYDDAP

SEQ ID NO: 1457390 - protein, 25 aa, Mycobacterium tuberculosis
PAHIVDVKRAIAWVRENIADYGGDP

SEQ ID NO: 1457391 - protein, 20 aa, Mycobacterium tuberculosis
PAHRAGAAYAELALLRGDPS

SEQ ID NO: 1457392 - protein, 24 aa, Mycobacterium tuberculosis
PAILRLPLTSAFFAAMARMRPKWV

SEQ ID NO: 1457393 - protein, 19 aa, Mycobacterium tuberculosis
PAKRKPGYANFAIADPPLK

SEQ ID NO: 1457394 - protein, 17 aa, Mycobacterium tuberculosis
PALDRLDLIVGDGEFVV

SEQ ID NO: 1457395 - protein, 25 aa, Mycobacterium tuberculosis
PANPPPRVAFMLGDAVPVAAVTTAG

SEQ ID NO: 1457396 - protein, 20 aa, Mycobacterium tuberculosis
PAPARRVGGHPAKRTFQALR

SEQ ID NO: 1457397 - protein, 20 aa, Mycobacterium tuberculosis
PAPIFGCLREVREWAQNTKD

SEQ ID NO: 1457398 - protein, 20 aa, Mycobacterium tuberculosis
PAPPPRELDMLLTAGERISN

SEQ ID NO: 1457399 - protein, 18 aa, Mycobacterium tuberculosis
PAQRHFTRAGALRLSPGL

SEQ ID NO: 1457400 - protein, 17 aa, Mycobacterium tuberculosis
PARFIDIVERFMDTTEP

SEQ ID NO: 1457401 - protein, 23 aa, Mycobacterium tuberculosis
PARLSARRFWVRYAAEATGALTL

SEQ ID NO: 1457402 - protein, 18 aa, Mycobacterium tuberculosis
PASLRRDFGLVVHWANLS

SEQ ID NO: 1457403 - protein, 18 aa, Mycobacterium tuberculosis
PATRSRVPTLARVAAAGV

SEQ ID NO: 1457404 - protein, 20 aa, Mycobacterium tuberculosis
PDAMAGLIRTMFGNRERYQI

SEQ ID NO: 1457405 - protein, 21 aa, Mycobacterium tuberculosis
PDELKAAVKRAARQRGVSEAQ

SEQ ID NO: 1457406 - protein, 24 aa, Mycobacterium tuberculosis
PDERGMRTVMCILNGQLRPVLVRD

SEQ ID NO: 1457407 - protein, 22 aa, Mycobacterium tuberculosis
PDGRIPIWLPPAKRLPDGLASY

SEQ ID NO: 1457408 - protein, 23 aa, Mycobacterium tuberculosis
PDGTRWVGLSAMRAADEQSATGS

SEQ ID NO: 1457409 - protein, 19 aa, Mycobacterium tuberculosis
PDIADVLYGIHRWLHGHAD

SEQ ID NO: 1457410 - protein, 23 aa, Mycobacterium tuberculosis
PDIFKEYFGTVIPAGDNKFSALN

SEQ ID NO: 1457411 - protein, 24 aa, Mycobacterium tuberculosis
PDLEVLTHGLTLWDLDRVFKVDGF

SEQ ID NO: 1457412 - protein, 18 aa, Mycobacterium tuberculosis
PDPFCEIESTLLWHLATA

SEQ ID NO: 1457413 - protein, 22 aa, Mycobacterium tuberculosis
PDQARAALIVLMQRYLVGDLAA

SEQ ID NO: 1457414 - protein, 25 aa, Mycobacterium tuberculosis
PDQMLAYNCSPSFNWKKHLDDATIA

SEQ ID NO: 1457415 - protein, 20 aa, Mycobacterium tuberculosis
PDRLRSGADVADFGCGSGRA

SEQ ID NO: 1457416 - protein, 20 aa, Mycobacterium tuberculosis
PDSYLAYGFAVHNCTAPIYK

SEQ ID NO: 1457417 - protein, 18 aa, Mycobacterium tuberculosis
PDVARIGSSIGAPDTAAA

SEQ ID NO: 1457418 - protein, 22 aa, Mycobacterium tuberculosis
PEAFTKLAARFLGPVLGGVQPV

SEQ ID NO: 1457419 - protein, 27 aa, Mycobacterium tuberculosis
PEAITRPRWLWKFAKTLRPPDLRVPNQ

SEQ ID NO: 1457420 - protein, 20 aa, Mycobacterium tuberculosis
PEALGPLEFPFVYRRHQLSL

SEQ ID NO: 1457421 - protein, 20 aa, Mycobacterium tuberculosis
PEATRVAVLRSFKDHWDREH

SEQ ID NO: 1457422 - protein, 20 aa, Mycobacterium tuberculosis
PEDYRTFWTQFGRVLKEGLL

SEQ ID NO: 1457423 - protein, 19 aa, Mycobacterium tuberculosis
PEETRYWYYALLGFGLNRY

SEQ ID NO: 1457424 - protein, 21 aa, Mycobacterium tuberculosis
PEIEVGKGFAGVMETFDNTRP

SEQ ID NO: 1457425 - protein, 22 aa, Mycobacterium tuberculosis
PEKLELCRDLGAQITINYRDED

SEQ ID NO: 1457426 - protein, 17 aa, Mycobacterium tuberculosis
PELGYRLLQRLGADVAD

SEQ ID NO: 1457427 - protein, 21 aa, Mycobacterium tuberculosis
PELPVGVRLIFQAAEELMPGG

SEQ ID NO: 1457428 - protein, 19 aa, Mycobacterium tuberculosis
PESHAMFVALAYAKLNGVR

SEQ ID NO: 1457429 - protein, 26 aa, Mycobacterium tuberculosis
PETGLRPPRPGNFVMSFLDASIAPLS

SEQ ID NO: 1457430 - protein, 31 aa, Mycobacterium tuberculosis; identical to SEQ ID NO: 203968

SEQ ID NO: 1457431 - protein, 21 aa, Mycobacterium tuberculosis
PFADLSFPAGVTVDRDDSVYV

SEQ ID NO: 1457432 - protein, 26 aa, Mycobacterium tuberculosis
PFAGHPTVGASWWLRERGTPINTLQV

SEQ ID NO: 1457433 - protein, 20 aa, Mycobacterium tuberculosis
PFEPDVRLSPYLALHGICRW

SEQ ID NO: 1457434 - protein, 18 aa, Mycobacterium tuberculosis
PFRISLIERDAWLRCMHT

SEQ ID NO: 1457435 - protein, 19 aa, Mycobacterium tuberculosis
PFVKAAYRIGQVQDIGRGV

SEQ ID NO: 1457436 - protein, 25 aa, Mycobacterium tuberculosis
PGAGPMLAAAVAWDGLAAELQSMAA

SEQ ID NO: 1457437 - protein, 28 aa, Mycobacterium tuberculosis
PGCPFAPRCPLVIDECLTAEPELLDVAT

SEQ ID NO: 1457438 - protein, 23 aa, Mycobacterium tuberculosis
PGDGWRVAMATLTFERGVSTLGQ

SEQ ID NO: 1457439 - protein, 19 aa, Mycobacterium tuberculosis
PGEQVCAPSAIVRPTSEAE

SEQ ID NO: 1457440 - protein, 24 aa, Mycobacterium tuberculosis
PGGARSGLRAAVDILEDIDDIHIA

SEQ ID NO: 1457441 - protein, 19 aa, Mycobacterium tuberculosis
PGGVVSRGDLLRVLPGDGS

SEQ ID NO: 1457442 - protein, 23 aa, Mycobacterium tuberculosis
PGGYLKAAVDFALDRDDYGPDLR

SEQ ID NO: 1457443 - protein, 23 aa, Mycobacterium tuberculosis
PGLHRPRTLLGKRLNDLVRETYA

SEQ ID NO: 1457444 - protein, 20 aa, Mycobacterium tuberculosis
PGLTEALHNIGFGNIGGNNY

SEQ ID NO: 1457445 - protein, 24 aa, Mycobacterium tuberculosis
PGMDPNWRRILLVCRATETMGTGG

SEQ ID NO: 1457446 - protein, 19 aa, Mycobacterium tuberculosis
PGMNGIDVCRVLRADSGVP

SEQ ID NO: 1457447 - protein, 23 aa, Mycobacterium tuberculosis
PGPDIDGGIDLTDDEFQAFLQAA

SEQ ID NO: 1457448 - protein, 26 aa, Mycobacterium tuberculosis
PGPSIACSRWGMLSPEGRCKTFDASA

SEQ ID NO: 1457449 - protein, 27 aa, Mycobacterium tuberculosis
PGRGPCYRCLHPAPPPPGLVPSCAEGG

SEQ ID NO: 1457450 - protein, 25 aa, Mycobacterium tuberculosis
PGVPMVFPLWLERLQVKYINRALKP

SEQ ID NO: 1457451 - protein, 27 aa, Mycobacterium tuberculosis
PHDIVLFPAWVWRSPLKPSPLDPPHVP

SEQ ID NO: 1457452 - protein, 24 aa, Mycobacterium tuberculosis
PHGQVLVFWDCYRPHDVQVRMFDV

SEQ ID NO: 1457453 - protein, 22 aa, Mycobacterium tuberculosis
PICAFSHCRDVVAAVSNAGGFG

SEQ ID NO: 1457454 - protein, 25 aa, Mycobacterium tuberculosis
PIDEISVLVPDDFVGAVLGDLSSRR

SEQ ID NO: 1457455 - protein, 24 aa, Mycobacterium tuberculosis
PIDLRADWPTALQAAGFDSAAPTA

SEQ ID NO: 1457456 - protein, 25 aa, Mycobacterium tuberculosis
PIDPWGGSYYVEWLTHRLARRARAH

SEQ ID NO: 1457457 - protein, 26 aa, Mycobacterium tuberculosis
PIGMAPEEWRAFAARASLHAARAKAK

SEQ ID NO: 1457458 - protein, 24 aa, Mycobacterium tuberculosis
PILLGAGWEGGWRCGEVVLSMVAD

SEQ ID NO: 1457459 - protein, 25 aa, Mycobacterium tuberculosis
PIPRPPSIRDSLCFLDHMRNCQEAM

SEQ ID NO: 1457460 - protein, 17 aa, Mycobacterium tuberculosis
PKLACATFLADYLPGPV

SEQ ID NO: 1457461 - protein, 21 aa, Mycobacterium tuberculosis
PKNPRLRARPRIKGLRLRATD

SEQ ID NO: 1457462 - protein, 20 aa, Mycobacterium tuberculosis
PKPPPRRITLTLPAIQRSRE

SEQ ID NO: 1457463 - protein, 18 aa, Mycobacterium tuberculosis
PKRARMLMDAAIFKDTLI

SEQ ID NO: 1457464 - protein, 25 aa, Mycobacterium tuberculosis
PLDTTWHRPGWTIGELEAAKAGRTI

SEQ ID NO: 1457465 - protein, 18 aa, Mycobacterium tuberculosis
PLGAFGIGGEFNMADLGQ

SEQ ID NO: 1457466 - protein, 24 aa, Mycobacterium tuberculosis
PLGLTLPEFVCLRMLSQSPGLSSA

SEQ ID NO: 1457467 - protein, 18 aa, Mycobacterium tuberculosis
PLGPYGFSGWVGPEPHGA

SEQ ID NO: 1457468 - protein, 18 aa, Mycobacterium tuberculosis
PLLDGEITSCYSMTEPQG

SEQ ID NO: 1457469 - protein, 25 aa, Mycobacterium tuberculosis
PLPLPLKTSCAWAQARRDGQDPYPP

SEQ ID NO: 1457470 - protein, 20 aa, Mycobacterium tuberculosis
PLRRELAGTFSARRGTYRLL

SEQ ID NO: 1457471 - protein, 24 aa, Mycobacterium tuberculosis
PMFAFGHGLSYTSFEYRDLVVTGG

SEQ ID NO: 1457472 - protein, 20 aa, Mycobacterium tuberculosis
PMGMMPMPMGMGGAGAGMPA

SEQ ID NO: 1457473 - protein, 18 aa, Mycobacterium tuberculosis
PNCGTCRYCCTGRQNLCD

SEQ ID NO: 1457474 - protein, 21 aa, Mycobacterium tuberculosis
PNLFENMGFTYIGPVDGHNIP

SEQ ID NO: 1457475 - protein, 23 aa, Mycobacterium tuberculosis
PNSPACWMDELLYARAATIYAGS

SEQ ID NO: 1457476 - protein, 18 aa, Mycobacterium tuberculosis
PPEGRFGSVASVQRYVDD

SEQ ID NO: 1457477 - protein, 19 aa, Mycobacterium tuberculosis
PPGCGKTFVVRALASTGQL

SEQ ID NO: 1457478 - protein, 20 aa, Mycobacterium tuberculosis
PPKPSMRIISDIFAYTSAKM

SEQ ID NO: 1457479 - protein, 21 aa, Mycobacterium tuberculosis
PPMIRYPIPPMIHGATQSATW

SEQ ID NO: 1457480 - protein, 25 aa, Mycobacterium tuberculosis
PPPGMHHLGCSRGVLLISSQRDAGH

SEQ ID NO: 1457481 - protein, 18 aa, Mycobacterium tuberculosis
PPPLRWLERRTRGDQLHP

SEQ ID NO: 1457482 - protein, 20 aa, Mycobacterium tuberculosis
PPPNVDIRWSTADLRPRVDL

SEQ ID NO: 1457483 - protein, 20 aa, Mycobacterium tuberculosis
PPRGKTVWFTGLSGSGKSSV

SEQ ID NO: 1457484 - protein, 19 aa, Mycobacterium tuberculosis
PPSIREIGDAVGLTSTSSV

SEQ ID NO: 1457485 - protein, 22 aa, Mycobacterium tuberculosis
PPSQANFVWLPLGSRTQDFVEQ

SEQ ID NO: 1457486 - protein, 26 aa, Mycobacterium tuberculosis
PQEARPRWRRMANGLLHSKTRDAEAI

SEQ ID NO: 1457487 - protein, 18 aa, Mycobacterium tuberculosis
PQHRGLREPFGAQVYHVN

SEQ ID NO: 1457488 - protein, 24 aa, Mycobacterium tuberculosis
PQSSDFLHGRWLVLRRGKRSIAGV

SEQ ID NO: 1457489 - protein, 18 aa, Mycobacterium tuberculosis
PQVSVWDLAALDIVVREA

SEQ ID NO: 1457490 - protein, 24 aa, Mycobacterium tuberculosis
PQYGEPLSRHWDFTDNPADRSRIN

SEQ ID NO: 1457491 - protein, 19 aa, Mycobacterium tuberculosis
PQYKHSVVMGVNKAKVPGK

SEQ ID NO: 1457492 - protein, 22 aa, Mycobacterium tuberculosis
PRDKRMEVALTYIFGIGRTRSN

SEQ ID NO: 1457493 - protein, 18 aa, Mycobacterium tuberculosis
PRDPAGRRQAIVEAAERV

SEQ ID NO: 1457494 - protein, 18 aa, Mycobacterium tuberculosis
PRFDSLRTLVPVSTRSNS

SEQ ID NO: 1457495 - protein, 19 aa, Mycobacterium tuberculosis
PRFNHPNVHAIHRDIRTVI

SEQ ID NO: 1457496 - protein, 24 aa, Mycobacterium tuberculosis
PRIGAPRWDTVIVGLDCQTTILDE

SEQ ID NO: 1457497 - protein, 21 aa, Mycobacterium tuberculosis
PRKVSPLAVQMIMPNGAAAVI

SEQ ID NO: 1457498 - protein, 19 aa, Mycobacterium tuberculosis
PRLDYAHAHLKGRRGRSPA

SEQ ID NO: 1457499 - protein, 20 aa, Mycobacterium tuberculosis
PRLGLPLAQELSAYLRSLDP

SEQ ID NO: 1457500 - protein, 26 aa, Mycobacterium tuberculosis
PRLRDHCQRVQMAVNQFIAPLSTVLG

SEQ ID NO: 1457501 - protein, 19 aa, Mycobacterium tuberculosis
PRRIFAHGFLHNRGEKMSK

SEQ ID NO: 1457502 - protein, 19 aa, Mycobacterium tuberculosis
PRRPLQIMGRRVLDLYPVS

SEQ ID NO: 1457503 - protein, 19 aa, Mycobacterium tuberculosis
PRSALKKATAITPGLESPT

SEQ ID NO: 1457504 - protein, 23 aa, Mycobacterium tuberculosis
PRVWEKLKAGIEFTVARETDEMK

SEQ ID NO: 1457505 - protein, 24 aa, Mycobacterium tuberculosis
PSDVLRCYLDLVLDGLLARLASGE

SEQ ID NO: 1457506 - protein, 25 aa, Mycobacterium tuberculosis
PSFLPKRPLVEVLRDLASRIYTDFT

SEQ ID NO: 1457507 - protein, 23 aa, Mycobacterium tuberculosis
PSGRLAISYSRKVFIPVTRLCRD

SEQ ID NO: 1457508 - protein, 20 aa, Mycobacterium tuberculosis
PSGSHLLPALIRRYDEAKAS

SEQ ID NO: 1457509 - protein, 20 aa, Mycobacterium tuberculosis
PSHEGACVRATWLKVVPDQL

SEQ ID NO: 1457510 - protein, 18 aa, Mycobacterium tuberculosis
PSKLEVFNAALAAADGGP

SEQ ID NO: 1457511 - protein, 19 aa, Mycobacterium tuberculosis
PSPFHVCATVAGRLLGAGY

SEQ ID NO: 1457512 - protein, 18 aa, Mycobacterium tuberculosis
PSPLRAGDVLPVGEHTDD

SEQ ID NO: 1457513 - protein, 19 aa, Mycobacterium tuberculosis
PSSSKGRYLKKITVSTTTG

SEQ ID NO: 1457514 - protein, 19 aa, Mycobacterium tuberculosis
PSTGTNLWGAFGLLAEMVK

SEQ ID NO: 1457515 - protein, 24 aa, Mycobacterium tuberculosis
PSYPQDRLDFILADCDAKLVLRTP

SEQ ID NO: 1457516 - protein, 20 aa, Mycobacterium tuberculosis
PTAPFWFVGSLGELQAVAVH

SEQ ID NO: 1457517 - protein, 24 aa, Mycobacterium tuberculosis
PTARRRFATLCYMTDGLDDYFMPL

SEQ ID NO: 1457518 - protein, 27 aa, Mycobacterium tuberculosis
PTAVSRARRAIAEFRIRGVSTNIPFLQ

SEQ ID NO: 1457519 - protein, 18 aa, Mycobacterium tuberculosis
PTDPRPFRAGPHETSALL

SEQ ID NO: 1457520 - protein, 18 aa, Mycobacterium tuberculosis
PTECEFFSLRGLALLTDT

SEQ ID NO: 1457521 - protein, 20 aa, Mycobacterium tuberculosis
PTGLAGLGILISEAVRGEGG

SEQ ID NO: 1457522 - protein, 18 aa, Mycobacterium tuberculosis
PTHCGATLIAGLDMDSDI

SEQ ID NO: 1457523 - protein, 17 aa, Mycobacterium tuberculosis
PTRAMIFDSVYDIYRGV

SEQ ID NO: 1457524 - protein, 18 aa, Mycobacterium tuberculosis
PTSVLLINHGLHIEILID

SEQ ID NO: 1457525 - protein, 23 aa, Mycobacterium tuberculosis
PTVAECLIVLTARHGPVARTIFE

SEQ ID NO: 1457526 - protein, 19 aa, Mycobacterium tuberculosis
PVEALIGVFDKIGVKTGID

SEQ ID NO: 1457527 - protein, 19 aa, Mycobacterium tuberculosis
PVHAVRLAGLVAHQEVLFG

SEQ ID NO: 1457528 - protein, 25 aa, Mycobacterium tuberculosis
PVLAICAAIQVLGHWYETSSGDRVD

SEQ ID NO: 1457529 - protein, 22 aa, Mycobacterium tuberculosis
PVLVKASAGGGGRGMRVVHELS

SEQ ID NO: 1457530 - protein, 24 aa, Mycobacterium tuberculosis
PVMADAAAALAEFDIPAEVRVVSA

SEQ ID NO: 1457531 - protein, 21 aa, Mycobacterium tuberculosis
PVQAWGWLSLAAGLAVLDSVA

SEQ ID NO: 1457532 - protein, 17 aa, Mycobacterium tuberculosis
PVSAIAPNTRLDFEQLP

SEQ ID NO: 1457533 - protein, 18 aa, Mycobacterium tuberculosis
PVTIPGFAINPFGLDVPL

SEQ ID NO: 1457534 - protein, 31 aa, Mycobacterium tuberculosis; identical to SEQ ID NO: 204536

SEQ ID NO: 1457535 - protein, 24 aa, Mycobacterium tuberculosis
PWTMPEPLLPIAIAAHAKTDEDKL

SEQ ID NO: 1457536 - protein, 18 aa, Mycobacterium tuberculosis
PYESCNLGSINLARMLAD

SEQ ID NO: 1457537 - protein, 17 aa, Mycobacterium tuberculosis
PYFSLAMLPGGRRRALL

SEQ ID NO: 1457538 - protein, 18 aa, Mycobacterium tuberculosis
PYGTVLIIGAWNYPFYLT

SEQ ID NO: 1457539 - protein, 19 aa, Mycobacterium tuberculosis
PYLDTVLFLLGVTRGEIEA

SEQ ID NO: 1457540 - protein, 25 aa, Mycobacterium tuberculosis
PYYQRFGFRVTREIALPDAGPPLWA

SEQ ID NO: 1457541 - protein, 18 aa, Mycobacterium tuberculosis
QAAREGRDMLALTSSQWD

SEQ ID NO: 1457542 - protein, 24 aa, Mycobacterium tuberculosis
QADPRPGVWHSSGMNRIRLSTTVD

SEQ ID NO: 1457543 - protein, 21 aa, Mycobacterium tuberculosis
QAEGLGQLFVRLLTANFEEAV

SEQ ID NO: 1457544 - protein, 17 aa, Mycobacterium tuberculosis
QAGAVGLVVTTDWTFSH

SEQ ID NO: 1457545 - protein, 24 aa, Mycobacterium tuberculosis
QAGMGFGGGVGLGLGGQAGGVIGG

SEQ ID NO: 1457546 - protein, 31 aa, Mycobacterium tuberculosis; identical to SEQ ID NO: 204578

SEQ ID NO: 1457547 - protein, 23 aa, Mycobacterium tuberculosis
QAISALLLPLAIEHTLQYRRGVP

SEQ ID NO: 1457548 - protein, 21 aa, Mycobacterium tuberculosis
QALDRWISWARRCRIPVFVEL

SEQ ID NO: 1457549 - protein, 17 aa, Mycobacterium tuberculosis
QALGPGVITEHRVTHPE

SEQ ID NO: 1457550 - protein, 27 aa, Mycobacterium tuberculosis
QARPPARLVGWTARFLGMVRPGDEVDF

SEQ ID NO: 1457551 - protein, 30 aa, Mycobacterium tuberculosis; identical to SEQ ID NO: 204616

SEQ ID NO: 1457552 - protein, 18 aa, Mycobacterium tuberculosis
QEASYPAVQYIPLADVVQ

SEQ ID NO: 1457553 - protein, 23 aa, Mycobacterium tuberculosis
QEDSRLLTRELLYTAVTRAKRKV

SEQ ID NO: 1457554 - protein, 24 aa, Mycobacterium tuberculosis
QEITRGRCAAISVPGDRSTEKLVA

SEQ ID NO: 1457555 - protein, 24 aa, Mycobacterium tuberculosis
QEKAQELGLTWLAEIGAHGVVAGP

SEQ ID NO: 1457556 - protein, 25 aa, Mycobacterium tuberculosis
QEPTVLPSRFPNLLANGSGGIAVGM

SEQ ID NO: 1457557 - protein, 19 aa, Mycobacterium tuberculosis
QFPAYQLTALIGGDLSKVD

SEQ ID NO: 1457558 - protein, 26 aa, Mycobacterium tuberculosis
QFYHPLDMFGEWNRAYGPAGFLQYQF

SEQ ID NO: 1457559 - protein, 27 aa, Mycobacterium tuberculosis
QGHWLLARLGKRVLRPGGVELTRTLLA

SEQ ID NO: 1457560 - protein, 24 aa, Mycobacterium tuberculosis
QGSARCRDVLALKLNAQLIDELPL

SEQ ID NO: 1457561 - protein, 24 aa, Mycobacterium tuberculosis
QGTWRLWLPGCSWPPNVPQRRGQR

SEQ ID NO: 1457562 - protein, 23 aa, Mycobacterium tuberculosis
QGVPKTGAFWHIDYMFMPEPFAF

SEQ ID NO: 1457563 - protein, 20 aa, Mycobacterium tuberculosis
QHCWRHWKPAHVGRRNMDLL

SEQ ID NO: 1457564 - protein, 23 aa, Mycobacterium tuberculosis
QHLAKLRMARLVRTRRDGTTIFY

SEQ ID NO: 1457565 - protein, 17 aa, Mycobacterium tuberculosis
QIFEGDILFLEWTANSA

SEQ ID NO: 1457566 - protein, 19 aa, Mycobacterium tuberculosis
QKAAEAWSGGYFAKSVVPV

SEQ ID NO: 1457567 - protein, 24 aa, Mycobacterium tuberculosis
QKAGRFGALIPRLVRQGINGEGLT

SEQ ID NO: 1457568 - protein, 21 aa, Mycobacterium tuberculosis
QKLKVLVSIFGRETPVELTFG

SEQ ID NO: 1457569 - protein, 19 aa, Mycobacterium tuberculosis
QKRLFARQMEVFAGFSENA

SEQ ID NO: 1457570 - protein, 23 aa, Mycobacterium tuberculosis
QLAEVHPHWIVLRTVIDVINPIE

SEQ ID NO: 1457571 - protein, 29 aa, Mycobacterium tuberculosis
QLHCKIMWCPSVSLSIWANAWLAGKAAPD

SEQ ID NO: 1457572 - protein, 18 aa, Mycobacterium tuberculosis
QLSEFGFSAVAEHPRLGP

SEQ ID NO: 1457573 - protein, 23 aa, Mycobacterium tuberculosis
QLSRARALLLGRDYVIPEDVKEL

SEQ ID NO: 1457574 - protein, 31 aa, Mycobacterium tuberculosis; identical to SEQ ID NO: 204737

SEQ ID NO: 1457575 - protein, 17 aa, Mycobacterium tuberculosis
QLVVPVLNARFALNAAN

SEQ ID NO: 1457576 - protein, 23 aa, Mycobacterium tuberculosis
QMAEPKWVLAMGVCASSGGMFNN

SEQ ID NO: 1457577 - protein, 23 aa, Mycobacterium tuberculosis
QNDPRSTYKFGPEDYGAAMQILE

SEQ ID NO: 1457578 - protein, 17 aa, Mycobacterium tuberculosis
QNYYSFRNWNITESWMG

SEQ ID NO: 1457579 - protein, 21 aa, Mycobacterium tuberculosis
QPTHFPSVFGPSGDQPLDAGT

SEQ ID NO: 1457580 - protein, 20 aa, Mycobacterium tuberculosis
QQLTLPFAAPHSMFNVKVGG

SEQ ID NO: 1457581 - protein, 39 aa, Mycobacterium tuberculosis; identical to SEQ ID NO: 204783

SEQ ID NO: 1457582 - protein, 21 aa, Mycobacterium tuberculosis
QRAGLRTACLDAKRYAGGMAS

SEQ ID NO: 1457583 - protein, 25 aa, Mycobacterium tuberculosis
QRAQWLRPLLDGKIRSAFSMTEPAV

SEQ ID NO: 1457584 - protein, 18 aa, Mycobacterium tuberculosis
QRAVLLLRDVLQWKSAEV

SEQ ID NO: 1457585 - protein, 30 aa, Mycobacterium tuberculosis; identical to SEQ ID NO: 204797

SEQ ID NO: 1457586 - protein, 20 aa, Mycobacterium tuberculosis
QRLLTAWLELGMATYDTNQR

SEQ ID NO: 1457587 - protein, 21 aa, Mycobacterium tuberculosis
QRLRSIAHLGVRTRDYAFIVN

SEQ ID NO: 1457588 - protein, 24 aa, Mycobacterium tuberculosis
QRPGDPTLRRLLPDFYRPDDLDDD

SEQ ID NO: 1457589 - protein, 19 aa, Mycobacterium tuberculosis
QRQEFASRIGVTAQDLTAY

SEQ ID NO: 1457590 - protein, 22 aa, Mycobacterium tuberculosis
QRRAELRTAKALLGVRDELKLS

SEQ ID NO: 1457591 - protein, 21 aa, Mycobacterium tuberculosis
QRSREVWLLVSGPGKADAVAA

SEQ ID NO: 1457592 - protein, 20 aa, Mycobacterium tuberculosis
QRSSNFMLWQAAYAEYIFQD

SEQ ID NO: 1457593 - protein, 25 aa, Mycobacterium tuberculosis
QSWDIFKCVRQVLDVLDRVDDPLPA

SEQ ID NO: 1457594 - protein, 25 aa, Mycobacterium tuberculosis
QSYGSRCVRPPILYGDVSRPRAMTV

SEQ ID NO: 1457595 - protein, 31 aa, Mycobacterium tuberculosis; identical to SEQ ID NO: 204874

SEQ ID NO: 1457596 - protein, 24 aa, Mycobacterium tuberculosis
QTNVEFLRFLLADERVRVGDLDTA

SEQ ID NO: 1457597 - protein, 20 aa, Mycobacterium tuberculosis
QVAAGIRSTGRWRGRPKNQD

SEQ ID NO: 1457598 - protein, 26 aa, Mycobacterium tuberculosis
QVNRKVLPGYILVRMDLTDDSWAAVR

SEQ ID NO: 1457599 - protein, 19 aa, Mycobacterium tuberculosis
QVTEVLKLLTGVGTPLVGR

SEQ ID NO: 1457600 - protein, 17 aa, Mycobacterium tuberculosis
QVVEGWYGQRFPKPLAR

SEQ ID NO: 1457601 - protein, 24 aa, Mycobacterium tuberculosis
QWGELYLPRFLFGVFLSEQMIAAI

SEQ ID NO: 1457602 - protein, 29 aa, Mycobacterium tuberculosis
QWLEGCAVQRIMFRDGLVLNFDDYNELVI

SEQ ID NO: 1457603 - protein, 24 aa, Mycobacterium tuberculosis
QYAQLRKAKGITVEHAREIMNDAT

SEQ ID NO: 1457604 - protein, 26 aa, Mycobacterium tuberculosis
QYTPEQWWPFIGNLSLDQSIAQGVTL

SEQ ID NO: 1457605 - protein, 25 aa, Mycobacterium tuberculosis
RAAEHPRPDYVLLHISDTHLIGGDR

SEQ ID NO: 1457606 - protein, 21 aa, Mycobacterium tuberculosis
RACQAGHRVLFATASQWVDRL

SEQ ID NO: 1457607 - protein, 18 aa, Mycobacterium tuberculosis
RADEIAFGYSDDGIDAVV

SEQ ID NO: 1457608 - protein, 27 aa, Mycobacterium tuberculosis
RADLVLPMWQRLEPVWGPARDVRDNQP

SEQ ID NO: 1457609 - protein, 19 aa, Mycobacterium tuberculosis
RADYPGLRVRVAMSVGPWQ

SEQ ID NO: 1457610 - protein, 31 aa, Mycobacterium tuberculosis; identical to SEQ ID NO: 195348

SEQ ID NO: 1457611 - protein, 19 aa, Mycobacterium tuberculosis
RAGLGSSVPQFWAGELQTV

SEQ ID NO: 1457612 - protein, 20 aa, Mycobacterium tuberculosis
RAILDEWKTISGVDRKVDDA

SEQ ID NO: 1457613 - protein, 25 aa, Mycobacterium tuberculosis
RAISEIGGLVTRVSVSGDADRAYLV

SEQ ID NO: 1457614 - protein, 23 aa, Mycobacterium tuberculosis
RALEGRAAALIANHGLVAVGPRP

SEQ ID NO: 1457615 - protein, 36 aa, Mycobacterium tuberculosis; identical to SEQ ID NO: 204997

SEQ ID NO: 1457616 - protein, 29 aa, Mycobacterium tuberculosis
RALVPDDLRPEWVLPRADEIAFGYSDDGI

SEQ ID NO: 1457617 - protein, 24 aa, Mycobacterium tuberculosis
RAMRDGRVSVFMGMGGNFASATPD

SEQ ID NO: 1457618 - protein, 25 aa, Mycobacterium tuberculosis
RAMTRAGRHIPVFAHVTVETTGTML

SEQ ID NO: 1457619 - protein, 19 aa, Mycobacterium tuberculosis
RAPGALPLDTTWHRPGWTI

SEQ ID NO: 1457620 - protein, 24 aa, Mycobacterium tuberculosis
RARAGEITAEMAFIAAREDMSAEL

SEQ ID NO: 1457621 - protein, 19 aa, Mycobacterium tuberculosis
RARLACSLADQGRAVAVVS

SEQ ID NO: 1457622 - protein, 26 aa, Mycobacterium tuberculosis
RARLWPRPVDAYADFDSCQSWTERGI

SEQ ID NO: 1457623 - protein, 25 aa, Mycobacterium tuberculosis
RARPCGHSPLVLWALGPARLDEVAP

SEQ ID NO: 1457624 - protein, 17 aa, Mycobacterium tuberculosis
RASALSYSSVLSTLTGE

SEQ ID NO: 1457625 - protein, 24 aa, Mycobacterium tuberculosis
RASDPTCWWMHHFQMPSRVETWVP

SEQ ID NO: 1457626 - protein, 19 aa, Mycobacterium tuberculosis
RASFMPKPFGQHPGSAMHT

SEQ ID NO: 1457627 - protein, 26 aa, Mycobacterium tuberculosis
RAVEVALRSARRFGAPVIVHVVTRKG

SEQ ID NO: 1457628 - protein, 22 aa, Mycobacterium tuberculosis
RAVGRYLAGRAGEAGVGKLGFE

SEQ ID NO: 1457629 - protein, 19 aa, Mycobacterium tuberculosis
RAVLVFDRRCRIEFDPHQH

SEQ ID NO: 1457630 - protein, 17 aa, Mycobacterium tuberculosis
RAYRLDWQPGTTVFEID

SEQ ID NO: 1457631 - protein, 19 aa, Mycobacterium tuberculosis
RCFEPRLQELIGYGLYAGK

SEQ ID NO: 1457632 - protein, 22 aa, Mycobacterium tuberculosis
RCVPGARGTFFARCEQALRAAG

SEQ ID NO: 1457633 - protein, 27 aa, Mycobacterium tuberculosis
RCYLDDRPIFLGRNGRISVFGSERALA

SEQ ID NO: 1457634 - protein, 19 aa, Mycobacterium tuberculosis
RDAAAVGFDVTVCIHPSQI

SEQ ID NO: 1457635 - protein, 22 aa, Mycobacterium tuberculosis
RDDAVAAIVAWIADRENAVPTA

SEQ ID NO: 1457636 - protein, 26 aa, Mycobacterium tuberculosis
RDDLLRLGELICREVGQHASTIRAVL

SEQ ID NO: 1457637 - protein, 26 aa, Mycobacterium tuberculosis
RDEPELRFELCLGVSGVHYPHETGRE

SEQ ID NO: 1457638 - protein, 25 aa, Mycobacterium tuberculosis
RDGPVVVHPSWWSAARVEVVTAAAR

SEQ ID NO: 1457639 - protein, 22 aa, Mycobacterium tuberculosis
RDGRAIEVIGRYHPKEEPSLIE

SEQ ID NO: 1457640 - protein, 22 aa, Mycobacterium tuberculosis
RDGWRISWMPGVVVVVLGGDTV

SEQ ID NO: 1457641 - protein, 24 aa, Mycobacterium tuberculosis
RDISAKKNEPDWMLQSRLKALRIF

SEQ ID NO: 1457642 - protein, 25 aa, Mycobacterium tuberculosis
RDNRAVHALARIMLHGRISHIQTSW

SEQ ID NO: 1457643 - protein, 17 aa, Mycobacterium tuberculosis
RDTLKKLGVRIRWVGSR

SEQ ID NO: 1457644 - protein, 18 aa, Mycobacterium tuberculosis
REAAPMWSARCPHPVLPP

SEQ ID NO: 1457645 - protein, 20 aa, Mycobacterium tuberculosis
REALRQAALVRFLAQGVEAT

SEQ ID NO: 1457646 - protein, 17 aa, Mycobacterium tuberculosis
REFKTGAARMALEAQVP

SEQ ID NO: 1457647 - protein, 23 aa, Mycobacterium tuberculosis
REGFPVELLSYFEVFTKTTISAE

SEQ ID NO: 1457648 - protein, 27 aa, Mycobacterium tuberculosis
REHDILAFERQWWKFAGVKEEAIKELF

SEQ ID NO: 1457649 - protein, 17 aa, Mycobacterium tuberculosis
REIIYRMGVTPPQAKQI

SEQ ID NO: 1457650 - protein, 19 aa, Mycobacterium tuberculosis
REIYWPRGKVLGGSSSMNA

SEQ ID NO: 1457651 - protein, 17 aa, Mycobacterium tuberculosis
RELEAFAAFASDLDAAS

SEQ ID NO: 1457652 - protein, 24 aa, Mycobacterium tuberculosis
RELQELRKSTGLDVSDRIRVVMSV

SEQ ID NO: 1457653 - protein, 19 aa, Mycobacterium tuberculosis
RELTAFVTYDHRLLSGCRE

SEQ ID NO: 1457654 - protein, 20 aa, Mycobacterium tuberculosis
RELVGEGTLFLLKVIGDSMV

SEQ ID NO: 1457655 - protein, 20 aa, Mycobacterium tuberculosis
REVHHMAALVGFGAAAINPY

SEQ ID NO: 1457656 - protein, 17 aa, Mycobacterium tuberculosis
REVPGLKAGQIHIRAGS

SEQ ID NO: 1457657 - protein, 23 aa, Mycobacterium tuberculosis
REWFTANATLGWATCPLTEAGFV

SEQ ID NO: 1457658 - protein, 21 aa, Mycobacterium tuberculosis
RFAGMLVAGVFLREFVAESVD

SEQ ID NO: 1457659 - protein, 23 aa, Mycobacterium tuberculosis
RFARLRESVGLMRQLWSGDRVDF

SEQ ID NO: 1457660 - protein, 17 aa, Mycobacterium tuberculosis
RFDREISPIQAPVLDEQ

SEQ ID NO: 1457661 - protein, 20 aa, Mycobacterium tuberculosis
RFPFERYRRLCDVGCADGLL

SEQ ID NO: 1457662 - protein, 17 aa, Mycobacterium tuberculosis
RFPWPPFEPDVRLSPYL

SEQ ID NO: 1457663 - protein, 27 aa, Mycobacterium tuberculosis
RFSEQLLPEHLHKVSLSFLVDDLVMHR

SEQ ID NO: 1457664 - protein, 19 aa, Mycobacterium tuberculosis
RGAAWGAGVGLAIGLFSPA

SEQ ID NO: 1457665 - protein, 20 aa, Mycobacterium tuberculosis
RGAFHGRSGYTLSLTNTKPT

SEQ ID NO: 1457666 - protein, 21 aa, Mycobacterium tuberculosis
RGAGDLWRHYVSAQSDRLVVL

SEQ ID NO: 1457667 - protein, 17 aa, Mycobacterium tuberculosis
RGAQLIAVCASWGSGPG

SEQ ID NO: 1457668 - protein, 18 aa, Mycobacterium tuberculosis
RGDKRALAETVHRNAEDA

SEQ ID NO: 1457669 - protein, 20 aa, Mycobacterium tuberculosis
RGERNWDYRYAWIRDSTFAL

SEQ ID NO: 1457670 - protein, 17 aa, Mycobacterium tuberculosis
RGETVHAPAHFDVEVIG

SEQ ID NO: 1457671 - protein, 19 aa, Mycobacterium tuberculosis
RGFFTSRVIGTFVNEALAM

SEQ ID NO: 1457672 - protein, 19 aa, Mycobacterium tuberculosis
RGGALAGIHPVDLGALAWR

SEQ ID NO: 1457673 - protein, 21 aa, Mycobacterium tuberculosis
RGGCMAAKFFTGLPLDGPDPE

SEQ ID NO: 1457674 - protein, 21 aa, Mycobacterium tuberculosis
RGGKISFTHLLGYALVQAVKK

SEQ ID NO: 1457675 - protein, 19 aa, Mycobacterium tuberculosis
RGGTVLCAIEVAREEISAY

SEQ ID NO: 1457676 - protein, 23 aa, Mycobacterium tuberculosis
RGIAEPYLRPGQLEEHLVYPVTT

SEQ ID NO: 1457677 - protein, 24 aa, Mycobacterium tuberculosis
RGIGATIAEVFARDGAHVVAIDVE

SEQ ID NO: 1457678 - protein, 24 aa, Mycobacterium tuberculosis
RGKGCDICKPVVASILASTGSDHI

SEQ ID NO: 1457679 - protein, 18 aa, Mycobacterium tuberculosis
RGLAKATLFGPAEVAERY

SEQ ID NO: 1457680 - protein, 20 aa, Mycobacterium tuberculosis
RGLEHMVRIYPRRDAASDTW

SEQ ID NO: 1457681 - protein, 18 aa, Mycobacterium tuberculosis
RGLPPKRRHEVFKALHDK

SEQ ID NO: 1457682 - protein, 18 aa, Mycobacterium tuberculosis
RGLRLSGFEVATAVDGAE

SEQ ID NO: 1457683 - protein, 26 aa, Mycobacterium tuberculosis
RGPNAGSRFLLDQAITSAGRHPDSDI

SEQ ID NO: 1457684 - protein, 17 aa, Mycobacterium tuberculosis
RGPVHLVALSRFPEPSS

SEQ ID NO: 1457685 - protein, 27 aa, Mycobacterium tuberculosis
RGQRLLQRCPVCLYAGSIMPDDLLAQC

SEQ ID NO: 1457686 - protein, 20 aa, Mycobacterium tuberculosis
RGRNGVLYAGEVNWDAAGLG

SEQ ID NO: 1457687 - protein, 28 aa, Mycobacterium tuberculosis
RGSTRGWFMCWLARAHPELVSRYRELYR

SEQ ID NO: 1457688 - protein, 24 aa, Mycobacterium tuberculosis
RGSVTRRPIHLMGLDKTFRLFSTL

SEQ ID NO: 1457689 - protein, 20 aa, Mycobacterium tuberculosis
RGTPVVAMPLLRRGNKEVHG

SEQ ID NO: 1457690 - protein, 17 aa, Mycobacterium tuberculosis
RGVNCDHVLISETAHTA

SEQ ID NO: 1457691 - protein, 25 aa, Mycobacterium tuberculosis
RGVSSCATCDGFFFRDQDIAVIGGG

SEQ ID NO: 1457692 - protein, 19 aa, Mycobacterium tuberculosis
RGVTISTLVQMAWATTLSA

SEQ ID NO: 1457693 - protein, 19 aa, Mycobacterium tuberculosis
RGWLTAPVIVLSARTDSSD

SEQ ID NO: 1457694 - protein, 22 aa, Mycobacterium tuberculosis
RHEKVQHRYGWIVVRVVAEDHP

SEQ ID NO: 1457695 - protein, 18 aa, Mycobacterium tuberculosis
RHHLKLAGRDDALFSDDA

SEQ ID NO: 1457696 - protein, 17 aa, Mycobacterium tuberculosis
RHLRAPITDALSRRLGH

SEQ ID NO: 1457697 - protein, 26 aa, Mycobacterium tuberculosis
RHLSYKTVWYGSALVVADRWFPSSKT

SEQ ID NO: 1457698 - protein, 17 aa, Mycobacterium tuberculosis
RHPGLAIGAVAVVNGAA

SEQ ID NO: 1457699 - protein, 23 aa, Mycobacterium tuberculosis
RHVSRGKLLPRERVDRLLDPGSP

SEQ ID NO: 1457700 - protein, 25 aa, Mycobacterium tuberculosis
RIAEHEMPGLMSLRREYAEVQPLKG

SEQ ID NO: 1457701 - protein, 19 aa, Mycobacterium tuberculosis
RIDPFRAAKTLNINFFVHD

SEQ ID NO: 1457702 - protein, 18 aa, Mycobacterium tuberculosis
RIEEDVVRAALADHDGVL

SEQ ID NO: 1457703 - protein, 17 aa, Mycobacterium tuberculosis
RIGIPAFGKSQWAHVER

SEQ ID NO: 1457704 - protein, 18 aa, Mycobacterium tuberculosis
RIGLALNCEIVPWCRFAR

SEQ ID NO: 1457705 - protein, 22 aa, Mycobacterium tuberculosis
RIGRLAVRLDVSRLVVVGTGRS

SEQ ID NO: 1457706 - protein, 23 aa, Mycobacterium tuberculosis
RIPAATMRRAWTMLAHYHGQLFS

SEQ ID NO: 1457707 - protein, 18 aa, Mycobacterium tuberculosis
RIPPFAAVQCISGPRHTR

SEQ ID NO: 1457708 - protein, 21 aa, Mycobacterium tuberculosis
RIQGGWLEFDAAIATPDQMAK

SEQ ID NO: 1457709 - protein, 17 aa, Mycobacterium tuberculosis
RISNALVAMAIESLGAH

SEQ ID NO: 1457710 - protein, 25 aa, Mycobacterium tuberculosis
RIVLPEMLYERVVEVDERVTADGRV

SEQ ID NO: 1457711 - protein, 18 aa, Mycobacterium tuberculosis
RKAYNWTVAQLKADIQAW

SEQ ID NO: 1457712 - protein, 20 aa, Mycobacterium tuberculosis
RKCIECFLCQNVCHVVRDHE

SEQ ID NO: 1457713 - protein, 30 aa, Mycobacterium tuberculosis; identical to SEQ ID NO: 205450

SEQ ID NO: 1457714 - protein, 26 aa, Mycobacterium tuberculosis
RKDWIPRLATMGVIASYCLTEPGAGS

SEQ ID NO: 1457715 - protein, 18 aa, Mycobacterium tuberculosis
RKGIARAKSVVALAYAGG

SEQ ID NO: 1457716 - protein, 18 aa, Mycobacterium tuberculosis
RKGVSVDVPENFDPTRRS

SEQ ID NO: 1457717 - protein, 18 aa, Mycobacterium tuberculosis
RKPAPSWRHTACPVNELS

SEQ ID NO: 1457718 - protein, 17 aa, Mycobacterium tuberculosis
RKPRQVFTRDVLLEQVW

SEQ ID NO: 1457719 - protein, 19 aa, Mycobacterium tuberculosis
RKSGKNFVAPLLYITDRNN

SEQ ID NO: 1457720 - protein, 24 aa, Mycobacterium tuberculosis
RKVRRLRRLAGLWLADQEERWAAV

SEQ ID NO: 1457721 - protein, 24 aa, Mycobacterium tuberculosis
RLAAAKTRLAPVFSAQTRENVVLA

SEQ ID NO: 1457722 - protein, 24 aa, Mycobacterium tuberculosis
RLADRLIPHRAWIFVYQLYLWDMR

SEQ ID NO: 1457723 - protein, 25 aa, Mycobacterium tuberculosis
RLANALRSWSVLRFEVTEDPSPGVD

SEQ ID NO: 1457724 - protein, 17 aa, Mycobacterium tuberculosis
RLARAGAVGALSVVDLL

SEQ ID NO: 1457725 - protein, 20 aa, Mycobacterium tuberculosis
RLATRHLRRYPGLQRAAGRG

SEQ ID NO: 1457726 - protein, 25 aa, Mycobacterium tuberculosis
RLCRDNCHYCTFVTVPGKLRAQGSS

SEQ ID NO: 1457727 - protein, 18 aa, Mycobacterium tuberculosis
RLDGVPLAIELAAARTDT

SEQ ID NO: 1457728 - protein, 18 aa, Mycobacterium tuberculosis
RLDKARFRSHPDLEVLTH

SEQ ID NO: 1457729 - protein, 18 aa, Mycobacterium tuberculosis
RLDPGLPLPSRAHDGDAG

SEQ ID NO: 1457730 - protein, 20 aa, Mycobacterium tuberculosis
RLEGYRRLAAASSDREVAAV

SEQ ID NO: 1457731 - protein, 20 aa, Mycobacterium tuberculosis
RLELKKFCPNCGKHQAHRET

SEQ ID NO: 1457732 - protein, 23 aa, Mycobacterium tuberculosis
RLGEAGGGFGIMMQTVLPWFNLG

SEQ ID NO: 1457733 - protein, 31 aa, Mycobacterium tuberculosis; identical to SEQ ID NO: 205536

SEQ ID NO: 1457734 - protein, 21 aa, Mycobacterium tuberculosis
RLIDRAGRWLLNYRPQPLAVG

SEQ ID NO: 1457735 - protein, 23 aa, Mycobacterium tuberculosis
RLLARAAAEFTRILTGVDIHPGA

SEQ ID NO: 1457736 - protein, 23 aa, Mycobacterium tuberculosis
RLLKLPIPVQRRVAAGVLSAGHA

SEQ ID NO: 1457737 - protein, 19 aa, Mycobacterium tuberculosis
RLPTGRRYGVVAGTGRLLE

SEQ ID NO: 1457738 - protein, 22 aa, Mycobacterium tuberculosis
RLRGVCKRYGSITAVSNLDLDV

SEQ ID NO: 1457739 - protein, 20 aa, Mycobacterium tuberculosis
RLRHAGGVAAAIARAGGPEL

SEQ ID NO: 1457740 - protein, 21 aa, Mycobacterium tuberculosis
RLRIVKRDVAAAIFDSHGLSV

SEQ ID NO: 1457741 - protein, 18 aa, Mycobacterium tuberculosis
RLSIPFTTGLLVGIGETL

SEQ ID NO: 1457742 - protein, 27 aa, Mycobacterium tuberculosis
RLSLSAGDRYTLWAPRWRDAGDEWEAF

SEQ ID NO: 1457743 - protein, 20 aa, Mycobacterium tuberculosis
RLSPYLALHGICRWGGSDSC

SEQ ID NO: 1457744 - protein, 18 aa, Mycobacterium tuberculosis
RLTPPVPSIPGRRSKPTI

SEQ ID NO: 1457745 - protein, 24 aa, Mycobacterium tuberculosis
RLTSCGRPTLFARVALLDEHGKPV

SEQ ID NO: 1457746 - protein, 26 aa, Mycobacterium tuberculosis
RLTSIALPRIRDFRGLSPKQFDGVGN

SEQ ID NO: 1457747 - protein, 19 aa, Mycobacterium tuberculosis
RMNGGFFPSVREYSVRYGL

SEQ ID NO: 1457748 - protein, 19 aa, Mycobacterium tuberculosis
RMPLHPVAIELLREVGPMA

SEQ ID NO: 1457749 - protein, 21 aa, Mycobacterium tuberculosis
RMVIPRPGGLTDIGYLTALLR

SEQ ID NO: 1457750 - protein, 25 aa, Mycobacterium tuberculosis
RNADEISRALTLLAELWSRYHNVLV

SEQ ID NO: 1457751 - protein, 23 aa, Mycobacterium tuberculosis
RNAKLASIPVGFAGRAALGLGKR

SEQ ID NO: 1457752 - protein, 23 aa, Mycobacterium tuberculosis
RNEHKRHRYAFTPFGGGVHKCIG

SEQ ID NO: 1457753 - protein, 21 aa, Mycobacterium tuberculosis
RNFLLPRGLAIVASRGAQKQA

SEQ ID NO: 1457754 - protein, 21 aa, Mycobacterium tuberculosis
RNGERYQFLRWGQGAFDDFKV

SEQ ID NO: 1457755 - protein, 25 aa, Mycobacterium tuberculosis
RNHVLDYLAAKGWQPEGVSLAELFR

SEQ ID NO: 1457756 - protein, 26 aa, Mycobacterium tuberculosis
RNILESFKLLTNVSRLFAQRCIAGLT

SEQ ID NO: 1457757 - protein, 24 aa, Mycobacterium tuberculosis
RNIWSGTAKFLFTRTTVGEIGILP

SEQ ID NO: 1457758 - protein, 20 aa, Mycobacterium tuberculosis
RNLMAIMTRVTWGCEPDDVS

SEQ ID NO: 1457759 - protein, 20 aa, Mycobacterium tuberculosis
RNQAPLSFPIPGWNICVDFP

SEQ ID NO: 1457760 - protein, 25 aa, Mycobacterium tuberculosis
RNVWSNAVIFCGHFPDGAEKFTKTD

SEQ ID NO: 1457761 - protein, 23 aa, Mycobacterium tuberculosis
RNYREAYGLFAVNGILFNHESPR

SEQ ID NO: 1457762 - protein, 17 aa, Mycobacterium tuberculosis
RPAGIWAYEAHRVAHRV

SEQ ID NO: 1457763 - protein, 17 aa, Mycobacterium tuberculosis
RPDRAIETNVEFWAAVV

SEQ ID NO: 1457764 - protein, 29 aa, Mycobacterium tuberculosis
RPDRSTTLALRWLVGYSRQRREKTMIERL

SEQ ID NO: 1457765 - protein, 19 aa, Mycobacterium tuberculosis
RPEETRMTFGARLQSPLAE

SEQ ID NO: 1457766 - protein, 24 aa, Mycobacterium tuberculosis
RPFYELVSRVGLERARRVVDLGCG

SEQ ID NO: 1457767 - protein, 27 aa, Mycobacterium tuberculosis
RPGGTIGVISWTCEGFFGRMLATIRPY

SEQ ID NO: 1457768 - protein, 18 aa, Mycobacterium tuberculosis
RPIFVTGLVRTGTTALHR

SEQ ID NO: 1457769 - protein, 25 aa, Mycobacterium tuberculosis
RPKKLFRPKVPVTIVVGERIEPTLP

SEQ ID NO: 1457770 - protein, 18 aa, Mycobacterium tuberculosis
RPLDAALRGLRRVSRARS

SEQ ID NO: 1457771 - protein, 19 aa, Mycobacterium tuberculosis
RPMHEKIVGRIAVSDLARR

SEQ ID NO: 1457772 - protein, 18 aa, Mycobacterium tuberculosis
RPMILKRFVKGISAEAVF

SEQ ID NO: 1457773 - protein, 24 aa, Mycobacterium tuberculosis
RPPVPLDAAILFAPVGDLVLPALE

SEQ ID NO: 1457774 - protein, 19 aa, Mycobacterium tuberculosis
RPRGISVLSGTRRGYELDA

SEQ ID NO: 1457775 - protein, 20 aa, Mycobacterium tuberculosis
RPRMLYDYFHQLFAQVTNPP

SEQ ID NO: 1457776 - protein, 19 aa, Mycobacterium tuberculosis
RPVPFIIGVAGSVAVGKST

SEQ ID NO: 1457777 - protein, 26 aa, Mycobacterium tuberculosis
RPVWDVEPWDRWLRDFFGPAATTDWY

SEQ ID NO: 1457778 - protein, 17 aa, Mycobacterium tuberculosis
RQAIQIPAAAHCALEYQ

SEQ ID NO: 1457779 - protein, 28 aa, Mycobacterium tuberculosis
RQDVAPVDGCIRIGLRYINEIRASLAEP

SEQ ID NO: 1457780 - protein, 18 aa, Mycobacterium tuberculosis
RQFDEWDVCIVPRERLRL

SEQ ID NO: 1457781 - protein, 19 aa, Mycobacterium tuberculosis
RQFPLDWRANGPIASTGLA

SEQ ID NO: 1457782 - protein, 17 aa, Mycobacterium tuberculosis
RQIPYTLACDLLLTGRH

SEQ ID NO: 1457783 - protein, 23 aa, Mycobacterium tuberculosis
RQLDWMVCRTVATLLRSKVSARP

SEQ ID NO: 1457784 - protein, 18 aa, Mycobacterium tuberculosis
RQLGFCRSTPPTIPHSRN

SEQ ID NO: 1457785 - protein, 18 aa, Mycobacterium tuberculosis
RQMIADRELETWLVVDMS

SEQ ID NO: 1457786 - protein, 20 aa, Mycobacterium tuberculosis
RQPGRLRIALSTRVPTPLPV

SEQ ID NO: 1457787 - protein, 25 aa, Mycobacterium tuberculosis
RQPPPRLANLLPLIRPHEHMPDSVR

SEQ ID NO: 1457788 - protein, 25 aa, Mycobacterium tuberculosis
RQPVTRARVSAVRGVNVDAVMRTLL

SEQ ID NO: 1457789 - protein, 19 aa, Mycobacterium tuberculosis
RQRSWFRRDHRVHWLDAGV

SEQ ID NO: 1457790 - protein, 17 aa, Mycobacterium tuberculosis
RQRVLVISTGSELASPG

SEQ ID NO: 1457791 - protein, 25 aa, Mycobacterium tuberculosis
RQYGIEPQQLFGYLQERNQLPTMFA

SEQ ID NO: 1457792 - protein, 29 aa, Mycobacterium tuberculosis
RRAGVPMQRIRPSLDWLIKNVGPHALASQ

SEQ ID NO: 1457793 - protein, 18 aa, Mycobacterium tuberculosis
RRAIQSFLESGVDLDDVL

SEQ ID NO: 1457794 - protein, 20 aa, Mycobacterium tuberculosis
RRARVLMRFIELVNDTIDEL

SEQ ID NO: 1457795 - protein, 24 aa, Mycobacterium tuberculosis
RRASARPGNCVRRTDGRGSRPGCP

SEQ ID NO: 1457796 - protein, 28 aa, Mycobacterium tuberculosis
RREFDRIKLGPSLWHRDFHDAVIVECPD

SEQ ID NO: 1457797 - protein, 21 aa, Mycobacterium tuberculosis
RRELVARLATGWVLEEVHDFE

SEQ ID NO: 1457798 - protein, 20 aa, Mycobacterium tuberculosis
RRFLESEGWIAWSGPAISEL

SEQ ID NO: 1457799 - protein, 25 aa, Mycobacterium tuberculosis
RRFPEELGKMGFVFNFITYGGHQID

SEQ ID NO: 1457800 - protein, 19 aa, Mycobacterium tuberculosis
RRGDGWVKLVGDWIDRQIG

SEQ ID NO: 1457801 - protein, 24 aa, Mycobacterium tuberculosis
RRGHRKLVRFQARRAIGPIRPTSA

SEQ ID NO: 1457802 - protein, 17 aa, Mycobacterium tuberculosis
RRGRDRIIVGYEGATVL

SEQ ID NO: 1457803 - protein, 20 aa, Mycobacterium tuberculosis
RRIAAGIVRRRAKTPFTSTA

SEQ ID NO: 1457804 - protein, 18 aa, Mycobacterium tuberculosis
RRITLTLPAIQRSREVWL

SEQ ID NO: 1457805 - protein, 20 aa, Mycobacterium tuberculosis
RRKAYNWAVATLKADIEAWR

SEQ ID NO: 1457806 - protein, 23 aa, Mycobacterium tuberculosis
RRLAERPANLAFFLRALTDRRRA

SEQ ID NO: 1457807 - protein, 20 aa, Mycobacterium tuberculosis
RRLAGFPATVTDIGDTLILT

SEQ ID NO: 1457808 - protein, 24 aa, Mycobacterium tuberculosis
RRLFADLMWVYPFGDRHTAMTVLV

SEQ ID NO: 1457809 - protein, 20 aa, Mycobacterium tuberculosis
RRLFAGGGFGGRRFDSGFGG

SEQ ID NO: 1457810 - protein, 26 aa, Mycobacterium tuberculosis
RRLRAKARLKFLIKDWGIAKFREVLE

SEQ ID NO: 1457811 - protein, 25 aa, Mycobacterium tuberculosis
RRLRKEIFELYGYTAVVHVLSASGI

SEQ ID NO: 1457812 - protein, 30 aa, Mycobacterium tuberculosis; identical to SEQ ID NO: 205878

SEQ ID NO: 1457813 - protein, 22 aa, Mycobacterium tuberculosis
RRPTLVPVEAIEFLRGEVQYTE

SEQ ID NO: 1457814 - protein, 21 aa, Mycobacterium tuberculosis
RRRELVKQAKHKGEEAKVSVR

SEQ ID NO: 1457815 - protein, 21 aa, Mycobacterium tuberculosis
RRRFSTVIEFFSYTPQELIAL

SEQ ID NO: 1457816 - protein, 21 aa, Mycobacterium tuberculosis
RRRGACMAVLDVSHPDICDFV

SEQ ID NO: 1457817 - protein, 30 aa, Mycobacterium tuberculosis; identical to SEQ ID NO: 205891

SEQ ID NO: 1457818 - protein, 21 aa, Mycobacterium tuberculosis
RRRRFDVGRGPLIRFLLIELP

SEQ ID NO: 1457819 - protein, 18 aa, Mycobacterium tuberculosis
RRRTGWSVVVTGLATEVS

SEQ ID NO: 1457820 - protein, 22 aa, Mycobacterium tuberculosis
RRSAESLYDFNLATYDEGDSFD

SEQ ID NO: 1457821 - protein, 24 aa, Mycobacterium tuberculosis
RRSLPIMFPIEVRFSAPDDSFLST

SEQ ID NO: 1457822 - protein, 18 aa, Mycobacterium tuberculosis
RRVESRAVDGVSFRLPRA

SEQ ID NO: 1457823 - protein, 20 aa, Mycobacterium tuberculosis
RRVGGDLYGSFLPGTQQNLE

SEQ ID NO: 1457824 - protein, 19 aa, Mycobacterium tuberculosis
RRVGPIIGTVAMQLPRLSR

SEQ ID NO: 1457825 - protein, 25 aa, Mycobacterium tuberculosis
RSAREWLEHMYDKWSAELDFPVPSF

SEQ ID NO: 1457826 - protein, 19 aa, Mycobacterium tuberculosis
RSCGMTAIVKGLRTGTDFE

SEQ ID NO: 1457827 - protein, 20 aa, Mycobacterium tuberculosis
RSEVIAALAAAFLNSLGPDD

SEQ ID NO: 1457828 - protein, 19 aa, Mycobacterium tuberculosis
RSGARVALVAGDRDIEAGT

SEQ ID NO: 1457829 - protein, 22 aa, Mycobacterium tuberculosis
RSGKLPPPEPVVYPLDQAAAAI

SEQ ID NO: 1457830 - protein, 24 aa, Mycobacterium tuberculosis
RSGKNVVTPLGWFYPSEKEAAPLE

SEQ ID NO: 1457831 - protein, 19 aa, Mycobacterium tuberculosis
RSGQYVFKEIVEHYLQQIS

SEQ ID NO: 1457832 - protein, 17 aa, Mycobacterium tuberculosis
RSGRTPDRRDWRLVREV

SEQ ID NO: 1457833 - protein, 17 aa, Mycobacterium tuberculosis
RSHRVRNNFSWLNSYYD

SEQ ID NO: 1457834 - protein, 18 aa, Mycobacterium tuberculosis
RSMVLQWGATDRGLVEAL

SEQ ID NO: 1457835 - protein, 20 aa, Mycobacterium tuberculosis
RSPAELFTALLTSPDHQLLR

SEQ ID NO: 1457836 - protein, 21 aa, Mycobacterium tuberculosis
RSPYGAAKVYSYWATRNYREA

SEQ ID NO: 1457837 - protein, 25 aa, Mycobacterium tuberculosis
RSRHGLAGMFTLRFDQFAHTLLSRA

SEQ ID NO: 1457838 - protein, 19 aa, Mycobacterium tuberculosis
RSRLVRFADRLTLVHTRYD

SEQ ID NO: 1457839 - protein, 20 aa, Mycobacterium tuberculosis
RSSVASAAWTGELADRKARN

SEQ ID NO: 1457840 - protein, 18 aa, Mycobacterium tuberculosis
RSTLRRNLTLMVAAETER

SEQ ID NO: 1457841 - protein, 17 aa, Mycobacterium tuberculosis
RTCSAAWSVNGSRRPSA

SEQ ID NO: 1457842 - protein, 24 aa, Mycobacterium tuberculosis
RTEDARVGKSLVIQLKYGPSRERS

SEQ ID NO: 1457843 - protein, 24 aa, Mycobacterium tuberculosis
RTFNVAWPKVFRPPVIAATVTTPV

SEQ ID NO: 1457844 - protein, 19 aa, Mycobacterium tuberculosis
RTFPLRSSFAPSYNMTINL

SEQ ID NO: 1457845 - protein, 32 aa, Mycobacterium tuberculosis; identical to SEQ ID NO: 206021

SEQ ID NO: 1457846 - protein, 29 aa, Mycobacterium tuberculosis
RTGEVLSVPVGDGFLGRVVNPLGQPIDGR

SEQ ID NO: 1457847 - protein, 19 aa, Mycobacterium tuberculosis
RTLLRTEFGITRMPPLGHE

SEQ ID NO: 1457848 - protein, 24 aa, Mycobacterium tuberculosis
RTLNELYMAAAHRPELQRLARLWP

SEQ ID NO: 1457849 - protein, 17 aa, Mycobacterium tuberculosis
RTLRLDQLIRYYVDHQL

SEQ ID NO: 1457850 - protein, 28 aa, Mycobacterium tuberculosis
RTRLPLPQRRFGGVVGRTMAESVGDWSI

SEQ ID NO: 1457851 - protein, 19 aa, Mycobacterium tuberculosis
RTRLTPICQLPTAAIDSTA

SEQ ID NO: 1457852 - protein, 24 aa, Mycobacterium tuberculosis
RTRVSFEVAGKWMSADVINVSAAG

SEQ ID NO: 1457853 - protein, 18 aa, Mycobacterium tuberculosis
RTSIAAVIALVDAIESAL

SEQ ID NO: 1457854 - protein, 22 aa, Mycobacterium tuberculosis
RTSNEAAFCYQLLVRSFGTNNL

SEQ ID NO: 1457855 - protein, 24 aa, Mycobacterium tuberculosis
RTTLYVTCEVVRIAALLIQPVMPE

SEQ ID NO: 1457856 - protein, 27 aa, Mycobacterium tuberculosis
RTTVNLKACIKAAADRVVFINTGFLDR

SEQ ID NO: 1457857 - protein, 23 aa, Mycobacterium tuberculosis
RTVRARIAGLDYRLDVNTLHRDK

SEQ ID NO: 1457858 - protein, 20 aa, Mycobacterium tuberculosis
RVAGTFTGMGLRGNASAPMA

SEQ ID NO: 1457859 - protein, 20 aa, Mycobacterium tuberculosis
RVCHARRPACGVCVLAKDCP

SEQ ID NO: 1457860 - protein, 23 aa, Mycobacterium tuberculosis
RVDGRSGVWLPGRPARKVAAIGV

SEQ ID NO: 1457861 - protein, 23 aa, Mycobacterium tuberculosis
RVFEELSLRGCVAALDGSDVIRA

SEQ ID NO: 1457862 - protein, 23 aa, Mycobacterium tuberculosis
RVFPNLFATHRVRAVDDYASHLL

SEQ ID NO: 1457863 - protein, 18 aa, Mycobacterium tuberculosis
RVGARLAARAQIRDIRLL

SEQ ID NO: 1457864 - protein, 24 aa, Mycobacterium tuberculosis
RVGLRIVIEIKRDAVAKVVINNLY

SEQ ID NO: 1457865 - protein, 20 aa, Mycobacterium tuberculosis
RVGWNRRQLSAVGGRGQQLF

SEQ ID NO: 1457866 - protein, 19 aa, Mycobacterium tuberculosis
RVHRVWADIRNEVLGGQYL

SEQ ID NO: 1457867 - protein, 22 aa, Mycobacterium tuberculosis
RVILIHWDDFFRPLSKPLRALP

SEQ ID NO: 1457868 - protein, 20 aa, Mycobacterium tuberculosis
RVKLERGVELLIGLEAISEP

SEQ ID NO: 1457869 - protein, 19 aa, Mycobacterium tuberculosis
RVLEALLLVIDTPVTADAL

SEQ ID NO: 1457870 - protein, 21 aa, Mycobacterium tuberculosis
RVLGVGVDGDWAWLHTDALPG

SEQ ID NO: 1457871 - protein, 20 aa, Mycobacterium tuberculosis
RVPTEKGYREFVDRLEDVKP

SEQ ID NO: 1457872 - protein, 18 aa, Mycobacterium tuberculosis
RVRFTSPHPAEFTDDVIE

SEQ ID NO: 1457873 - protein, 20 aa, Mycobacterium tuberculosis
RVSGCQLALAGDNAATLALA

SEQ ID NO: 1457874 - protein, 23 aa, Mycobacterium tuberculosis
RVTHAQFVPAMFVRMLKLPEAVR

SEQ ID NO: 1457875 - protein, 27 aa, Mycobacterium tuberculosis
RVVTNATKLPGLRGWRRPQGELDESSR

SEQ ID NO: 1457876 - protein, 24 aa, Mycobacterium tuberculosis
RVVVPDFQLSLAIGKEGQNARLAA

SEQ ID NO: 1457877 - protein, 17 aa, Mycobacterium tuberculosis
RVYGLVMRVLRDTGYSE

SEQ ID NO: 1457878 - protein, 25 aa, Mycobacterium tuberculosis
RVYRWKPAPLGGVFDHLVTGIARRQ

SEQ ID NO: 1457879 - protein, 24 aa, Mycobacterium tuberculosis
RWAILIKIHHCMAGAMSAAHLLAR

SEQ ID NO: 1457880 - protein, 24 aa, Mycobacterium tuberculosis
RYDDLRPGLRMNIIANPGIPKANF

SEQ ID NO: 1457881 - protein, 23 aa, Mycobacterium tuberculosis
RYGSFRRSFRLPAHVTSEAIAAS

SEQ ID NO: 1457882 - protein, 32 aa, Mycobacterium tuberculosis; identical to SEQ ID NO: 206176

SEQ ID NO: 1457883 - protein, 25 aa, Mycobacterium tuberculosis
RYRDRGRPFLAFLYGIAAHKVADAH

SEQ ID NO: 1457884 - protein, 21 aa, Mycobacterium tuberculosis
RYRDRIPILIGGGGEKKTFAI

SEQ ID NO: 1457885 - protein, 32 aa, Mycobacterium tuberculosis; identical to SEQ ID NO: 211740

SEQ ID NO: 1457886 - protein, 22 aa, Mycobacterium tuberculosis
SAEALGEGWFWPAAAAHPSLPR

SEQ ID NO: 1457887 - protein, 25 aa, Mycobacterium tuberculosis
SAFHPLGVGSPFWAAIDLQRYGLTW

SEQ ID NO: 1457888 - protein, 26 aa, Mycobacterium tuberculosis
SAGVRALRDGVVWRIAAETFTDMLEA

SEQ ID NO: 1457889 - protein, 27 aa, Mycobacterium tuberculosis
SAKELYEIRTLFGVLFQDGALFGSMNL

SEQ ID NO: 1457890 - protein, 18 aa, Mycobacterium tuberculosis
SALGLGRVEHVVCDVTST

SEQ ID NO: 1457891 - protein, 22 aa, Mycobacterium tuberculosis
SANRPTTFEVFARRLPTGRRYG

SEQ ID NO: 1457892 - protein, 17 aa, Mycobacterium tuberculosis
SAQAAAIHEMFVNTLQM

SEQ ID NO: 1457893 - protein, 23 aa, Mycobacterium tuberculosis
SAQRAKIVADYLVARGVAGDHIA

SEQ ID NO: 1457894 - protein, 21 aa, Mycobacterium tuberculosis
SARRGDYRVVYAIDDGHHRVE

SEQ ID NO: 1457895 - protein, 19 aa, Mycobacterium tuberculosis
SARYRPWMPAAGNHENEVG

SEQ ID NO: 1457896 - protein, 18 aa, Mycobacterium tuberculosis
SAVLAELLERIRASVERL

SEQ ID NO: 1457897 - protein, 26 aa, Mycobacterium tuberculosis
SCPPETKLSCPIYAFIGDKDWIATQD

SEQ ID NO: 1457898 - protein, 34 aa, Mycobacterium tuberculosis; identical to SEQ ID NO: 206273

SEQ ID NO: 1457899 - protein, 28 aa, Mycobacterium tuberculosis
SDELIGLLARLGYRFAPTQIPGTVDYYL

SEQ ID NO: 1457900 - protein, 17 aa, Mycobacterium tuberculosis
SDIGGAVQRLIRRLPAG

SEQ ID NO: 1457901 - protein, 17 aa, Mycobacterium tuberculosis
SDLLVAECLRTGAWEGL

SEQ ID NO: 1457902 - protein, 24 aa, Mycobacterium tuberculosis
SDPHIPSLFAIYPTNDWHERETYD

SEQ ID NO: 1457903 - protein, 24 aa, Mycobacterium tuberculosis
SDQPRPLVPAMFSAVLSRLRRTHT

SEQ ID NO: 1457904 - protein, 19 aa, Mycobacterium tuberculosis
SDTAEFGGYLSGPRVIDAG

SEQ ID NO: 1457905 - protein, 25 aa, Mycobacterium tuberculosis
SDTVDAFALPDCAGHPTWYEPSEWL

SEQ ID NO: 1457906 - protein, 18 aa, Mycobacterium tuberculosis
SDVFWCTADIGWVTGHTY

SEQ ID NO: 1457907 - protein, 26 aa, Mycobacterium tuberculosis
SDWGGTPSWECALAGLDQECGAQIDA

SEQ ID NO: 1457908 - protein, 26 aa, Mycobacterium tuberculosis
SEAGRICASLGLPERVLTQRLRTLSG

SEQ ID NO: 1457909 - protein, 26 aa, Mycobacterium tuberculosis
SEALREYGVRVLVIRPGQVRTRMSAH

SEQ ID NO: 1457910 - protein, 17 aa, Mycobacterium tuberculosis
SEARYTYSSAWFDAISA

SEQ ID NO: 1457911 - protein, 23 aa, Mycobacterium tuberculosis
SEGLELVGLMGIPPLDWDPDEAF

SEQ ID NO: 1457912 - protein, 24 aa, Mycobacterium tuberculosis
SEKDVKRQLLLDALADELQVQVGQ

SEQ ID NO: 1457913 - protein, 19 aa, Mycobacterium tuberculosis
SESNAMWALSIPVPFTKPV

SEQ ID NO: 1457914 - protein, 20 aa, Mycobacterium tuberculosis
SESQERMCAVVSPKNVDAFL

SEQ ID NO: 1457915 - protein, 19 aa, Mycobacterium tuberculosis
SEVAMEIALNAVRIHGGYG

SEQ ID NO: 1457916 - protein, 20 aa, Mycobacterium tuberculosis
SFEPKADWKHLFSYWDEILG

SEQ ID NO: 1457917 - protein, 18 aa, Mycobacterium tuberculosis
SFQPSVSVPVDLDGARKV

SEQ ID NO: 1457918 - protein, 18 aa, Mycobacterium tuberculosis
SFRLPRASTLAIVGESGS

SEQ ID NO: 1457919 - protein, 30 aa, Mycobacterium tuberculosis; identical to SEQ ID NO: 206366

SEQ ID NO: 1457920 - protein, 18 aa, Mycobacterium tuberculosis
SGDPEVRQLILLDAPVVL

SEQ ID NO: 1457921 - protein, 27 aa, Mycobacterium tuberculosis
SGGAGRWRGGDGAVRRLEFTEPMTVST

SEQ ID NO: 1457922 - protein, 28 aa, Mycobacterium tuberculosis
SGINAAICCAAAEFATRTQATATGVAAA

SEQ ID NO: 1457923 - protein, 24 aa, Mycobacterium tuberculosis
SGKVKHVGFRWAADKQLRDAVCDF

SEQ ID NO: 1457924 - protein, 19 aa, Mycobacterium tuberculosis
SGRFCGGDVVELRAPDAAM

SEQ ID NO: 1457925 - protein, 20 aa, Mycobacterium tuberculosis
SGSSDYLAGRAFSFISAIDS

SEQ ID NO: 1457926 - protein, 25 aa, Mycobacterium tuberculosis
SGTEPKLKCYLEIRCAVTGDLPAAR

SEQ ID NO: 1457927 - protein, 19 aa, Mycobacterium tuberculosis
SGVALRLDDGCTINADLLL

SEQ ID NO: 1457928 - protein, 19 aa, Mycobacterium tuberculosis
SIAALRGEPVDSYGVGTSL

SEQ ID NO: 1457929 - protein, 21 aa, Mycobacterium tuberculosis
SIRLVTPVQWAMRQTVRDTEL

SEQ ID NO: 1457930 - protein, 18 aa, Mycobacterium tuberculosis
SISTFQAVQFMLADMAMK

SEQ ID NO: 1457931 - protein, 22 aa, Mycobacterium tuberculosis
SKAGGFGVLGAVGFTPEQLEIE

SEQ ID NO: 1457932 - protein, 19 aa, Mycobacterium tuberculosis
SKATMYVCGITPYDATHLG

SEQ ID NO: 1457933 - protein, 22 aa, Mycobacterium tuberculosis
SKEQCFLELLLADNETLGNSIR

SEQ ID NO: 1457934 - protein, 17 aa, Mycobacterium tuberculosis
SKLKANIAQILKNEGYI

SEQ ID NO: 1457935 - protein, 18 aa, Mycobacterium tuberculosis
SKVAIGQSVELAFDTARL

SEQ ID NO: 1457936 - protein, 22 aa, Mycobacterium tuberculosis
SLAHLSQWCFVLARTEKGSQRH

SEQ ID NO: 1457937 - protein, 19 aa, Mycobacterium tuberculosis
SLDDLAKRLIVLVEPVEAI

SEQ ID NO: 1457938 - protein, 26 aa, Mycobacterium tuberculosis
SLGAPGARVLLVWDAPNLDMGLGSIL

SEQ ID NO: 1457939 - protein, 19 aa, Mycobacterium tuberculosis
SLHLGRLKDRVGLRPDQVS

SEQ ID NO: 1457940 - protein, 24 aa, Mycobacterium tuberculosis
SLLRCGEMLSAVLLDATMAGLATC

SEQ ID NO: 1457941 - protein, 20 aa, Mycobacterium tuberculosis
SLPDLLPLLEKVAGTGKPLL

SEQ ID NO: 1457942 - protein, 24 aa, Mycobacterium tuberculosis
SLQLRWPLRMLLGGKPLQHIAADK

SEQ ID NO: 1457943 - protein, 20 aa, Mycobacterium tuberculosis
SLRLPLAHGDLLVMGGSCQR

SEQ ID NO: 1457944 - protein, 23 aa, Mycobacterium tuberculosis
SLTSPRGKRQFRRAILDHQAGTV

SEQ ID NO: 1457945 - protein, 24 aa, Mycobacterium tuberculosis
SMGFKTFGFGFGRVDQWEPDEVYW

SEQ ID NO: 1457946 - protein, 27 aa, Mycobacterium tuberculosis
SMVVSRARLQLAIAWANILLQRPAPAT

SEQ ID NO: 1457947 - protein, 18 aa, Mycobacterium tuberculosis
SNATLWPLYHDVIVKPLY

SEQ ID NO: 1457948 - protein, 26 aa, Mycobacterium tuberculosis
SNGLAAELLRRLPFELTAGQREVLDV

SEQ ID NO: 1457949 - protein, 17 aa, Mycobacterium tuberculosis
SNHVLPTAGCARHSSGL

SEQ ID NO: 1457950 - protein, 18 aa, Mycobacterium tuberculosis
SNTSWPLPGQDVIDHAGG

SEQ ID NO: 1457951 - protein, 25 aa, Mycobacterium tuberculosis
SPGELRFGPLQARDELAACEILADA

SEQ ID NO: 1457952 - protein, 19 aa, Mycobacterium tuberculosis
SPGFLGFQLLRPVKGEERY

SEQ ID NO: 1457953 - protein, 19 aa, Mycobacterium tuberculosis
SPIRLRTVAATVFTRPEIA

SEQ ID NO: 1457954 - protein, 29 aa, Mycobacterium tuberculosis
SPPDMKLPISLALGWPRRVSGAAAACDFH

SEQ ID NO: 1457955 - protein, 20 aa, Mycobacterium tuberculosis
SPPFVPFVQLCPSLLSIDGP

SEQ ID NO: 1457956 - protein, 28 aa, Mycobacterium tuberculosis
SPYVDAWLLRACAKLGVRLVHSTPGRPQ

SEQ ID NO: 1457957 - protein, 24 aa, Mycobacterium tuberculosis
SQESMPLAGLVFNRTHPMLCALPI

SEQ ID NO: 1457958 - protein, 18 aa, Mycobacterium tuberculosis
SQNLIPRVFWMTYQNSRD

SEQ ID NO: 1457959 - protein, 19 aa, Mycobacterium tuberculosis
SRAKELVFSGRFFDAEEAL

SEQ ID NO: 1457960 - protein, 22 aa, Mycobacterium tuberculosis
SRANARGLVVVRIGTETKASEG

SEQ ID NO: 1457961 - protein, 20 aa, Mycobacterium tuberculosis
SRAVPLRLVSVIKPTHPSPD

SEQ ID NO: 1457962 - protein, 26 aa, Mycobacterium tuberculosis
SRFRGMCEARGLPAVRIGVVDQGSDA

SEQ ID NO: 1457963 - protein, 20 aa, Mycobacterium tuberculosis
SRHCSLWLSLAQMWAGNLTE

SEQ ID NO: 1457964 - protein, 30 aa, Mycobacterium tuberculosis; identical to SEQ ID NO: 206642

SEQ ID NO: 1457965 - protein, 25 aa, Mycobacterium tuberculosis
SRKMSVSKLLRPVLDEFVQRETGRI

SEQ ID NO: 1457966 - protein, 25 aa, Mycobacterium tuberculosis
SRLGETRRLRVCGPLNTVVNAAWVF

SEQ ID NO: 1457967 - protein, 19 aa, Mycobacterium tuberculosis
SRLKGKQVEFFAAALGGPE

SEQ ID NO: 1457968 - protein, 22 aa, Mycobacterium tuberculosis
SRNPRSLRVCTLLRKPDAVHAN

SEQ ID NO: 1457969 - protein, 25 aa, Mycobacterium tuberculosis
SRNRKGSTWVLSLSAGRLVTADHIG

SEQ ID NO: 1457970 - protein, 24 aa, Mycobacterium tuberculosis
SRQRPELAWFPSLAHHLQDASRGH

SEQ ID NO: 1457971 - protein, 21 aa, Mycobacterium tuberculosis
SRRGFSFNCLTSYSDASKMRD

SEQ ID NO: 1457972 - protein, 18 aa, Mycobacterium tuberculosis
SRRIPGSHGHRAVKAKLA

SEQ ID NO: 1457973 - protein, 27 aa, Mycobacterium tuberculosis
SRRTSCLSGLGYPASTPVLGAQPIDID

SEQ ID NO: 1457974 - protein, 21 aa, Mycobacterium tuberculosis
SRSPIALSVTLQAVRRAAKLD

SEQ ID NO: 1457975 - protein, 24 aa, Mycobacterium tuberculosis
SRYWPADDYRAGVVQTSFDKQFVR

SEQ ID NO: 1457976 - protein, 27 aa, Mycobacterium tuberculosis
SSAADRLWLRGGLPPSFTARSNEDSAA

SEQ ID NO: 1457977 - protein, 25 aa, Mycobacterium tuberculosis
SSELWQLERERIFNRSWMLVAHVDQ

SEQ ID NO: 1457978 - protein, 23 aa, Mycobacterium tuberculosis
SSIDVRLDCLFRVFNNTRYTHID

SEQ ID NO: 1457979 - protein, 29 aa, Mycobacterium tuberculosis
SSLDQGGPCARTVLDTALLHQVIAGHDPR

SEQ ID NO: 1457980 - protein, 18 aa, Mycobacterium tuberculosis
SSLVALHMAVGSLRSGEC

SEQ ID NO: 1457981 - protein, 23 aa, Mycobacterium tuberculosis
STALYPPKRFLGAARNIEEGGSL

SEQ ID NO: 1457982 - protein, 18 aa, Mycobacterium tuberculosis
STIAGRLLGSVPANVSRR

SEQ ID NO: 1457983 - protein, 28 aa, Mycobacterium tuberculosis
STIEILPVIGLPEFRPGDDLSAAVAAAA

SEQ ID NO: 1457984 - protein, 17 aa, Mycobacterium tuberculosis
STKDLADAFAFNVGTAH

SEQ ID NO: 1457985 - protein, 17 aa, Mycobacterium tuberculosis
STLPMAVPVNLRAEGDA

SEQ ID NO: 1457986 - protein, 24 aa, Mycobacterium tuberculosis
STNLPRVLGGLGVAIISTSSGLLT

SEQ ID NO: 1457987 - protein, 18 aa, Mycobacterium tuberculosis
STRFFPMLTTAAGTVKPA

SEQ ID NO: 1457988 - protein, 28 aa, Mycobacterium tuberculosis
STVSSIFLMCLPDRVLAYGDCAIIPNPT

SEQ ID NO: 1457989 - protein, 21 aa, Mycobacterium tuberculosis
SVAVLARLDLGSVLIPMPAAG

SEQ ID NO: 1457990 - protein, 24 aa, Mycobacterium tuberculosis
SVCRACPRLVSWREEVAVVKRRAF

SEQ ID NO: 1457991 - protein, 24 aa, Mycobacterium tuberculosis
SVDAVLVAQAWHWVDPARAIPEVA

SEQ ID NO: 1457992 - protein, 17 aa, Mycobacterium tuberculosis
SVGRVIPTVAARVVDQN

SEQ ID NO: 1457993 - protein, 23 aa, Mycobacterium tuberculosis
SVPHYGIGYGLLRYVYAPTGRVL

SEQ ID NO: 1457994 - protein, 17 aa, Mycobacterium tuberculosis
SVYARVNPFGFIETPYR

SEQ ID NO: 1457995 - protein, 23 aa, Mycobacterium tuberculosis
SWLETETSCTFGRGPNPLLVSVR

SEQ ID NO: 1457996 - protein, 25 aa, Mycobacterium tuberculosis
SWWKEERGARIFIDFNQNARDRTMA

SEQ ID NO: 1457997 - protein, 25 aa, Mycobacterium tuberculosis
SYGRFMRIRIFDCWMHEQDIRAAVQ

SEQ ID NO: 1457998 - protein, 21 aa, Mycobacterium tuberculosis
TAADLRRLRGAVAGLGDPELM

SEQ ID NO: 1457999 - protein, 34 aa, Mycobacterium tuberculosis; identical to SEQ ID NO: 206809

SEQ ID NO: 1458000 - protein, 23 aa, Mycobacterium tuberculosis
TAAKRLCRSRVGIDAEAGPTEIA

SEQ ID NO: 1458001 - protein, 17 aa, Mycobacterium tuberculosis
TAALFALDSPARVAEFT

SEQ ID NO: 1458002 - protein, 28 aa, Mycobacterium tuberculosis
TAGLPFHFQRWAEFEGFVYDQKKTGIID

SEQ ID NO: 1458003 - protein, 26 aa, Mycobacterium tuberculosis
TAGRVKRPQIAIATWIVPSIVAFGTD

SEQ ID NO: 1458004 - protein, 26 aa, Mycobacterium tuberculosis
TAISARSEWAPEFAIHDLDSLDALAA

SEQ ID NO: 1458005 - protein, 23 aa, Mycobacterium tuberculosis
TAKREIRLLSRFTGANPTVPVVG

SEQ ID NO: 1458006 - protein, 24 aa, Mycobacterium tuberculosis
TAMLRRLGIEGDFKGGFRVTTPEV

SEQ ID NO: 1458007 - protein, 28 aa, Mycobacterium tuberculosis
TAPTLIRMFMKWGREIPDSHDLSSLRLL

SEQ ID NO: 1458008 - protein, 25 aa, Mycobacterium tuberculosis
TATSAEFRKLLADWKAAGRASKDVD

SEQ ID NO: 1458009 - protein, 22 aa, Mycobacterium tuberculosis
TCTAADVPFFFKQWGGRTPKAF

SEQ ID NO: 1458010 - protein, 22 aa, Mycobacterium tuberculosis
TDAETTWKLLLDRQSGIRTLDD

SEQ ID NO: 1458011 - protein, 17 aa, Mycobacterium tuberculosis
TDAGAQWRQAGCSMCLG

SEQ ID NO: 1458012 - protein, 18 aa, Mycobacterium tuberculosis
TDDCGPIIAGWLEQHGFS

SEQ ID NO: 1458013 - protein, 26 aa, Mycobacterium tuberculosis
TDERGRRFLIHTARIAYVEIGVADAR

SEQ ID NO: 1458014 - protein, 31 aa, Mycobacterium tuberculosis; identical to SEQ ID NO: 206908

SEQ ID NO: 1458015 - protein, 17 aa, Mycobacterium tuberculosis
TDIPVTVKFRIGIDDAH

SEQ ID NO: 1458016 - protein, 26 aa, Mycobacterium tuberculosis
TDPQELHELLTLPFRSASEFIDATLA

SEQ ID NO: 1458017 - protein, 24 aa, Mycobacterium tuberculosis
TDRPVFICGPGPFMQAARDALAAL

SEQ ID NO: 1458018 - protein, 27 aa, Mycobacterium tuberculosis
TDSEAMDAFGLLCRMEGIIPAIESAHA

SEQ ID NO: 1458019 - protein, 20 aa, Mycobacterium tuberculosis
TDTKIAWKGDEAVELTSSTE

SEQ ID NO: 1458020 - protein, 22 aa, Mycobacterium tuberculosis
TEGLPRLRALTGELAAGVRLGM

SEQ ID NO: 1458021 - protein, 23 aa, Mycobacterium tuberculosis
TEHLPGIAVPTVFTHGTADPFGT

SEQ ID NO: 1458022 - protein, 25 aa, Mycobacterium tuberculosis
TEIPRGGRRLFVFLGSTIGNLTPGP

SEQ ID NO: 1458023 - protein, 18 aa, Mycobacterium tuberculosis
TELVAWLNGHPDFNDLPV

SEQ ID NO: 1458024 - protein, 24 aa, Mycobacterium tuberculosis
TEPAGLKGLHEFFTPVLRNLGRCG

SEQ ID NO: 1458025 - protein, 20 aa, Mycobacterium tuberculosis
TERILYYTGINYKIGEVHDG

SEQ ID NO: 1458026 - protein, 25 aa, Mycobacterium tuberculosis
TEVTLRFPDGEVVTMHVISVVEETP

SEQ ID NO: 1458027 - protein, 22 aa, Mycobacterium tuberculosis
TFDAPRRLGLMHGDAHPGNFML

SEQ ID NO: 1458028 - protein, 21 aa, Mycobacterium tuberculosis
TFHYPGGLVDFVKHINRTKNA

SEQ ID NO: 1458029 - protein, 19 aa, Mycobacterium tuberculosis
TFQVLPWATSSGHHHSARM

SEQ ID NO: 1458030 - protein, 20 aa, Mycobacterium tuberculosis
TFREALRLGHNYIGTEHLLL

SEQ ID NO: 1458031 - protein, 18 aa, Mycobacterium tuberculosis
TGALLRRTGTVVVEHRFD

SEQ ID NO: 1458032 - protein, 27 aa, Mycobacterium tuberculosis
TGASPRFLLDFSRRFPDAAVVRLERDY

SEQ ID NO: 1458033 - protein, 23 aa, Mycobacterium tuberculosis
TGDELRATLLALLGSPHLCSRAF

SEQ ID NO: 1458034 - protein, 22 aa, Mycobacterium tuberculosis
TGGRIPREYIPSVDAGAQDAMQ

SEQ ID NO: 1458035 - protein, 23 aa, Mycobacterium tuberculosis
TGGYSPPTNLLINGQAVTIDQTP

SEQ ID NO: 1458036 - protein, 29 aa, Mycobacterium tuberculosis
TGIVSRGGSIMAAWCLAHHRESFLYTNFE

SEQ ID NO: 1458037 - protein, 20 aa, Mycobacterium tuberculosis
TGLLDLLNRLGITPLPNTAG

SEQ ID NO: 1458038 - protein, 24 aa, Mycobacterium tuberculosis
TGPYDYLLHIRVCDTADLDRLLRR

SEQ ID NO: 1458039 - protein, 25 aa, Mycobacterium tuberculosis
TGQLRARFAAGLSAMYAAEVPAYGT

SEQ ID NO: 1458040 - protein, 18 aa, Mycobacterium tuberculosis
TGRCCGHVDFGNLGVADR

SEQ ID NO: 1458041 - protein, 20 aa, Mycobacterium tuberculosis
TGSTVRFWADPAVFETTEYD

SEQ ID NO: 1458042 - protein, 24 aa, Mycobacterium tuberculosis
TGTGCRPSRVWVMNRLREKMPHVY

SEQ ID NO: 1458043 - protein, 23 aa, Mycobacterium tuberculosis
TGTRAHSARSWLGDNAIHKLGAV

SEQ ID NO: 1458044 - protein, 25 aa, Mycobacterium tuberculosis
TGVRSRLMLDIARWRRRRREELAAL

SEQ ID NO: 1458045 - protein, 23 aa, Mycobacterium tuberculosis
TGWTRSRPGDSFIVAPQSDGGPG

SEQ ID NO: 1458046 - protein, 29 aa, Mycobacterium tuberculosis
THLPPGAWPPTSWYADWIRGLDVFTTNVE

SEQ ID NO: 1458047 - protein, 22 aa, Mycobacterium tuberculosis
TIKSAVAFGALLSRGIGDTIRV

SEQ ID NO: 1458048 - protein, 32 aa, Mycobacterium tuberculosis; identical to SEQ ID NO: 207091

SEQ ID NO: 1458049 - protein, 23 aa, Mycobacterium tuberculosis
TIRQRLGGIEGRRIVIVGDILHS

SEQ ID NO: 1458050 - protein, 18 aa, Mycobacterium tuberculosis
TISELRYPATAFTDAIDA

SEQ ID NO: 1458051 - protein, 31 aa, Mycobacterium tuberculosis; identical to SEQ ID NO: 207096

SEQ ID NO: 1458052 - protein, 20 aa, Mycobacterium tuberculosis
TKFADEWVRCAAGTDTALAM

SEQ ID NO: 1458053 - protein, 18 aa, Mycobacterium tuberculosis
TKFFDEFFMDATRAGIRQ

SEQ ID NO: 1458054 - protein, 23 aa, Mycobacterium tuberculosis
TLAQRWDLTASELARNVHTHPTM

SEQ ID NO: 1458055 - protein, 19 aa, Mycobacterium tuberculosis
TLDGWQDWAKQRGHRGLAY

SEQ ID NO: 1458056 - protein, 24 aa, Mycobacterium tuberculosis
TLDVPELEALLAYEQATKARAPFQ

SEQ ID NO: 1458057 - protein, 19 aa, Mycobacterium tuberculosis
TLHRHFNWVRSWYDFAVEG

SEQ ID NO: 1458058 - protein, 27 aa, Mycobacterium tuberculosis
TLIAMPALRLDAAFAHLNLGDSHGNAA

SEQ ID NO: 1458059 - protein, 25 aa, Mycobacterium tuberculosis
TLNLKEWKAEWGVADPREARGALTT

SEQ ID NO: 1458060 - protein, 26 aa, Mycobacterium tuberculosis
TLPPHPAHFLWLNWGPCPPRQDMAYS

SEQ ID NO: 1458061 - protein, 24 aa, Mycobacterium tuberculosis
TLRISSQLLANWLRHGVITSADVR

SEQ ID NO: 1458062 - protein, 18 aa, Mycobacterium tuberculosis
TLRRSLRLLADFRYEQRD

SEQ ID NO: 1458063 - protein, 23 aa, Mycobacterium tuberculosis
TLSALTCEFLFLCSGYYNYDEGY

SEQ ID NO: 1458064 - protein, 23 aa, Mycobacterium tuberculosis
TLTGDGIGIVFRKGLPLEDMEFH

SEQ ID NO: 1458065 - protein, 18 aa, Mycobacterium tuberculosis
TLTGFKWLARADANLPGT

SEQ ID NO: 1458066 - protein, 21 aa, Mycobacterium tuberculosis
TMGIGGGYVTSWVGDPGAVTE

SEQ ID NO: 1458067 - protein, 22 aa, Mycobacterium tuberculosis
TMPRPNFPVVNFLDAGAAPLSV

SEQ ID NO: 1458068 - protein, 26 aa, Mycobacterium tuberculosis
TMTKSLRAGKVFVDWSQNSGSKTTIA

SEQ ID NO: 1458069 - protein, 18 aa, Mycobacterium tuberculosis
TNDYEWDLLLSKTGWSEA

SEQ ID NO: 1458070 - protein, 18 aa, Mycobacterium tuberculosis
TNHLGHFALTGLLIDRLL

SEQ ID NO: 1458071 - protein, 18 aa, Mycobacterium tuberculosis
TNYQSRTSRPIPVVVLTR

SEQ ID NO: 1458072 - protein, 19 aa, Mycobacterium tuberculosis
TPAKIRRYAAVGGDHNPIH

SEQ ID NO: 1458073 - protein, 42 aa, Mycobacterium tuberculosis; identical to SEQ ID NO: 207199

SEQ ID NO: 1458074 - protein, 25 aa, Mycobacterium tuberculosis
TPDHKVLTEYGWRAAGELRKGDRVA

SEQ ID NO: 1458075 - protein, 23 aa, Mycobacterium tuberculosis
TPGHPEFRHTPGVEITTGPLGQG

SEQ ID NO: 1458076 - protein, 20 aa, Mycobacterium tuberculosis
TPIKMLLRLALDAGSGVLYR

SEQ ID NO: 1458077 - protein, 26 aa, Mycobacterium tuberculosis
TPLARLYGWHRAMRIFDGPDEVHLRS

SEQ ID NO: 1458078 - protein, 24 aa, Mycobacterium tuberculosis
TPPSHLFPAEFAKRAKTLSESVGL

SEQ ID NO: 1458079 - protein, 32 aa, Mycobacterium tuberculosis; identical to SEQ ID NO: 207220

SEQ ID NO: 1458080 - protein, 23 aa, Mycobacterium tuberculosis
TPRSRRVLLEGWEKFDEPVDRIV

SEQ ID NO: 1458081 - protein, 29 aa, Mycobacterium tuberculosis
TPTFGPLRIRFWACGIFEVQRARYGITTS

SEQ ID NO: 1458082 - protein, 24 aa, Mycobacterium tuberculosis
TPVPRPERQYYWFGEPIDTTEFMG

SEQ ID NO: 1458083 - protein, 25 aa, Mycobacterium tuberculosis
TPVPTCPGWSLGQLFRHVGRGDRWA

SEQ ID NO: 1458084 - protein, 19 aa, Mycobacterium tuberculosis
TPYSRMWGAYLTGMWLYRL

SEQ ID NO: 1458085 - protein, 18 aa, Mycobacterium tuberculosis
TRAPRFGAYIASKAALDS

SEQ ID NO: 1458086 - protein, 26 aa, Mycobacterium tuberculosis
TRDQRWKRYNIFNVVWNTILAIGFEW

SEQ ID NO: 1458087 - protein, 19 aa, Mycobacterium tuberculosis
TRFVLVGRPGPPPARTGAD

SEQ ID NO: 1458088 - protein, 18 aa, Mycobacterium tuberculosis
TRHPNLRASFLHGNLSRP

SEQ ID NO: 1458089 - protein, 22 aa, Mycobacterium tuberculosis
TRIALSRGLRPDRFVAEVRQYG

SEQ ID NO: 1458090 - protein, 18 aa, Mycobacterium tuberculosis
TRLRVIPNHVCLTTNLVD

SEQ ID NO: 1458091 - protein, 34 aa, Mycobacterium tuberculosis; identical to SEQ ID NO: 207283

SEQ ID NO: 1458092 - protein, 20 aa, Mycobacterium tuberculosis
TRQDIDDIFWLQATIAQELA

SEQ ID NO: 1458093 - protein, 24 aa, Mycobacterium tuberculosis
TRVIWKLIKDMLILPYLDIRLDYY

SEQ ID NO: 1458094 - protein, 21 aa, Mycobacterium tuberculosis
TSCPNCSGRGILLHADPVDSA

SEQ ID NO: 1458095 - protein, 29 aa, Mycobacterium tuberculosis
TSEGWRMYTRARFAPYVEKLLLDGARTKL

SEQ ID NO: 1458096 - protein, 24 aa, Mycobacterium tuberculosis
TSGLSRVAPYLARTMPQLLSVECW

SEQ ID NO: 1458097 - protein, 30 aa, Mycobacterium tuberculosis; identical to SEQ ID NO: 207324

SEQ ID NO: 1458098 - protein, 20 aa, Mycobacterium tuberculosis
TSLDDAGPWAHARAAAEVLI

SEQ ID NO: 1458099 - protein, 27 aa, Mycobacterium tuberculosis
TTIRTLRRLGFRCGVVSGGFRRIIEPL

SEQ ID NO: 1458100 - protein, 25 aa, Mycobacterium tuberculosis
TTLGYRQYLFWTFAIYTGRLLHGRL

SEQ ID NO: 1458101 - protein, 17 aa, Mycobacterium tuberculosis
TTMRLLDELGLWERFAA

SEQ ID NO: 1458102 - protein, 28 aa, Mycobacterium tuberculosis
TTRDYRSVIDFYRQVFGWRTEQISDTDE

SEQ ID NO: 1458103 - protein, 18 aa, Mycobacterium tuberculosis
TVAAWPAVCSGLRSEARN

SEQ ID NO: 1458104 - protein, 22 aa, Mycobacterium tuberculosis
TVADIYRHFGLTLSDEARQAMT

SEQ ID NO: 1458105 - protein, 18 aa, Mycobacterium tuberculosis
TVAKRGAAIIDARGASSA

SEQ ID NO: 1458106 - protein, 19 aa, Mycobacterium tuberculosis
TVFCERYLPTGHHVEVQVM

SEQ ID NO: 1458107 - protein, 19 aa, Mycobacterium tuberculosis
TVFTAEAWGSDAYTPLAWW

SEQ ID NO: 1458108 - protein, 19 aa, Mycobacterium tuberculosis
TVNVCKYNLGWGAIGMCTH

SEQ ID NO: 1458109 - protein, 30 aa, Mycobacterium tuberculosis; identical to SEQ ID NO: 207397

SEQ ID NO: 1458110 - protein, 19 aa, Mycobacterium tuberculosis
TVSLGDWQILLPRAVVGTA

SEQ ID NO: 1458111 - protein, 32 aa, Mycobacterium tuberculosis; identical to SEQ ID NO: 85362

SEQ ID NO: 1458112 - protein, 22 aa, Mycobacterium tuberculosis
TVVVEIAERLVLVAGAEVAAVA

SEQ ID NO: 1458113 - protein, 19 aa, Mycobacterium tuberculosis
TVYSGEWWHFDGPGAGVDR

SEQ ID NO: 1458114 - protein, 19 aa, Mycobacterium tuberculosis
TWDLLRLTRMPTVQVDIGY

SEQ ID NO: 1458115 - protein, 20 aa, Mycobacterium tuberculosis
TWLEVPLPPGVLRWQQDHGR

SEQ ID NO: 1458116 - protein, 25 aa, Mycobacterium tuberculosis
TWSEVFRRTRIVAHEVRRHCTTGDR

SEQ ID NO: 1458117 - protein, 21 aa, Mycobacterium tuberculosis
TWTQFGMRLAAIGAHVQRFAG

SEQ ID NO: 1458118 - protein, 18 aa, Mycobacterium tuberculosis
VAAAAKVNTLLDVAQANL

SEQ ID NO: 1458119 - protein, 19 aa, Mycobacterium tuberculosis
VAAGLEFYGNRGWLEKPSG

SEQ ID NO: 1458120 - protein, 24 aa, Mycobacterium tuberculosis
VAAITVGLSRGWSLIKSVRLGNAA

SEQ ID NO: 1458121 - protein, 19 aa, Mycobacterium tuberculosis
VAARLGARVSVEIVNADAM

SEQ ID NO: 1458122 - protein, 17 aa, Mycobacterium tuberculosis
VAARPVGMFRMVDEHGG

SEQ ID NO: 1458123 - protein, 24 aa, Mycobacterium tuberculosis
VAASWPAGVNPLWTYGGGTPGEAI

SEQ ID NO: 1458124 - protein, 27 aa, Mycobacterium tuberculosis
VAEVWRRGSVIGSWLLDLTAIALRESP

SEQ ID NO: 1458125 - protein, 26 aa, Mycobacterium tuberculosis
VAFRGTAPAGRGFWFPPTVLTPKRGD

SEQ ID NO: 1458126 - protein, 19 aa, Mycobacterium tuberculosis
VAGCPRPVTRLLAELEPAD

SEQ ID NO: 1458127 - protein, 18 aa, Mycobacterium tuberculosis
VAGFSMGGFGALKYAAKY

SEQ ID NO: 1458128 - protein, 23 aa, Mycobacterium tuberculosis
VAHPDRRTVLLIGDGAAQLTVQE

SEQ ID NO: 1458129 - protein, 23 aa, Mycobacterium tuberculosis
VAIEGDSAFGFSGMEFETICRYR

SEQ ID NO: 1458130 - protein, 25 aa, Mycobacterium tuberculosis
VALARPEEHVICIAGDGAFLMHGTE

SEQ ID NO: 1458131 - protein, 23 aa, Mycobacterium tuberculosis
VALHKLPVTMVLDRAGITGSDGA

SEQ ID NO: 1458132 - protein, 24 aa, Mycobacterium tuberculosis
VANADFMGGFALWVDEQRHLHHTY

SEQ ID NO: 1458133 - protein, 34 aa, Mycobacterium tuberculosis; identical to SEQ ID NO: 207520

SEQ ID NO: 1458134 - protein, 18 aa, Mycobacterium tuberculosis
VAQGRLLVAAAISFIEDV

SEQ ID NO: 1458135 - protein, 24 aa, Mycobacterium tuberculosis
VAQLRSGMTIGIAGWGSRRKPMAF

SEQ ID NO: 1458136 - protein, 22 aa, Mycobacterium tuberculosis
VATLRRFTERFAPFNLSETAIR

SEQ ID NO: 1458137 - protein, 24 aa, Mycobacterium tuberculosis
VATNEIRALMALPPGQAPDPSRLA

SEQ ID NO: 1458138 - protein, 23 aa, Mycobacterium tuberculosis
VAVMRRLAAGHGRVDVVDDQTGS

SEQ ID NO: 1458139 - protein, 18 aa, Mycobacterium tuberculosis
VAVTNCLNFGSPEDPGVM

SEQ ID NO: 1458140 - protein, 23 aa, Mycobacterium tuberculosis
VCIVPRERLRLLPGKASQQQVWL

SEQ ID NO: 1458141 - protein, 30 aa, Mycobacterium tuberculosis; identical to SEQ ID NO: 207575

SEQ ID NO: 1458142 - protein, 24 aa, Mycobacterium tuberculosis
VDAALRPIIDRAYQPGPAPAVNPR

SEQ ID NO: 1458143 - protein, 19 aa, Mycobacterium tuberculosis
VDGRARVVDDFGGPAPTAT

SEQ ID NO: 1458144 - protein, 24 aa, Mycobacterium tuberculosis
VDLDLPRDALIVFTGLSGSGKSSL

SEQ ID NO: 1458145 - protein, 28 aa, Mycobacterium tuberculosis
VDLFPAHRPRPGYLPVLRAYDYAGDEVV

SEQ ID NO: 1458146 - protein, 17 aa, Mycobacterium tuberculosis
VDLGAAIDTQGRNTAVR

SEQ ID NO: 1458147 - protein, 22 aa, Mycobacterium tuberculosis
VDPWGHFDGLRAWLNGLLDTGY

SEQ ID NO: 1458148 - protein, 17 aa, Mycobacterium tuberculosis
VDQARRSGASWSDIGKS

SEQ ID NO: 1458149 - protein, 21 aa, Mycobacterium tuberculosis
VDRVKDMIVTGGFNVFPREVE

SEQ ID NO: 1458150 - protein, 19 aa, Mycobacterium tuberculosis
VDTLAKAGAVFVEETEQVP

SEQ ID NO: 1458151 - protein, 24 aa, Mycobacterium tuberculosis
VEAKAAIRQIEFLIRATAQRPDAV

SEQ ID NO: 1458152 - protein, 18 aa, Mycobacterium tuberculosis
VEAVPAHILIAIDEAYVE

SEQ ID NO: 1458153 - protein, 18 aa, Mycobacterium tuberculosis
VECCSYLLAVDVDLNTVP

SEQ ID NO: 1458154 - protein, 25 aa, Mycobacterium tuberculosis
VEEFSKVLADVCVRAPRIGLVSNVT

SEQ ID NO: 1458155 - protein, 23 aa, Mycobacterium tuberculosis
VEGFTRDGVHRWRSIPYARAPVG

SEQ ID NO: 1458156 - protein, 23 aa, Mycobacterium tuberculosis
VEINEAFAPVVMAWLKEIKADPA

SEQ ID NO: 1458157 - protein, 28 aa, Mycobacterium tuberculosis
VEIRRLAIECLRQLAAVAPAVFADFEVT

SEQ ID NO: 1458158 - protein, 23 aa, Mycobacterium tuberculosis
VELPLMEVRALLDLGDVAKATRK

SEQ ID NO: 1458159 - protein, 18 aa, Mycobacterium tuberculosis
VELSKLYLLPGYHGTGAA

SEQ ID NO: 1458160 - protein, 18 aa, Mycobacterium tuberculosis
VEPAWQRAAGHQVQPQTG

SEQ ID NO: 1458161 - protein, 17 aa, Mycobacterium tuberculosis
VEYRFTRTGLALPGDPV

SEQ ID NO: 1458162 - protein, 24 aa, Mycobacterium tuberculosis
VFYLHSRLLERCAKLSDDLGGGSL

SEQ ID NO: 1458163 - protein, 20 aa, Mycobacterium tuberculosis
VGALGLRPTLAALKTGARLA

SEQ ID NO: 1458164 - protein, 28 aa, Mycobacterium tuberculosis
VGAQCRDLLHWRFCRGVPPRATNDTDIA

SEQ ID NO: 1458165 - protein, 19 aa, Mycobacterium tuberculosis
VGARLAGTRVLRADALTQL

SEQ ID NO: 1458166 - protein, 24 aa, Mycobacterium tuberculosis
VGDAFRAGFLTGRSAGLGLERSAQ

SEQ ID NO: 1458167 - protein, 18 aa, Mycobacterium tuberculosis
VGDDVAHPELGHGWVQGA

SEQ ID NO: 1458168 - protein, 24 aa, Mycobacterium tuberculosis
VGERWTLLILREAFFGVRRFGQLA

SEQ ID NO: 1458169 - protein, 19 aa, Mycobacterium tuberculosis
VGFAGRAALGLGKRLTGKS

SEQ ID NO: 1458170 - protein, 20 aa, Mycobacterium tuberculosis
VGFKGSRKSTPFAAQLAAEN

SEQ ID NO: 1458171 - protein, 22 aa, Mycobacterium tuberculosis
VGGACRRYLQELGDLPTNTLTA

SEQ ID NO: 1458172 - protein, 25 aa, Mycobacterium tuberculosis
VGGMGGLGFVVARWLAEQGAGLIVL

SEQ ID NO: 1458173 - protein, 20 aa, Mycobacterium tuberculosis
VGHRYRWLRGTGLLAAAACA

SEQ ID NO: 1458174 - protein, 26 aa, Mycobacterium tuberculosis
VGLAAWRLGAGRSRPGARVQHGAGVR

SEQ ID NO: 1458175 - protein, 18 aa, Mycobacterium tuberculosis
VGLRVAWRTLENSGINPD

SEQ ID NO: 1458176 - protein, 30 aa, Mycobacterium tuberculosis; identical to SEQ ID NO: 207792

SEQ ID NO: 1458177 - protein, 23 aa, Mycobacterium tuberculosis
VGQLRPLLAPGLVDSVLAVSRTA

SEQ ID NO: 1458178 - protein, 28 aa, Mycobacterium tuberculosis
VGRPADGPPAWLRFFGCNPRHHSLAFLP

SEQ ID NO: 1458179 - protein, 24 aa, Mycobacterium tuberculosis
VGRVLRPGGKFIYTVRHTGDAHYG

SEQ ID NO: 1458180 - protein, 24 aa, Mycobacterium tuberculosis
VGVRLPGMRGVPVVSQGCRPIGYP

SEQ ID NO: 1458181 - protein, 30 aa, Mycobacterium tuberculosis; identical to SEQ ID NO: 207819

SEQ ID NO: 1458182 - protein, 25 aa, Mycobacterium tuberculosis
VGYPDRVRAGLLLAVGARATADQIG

SEQ ID NO: 1458183 - protein, 24 aa, Mycobacterium tuberculosis
VHARRCGWSLGISAETLRRWAGQA

SEQ ID NO: 1458184 - protein, 22 aa, Mycobacterium tuberculosis
VHDGGDHFVVFGAVESLSEVPA

SEQ ID NO: 1458185 - protein, 21 aa, Mycobacterium tuberculosis
VHGFSTLWLDDAVNADVKQTS

SEQ ID NO: 1458186 - protein, 24 aa, Mycobacterium tuberculosis
VHILIDLPAVPGFGNTTGAPSSGF

SEQ ID NO: 1458187 - protein, 18 aa, Mycobacterium tuberculosis
VHSARWRPWRSYATQHLW

SEQ ID NO: 1458188 - protein, 22 aa, Mycobacterium tuberculosis
VIKMVLAMRHELLPATLHVDVP

SEQ ID NO: 1458189 - protein, 19 aa, Mycobacterium tuberculosis
VIYRAGLARTRRMARQLVS

SEQ ID NO: 1458190 - protein, 22 aa, Mycobacterium tuberculosis
VKEVKAAMAALDIDPAFAERSV

SEQ ID NO: 1458191 - protein, 23 aa, Mycobacterium tuberculosis
VKGGRRFSFTALVIVGDGNGMVG

SEQ ID NO: 1458192 - protein, 18 aa, Mycobacterium tuberculosis
VKGVSFLADEIGRFIRAA

SEQ ID NO: 1458193 - protein, 19 aa, Mycobacterium tuberculosis
VKKAYQLLAPESRSASIGY

SEQ ID NO: 1458194 - protein, 17 aa, Mycobacterium tuberculosis
VKSALDLGVPVTGIAEA

SEQ ID NO: 1458195 - protein, 18 aa, Mycobacterium tuberculosis
VKSFYRRPLQVSDVTSGV

SEQ ID NO: 1458196 - protein, 19 aa, Mycobacterium tuberculosis
VKVVRLGGVGRGFSSGVSM

SEQ ID NO: 1458197 - protein, 22 aa, Mycobacterium tuberculosis
VKYGGLQWTWSQYLAESAARAA

SEQ ID NO: 1458198 - protein, 25 aa, Mycobacterium tuberculosis
VLAHPCPMCYGSLYYCSPDEVVFLT

SEQ ID NO: 1458199 - protein, 18 aa, Mycobacterium tuberculosis
VLAWLHPPGIDFGPALLA

SEQ ID NO: 1458200 - protein, 20 aa, Mycobacterium tuberculosis
VLDWITGSALVPVRERLSDE

SEQ ID NO: 1458201 - protein, 18 aa, Mycobacterium tuberculosis
VLEAMGIPHTEVDLILVN

SEQ ID NO: 1458202 - protein, 26 aa, Mycobacterium tuberculosis
VLEPRLRVPDEFGLSRYLAAGLAALQ

SEQ ID NO: 1458203 - protein, 24 aa, Mycobacterium tuberculosis
VLETGNPVTMPWRDSVNAIMQAWY

SEQ ID NO: 1458204 - protein, 24 aa, Mycobacterium tuberculosis
VLGLPRGGVPVAFEVAKSLQAPLD

SEQ ID NO: 1458205 - protein, 24 aa, Mycobacterium tuberculosis
VLHLLYSRFWHKVLYDLGHVSSRE

SEQ ID NO: 1458206 - protein, 19 aa, Mycobacterium tuberculosis
VLIALGWPNHVHHAAAQRW

SEQ ID NO: 1458207 - protein, 17 aa, Mycobacterium tuberculosis
VLIALVVAEHVHHDAAA

SEQ ID NO: 1458208 - protein, 18 aa, Mycobacterium tuberculosis
VLKLHAWLDRSADHDYKD

SEQ ID NO: 1458209 - protein, 18 aa, Mycobacterium tuberculosis
VLNMPRHPIRLARFGPRA

SEQ ID NO: 1458210 - protein, 17 aa, Mycobacterium tuberculosis
VLTAMSAFFFGLVDAPN

SEQ ID NO: 1458211 - protein, 23 aa, Mycobacterium tuberculosis
VLTRPDAASGRRGKPQPSPVARE

SEQ ID NO: 1458212 - protein, 27 aa, Mycobacterium tuberculosis
VLVLHDWGSALGFDWANQHRDRVQGIA

SEQ ID NO: 1458213 - protein, 24 aa, Mycobacterium tuberculosis
VMGLAELLAALGIPYDSEEAVRLA

SEQ ID NO: 1458214 - protein, 18 aa, Mycobacterium tuberculosis
VMMVHTLLWPDEIRDPDF

SEQ ID NO: 1458215 - protein, 19 aa, Mycobacterium tuberculosis
VMRQLPITLLHIVAPVVVG

SEQ ID NO: 1458216 - protein, 24 aa, Mycobacterium tuberculosis
VMSQLRTALRMQISAGYTVVEALE

SEQ ID NO: 1458217 - protein, 19 aa, Mycobacterium tuberculosis
VNACLDRLRRAKAHPTAPL

SEQ ID NO: 1458218 - protein, 21 aa, Mycobacterium tuberculosis
VNANGIYVCRAIVSHRMPEGV

SEQ ID NO: 1458219 - protein, 26 aa, Mycobacterium tuberculosis
VNHLGHFALVTGILDWLARPARIVVV

SEQ ID NO: 1458220 - protein, 23 aa, Mycobacterium tuberculosis
VNPSGRLPITFPVDLGQTPRSQP

SEQ ID NO: 1458221 - protein, 17 aa, Mycobacterium tuberculosis
VNQPWTIRQYAGFSTAA

SEQ ID NO: 1458222 - protein, 21 aa, Mycobacterium tuberculosis
VNRARRIERFLSQNMMAAEQF

SEQ ID NO: 1458223 - protein, 20 aa, Mycobacterium tuberculosis
VNRHRRLAVQVLKLPRLKAV

SEQ ID NO: 1458224 - protein, 23 aa, Mycobacterium tuberculosis
VNVLCTPGVWARHRKLAHTAPAL

SEQ ID NO: 1458225 - protein, 17 aa, Mycobacterium tuberculosis
VPAHILIAIDEAYVEYI

SEQ ID NO: 1458226 - protein, 19 aa, Mycobacterium tuberculosis
VPFAARWPVEVHIYPNRLV

SEQ ID NO: 1458227 - protein, 25 aa, Mycobacterium tuberculosis
VPFGTRWYGYFLRRLAERPANLAFF

SEQ ID NO: 1458228 - protein, 21 aa, Mycobacterium tuberculosis
VPGGFRAGFHATLPMIDMPQY

SEQ ID NO: 1458229 - protein, 23 aa, Mycobacterium tuberculosis
VPLTYPFALTFPSVMSLVTGFDF

SEQ ID NO: 1458230 - protein, 20 aa, Mycobacterium tuberculosis
VPNLFWCVGYTNASWTLRAD

SEQ ID NO: 1458231 - protein, 18 aa, Mycobacterium tuberculosis
VPNSGGRQGYFGPCPPAG

SEQ ID NO: 1458232 - protein, 19 aa, Mycobacterium tuberculosis
VPPMPAPVEPQGPAVWEEI

SEQ ID NO: 1458233 - protein, 20 aa, Mycobacterium tuberculosis
VPSPFGLFPDVDWAEVAADL

SEQ ID NO: 1458234 - protein, 20 aa, Mycobacterium tuberculosis
VPTPASLFAPINPIAVASAL

SEQ ID NO: 1458235 - protein, 17 aa, Mycobacterium tuberculosis
VPVSAAVWREGHEAVAA

SEQ ID NO: 1458236 - protein, 20 aa, Mycobacterium tuberculosis
VPVSGLLALTARTLRQTEFI

SEQ ID NO: 1458237 - protein, 23 aa, Mycobacterium tuberculosis
VQFCRERLAAFEIPASFQEASGL

SEQ ID NO: 1458238 - protein, 22 aa, Mycobacterium tuberculosis
VQIMRYRGYRDLTLALTGRPPG

SEQ ID NO: 1458239 - protein, 26 aa, Mycobacterium tuberculosis
VQLTRKRLGTGLIEAFSTSCPNCSGR

SEQ ID NO: 1458240 - protein, 21 aa, Mycobacterium tuberculosis
VQPNLKVIVNLGYGDPAYGYS

SEQ ID NO: 1458241 - protein, 17 aa, Mycobacterium tuberculosis
VQVPVLLVGGWQDIFLR

SEQ ID NO: 1458242 - protein, 20 aa, Mycobacterium tuberculosis
VRAALPRPRGISVLSGTRRG

SEQ ID NO: 1458243 - protein, 20 aa, Mycobacterium tuberculosis
VRALEVMLSLGAQVRDISAL

SEQ ID NO: 1458244 - protein, 18 aa, Mycobacterium tuberculosis
VRDGDILVGKVTPKGETE

SEQ ID NO: 1458245 - protein, 18 aa, Mycobacterium tuberculosis
VRETMTFRAVPDALAVVA

SEQ ID NO: 1458246 - protein, 18 aa, Mycobacterium tuberculosis
VREVCDRYDLPYTTGSFL

SEQ ID NO: 1458247 - protein, 17 aa, Mycobacterium tuberculosis
VRGARYVGADGVFEVPA

SEQ ID NO: 1458248 - protein, 17 aa, Mycobacterium tuberculosis
VRGWAVTNPARWALLYG

SEQ ID NO: 1458249 - protein, 24 aa, Mycobacterium tuberculosis
VRHYIIDCALRWMRDFHADGLRLD

SEQ ID NO: 1458250 - protein, 21 aa, Mycobacterium tuberculosis
VRKEKYLAAKALGYELASYVS

SEQ ID NO: 1458251 - protein, 20 aa, Mycobacterium tuberculosis
VRLGPEMNRTVVVELDTSGT

SEQ ID NO: 1458252 - protein, 25 aa, Mycobacterium tuberculosis
VRLQDRVLLRFGLHQALRLGKPLQF

SEQ ID NO: 1458253 - protein, 24 aa, Mycobacterium tuberculosis
VRNEWGWAEAHLDMGWQDIKVAAE

SEQ ID NO: 1458254 - protein, 17 aa, Mycobacterium tuberculosis
VRSRIVKRRGHLQAVCE

SEQ ID NO: 1458255 - protein, 21 aa, Mycobacterium tuberculosis
VRTFSGLLDRFGRGKGCDICK

SEQ ID NO: 1458256 - protein, 24 aa, Mycobacterium tuberculosis
VRWNCKAGKCGSCSAEINGKPRLM

SEQ ID NO: 1458257 - protein, 27 aa, Mycobacterium tuberculosis
VSADDEPKCSLCQALTAASSQIQSESR

SEQ ID NO: 1458258 - protein, 19 aa, Mycobacterium tuberculosis
VSAILGGAMGQGFSQMMKG

SEQ ID NO: 1458259 - protein, 21 aa, Mycobacterium tuberculosis
VSAKEYRDWFATLPAELTDVV

SEQ ID NO: 1458260 - protein, 23 aa, Mycobacterium tuberculosis
VSGVGPRLAMAALAVHDAPALRQ

SEQ ID NO: 1458261 - protein, 29 aa, Mycobacterium tuberculosis
VSLCRSVDIPARFVLGQALELPQPGAQDC

SEQ ID NO: 1458262 - protein, 21 aa, Mycobacterium tuberculosis
VSTAIASIFGAYGRQCQVLSA

SEQ ID NO: 1458263 - protein, 28 aa, Mycobacterium tuberculosis
VTGYDILFFWVARMMMFGTFVGDDAAIT

SEQ ID NO: 1458264 - protein, 19 aa, Mycobacterium tuberculosis
VTLANRLAGNITEYSGIHV

SEQ ID NO: 1458265 - protein, 25 aa, Mycobacterium tuberculosis
VTLRGYRGAKNVLLVFFPLAFTGIC

SEQ ID NO: 1458266 - protein, 23 aa, Mycobacterium tuberculosis
VTREIPWEMKVSGLRARLGGARL

SEQ ID NO: 1458267 - protein, 18 aa, Mycobacterium tuberculosis
VTSLLRFAGGLHIVGGRV

SEQ ID NO: 1458268 - protein, 24 aa, Mycobacterium tuberculosis
VVALERLGRWCVPGPVTESIAVAP

SEQ ID NO: 1458269 - protein, 18 aa, Mycobacterium tuberculosis
VVCEDSLGLAEEFEAAMQ

SEQ ID NO: 1458270 - protein, 18 aa, Mycobacterium tuberculosis
VVCFPDRWLDLRYVGPAS

SEQ ID NO: 1458271 - protein, 22 aa, Mycobacterium tuberculosis
VVDENLLRLGVALSPSEKTRPG

SEQ ID NO: 1458272 - protein, 17 aa, Mycobacterium tuberculosis
VVDRSFVDNHCAGFDGY

SEQ ID NO: 1458273 - protein, 18 aa, Mycobacterium tuberculosis
VVEIEFLVTMIVVCSQGP

SEQ ID NO: 1458274 - protein, 20 aa, Mycobacterium tuberculosis
VVGCGPGPFTGLRAGMASAA

SEQ ID NO: 1458275 - protein, 33 aa, Mycobacterium tuberculosis; identical to SEQ ID NO: 751029

SEQ ID NO: 1458276 - protein, 22 aa, Mycobacterium tuberculosis
VVHLHGRVGGLVRVGTADAAGC

SEQ ID NO: 1458277 - protein, 18 aa, Mycobacterium tuberculosis
VVHPRSWLLRQASSGVSA

SEQ ID NO: 1458278 - protein, 17 aa, Mycobacterium tuberculosis
VVLWTFPNSALAIAGER

SEQ ID NO: 1458279 - protein, 21 aa, Mycobacterium tuberculosis
VVRTRGRLWLANRPDQVMWLE

SEQ ID NO: 1458280 - protein, 19 aa, Mycobacterium tuberculosis
VVSGGFRRIIEPLARELML

SEQ ID NO: 1458281 - protein, 18 aa, Mycobacterium tuberculosis
VVSGWRADTFVAGAPEPR

SEQ ID NO: 1458282 - protein, 19 aa, Mycobacterium tuberculosis
VVSRLADFIRSRGHGTDDS

SEQ ID NO: 1458283 - protein, 25 aa, Mycobacterium tuberculosis
VWVARLAVDFRQRFKKDVVIDMLCY

SEQ ID NO: 1458284 - protein, 25 aa, Mycobacterium tuberculosis
VYCRPSCPVRPPFARNVRFLPTAAA

SEQ ID NO: 1458285 - protein, 24 aa, Mycobacterium tuberculosis
VYFALLARRRMDLYGATVEDFAQV

SEQ ID NO: 1458286 - protein, 18 aa, Mycobacterium tuberculosis
VYLRDLVLALRWVHDNIA

SEQ ID NO: 1458287 - protein, 24 aa, Mycobacterium tuberculosis
VYRCDLGYGAKPWLIVSNNARNRH

SEQ ID NO: 1458288 - protein, 19 aa, Mycobacterium tuberculosis
VYRLRASRAGKVLDQREAI

SEQ ID NO: 1458289 - protein, 17 aa, Mycobacterium tuberculosis
WAALTASIGDRVQIVGD

SEQ ID NO: 1458290 - protein, 21 aa, Mycobacterium tuberculosis
WAGRLRRLLVEQASVILRRTI

SEQ ID NO: 1458291 - protein, 17 aa, Mycobacterium tuberculosis
WAGRQMVGVGLARLDPA

SEQ ID NO: 1458292 - protein, 19 aa, Mycobacterium tuberculosis
WAGTCKPGDGLGIAGDEVL

SEQ ID NO: 1458293 - protein, 24 aa, Mycobacterium tuberculosis
WAKQRGHRGLAYVLVAEDGTLGGP

SEQ ID NO: 1458294 - protein, 20 aa, Mycobacterium tuberculosis
WAPLMWTSLVVTAWMGEHGG

SEQ ID NO: 1458295 - protein, 19 aa, Mycobacterium tuberculosis
WCTADIGWVTGHTYGVYGP

SEQ ID NO: 1458296 - protein, 25 aa, Mycobacterium tuberculosis
WDDTPEGFGRIAATTARQVMLQRFR

SEQ ID NO: 1458297 - protein, 18 aa, Mycobacterium tuberculosis
WDIWKASLQGVLATRPDF

SEQ ID NO: 1458298 - protein, 19 aa, Mycobacterium tuberculosis
WDPAELGPVVSDLLAKSRP

SEQ ID NO: 1458299 - protein, 22 aa, Mycobacterium tuberculosis
WDPARWPLPVLPSSRSGPAPQS

SEQ ID NO: 1458300 - protein, 27 aa, Mycobacterium tuberculosis
WDPFPEFLGGLRFAGAQVVPIRVYRWK

SEQ ID NO: 1458301 - protein, 22 aa, Mycobacterium tuberculosis
WDQRAPIGWNMKDATPVAKTVC

SEQ ID NO: 1458302 - protein, 20 aa, Mycobacterium tuberculosis
WDQRLCAVPDADMFKAIRDG

SEQ ID NO: 1458303 - protein, 25 aa, Mycobacterium tuberculosis
WDVLARFGNMLSVSLIFVLETMVQQ

SEQ ID NO: 1458304 - protein, 19 aa, Mycobacterium tuberculosis
WELEDLSFAILHPKKYEEI

SEQ ID NO: 1458305 - protein, 27 aa, Mycobacterium tuberculosis
WESLQETLYWLAQPGIRESIAEADADI

SEQ ID NO: 1458306 - protein, 20 aa, Mycobacterium tuberculosis
WFASNCAGEAFVVLAKPEGA

SEQ ID NO: 1458307 - protein, 20 aa, Mycobacterium tuberculosis
WFDEHGISFTRHYTGSLACV

SEQ ID NO: 1458308 - protein, 20 aa, Mycobacterium tuberculosis
WFDPGKFWSGDSLPLAPGYR

SEQ ID NO: 1458309 - protein, 17 aa, Mycobacterium tuberculosis
WFVDGLIGATLGFGGEE

SEQ ID NO: 1458310 - protein, 30 aa, Mycobacterium tuberculosis; identical to SEQ ID NO: 208464

SEQ ID NO: 1458311 - protein, 18 aa, Mycobacterium tuberculosis
WGHDRVAQVITFGTIKTK

SEQ ID NO: 1458312 - protein, 17 aa, Mycobacterium tuberculosis
WGPAYATETHYLRVYLA

SEQ ID NO: 1458313 - protein, 38 aa, Mycobacterium tuberculosis; identical to SEQ ID NO: 208474

SEQ ID NO: 1458314 - protein, 24 aa, Mycobacterium tuberculosis
WHAELGDKLLDVWTGTNHRGVQLN

SEQ ID NO: 1458315 - protein, 21 aa, Mycobacterium tuberculosis
WILNGAKCWITNGGKSTWYTV

SEQ ID NO: 1458316 - protein, 18 aa, Mycobacterium tuberculosis
WILRRILRRLGYAAYGWG

SEQ ID NO: 1458317 - protein, 17 aa, Mycobacterium tuberculosis
WIREFPSLGAAAYPVQR

SEQ ID NO: 1458318 - protein, 19 aa, Mycobacterium tuberculosis
WIRGWRAGGFDALVPNPRQ

SEQ ID NO: 1458319 - protein, 17 aa, Mycobacterium tuberculosis
WKVKRIRNTPRVTLATC

SEQ ID NO: 1458320 - protein, 20 aa, Mycobacterium tuberculosis
WKYLMALFSSKIDEHADPKV

SEQ ID NO: 1458321 - protein, 26 aa, Mycobacterium tuberculosis
WLCVPRPDSPSVFGAILDRSAGHFRL

SEQ ID NO: 1458322 - protein, 18 aa, Mycobacterium tuberculosis
WLGTVVQAYLRRTLADCA

SEQ ID NO: 1458323 - protein, 19 aa, Mycobacterium tuberculosis
WLPAFAILEHVGRRSGKPY

SEQ ID NO: 1458324 - protein, 25 aa, Mycobacterium tuberculosis
WLPFYHDMGLMLGIILPMINQDTAV

SEQ ID NO: 1458325 - protein, 19 aa, Mycobacterium tuberculosis
WLPGTALVIADLVWADGSE

SEQ ID NO: 1458326 - protein, 17 aa, Mycobacterium tuberculosis
WLVCVHGTEMGRAPLDL

SEQ ID NO: 1458327 - protein, 17 aa, Mycobacterium tuberculosis
WNHPVVDPHTVEPDHHG

SEQ ID NO: 1458328 - protein, 24 aa, Mycobacterium tuberculosis
WNLGGLKAALAIAGREAAADLARM

SEQ ID NO: 1458329 - protein, 26 aa, Mycobacterium tuberculosis
WPRHILDVKTAIAWARANVDKFGGDR

SEQ ID NO: 1458330 - protein, 20 aa, Mycobacterium tuberculosis
WPRHRRLSIGADDGRSAVLA

SEQ ID NO: 1458331 - protein, 22 aa, Mycobacterium tuberculosis
WQATSPLPGWDVKAVVSHIIGT

SEQ ID NO: 1458332 - protein, 18 aa, Mycobacterium tuberculosis
WQLGMTRHFLAGDAQPRY

SEQ ID NO: 1458333 - protein, 28 aa, Mycobacterium tuberculosis
WQPEGVSLAELFRRSGLDVRAADDDTIF

SEQ ID NO: 1458334 - protein, 20 aa, Mycobacterium tuberculosis
WQPPTPRRLGPFRASEETWR

SEQ ID NO: 1458335 - protein, 25 aa, Mycobacterium tuberculosis
WQRQGRAGSHVSIRWDVPGDTTPGQ

SEQ ID NO: 1458336 - protein, 18 aa, Mycobacterium tuberculosis
WRDIHLDSSFAVDLGEPI

SEQ ID NO: 1458337 - protein, 17 aa, Mycobacterium tuberculosis
WRGPVLDDLRDFQFVEP

SEQ ID NO: 1458338 - protein, 17 aa, Mycobacterium tuberculosis
WRHTACPVNELSKSAAY

SEQ ID NO: 1458339 - protein, 20 aa, Mycobacterium tuberculosis
WRMPMGPVVNLTRWMEAAGC

SEQ ID NO: 1458340 - protein, 18 aa, Mycobacterium tuberculosis
WRNLASGYQVKTYRDDAD

SEQ ID NO: 1458341 - protein, 17 aa, Mycobacterium tuberculosis
WRRLLGPLVAHSETVVE

SEQ ID NO: 1458342 - protein, 19 aa, Mycobacterium tuberculosis
WRSALATALAAPANSTSID

SEQ ID NO: 1458343 - protein, 19 aa, Mycobacterium tuberculosis
WRSFELYPPQVRVAGAIPI

SEQ ID NO: 1458344 - protein, 22 aa, Mycobacterium tuberculosis
WRTDFLNDMGLVIADSIKPFAV

SEQ ID NO: 1458345 - protein, 20 aa, Mycobacterium tuberculosis
WRWIAEDHTVALFLDKDRVL

SEQ ID NO: 1458346 - protein, 18 aa, Mycobacterium tuberculosis
WRYIRAAVRAVLACTRRE

SEQ ID NO: 1458347 - protein, 18 aa, Mycobacterium tuberculosis
WSDLRRAAMAAGLQEIAG

SEQ ID NO: 1458348 - protein, 17 aa, Mycobacterium tuberculosis
WSPVSLGDYCAGSNHVL

SEQ ID NO: 1458349 - protein, 17 aa, Mycobacterium tuberculosis
WTAAMLASGARLDFTDL

SEQ ID NO: 1458350 - protein, 20 aa, Mycobacterium tuberculosis
WTERWPDLVASFTAATRAEE

SEQ ID NO: 1458351 - protein, 27 aa, Mycobacterium tuberculosis
WTFLGPRPAGWWVRRRLHEVAVHRADV

SEQ ID NO: 1458352 - protein, 28 aa, Mycobacterium tuberculosis
WTSAAHKARWGVCLARTDPDAPKHKGIT

SEQ ID NO: 1458353 - protein, 17 aa, Mycobacterium tuberculosis
WTVSKLYYVHGFLRERM

SEQ ID NO: 1458354 - protein, 18 aa, Mycobacterium tuberculosis
WVEMFGADALRFTLARGA

SEQ ID NO: 1458355 - protein, 18 aa, Mycobacterium tuberculosis
WVEYEPYGTVLIIGAWNY

SEQ ID NO: 1458356 - protein, 31 aa, Mycobacterium tuberculosis; identical to SEQ ID NO: 208669

SEQ ID NO: 1458357 - protein, 24 aa, Mycobacterium tuberculosis
WVPLGEVPEVWAAVTSVFRDYGYR

SEQ ID NO: 1458358 - protein, 18 aa, Mycobacterium tuberculosis
WYDTRRIPAATAEALERT

SEQ ID NO: 1458359 - protein, 17 aa, Mycobacterium tuberculosis
WYGLDGVEHTGGPLVDF

SEQ ID NO: 1458360 - protein, 18 aa, Mycobacterium tuberculosis
WYYARTFEGKQYGVHCRC

SEQ ID NO: 1458361 - protein, 20 aa, Mycobacterium tuberculosis
YAACLPERFADVMRVTADVL

SEQ ID NO: 1458362 - protein, 25 aa, Mycobacterium tuberculosis
YAALEFWSALHGFVLLEMTGVMDDI

SEQ ID NO: 1458363 - protein, 19 aa, Mycobacterium tuberculosis
YAALMAGADLVLPDRHLDA

SEQ ID NO: 1458364 - protein, 18 aa, Mycobacterium tuberculosis
YAGADRVLGRLVKVTPTS

SEQ ID NO: 1458365 - protein, 24 aa, Mycobacterium tuberculosis
YAIERPHMYRLMFGSTSAHGINVP

SEQ ID NO: 1458366 - protein, 20 aa, Mycobacterium tuberculosis
YARPRFDDDYGRYDGRDYDD

SEQ ID NO: 1458367 - protein, 22 aa, Mycobacterium tuberculosis
YAWSRMRMMRSGKHITYHSVRR

SEQ ID NO: 1458368 - protein, 18 aa, Mycobacterium tuberculosis
YDAPFAFVDLDAMWGNAD

SEQ ID NO: 1458369 - protein, 19 aa, Mycobacterium tuberculosis
YDDFCRRQHTFSSTLTVES

SEQ ID NO: 1458370 - protein, 21 aa, Mycobacterium tuberculosis
YDEAWMLNTVFDYHNENAKEE

SEQ ID NO: 1458371 - protein, 22 aa, Mycobacterium tuberculosis
YDRRWLHEQGIALTMSDLRFLK

SEQ ID NO: 1458372 - protein, 18 aa, Mycobacterium tuberculosis
YDRRYGLDDTHLRAIAQL

SEQ ID NO: 1458373 - protein, 19 aa, Mycobacterium tuberculosis
YDTGLSLSAVCALEPYWEA

SEQ ID NO: 1458374 - protein, 19 aa, Mycobacterium tuberculosis
YDVVDGRPHLRLENRVLPA

SEQ ID NO: 1458375 - protein, 17 aa, Mycobacterium tuberculosis
YEEPAFDIFALVPPPVG

SEQ ID NO: 1458376 - protein, 19 aa, Mycobacterium tuberculosis
YELEEARPWARIHAPNIAE

SEQ ID NO: 1458377 - protein, 19 aa, Mycobacterium tuberculosis
YELLGRGDTLGVFQLDGGP

SEQ ID NO: 1458378 - protein, 19 aa, Mycobacterium tuberculosis
YERHIACTRLPDLRESMRR

SEQ ID NO: 1458379 - protein, 24 aa, Mycobacterium tuberculosis
YEWPEDRQSLSWTLESSSLLKSLE

SEQ ID NO: 1458380 - protein, 18 aa, Mycobacterium tuberculosis
YFAELDWERNFLRQLQSH

SEQ ID NO: 1458381 - protein, 21 aa, Mycobacterium tuberculosis
YGKKLSWADLIVFAGNCALES

SEQ ID NO: 1458382 - protein, 19 aa, Mycobacterium tuberculosis
YGLTYPGVGFVVWRGPEHL

SEQ ID NO: 1458383 - protein, 18 aa, Mycobacterium tuberculosis
YGQVKFSNLKARAAVGAL

SEQ ID NO: 1458384 - protein, 24 aa, Mycobacterium tuberculosis
YGVLVRGRHVAVSAVTLLPGATIT

SEQ ID NO: 1458385 - protein, 26 aa, Mycobacterium tuberculosis
YHELEAMPDLVARVIAATGPVAELAH

SEQ ID NO: 1458386 - protein, 18 aa, Mycobacterium tuberculosis
YHLSRPAEALAWMCDRAV

SEQ ID NO: 1458387 - protein, 17 aa, Mycobacterium tuberculosis
YIEFNSLVDRGYWDDDE

SEQ ID NO: 1458388 - protein, 18 aa, Mycobacterium tuberculosis
YIQRAAGVRRCAGSVRVA

SEQ ID NO: 1458389 - protein, 23 aa, Mycobacterium tuberculosis
YKVGLGSVRYLLAVGDLLIGWRL

SEQ ID NO: 1458390 - protein, 17 aa, Mycobacterium tuberculosis
YLLGLALAQARGTKYPD

SEQ ID NO: 1458391 - protein, 25 aa, Mycobacterium tuberculosis
YLRPDELHLGFNFRLARTEFDAAEI

SEQ ID NO: 1458392 - protein, 24 aa, Mycobacterium tuberculosis
YLTQCCYTMRTIFDVKPDSDVFWC

SEQ ID NO: 1458393 - protein, 22 aa, Mycobacterium tuberculosis
YNKLFEERIIFLGVQVDDASAN

SEQ ID NO: 1458394 - protein, 17 aa, Mycobacterium tuberculosis
YNLQWKPVGGFPVTFGW

SEQ ID NO: 1458395 - protein, 18 aa, Mycobacterium tuberculosis
YNPGHLMVVPYRRVSELE

SEQ ID NO: 1458396 - protein, 19 aa, Mycobacterium tuberculosis
YPALTLAQLRARLHTLDVP

SEQ ID NO: 1458397 - protein, 26 aa, Mycobacterium tuberculosis
YPARVKCALLGWMAFKDALAQASEAF

SEQ ID NO: 1458398 - protein, 24 aa, Mycobacterium tuberculosis
YPGCKRIVLGHSMGGGIVFAYGVE

SEQ ID NO: 1458399 - protein, 19 aa, Mycobacterium tuberculosis
YPGSNVALCVGMCGQLIYV

SEQ ID NO: 1458400 - protein, 23 aa, Mycobacterium tuberculosis
YPVKRGDTVLVHAGAGGVGLILT

SEQ ID NO: 1458401 - protein, 18 aa, Mycobacterium tuberculosis
YQDYQSWTDRTIPIVVCE

SEQ ID NO: 1458402 - protein, 18 aa, Mycobacterium tuberculosis
YRDYIGWLAGRDQTASRA

SEQ ID NO: 1458403 - protein, 23 aa, Mycobacterium tuberculosis
YRPEHNVTVGLVFRARTSESELL

SEQ ID NO: 1458404 - protein, 25 aa, Mycobacterium tuberculosis
YRPSHEKLAWARRVLAASRSERGAF

SEQ ID NO: 1458405 - protein, 22 aa, Mycobacterium tuberculosis
YRQLDYWARTSLVVPSIRSAAG

SEQ ID NO: 1458406 - protein, 25 aa, Mycobacterium tuberculosis
YRRTLRLPWGNGIVSLTPAPDHVRC

SEQ ID NO: 1458407 - protein, 19 aa, Mycobacterium tuberculosis
YRTLLEFFFQIHDPTTKDR

SEQ ID NO: 1458408 - protein, 17 aa, Mycobacterium tuberculosis
YSCKGCRYLIDAQYSAT

SEQ ID NO: 1458409 - protein, 18 aa, Mycobacterium tuberculosis
YSGVPVRVCRTGYTGEHG

SEQ ID NO: 1458410 - protein, 27 aa, Mycobacterium tuberculosis
YTEEMPVAVPWSLPAARSAHAGNDAPV

SEQ ID NO: 1458411 - protein, 20 aa, Mycobacterium tuberculosis
YTLRFKDLRTGEQYPDEIAG

SEQ ID NO: 1458412 - protein, 20 aa, Mycobacterium tuberculosis
YTNFEELCDIFARYDVTFSL

SEQ ID NO: 1458413 - protein, 17 aa, Mycobacterium tuberculosis
YTPLAWWGSSTQRVRLG

SEQ ID NO: 1458414 - protein, 20 aa, Mycobacterium tuberculosis
YWDDDECRWHVFTADGREYV

SEQ ID NO: 1458415 - protein, 24 aa, Mycobacterium tuberculosis
YWVEHVRKPVRFFDGVGLAESLGA

SEQ ID NO: 1458416 - protein, 24 aa, Mycobacterium tuberculosis
YWVGNHCKRVFVEAVDVVSGIGYD

SEQ ID NO: 1458417 - protein, 18 aa, Mycobacterium tuberculosis
YYIGYKCQRGLADLTDAE

SEQ ID NO: 1458418 - protein, 17 aa, Mycobacterium tuberculosis
YYLMGFDIASFTPIFVM

SEQ ID NO: 1458419 - protein, 17 aa, Mycobacterium tuberculosis
YYLSFLLDRANRTYLAM

SEQ ID NO: 1458420 - protein, 21 aa, Mycobacterium tuberculosis
YYTICELLHRHGFAGATVLLG

SEQ ID NO: 1458421 - protein, 22 aa, Mycobacterium tuberculosis
AAAAPYAGWLAAAATQAEQAAT

SEQ ID NO: 1458422 - protein, 19 aa, Mycobacterium tuberculosis
AAADCLARAVLAGVLNAQP

SEQ ID NO: 1458423 - protein, 25 aa, Mycobacterium tuberculosis
AAAGRPGPVPLALGPVHPGGPTLID

SEQ ID NO: 1458424 - protein, 21 aa, Mycobacterium tuberculosis
AAAILSARFGPSVLYGVPNFF

SEQ ID NO: 1458425 - protein, 18 aa, Mycobacterium tuberculosis
AAALALGTQGAWTGSQWL

SEQ ID NO: 1458426 - protein, 17 aa, Mycobacterium tuberculosis
AAARYAANPERSIAEAH

SEQ ID NO: 1458427 - protein, 17 aa, Mycobacterium tuberculosis
AAASAYEAAFFATVPPP

SEQ ID NO: 1458428 - protein, 18 aa, Mycobacterium tuberculosis
AAASRLAGAYGEHAAAEI

SEQ ID NO: 1458429 - protein, 24 aa, Mycobacterium tuberculosis
AAEGARLQLLLSRNEIDRAATILA

SEQ ID NO: 1458430 - protein, 17 aa, Mycobacterium tuberculosis
AAELGMAAIYCRDDVGG

SEQ ID NO: 1458431 - protein, 18 aa, Mycobacterium tuberculosis
AAFCDGYAVASGIDPRDS

SEQ ID NO: 1458432 - protein, 17 aa, Mycobacterium tuberculosis
AAFEVSQTSRSAPCVLG

SEQ ID NO: 1458433 - protein, 26 aa, Mycobacterium tuberculosis
AAGLSRASSIGALSVPPSWAGQANLV

SEQ ID NO: 1458434 - protein, 21 aa, Mycobacterium tuberculosis
AAGRLRFTTDYDMAADFADVH

SEQ ID NO: 1458435 - protein, 37 aa, Mycobacterium tuberculosis; identical to SEQ ID NO: 195809

SEQ ID NO: 1458436 - protein, 19 aa, Mycobacterium tuberculosis
AALGSRLGGHIVQGHVDAT

SEQ ID NO: 1458437 - protein, 17 aa, Mycobacterium tuberculosis
AALLKLPVANWPALGGM

SEQ ID NO: 1458438 - protein, 18 aa, Mycobacterium tuberculosis
AALMCYEAHIAGLGDNVA

SEQ ID NO: 1458439 - protein, 17 aa, Mycobacterium tuberculosis
AALRVNRSLVLPDPPRH

SEQ ID NO: 1458440 - protein, 18 aa, Mycobacterium tuberculosis
AAMLRRIRLTPAGPDTAD

SEQ ID NO: 1458441 - protein, 17 aa, Mycobacterium tuberculosis
AAPKYAEAGIRAIDLTP

SEQ ID NO: 1458442 - protein, 17 aa, Mycobacterium tuberculosis
AAPSVGLMQPWRFIRIT

SEQ ID NO: 1458443 - protein, 24 aa, Mycobacterium tuberculosis
AAQRLASCGAREVIVTNTLPIGED

SEQ ID NO: 1458444 - protein, 17 aa, Mycobacterium tuberculosis
AARAQIRDIRLLRTQAA

SEQ ID NO: 1458445 - protein, 24 aa, Mycobacterium tuberculosis
AARRADIAIVFAIRAEGEGFDSAD

SEQ ID NO: 1458446 - protein, 18 aa, Mycobacterium tuberculosis
AARVPRLLFLGSSCIYPK

SEQ ID NO: 1458447 - protein, 21 aa, Mycobacterium tuberculosis
AATQDPRAWAALPRAGAVIFA

SEQ ID NO: 1458448 - protein, 23 aa, Mycobacterium tuberculosis
AATRLPEAPALVVTADRIAISHR

SEQ ID NO: 1458449 - protein, 25 aa, Mycobacterium tuberculosis
AAVNDLRLALGVMLEIGPRGPERLP

SEQ ID NO: 1458450 - protein, 18 aa, Mycobacterium tuberculosis
AAVRAWLLSQRRIVTTYA

SEQ ID NO: 1458451 - protein, 20 aa, Mycobacterium tuberculosis
ACADCGVTVDRMPRVETFGV

SEQ ID NO: 1458452 - protein, 21 aa, Mycobacterium tuberculosis
ACGTLRLADFDKIELSNLNRV

SEQ ID NO: 1458453 - protein, 25 aa, Mycobacterium tuberculosis
ACLSEARYGIVWGAMGAARSAWQCA

SEQ ID NO: 1458454 - protein, 21 aa, Mycobacterium tuberculosis
ACQGFITQLGRNFQVIYEQAN

SEQ ID NO: 1458455 - protein, 26 aa, Mycobacterium tuberculosis
ACQKWPRRMRKMFLSLIQRQLPEGYD

SEQ ID NO: 1458456 - protein, 17 aa, Mycobacterium tuberculosis
ACVRATWLKVVPDQLGR

SEQ ID NO: 1458457 - protein, 23 aa, Mycobacterium tuberculosis
ADAGRFLTTIKHRLEEGAFEADL

SEQ ID NO: 1458458 - protein, 22 aa, Mycobacterium tuberculosis
ADARLAQGHPVAWIHGTALRTE

SEQ ID NO: 1458459 - protein, 20 aa, Mycobacterium tuberculosis
ADDGYPVFVDALVNMRHTLA

SEQ ID NO: 1458460 - protein, 25 aa, Mycobacterium tuberculosis
ADGVMRWLEEHRRGVAMDSGVVPIV

SEQ ID NO: 1458461 - protein, 20 aa, Mycobacterium tuberculosis
ADIRFGSYRLFSLDAAPGPD

SEQ ID NO: 1458462 - protein, 18 aa, Mycobacterium tuberculosis
ADISGVYNTGALGLITSA

SEQ ID NO: 1458463 - protein, 21 aa, Mycobacterium tuberculosis
ADLALAGGCAVLLEPHASVAA

SEQ ID NO: 1458464 - protein, 21 aa, Mycobacterium tuberculosis
ADLPPAYIAVAGYDPLRDDGI

SEQ ID NO: 1458465 - protein, 20 aa, Mycobacterium tuberculosis
ADLQSWLVLITGYDAVSLQP

SEQ ID NO: 1458466 - protein, 24 aa, Mycobacterium tuberculosis
ADLRAGLPDGEFFGVIAQLPGASG

SEQ ID NO: 1458467 - protein, 27 aa, Mycobacterium tuberculosis
ADPALALELGTYLGYGALRIARAAPEA

SEQ ID NO: 1458468 - protein, 19 aa, Mycobacterium tuberculosis
ADQACTDWPVAAAEDDEAR

SEQ ID NO: 1458469 - protein, 17 aa, Mycobacterium tuberculosis
ADRASRVQPGFTIANHN

SEQ ID NO: 1458470 - protein, 18 aa, Mycobacterium tuberculosis
ADTLGYISLRGMVAASEQ

SEQ ID NO: 1458471 - protein, 22 aa, Mycobacterium tuberculosis
ADVEASGLWPGKVVTEVSPAGD

SEQ ID NO: 1458472 - protein, 22 aa, Mycobacterium tuberculosis
ADVVSAWTGIPAGRLLEGETAK

SEQ ID NO: 1458473 - protein, 23 aa, Mycobacterium tuberculosis
AEALTSLPGVGVWTAAETTQRVF

SEQ ID NO: 1458474 - protein, 19 aa, Mycobacterium tuberculosis
AEASVPVFTVRLADHPSRD

SEQ ID NO: 1458475 - protein, 19 aa, Mycobacterium tuberculosis
AEAVLRAAALIGGLDNAAL

SEQ ID NO: 1458476 - protein, 24 aa, Mycobacterium tuberculosis
AEDDGILMGYGWHRGRDEGQLLLL

SEQ ID NO: 1458477 - protein, 23 aa, Mycobacterium tuberculosis
AEEFFDLIWRLMRFDKHGPLDLI

SEQ ID NO: 1458478 - protein, 23 aa, Mycobacterium tuberculosis
AEELASWLSGLRGSRVVLRVPRR

SEQ ID NO: 1458479 - protein, 18 aa, Mycobacterium tuberculosis
AEEYYLSFLLDRANRTYL

SEQ ID NO: 1458480 - protein, 17 aa, Mycobacterium tuberculosis
AEGRKVLAREVDIRDDA

SEQ ID NO: 1458481 - protein, 26 aa, Mycobacterium tuberculosis
AEGSTHAFGGMPLMGSGAGRAFNNFA

SEQ ID NO: 1458482 - protein, 18 aa, Mycobacterium tuberculosis
AEHAELELALADPALHSN

SEQ ID NO: 1458483 - protein, 19 aa, Mycobacterium tuberculosis
AEHPRLGPVRNPWNTDYTA

SEQ ID NO: 1458484 - protein, 20 aa, Mycobacterium tuberculosis
AEIKRRLPSMYHQFKELAEV

SEQ ID NO: 1458485 - protein, 18 aa, Mycobacterium tuberculosis
AELAAAFEKFEKTVARAA

SEQ ID NO: 1458486 - protein, 19 aa, Mycobacterium tuberculosis
AELDAGVPARGLNGEAYRG

SEQ ID NO: 1458487 - protein, 21 aa, Mycobacterium tuberculosis
AELDASVAMDTFGKWVSPARL

SEQ ID NO: 1458488 - protein, 21 aa, Mycobacterium tuberculosis
AELDFPVPSFAEFWRTGRLEL

SEQ ID NO: 1458489 - protein, 25 aa, Mycobacterium tuberculosis
AELGAAMTRLACERASVGDDELAAK

SEQ ID NO: 1458490 - protein, 25 aa, Mycobacterium tuberculosis
AELKKKPGIHAVHMAGGNKAEIAPT

SEQ ID NO: 1458491 - protein, 19 aa, Mycobacterium tuberculosis
AELPEHIVIVGSGFIAAEF

SEQ ID NO: 1458492 - protein, 20 aa, Mycobacterium tuberculosis
AELPLPVGLLKIDVEGLERA

SEQ ID NO: 1458493 - protein, 24 aa, Mycobacterium tuberculosis
AELSRLRPLPFRLVLDGTEEIVAD

SEQ ID NO: 1458494 - protein, 17 aa, Mycobacterium tuberculosis
AELTRRGHEVLIQAGAG

SEQ ID NO: 1458495 - protein, 24 aa, Mycobacterium tuberculosis
AEMARRIDVARVYAHHVVERQLAG

SEQ ID NO: 1458496 - protein, 21 aa, Mycobacterium tuberculosis
AEQRVALDLLLDESVGIVSLG

SEQ ID NO: 1458497 - protein, 28 aa, Mycobacterium tuberculosis
AERLRAGGMGIPAFYTPAGVGTQVADGG

SEQ ID NO: 1458498 - protein, 23 aa, Mycobacterium tuberculosis
AERWEWPTPMLPAVQGLSPDGAD

SEQ ID NO: 1458499 - protein, 27 aa, Mycobacterium tuberculosis
AESPRETWLRLLLIRAGFPRPQTQIPV

SEQ ID NO: 1458500 - protein, 19 aa, Mycobacterium tuberculosis
AETQPQGWVRLRGEAALVV

SEQ ID NO: 1458501 - protein, 19 aa, Mycobacterium tuberculosis
AEVARRLHNKGAKLVLTDL

SEQ ID NO: 1458502 - protein, 20 aa, Mycobacterium tuberculosis
AEVFCAPEVVEYLRSATDRL

SEQ ID NO: 1458503 - protein, 18 aa, Mycobacterium tuberculosis
AEVRRIEHQVAHEVVAEV

SEQ ID NO: 1458504 - protein, 23 aa, Mycobacterium tuberculosis
AEYGRLRHGQILFTFLHLAASRA

SEQ ID NO: 1458505 - protein, 17 aa, Mycobacterium tuberculosis
AFAPMALAVAKRLHNQG

SEQ ID NO: 1458506 - protein, 18 aa, Mycobacterium tuberculosis
AFDNGPWPSTPPHERAAV

SEQ ID NO: 1458507 - protein, 19 aa, Mycobacterium tuberculosis
AFLPFPFDSVIAGGASMAY

SEQ ID NO: 1458508 - protein, 22 aa, Mycobacterium tuberculosis
AFPYVVVTGIAMTTALATDAET

SEQ ID NO: 1458509 - protein, 19 aa, Mycobacterium tuberculosis
AFVRCLESGYAANVEAVVT

SEQ ID NO: 1458510 - protein, 25 aa, Mycobacterium tuberculosis
AGAQYKKLRDVLGLLRDAYCRHIGV

SEQ ID NO: 1458511 - protein, 17 aa, Mycobacterium tuberculosis
AGAVHLNKGCYRGQETV

SEQ ID NO: 1458512 - protein, 25 aa, Mycobacterium tuberculosis
AGDHAAICWPLLVGMAKAKYYLLTC

SEQ ID NO: 1458513 - protein, 21 aa, Mycobacterium tuberculosis
AGDSRLVAVLAELDDADTRAA

SEQ ID NO: 1458514 - protein, 19 aa, Mycobacterium tuberculosis
AGGSLEIFLTPQLPAPLIQ

SEQ ID NO: 1458515 - protein, 23 aa, Mycobacterium tuberculosis
AGHPFAATGGRILAQTAKQLAEK

SEQ ID NO: 1458516 - protein, 19 aa, Mycobacterium tuberculosis
AGHYGMCGRAYDPRFLFAW

SEQ ID NO: 1458517 - protein, 25 aa, Mycobacterium tuberculosis
AGILDVLDNYAFVRTSGYLPGPHDV

SEQ ID NO: 1458518 - protein, 17 aa, Mycobacterium tuberculosis
AGLKAAYHAHREAYQRI

SEQ ID NO: 1458519 - protein, 29 aa, Mycobacterium tuberculosis
AGPGECVALLFERCAPAVVAMVAVLKTGA

SEQ ID NO: 1458520 - protein, 20 aa, Mycobacterium tuberculosis
AGSLVLLAWGAANRDPRQYE

SEQ ID NO: 1458521 - protein, 18 aa, Mycobacterium tuberculosis
AGSPEERAAVLGILAELL

SEQ ID NO: 1458522 - protein, 19 aa, Mycobacterium tuberculosis
AGTGLAAISWGLAHERMSI

SEQ ID NO: 1458523 - protein, 19 aa, Mycobacterium tuberculosis
AGTGVRFTPTLTFTLDTIS

SEQ ID NO: 1458524 - protein, 17 aa, Mycobacterium tuberculosis
AGTWVKAVAGIRLALSL

SEQ ID NO: 1458525 - protein, 26 aa, Mycobacterium tuberculosis
AGVPYPSLKRMNPWKRFFHNQTKIDE

SEQ ID NO: 1458526 - protein, 26 aa, Mycobacterium tuberculosis
AGVYPPCSAFEAWFVSAALDDAAFGR

SEQ ID NO: 1458527 - protein, 24 aa, Mycobacterium tuberculosis
AGYRGEIKVALINLDPAAPIVVHR

SEQ ID NO: 1458528 - protein, 17 aa, Mycobacterium tuberculosis
AGYRRFLERRLRETFGF

SEQ ID NO: 1458529 - protein, 20 aa, Mycobacterium tuberculosis
AHGRRRRARFFGRNVNVPLM

SEQ ID NO: 1458530 - protein, 20 aa, Mycobacterium tuberculosis
AHHRESFLYTNFEELCDIFA

SEQ ID NO: 1458531 - protein, 18 aa, Mycobacterium tuberculosis
AHLRPELGGQGFGQVKLA

SEQ ID NO: 1458532 - protein, 17 aa, Mycobacterium tuberculosis
AHNRVHFPRAMFDEPLP

SEQ ID NO: 1458533 - protein, 18 aa, Mycobacterium tuberculosis
AHPEPLPPVSGLTIAVER

SEQ ID NO: 1458534 - protein, 25 aa, Mycobacterium tuberculosis
AHVGIQLYVKRVFIMGDCDQLMPEY

SEQ ID NO: 1458535 - protein, 17 aa, Mycobacterium tuberculosis
AIAQLNFANARRNPNAQ

SEQ ID NO: 1458536 - protein, 25 aa, Mycobacterium tuberculosis
AICSARTAAQFGIEPRVAMLSYSTG

SEQ ID NO: 1458537 - protein, 22 aa, Mycobacterium tuberculosis
AIEEMLRWTAPVKNMCRVLTAD

SEQ ID NO: 1458538 - protein, 26 aa, Mycobacterium tuberculosis
AIEVYPHPATVALFRLPRALKYKAKP

SEQ ID NO: 1458539 - protein, 24 aa, Mycobacterium tuberculosis
AIIDSLLRSCPRLTILTTSTEAIG

SEQ ID NO: 1458540 - protein, 18 aa, Mycobacterium tuberculosis
AITKVIWSEYFRRYTDLA

SEQ ID NO: 1458541 - protein, 17 aa, Mycobacterium tuberculosis
AKDRGLWNLFLSAESGL

SEQ ID NO: 1458542 - protein, 19 aa, Mycobacterium tuberculosis
AKEVISIAGRNIFPTEVEL

SEQ ID NO: 1458543 - protein, 19 aa, Mycobacterium tuberculosis
AKLFDEWFPANKLVKLGLR

SEQ ID NO: 1458544 - protein, 20 aa, Mycobacterium tuberculosis
AKLGAWGVIASVQPNFDELW

SEQ ID NO: 1458545 - protein, 20 aa, Mycobacterium tuberculosis
AKLPTIAAYAYKKSVGQPFL

SEQ ID NO: 1458546 - protein, 20 aa, Mycobacterium tuberculosis
AKMRALRQLWARVAEVVGDP

SEQ ID NO: 1458547 - protein, 18 aa, Mycobacterium tuberculosis
AKSPRLRQAGTFADAALR

SEQ ID NO: 1458548 - protein, 17 aa, Mycobacterium tuberculosis
ALAADVGAEFVVVAGDV

SEQ ID NO: 1458549 - protein, 26 aa, Mycobacterium tuberculosis
ALAARGFSHNDFRAVADLIAAALTAT

SEQ ID NO: 1458550 - protein, 26 aa, Mycobacterium tuberculosis
ALAGEYGGPCYARIDAPADREQKARL

SEQ ID NO: 1458551 - protein, 25 aa, Mycobacterium tuberculosis
ALARELADAILIRKVDWVDEITRVH

SEQ ID NO: 1458552 - protein, 18 aa, Mycobacterium tuberculosis
ALARLGMFAPALSYLEEP

SEQ ID NO: 1458553 - protein, 26 aa, Mycobacterium tuberculosis
ALDRNALHEVVGWWAKLPVTGMQPVQ

SEQ ID NO: 1458554 - protein, 32 aa, Mycobacterium tuberculosis; identical to SEQ ID NO: 196597

SEQ ID NO: 1458555 - protein, 27 aa, Mycobacterium tuberculosis
ALGAACWDARRWLGRPGLDDRASADLL

SEQ ID NO: 1458556 - protein, 22 aa, Mycobacterium tuberculosis
ALGAEVRWASCNIFSTQDHAAA

SEQ ID NO: 1458557 - protein, 17 aa, Mycobacterium tuberculosis
ALHRRGPHRVLRGDLAF

SEQ ID NO: 1458558 - protein, 24 aa, Mycobacterium tuberculosis
ALLDIAARIAVPVVVSSALDSAVG

SEQ ID NO: 1458559 - protein, 24 aa, Mycobacterium tuberculosis
ALPEEFRMAVYYADVEGFPYKEIA

SEQ ID NO: 1458560 - protein, 23 aa, Mycobacterium tuberculosis
ALRRAARADGWMHGGGDPDELDR

SEQ ID NO: 1458561 - protein, 18 aa, Mycobacterium tuberculosis
ALSETLRRRRASGGPAEQ

SEQ ID NO: 1458562 - protein, 24 aa, Mycobacterium tuberculosis
ALTRAQSQVVAWWAPTFDEVNGGL

SEQ ID NO: 1458563 - protein, 18 aa, Mycobacterium tuberculosis
ALVRTGVAVAVPFGMVGL

SEQ ID NO: 1458564 - protein, 20 aa, Mycobacterium tuberculosis
AMLERAHLAYGEIMDLAVGL

SEQ ID NO: 1458565 - protein, 18 aa, Mycobacterium tuberculosis
ANIAGWPMAKAFAVAPKM

SEQ ID NO: 1458566 - protein, 22 aa, Mycobacterium tuberculosis
ANLAGLFLDNTGNLTLNFGVAN

SEQ ID NO: 1458567 - protein, 17 aa, Mycobacterium tuberculosis
ANLRHTVRFDRAVESAI

SEQ ID NO: 1458568 - protein, 22 aa, Mycobacterium tuberculosis
ANPAVWMYAGGAGFAQILYHLG

SEQ ID NO: 1458569 - protein, 17 aa, Mycobacterium tuberculosis
ANPRASRTVPFVSKATA

SEQ ID NO: 1458570 - protein, 25 aa, Mycobacterium tuberculosis
ANPTPKGCVFEYVYLARPDSTIAGR

SEQ ID NO: 1458571 - protein, 24 aa, Mycobacterium tuberculosis
ANSEPRTGLSMGEHAAVTAKQMGI

SEQ ID NO: 1458572 - protein, 24 aa, Mycobacterium tuberculosis
APDVIRLAPPLIIAEAQLDGFVAA

SEQ ID NO: 1458573 - protein, 24 aa, Mycobacterium tuberculosis
APGARLAWREDATWAPHGGESRVD

SEQ ID NO: 1458574 - protein, 17 aa, Mycobacterium tuberculosis
APICLTWELTYACNLAC

SEQ ID NO: 1458575 - protein, 17 aa, Mycobacterium tuberculosis
APKDRDIAMVFQSYALY

SEQ ID NO: 1458576 - protein, 23 aa, Mycobacterium tuberculosis
APLDARIGWRRATLAVCEALLAN

SEQ ID NO: 1458577 - protein, 17 aa, Mycobacterium tuberculosis
APLDRRLLLGMLAELPA

SEQ ID NO: 1458578 - protein, 23 aa, Mycobacterium tuberculosis
APPHGGIAFGWDRTTALLAGMDS

SEQ ID NO: 1458579 - protein, 22 aa, Mycobacterium tuberculosis
AQAPDGLSCFLLPRVLPDGTRN

SEQ ID NO: 1458580 - protein, 28 aa, Mycobacterium tuberculosis
AQAPKGIVMPARLPNRIHPFVQEIVPVQ

SEQ ID NO: 1458581 - protein, 19 aa, Mycobacterium tuberculosis
AQLASWQPALPNINLGVGN

SEQ ID NO: 1458582 - protein, 20 aa, Mycobacterium tuberculosis
AQRAWAEGRFDREISPIQAP

SEQ ID NO: 1458583 - protein, 27 aa, Mycobacterium tuberculosis
AQSPKETWLRLLLIRAGFPRPQTQIAV

SEQ ID NO: 1458584 - protein, 22 aa, Mycobacterium tuberculosis
AQVTEFDGGVLVNWDVREGVFA

SEQ ID NO: 1458585 - protein, 22 aa, Mycobacterium tuberculosis
AQVYRRARGCPGLGMRVQDRGA

SEQ ID NO: 1458586 - protein, 20 aa, Mycobacterium tuberculosis
ARAFVNRPLVLLADEPTGNL

SEQ ID NO: 1458587 - protein, 17 aa, Mycobacterium tuberculosis
ARAGRAAADYAARHQKS

SEQ ID NO: 1458588 - protein, 18 aa, Mycobacterium tuberculosis
ARALTLAARFQSALDGTL

SEQ ID NO: 1458589 - protein, 18 aa, Mycobacterium tuberculosis
ARCMIAAGALVVAGTQIP

SEQ ID NO: 1458590 - protein, 20 aa, Mycobacterium tuberculosis
AREALIKTDIFGSAADVEKL

SEQ ID NO: 1458591 - protein, 26 aa, Mycobacterium tuberculosis
AREKLFPLICRYAVAYHVVFIPSAEV

SEQ ID NO: 1458592 - protein, 21 aa, Mycobacterium tuberculosis
ARELSNLVELARRTAAADDPL

SEQ ID NO: 1458593 - protein, 33 aa, Mycobacterium tuberculosis; identical to SEQ ID NO: 78145

SEQ ID NO: 1458594 - protein, 18 aa, Mycobacterium tuberculosis
ARFARDWLSEDLARLPVG

SEQ ID NO: 1458595 - protein, 20 aa, Mycobacterium tuberculosis
ARFDGWFVVAVLTTGVYCRP

SEQ ID NO: 1458596 - protein, 18 aa, Mycobacterium tuberculosis
ARHLEVERKFDVIESTVS

SEQ ID NO: 1458597 - protein, 21 aa, Mycobacterium tuberculosis
ARHRARRLAGRVVHDATCSIG

SEQ ID NO: 1458598 - protein, 20 aa, Mycobacterium tuberculosis
ARIAFLIRFGTGVLPEPKTV

SEQ ID NO: 1458599 - protein, 20 aa, Mycobacterium tuberculosis
ARKKPPFGIGQIGKSFRNEI

SEQ ID NO: 1458600 - protein, 24 aa, Mycobacterium tuberculosis
ARLAERRPAAALCEIVSPDNPVQM

SEQ ID NO: 1458601 - protein, 19 aa, Mycobacterium tuberculosis
ARLPGRAAGALLFTCNGRG

SEQ ID NO: 1458602 - protein, 19 aa, Mycobacterium tuberculosis
ARLSRRGRRLGLTDTNNGL

SEQ ID NO: 1458603 - protein, 22 aa, Mycobacterium tuberculosis
ARLWPDGLLALLEPRIGRRAAN

SEQ ID NO: 1458604 - protein, 18 aa, Mycobacterium tuberculosis
ARLYLCTDARRERGDLAQ

SEQ ID NO: 1458605 - protein, 20 aa, Mycobacterium tuberculosis
ARMLRTAWTDEWDRPDSPDP

SEQ ID NO: 1458606 - protein, 25 aa, Mycobacterium tuberculosis
ARPTGAFGRLLGRIWRAETADVNRI

SEQ ID NO: 1458607 - protein, 18 aa, Mycobacterium tuberculosis
ARQLPGRLVGVSVDSDGT

SEQ ID NO: 1458608 - protein, 17 aa, Mycobacterium tuberculosis
ARSCIILVFHRVADNPG

SEQ ID NO: 1458609 - protein, 18 aa, Mycobacterium tuberculosis
ARSGTPVQVLGFREHASW

SEQ ID NO: 1458610 - protein, 23 aa, Mycobacterium tuberculosis
ARSLVSEVLEFLATAGTNYNKTV

SEQ ID NO: 1458611 - protein, 27 aa, Mycobacterium tuberculosis
ARSWAETLWRMSVSIAGAVCTAAARAV

SEQ ID NO: 1458612 - protein, 17 aa, Mycobacterium tuberculosis
ARVAALEANQADYRAVL

SEQ ID NO: 1458613 - protein, 18 aa, Mycobacterium tuberculosis
ARVAECLAAIEAPLVITP

SEQ ID NO: 1458614 - protein, 23 aa, Mycobacterium tuberculosis
ARVAELLDIVGLRHGDASRYPAE

SEQ ID NO: 1458615 - protein, 18 aa, Mycobacterium tuberculosis
ARVGNVLYRDFQPVAVLD

SEQ ID NO: 1458616 - protein, 22 aa, Mycobacterium tuberculosis
ARVLQALLARWDHHPRVDLVTT

SEQ ID NO: 1458617 - protein, 23 aa, Mycobacterium tuberculosis
ARVVSMPCLEWFEAQPYEYRDAV

SEQ ID NO: 1458618 - protein, 25 aa, Mycobacterium tuberculosis
ARYAELNTAIGTNWFPGTTPEVVSY

SEQ ID NO: 1458619 - protein, 17 aa, Mycobacterium tuberculosis
ARYWHSYWSKFSDKGYY

SEQ ID NO: 1458620 - protein, 24 aa, Mycobacterium tuberculosis
ASASELRDGLCFVDLAPITESGIV

SEQ ID NO: 1458621 - protein, 23 aa, Mycobacterium tuberculosis
ASATIDAARDWLLGTPADDWVSM

SEQ ID NO: 1458622 - protein, 24 aa, Mycobacterium tuberculosis
ASELHCAAMSFGSVTSGLVVGWWQ

SEQ ID NO: 1458623 - protein, 20 aa, Mycobacterium tuberculosis
ASFDIPWLVIRALSDLAGAD

SEQ ID NO: 1458624 - protein, 18 aa, Mycobacterium tuberculosis
ASFGPWADLVPHLDDLVA

SEQ ID NO: 1458625 - protein, 25 aa, Mycobacterium tuberculosis
ASFVDDFVLYWGFLALAQVRSGRRT

SEQ ID NO: 1458626 - protein, 20 aa, Mycobacterium tuberculosis
ASGIPGDWALYDVDGKNGEH

SEQ ID NO: 1458627 - protein, 19 aa, Mycobacterium tuberculosis
ASHNGMWDLSMLGIVPGIR

SEQ ID NO: 1458628 - protein, 18 aa, Mycobacterium tuberculosis
ASIAGLFLTTEAVVADKP

SEQ ID NO: 1458629 - protein, 18 aa, Mycobacterium tuberculosis
ASIDLCRAKHRLPGLQFV

SEQ ID NO: 1458630 - protein, 19 aa, Mycobacterium tuberculosis
ASNTHRWFGAYGVTKSAVD

SEQ ID NO: 1458631 - protein, 27 aa, Mycobacterium tuberculosis
ASPGYPCYRNILSALGCEVVEIPCGPQ

SEQ ID NO: 1458632 - protein, 21 aa, Mycobacterium tuberculosis
ASRGHARGCGPLRQVVSRRVA

SEQ ID NO: 1458633 - protein, 27 aa, Mycobacterium tuberculosis
ASSGLGLQCARALLRRDASWHVVLAVR

SEQ ID NO: 1458634 - protein, 24 aa, Mycobacterium tuberculosis
ASVGGLKVPAVWTATTPAASPAVL

SEQ ID NO: 1458635 - protein, 23 aa, Mycobacterium tuberculosis
ASVPRWLQRPARLVIQSVLGRVR

SEQ ID NO: 1458636 - protein, 25 aa, Mycobacterium tuberculosis
ASVSCAIQNLWLAARSEGLGMGWVS

SEQ ID NO: 1458637 - protein, 17 aa, Mycobacterium tuberculosis
ATARPPTFVLFTTGFLE

SEQ ID NO: 1458638 - protein, 26 aa, Mycobacterium tuberculosis
ATAYLECAQACGLGLLGGPPTPETAL

SEQ ID NO: 1458639 - protein, 19 aa, Mycobacterium tuberculosis
ATEALNLVSYVLGDSRFER

SEQ ID NO: 1458640 - protein, 22 aa, Mycobacterium tuberculosis
ATELLLAMVRRLSVADTGIELL

SEQ ID NO: 1458641 - protein, 35 aa, Mycobacterium tuberculosis; identical to SEQ ID NO: 197157

SEQ ID NO: 1458642 - protein, 23 aa, Mycobacterium tuberculosis
ATGRAVGVLADLQGPKIRLGRFA

SEQ ID NO: 1458643 - protein, 27 aa, Mycobacterium tuberculosis
ATGVKRQEDFIGIHFFSPVDKMPLVEI

SEQ ID NO: 1458644 - protein, 18 aa, Mycobacterium tuberculosis
ATLDRYNAYAARGADPDF

SEQ ID NO: 1458645 - protein, 17 aa, Mycobacterium tuberculosis
ATLTFRDPKELRFFTRT

SEQ ID NO: 1458646 - protein, 24 aa, Mycobacterium tuberculosis
ATRAEGVACYQLFISGLLDVTDNV

SEQ ID NO: 1458647 - protein, 27 aa, Mycobacterium tuberculosis
ATRSGDVWLLNGFKWFASNCAGEAFVV

SEQ ID NO: 1458648 - protein, 17 aa, Mycobacterium tuberculosis
ATVGVIHFFATHGTSMT

SEQ ID NO: 1458649 - protein, 19 aa, Mycobacterium tuberculosis
ATYRPGQAVEAVFVSALPN

SEQ ID NO: 1458650 - protein, 17 aa, Mycobacterium tuberculosis
AVADFMADHVFNRLDIP

SEQ ID NO: 1458651 - protein, 17 aa, Mycobacterium tuberculosis
AVAGGGGRGMRRVGDIA

SEQ ID NO: 1458652 - protein, 22 aa, Mycobacterium tuberculosis
AVDPAVVVLLNLSRDQLDRVGE

SEQ ID NO: 1458653 - protein, 24 aa, Mycobacterium tuberculosis
AVDRAILRVSVWELLHAADVPEPV

SEQ ID NO: 1458654 - protein, 18 aa, Mycobacterium tuberculosis
AVEFGFVAHRGMTVLPLA

SEQ ID NO: 1458655 - protein, 17 aa, Mycobacterium tuberculosis
AVFADRGAHVVLAVRNL

SEQ ID NO: 1458656 - protein, 17 aa, Mycobacterium tuberculosis
AVGKLYVQRHFPPDAKS

SEQ ID NO: 1458657 - protein, 18 aa, Mycobacterium tuberculosis
AVHTLPMLYALREQTPDT

SEQ ID NO: 1458658 - protein, 25 aa, Mycobacterium tuberculosis
AVIRAEADLARFPADVARVVVRLIH

SEQ ID NO: 1458659 - protein, 23 aa, Mycobacterium tuberculosis
AVKHLCAQMLCRAEQADVAAADA

SEQ ID NO: 1458660 - protein, 23 aa, Mycobacterium tuberculosis
AVKSSLRTAVRAFREAAHAGDKA

SEQ ID NO: 1458661 - protein, 20 aa, Mycobacterium tuberculosis
AVMSCGTLRELLTIAMRYFA

SEQ ID NO: 1458662 - protein, 18 aa, Mycobacterium tuberculosis
AVNTAAWYVNAAIPTAIF

SEQ ID NO: 1458663 - protein, 25 aa, Mycobacterium tuberculosis
AVPLAKACARIMLGATIAQLRAEGL

SEQ ID NO: 1458664 - protein, 18 aa, Mycobacterium tuberculosis
AVRDGRPTVLQSLTEDPA

SEQ ID NO: 1458665 - protein, 19 aa, Mycobacterium tuberculosis
AVRIGDWPAAYAIGEHLSV

SEQ ID NO: 1458666 - protein, 27 aa, Mycobacterium tuberculosis
AVRPRSCAALPRILRDNGYVTGAFGKW

SEQ ID NO: 1458667 - protein, 25 aa, Mycobacterium tuberculosis
AVRTFARRRIDAILADVAPADGPDD

SEQ ID NO: 1458668 - protein, 17 aa, Mycobacterium tuberculosis
AVTVFLAPPSWQDLQAR

SEQ ID NO: 1458669 - protein, 24 aa, Mycobacterium tuberculosis
AVVKQAAAFHSEFTRTLEAAGNAY

SEQ ID NO: 1458670 - protein, 18 aa, Mycobacterium tuberculosis
AWLAEGLLMYLPAEAQDR

SEQ ID NO: 1458671 - protein, 21 aa, Mycobacterium tuberculosis
AWSEGRDLWWHHVVGSASPAH

SEQ ID NO: 1458672 - protein, 18 aa, Mycobacterium tuberculosis
AWTNARQSYPVRVAHVLS

SEQ ID NO: 1458673 - protein, 21 aa, Mycobacterium tuberculosis
AWWPECSKEAYADGIAGAVEA

SEQ ID NO: 1458674 - protein, 23 aa, Mycobacterium tuberculosis
AYAEGLRALYLYAAAHQDDAVAQ

SEQ ID NO: 1458675 - protein, 19 aa, Mycobacterium tuberculosis
AYGPAGFLQYQFVIPTEAV

SEQ ID NO: 1458676 - protein, 33 aa, Mycobacterium tuberculosis; identical to SEQ ID NO: 210617

SEQ ID NO: 1458677 - protein, 18 aa, Mycobacterium tuberculosis
AYSTRLKITPTRVWTTPT

SEQ ID NO: 1458678 - protein, 25 aa, Mycobacterium tuberculosis
CAALSTRWCSMRVQLQGSAGGRIET

SEQ ID NO: 1458679 - protein, 20 aa, Mycobacterium tuberculosis
CAASLRVALARVHPRATGIV

SEQ ID NO: 1458680 - protein, 21 aa, Mycobacterium tuberculosis
CALPLHRRFGLAATARASFAV

SEQ ID NO: 1458681 - protein, 18 aa, Mycobacterium tuberculosis
CALSESKIAATAHILDTE

SEQ ID NO: 1458682 - protein, 19 aa, Mycobacterium tuberculosis
CAMVGCPIVGINDSGGARI

SEQ ID NO: 1458683 - protein, 27 aa, Mycobacterium tuberculosis
CANCRGGEYRRCVRHGLADMYGFIPVD

SEQ ID NO: 1458684 - protein, 25 aa, Mycobacterium tuberculosis
CDFWFPPIELPVGFGQTRTAKQLPV

SEQ ID NO: 1458685 - protein, 18 aa, Mycobacterium tuberculosis
CEGPEPGDSLTLRYAGAR

SEQ ID NO: 1458686 - protein, 20 aa, Mycobacterium tuberculosis
CEVVRRLKAAGAVIVGKTNT

SEQ ID NO: 1458687 - protein, 19 aa, Mycobacterium tuberculosis
CFSNAMPPDEEWPRSTVSE

SEQ ID NO: 1458688 - protein, 28 aa, Mycobacterium tuberculosis
CFVVCSEILPRWGVQTVFVDGDDLSQWE

SEQ ID NO: 1458689 - protein, 35 aa, Mycobacterium tuberculosis; identical to SEQ ID NO: 197430

SEQ ID NO: 1458690 - protein, 20 aa, Mycobacterium tuberculosis
CIAAKRFIVHADIYDDFVDK

SEQ ID NO: 1458691 - protein, 18 aa, Mycobacterium tuberculosis
CNEFSEWQSAGLGHDALL

SEQ ID NO: 1458692 - protein, 17 aa, Mycobacterium tuberculosis
CPDLDTCMYTLGGGVDP

SEQ ID NO: 1458693 - protein, 19 aa, Mycobacterium tuberculosis
CPPAGTGTHHYRFTLYHLP

SEQ ID NO: 1458694 - protein, 22 aa, Mycobacterium tuberculosis
CQLDRIGARLAEPLRIALAGTL

SEQ ID NO: 1458695 - protein, 19 aa, Mycobacterium tuberculosis
CQRAIGITLARMMSRRQFG

SEQ ID NO: 1458696 - protein, 17 aa, Mycobacterium tuberculosis
CQSILGYVVRWVDQGVG

SEQ ID NO: 1458697 - protein, 27 aa, Mycobacterium tuberculosis
CRASLDRLGLDYVDLYLIHWPAPPVGK

SEQ ID NO: 1458698 - protein, 18 aa, Mycobacterium tuberculosis
CRGLARVDFFLTDDGPVI

SEQ ID NO: 1458699 - protein, 17 aa, Mycobacterium tuberculosis
CRHCPVMQECAADALDN

SEQ ID NO: 1458700 - protein, 18 aa, Mycobacterium tuberculosis
CRLDCRRRGPAVPQRDPP

SEQ ID NO: 1458701 - protein, 19 aa, Mycobacterium tuberculosis
CRQIMLYHLDRGWADHLAY

SEQ ID NO: 1458702 - protein, 18 aa, Mycobacterium tuberculosis
CRQVPVHHSFAYRSYSWY

SEQ ID NO: 1458703 - protein, 19 aa, Mycobacterium tuberculosis
CSAMARSYLGPEFDIHCGG

SEQ ID NO: 1458704 - protein, 17 aa, Mycobacterium tuberculosis
CTPTRPKEFIALLDELL

SEQ ID NO: 1458705 - protein, 18 aa, Mycobacterium tuberculosis
CTYREGLSAVRVAGGVAG

SEQ ID NO: 1458706 - protein, 17 aa, Mycobacterium tuberculosis
CVGSDWCRYGQQDSVQL

SEQ ID NO: 1458707 - protein, 21 aa, Mycobacterium tuberculosis
CVTSVKWARLDSAPFTDRLVR

SEQ ID NO: 1458708 - protein, 19 aa, Mycobacterium tuberculosis
CYGAAGVAMGTRFLLTSDS

SEQ ID NO: 1458709 - protein, 20 aa, Mycobacterium tuberculosis
DAALRVLAPLGLVFDENSPW

SEQ ID NO: 1458710 - protein, 19 aa, Mycobacterium tuberculosis
DAARSFVAAPGRAMTSAGL

SEQ ID NO: 1458711 - protein, 18 aa, Mycobacterium tuberculosis
DACAHALLDAISRLPQIP

SEQ ID NO: 1458712 - protein, 25 aa, Mycobacterium tuberculosis
DAGADYRPACDVMLALVAQLDPGQR

SEQ ID NO: 1458713 - protein, 22 aa, Mycobacterium tuberculosis
DAGLHWFRAALDARPADESIID

SEQ ID NO: 1458714 - protein, 26 aa, Mycobacterium tuberculosis
DAIPCSAPLPAPRVSPYPAVFQDVSL

SEQ ID NO: 1458715 - protein, 24 aa, Mycobacterium tuberculosis
DALAADVRRADCQIVVTDADHRAL

SEQ ID NO: 1458716 - protein, 17 aa, Mycobacterium tuberculosis
DALRGYASITVVERSIA

SEQ ID NO: 1458717 - protein, 21 aa, Mycobacterium tuberculosis
DALRPLTAVVRSARMSAVTAI

SEQ ID NO: 1458718 - protein, 18 aa, Mycobacterium tuberculosis
DAPCEPVPIRTPLAETVG

SEQ ID NO: 1458719 - protein, 21 aa, Mycobacterium tuberculosis
DAPLPAWTHARLFIDDDGQEQ

SEQ ID NO: 1458720 - protein, 18 aa, Mycobacterium tuberculosis
DAPWKDIEAQGWIAPAEC

SEQ ID NO: 1458721 - protein, 24 aa, Mycobacterium tuberculosis
DAQAWAAEIARLAPLAIQHAKRVL

SEQ ID NO: 1458722 - protein, 27 aa, Mycobacterium tuberculosis
DAVDLWGADGAEGWTADPIIGVGSAAT

SEQ ID NO: 1458723 - protein, 24 aa, Mycobacterium tuberculosis
DAVRATREFLVWAVNDAIERGELA

SEQ ID NO: 1458724 - protein, 19 aa, Mycobacterium tuberculosis
DAVVCAYVALYAQRRPADV

SEQ ID NO: 1458725 - protein, 25 aa, Mycobacterium tuberculosis
DCGADFRLTDAAVWERFYGSSHAGS

SEQ ID NO: 1458726 - protein, 23 aa, Mycobacterium tuberculosis
DDGIGLDEFVDWLNSPTSGSGCT

SEQ ID NO: 1458727 - protein, 23 aa, Mycobacterium tuberculosis
DDIAQRGWPVFCVSTATRENLQP

SEQ ID NO: 1458728 - protein, 23 aa, Mycobacterium tuberculosis
DDMSVGQLVKWARESIGRTEKID

SEQ ID NO: 1458729 - protein, 26 aa, Mycobacterium tuberculosis
DDPNWFRFHQMFADFLHRRLERGGSH

SEQ ID NO: 1458730 - protein, 20 aa, Mycobacterium tuberculosis
DDSRLRWLRAGEVPTLGNWF

SEQ ID NO: 1458731 - protein, 18 aa, Mycobacterium tuberculosis
DDTHLRAIAQLNFANARR

SEQ ID NO: 1458732 - protein, 18 aa, Mycobacterium tuberculosis
DDVHGWLDLVLDGPLASE

SEQ ID NO: 1458733 - protein, 19 aa, Mycobacterium tuberculosis
DDVSAHPASIGFPPYHPPM

SEQ ID NO: 1458734 - protein, 22 aa, Mycobacterium tuberculosis
DEAFPRLSVIRAPRHDRVVGPF

SEQ ID NO: 1458735 - protein, 20 aa, Mycobacterium tuberculosis
DEFRASKIMLDRARNNDKIR

SEQ ID NO: 1458736 - protein, 18 aa, Mycobacterium tuberculosis
DEKPCPRERPPADQLAAF

SEQ ID NO: 1458737 - protein, 24 aa, Mycobacterium tuberculosis
DEKVEYVDVRFCDLPGIMQHFTIP

SEQ ID NO: 1458738 - protein, 31 aa, Mycobacterium tuberculosis; identical to SEQ ID NO: 197701

SEQ ID NO: 1458739 - protein, 18 aa, Mycobacterium tuberculosis
DEMICGMAEVVKAGFIAD

SEQ ID NO: 1458740 - protein, 19 aa, Mycobacterium tuberculosis
DEQWQCDRCSVVHQRDDCA

SEQ ID NO: 1458741 - protein, 21 aa, Mycobacterium tuberculosis
DETNFEYGLECILDHAGRLIE

SEQ ID NO: 1458742 - protein, 23 aa, Mycobacterium tuberculosis
DFAYDVSHLELPLPADGSTMPST

SEQ ID NO: 1458743 - protein, 23 aa, Mycobacterium tuberculosis
DFKQCPLLYRFRAIDRLPEATSA

SEQ ID NO: 1458744 - protein, 22 aa, Mycobacterium tuberculosis
DGEARQGRRGRRFRDRRRRGER

SEQ ID NO: 1458745 - protein, 25 aa, Mycobacterium tuberculosis
DGEFVKFGPSWAWPKPVQPHIPVLV

SEQ ID NO: 1458746 - protein, 22 aa, Mycobacterium tuberculosis
DGGDPKGALVPTSWSHAMAVAA

SEQ ID NO: 1458747 - protein, 25 aa, Mycobacterium tuberculosis
DGGLPTDHPAVWNHPVVDPHTVEPD

SEQ ID NO: 1458748 - protein, 21 aa, Mycobacterium tuberculosis
DGISEFLERIAVQAGSGGTPL

SEQ ID NO: 1458749 - protein, 18 aa, Mycobacterium tuberculosis
DGLYRLTPTTGRTHQLRV

SEQ ID NO: 1458750 - protein, 26 aa, Mycobacterium tuberculosis
DGMGGLRLLLSLARAYAGEPDEVGGP

SEQ ID NO: 1458751 - protein, 28 aa, Mycobacterium tuberculosis
DGRLGVGWPKEFGGLGFGPIEQQIFVNE

SEQ ID NO: 1458752 - protein, 24 aa, Mycobacterium tuberculosis
DGVADFLAARGIRLPPGSPTDLTD

SEQ ID NO: 1458753 - protein, 17 aa, Mycobacterium tuberculosis
DGVRFCAVCGNVSDNER

SEQ ID NO: 1458754 - protein, 18 aa, Mycobacterium tuberculosis
DHGGRWCRHRSLQRRLHR

SEQ ID NO: 1458755 - protein, 19 aa, Mycobacterium tuberculosis
DHMHACGVVDIATGLASTP

SEQ ID NO: 1458756 - protein, 23 aa, Mycobacterium tuberculosis
DHSRIPMWVEETLRYDTSSQILA

SEQ ID NO: 1458757 - protein, 18 aa, Mycobacterium tuberculosis
DIEAQGWIAPAECVEVRV

SEQ ID NO: 1458758 - protein, 24 aa, Mycobacterium tuberculosis
DIEEFSRRFGVQVEDGFGSTENAV

SEQ ID NO: 1458759 - protein, 22 aa, Mycobacterium tuberculosis
DIGKHFSVNVMLARDTIRRRLA

SEQ ID NO: 1458760 - protein, 19 aa, Mycobacterium tuberculosis
DITARRGALLVLDEVQTGM

SEQ ID NO: 1458761 - protein, 26 aa, Mycobacterium tuberculosis
DIVPRYRTMRGYKVERRFGWDTHGLP

SEQ ID NO: 1458762 - protein, 29 aa, Mycobacterium tuberculosis
DKAKAAPLWRVLVALSIRHVGPTAARALA

SEQ ID NO: 1458763 - protein, 23 aa, Mycobacterium tuberculosis
DKDIPHLTAAIIAKYISNLRLLG

SEQ ID NO: 1458764 - protein, 23 aa, Mycobacterium tuberculosis
DKLPRYIAGVLARLQEVWLGRQI

SEQ ID NO: 1458765 - protein, 18 aa, Mycobacterium tuberculosis
DKNPELEPLLSQAIEAAT

SEQ ID NO: 1458766 - protein, 24 aa, Mycobacterium tuberculosis
DKPPGVAETIDWVAALVALGVADL

SEQ ID NO: 1458767 - protein, 22 aa, Mycobacterium tuberculosis
DKVLGYRNWLGLNKGDLAAAVD

SEQ ID NO: 1458768 - protein, 18 aa, Mycobacterium tuberculosis
DKWHRRRVIEPIDMDAYR

SEQ ID NO: 1458769 - protein, 24 aa, Mycobacterium tuberculosis
DLAGRPRFVTAMRWGHLPLAGENG

SEQ ID NO: 1458770 - protein, 27 aa, Mycobacterium tuberculosis
DLALDKLHLEPGMTLLDIGCGWGGGLQ

SEQ ID NO: 1458771 - protein, 20 aa, Mycobacterium tuberculosis
DLATPGFLSGIGNFGTNLAG

SEQ ID NO: 1458772 - protein, 20 aa, Mycobacterium tuberculosis
DLKQRPVVIEAAAQGCSPDQ

SEQ ID NO: 1458773 - protein, 25 aa, Mycobacterium tuberculosis
DLLERGRYDLVLALASTHTGDGTVE

SEQ ID NO: 1458774 - protein, 29 aa, Mycobacterium tuberculosis
DLPKLGERLNLPAGWSYHTRVLTSELRVD

SEQ ID NO: 1458775 - protein, 19 aa, Mycobacterium tuberculosis
DLRGITKLTGITVDDVAKR

SEQ ID NO: 1458776 - protein, 24 aa, Mycobacterium tuberculosis
DLSTLRFALSGAEPVEPADVEDLL

SEQ ID NO: 1458777 - protein, 25 aa, Mycobacterium tuberculosis
DLTFRRRSCCLFYRVPAGGKCGDCP

SEQ ID NO: 1458778 - protein, 31 aa, Mycobacterium tuberculosis; identical to SEQ ID NO: 197942

SEQ ID NO: 1458779 - protein, 29 aa, Mycobacterium tuberculosis
DMLRCRRWCSGTSNRWCEMRVRVDGRKGG

SEQ ID NO: 1458780 - protein, 22 aa, Mycobacterium tuberculosis
DPAKRLAQALGINDLGNTPQRV

SEQ ID NO: 1458781 - protein, 25 aa, Mycobacterium tuberculosis
DPATVRYLREFRFRGDIDGYAEGEL

SEQ ID NO: 1458782 - protein, 23 aa, Mycobacterium tuberculosis
DPGVISYLWRTARMGVEDIESML

SEQ ID NO: 1458783 - protein, 19 aa, Mycobacterium tuberculosis
DPLDSVYFAGYAMWNYLTT

SEQ ID NO: 1458784 - protein, 25 aa, Mycobacterium tuberculosis
DPRPPMITSGLRIGTPALAARGFSH

SEQ ID NO: 1458785 - protein, 17 aa, Mycobacterium tuberculosis
DPTWVYTCAYFERDDMT

SEQ ID NO: 1458786 - protein, 18 aa, Mycobacterium tuberculosis
DPVRLAALRKVMPRLLNV

SEQ ID NO: 1458787 - protein, 17 aa, Mycobacterium tuberculosis
DPYPHYRELLAGERVQY

SEQ ID NO: 1458788 - protein, 18 aa, Mycobacterium tuberculosis
DQDIKVIVLRGAGRAFSG

SEQ ID NO: 1458789 - protein, 17 aa, Mycobacterium tuberculosis
DQLRLTGTHWGCDTSNC

SEQ ID NO: 1458790 - protein, 22 aa, Mycobacterium tuberculosis
DQLRRHGWKGFGPVPYSHQPNR

SEQ ID NO: 1458791 - protein, 25 aa, Mycobacterium tuberculosis
DREREVAELLLLGMPYRDIGARLFI

SEQ ID NO: 1458792 - protein, 26 aa, Mycobacterium tuberculosis
DRFNELVMRAGLTWQQVVLLRAYAKY

SEQ ID NO: 1458793 - protein, 20 aa, Mycobacterium tuberculosis
DRHLRYPLRDVIWGHDQDLL

SEQ ID NO: 1458794 - protein, 18 aa, Mycobacterium tuberculosis
DRIRWNAKYECADPTEAV

SEQ ID NO: 1458795 - protein, 18 aa, Mycobacterium tuberculosis
DRITAWGLAGEPSLKQFV

SEQ ID NO: 1458796 - protein, 21 aa, Mycobacterium tuberculosis
DRLIYATAIEHGWRLVTKDRR

SEQ ID NO: 1458797 - protein, 25 aa, Mycobacterium tuberculosis
DRLSDQEIMAFLFLMVIAGNETTTK

SEQ ID NO: 1458798 - protein, 19 aa, Mycobacterium tuberculosis
DRPALPAALTILRDITAGS

SEQ ID NO: 1458799 - protein, 22 aa, Mycobacterium tuberculosis
DRSRQLAAIGCHFTQSADNPVL

SEQ ID NO: 1458800 - protein, 20 aa, Mycobacterium tuberculosis
DRVAELARMLAGLGDSDSGR

SEQ ID NO: 1458801 - protein, 24 aa, Mycobacterium tuberculosis
DRWHSLARLAIRDDIYGALRSLCF

SEQ ID NO: 1458802 - protein, 25 aa, Mycobacterium tuberculosis
DSAGRLRIGAAVGINGDVGAKARAL

SEQ ID NO: 1458803 - protein, 17 aa, Mycobacterium tuberculosis
DSLAITWAHPELPQRAF

SEQ ID NO: 1458804 - protein, 20 aa, Mycobacterium tuberculosis
DSLDWPDYIGQLSVEGSAGA

SEQ ID NO: 1458805 - protein, 18 aa, Mycobacterium tuberculosis
DSMLVKLTCRGRDLPTAV

SEQ ID NO: 1458806 - protein, 24 aa, Mycobacterium tuberculosis
DTEIPSPAAGVLTKIIAQEDDTVE

SEQ ID NO: 1458807 - protein, 24 aa, Mycobacterium tuberculosis
DTQLPNWWGPILAPALAGVGALRG

SEQ ID NO: 1458808 - protein, 18 aa, Mycobacterium tuberculosis
DVEALALAAGERFGPDRV

SEQ ID NO: 1458809 - protein, 25 aa, Mycobacterium tuberculosis
DVIEVPGLLDLSSLWQIYAVDRPTL

SEQ ID NO: 1458810 - protein, 18 aa, Mycobacterium tuberculosis
DVLPLWVAEMDVKLPPTV

SEQ ID NO: 1458811 - protein, 17 aa, Mycobacterium tuberculosis
DVMLDWDPTTAYSCQQG

SEQ ID NO: 1458812 - protein, 22 aa, Mycobacterium tuberculosis
DVTEQFGTPGWIISQGPQVLLD

SEQ ID NO: 1458813 - protein, 26 aa, Mycobacterium tuberculosis
DVVAELRAGLPPTLAVAGSYLDGIGV

SEQ ID NO: 1458814 - protein, 22 aa, Mycobacterium tuberculosis
DVVGGSCRFVLSGYSSGGVLAY

SEQ ID NO: 1458815 - protein, 23 aa, Mycobacterium tuberculosis
DWDDELLSLFSIPRAMLPEIASS

SEQ ID NO: 1458816 - protein, 21 aa, Mycobacterium tuberculosis
DWPAEAVVVGPLHFEPTDRVL

SEQ ID NO: 1458817 - protein, 20 aa, Mycobacterium tuberculosis
DWPHIGVALMQPRARGRITL

SEQ ID NO: 1458818 - protein, 18 aa, Mycobacterium tuberculosis
DWVSMAVVSDGSYGVPEG

SEQ ID NO: 1458819 - protein, 19 aa, Mycobacterium tuberculosis
EAAAVYDLFVKTLGVSAGT

SEQ ID NO: 1458820 - protein, 20 aa, Mycobacterium tuberculosis
EAAGRLMFYGQGAGGAPTAS

SEQ ID NO: 1458821 - protein, 24 aa, Mycobacterium tuberculosis
EAALAIRAGALWVAANVDPTLPTE

SEQ ID NO: 1458822 - protein, 23 aa, Mycobacterium tuberculosis
EAELKAALWELIWAGRVTGDTFA

SEQ ID NO: 1458823 - protein, 24 aa, Mycobacterium tuberculosis
EAFVAAYMPFLAWLIQASADCVEM

SEQ ID NO: 1458824 - protein, 19 aa, Mycobacterium tuberculosis
EAGKARWAAQEEIVDLIAN

SEQ ID NO: 1458825 - protein, 22 aa, Mycobacterium tuberculosis
EALGKIYAGMGIVRHPEIREVR

SEQ ID NO: 1458826 - protein, 19 aa, Mycobacterium tuberculosis
EAPGACVVVNPCLAGGSLE

SEQ ID NO: 1458827 - protein, 28 aa, Mycobacterium tuberculosis
EARPRAGILRAREFVMKDSYSFDIDAAG

SEQ ID NO: 1458828 - protein, 28 aa, Mycobacterium tuberculosis
EARTRAIARLGSFFSDRRMAALRAAEVV

SEQ ID NO: 1458829 - protein, 22 aa, Mycobacterium tuberculosis
EASYFGPSFMINWLHNRYGNYK

SEQ ID NO: 1458830 - protein, 26 aa, Mycobacterium tuberculosis
EAVGACSRGLMSRADVDAIERAICPG

SEQ ID NO: 1458831 - protein, 18 aa, Mycobacterium tuberculosis
EAVNLFRANVIDVSPESL

SEQ ID NO: 1458832 - protein, 25 aa, Mycobacterium tuberculosis
EAVRAAMVQPALVAANRSDLVSLVF

SEQ ID NO: 1458833 - protein, 17 aa, Mycobacterium tuberculosis
EAVSGWATKQPQVWWTS

SEQ ID NO: 1458834 - protein, 18 aa, Mycobacterium tuberculosis
ECEFIIRLLPDGVMSNYL

SEQ ID NO: 1458835 - protein, 24 aa, Mycobacterium tuberculosis
EDCHFCSQSGLFASPVRSAWLDIP

SEQ ID NO: 1458836 - protein, 18 aa, Mycobacterium tuberculosis
EEAVFRIDHYLGKETVQN

SEQ ID NO: 1458837 - protein, 25 aa, Mycobacterium tuberculosis
EEHRKAFRRTIKWRTGCEGRISHLK

SEQ ID NO: 1458838 - protein, 17 aa, Mycobacterium tuberculosis
EELRVGTPRGPNLFENM

SEQ ID NO: 1458839 - protein, 35 aa, Mycobacterium tuberculosis; identical to SEQ ID NO: 198421

SEQ ID NO: 1458840 - protein, 19 aa, Mycobacterium tuberculosis
EEVLACAHAGIPVTVVPGV

SEQ ID NO: 1458841 - protein, 24 aa, Mycobacterium tuberculosis
EEVREYLAQLGFRTVNEAVGQAGA

SEQ ID NO: 1458842 - protein, 25 aa, Mycobacterium tuberculosis
EFAWLRSRLPTLWTNSYFVATVGGF

SEQ ID NO: 1458843 - protein, 18 aa, Mycobacterium tuberculosis
EFIAYRYALATGIIDETG

SEQ ID NO: 1458844 - protein, 17 aa, Mycobacterium tuberculosis
EFTEAWTTFATVEKSWA

SEQ ID NO: 1458845 - protein, 17 aa, Mycobacterium tuberculosis
EGALYLRMDDFPARLVV

SEQ ID NO: 1458846 - protein, 19 aa, Mycobacterium tuberculosis
EGFARWLRESAAVGVTDTT

SEQ ID NO: 1458847 - protein, 31 aa, Mycobacterium tuberculosis; identical to SEQ ID NO: 198468

SEQ ID NO: 1458848 - protein, 20 aa, Mycobacterium tuberculosis
EGIAWRFRTGSPWRDLPAEF

SEQ ID NO: 1458849 - protein, 24 aa, Mycobacterium tuberculosis
EGPAALPWGDLGVDVVVESTGLFT

SEQ ID NO: 1458850 - protein, 20 aa, Mycobacterium tuberculosis
EGRDMLALTSSQWDITDPAA

SEQ ID NO: 1458851 - protein, 24 aa, Mycobacterium tuberculosis
EGVSGVREAACYEIPDEEFGALVG

SEQ ID NO: 1458852 - protein, 18 aa, Mycobacterium tuberculosis
EHRSCAKAQALVAERGFE

SEQ ID NO: 1458853 - protein, 25 aa, Mycobacterium tuberculosis
EIAQTVARWLVLYLRRPGGQTQFAA

SEQ ID NO: 1458854 - protein, 21 aa, Mycobacterium tuberculosis
EIPKSSLGAGLGLRSGLSAGL

SEQ ID NO: 1458855 - protein, 17 aa, Mycobacterium tuberculosis
EIRAVGIGELLARIDRL

SEQ ID NO: 1458856 - protein, 20 aa, Mycobacterium tuberculosis
EKFSPFSGFGYFTSGLSGFA

SEQ ID NO: 1458857 - protein, 17 aa, Mycobacterium tuberculosis
EKLEAFANFGFPESHAL

SEQ ID NO: 1458858 - protein, 19 aa, Mycobacterium tuberculosis
EKLRKAAGLLNLDDLAESA

SEQ ID NO: 1458859 - protein, 21 aa, Mycobacterium tuberculosis
ELEASLLLYFGGVSRLSSEVI

SEQ ID NO: 1458860 - protein, 21 aa, Mycobacterium tuberculosis
ELERVLARSAGILGIELGADA

SEQ ID NO: 1458861 - protein, 20 aa, Mycobacterium tuberculosis
ELGDLLLQVLFHARIAEDAS

SEQ ID NO: 1458862 - protein, 17 aa, Mycobacterium tuberculosis
ELIGFAARQRSASVGSH

SEQ ID NO: 1458863 - protein, 28 aa, Mycobacterium tuberculosis
ELIRVRISPAWLRLDARFGSVYRHRGHA

SEQ ID NO: 1458864 - protein, 21 aa, Mycobacterium tuberculosis
ELKPDPWLADVCREEMQRLGR

SEQ ID NO: 1458865 - protein, 19 aa, Mycobacterium tuberculosis
ELLGIPWVELNPHPLYLPS

SEQ ID NO: 1458866 - protein, 33 aa, Mycobacterium tuberculosis; identical to SEQ ID NO: 198615

SEQ ID NO: 1458867 - protein, 28 aa, Mycobacterium tuberculosis
ELLSVAAGMPFPLFVKAVAGGGGRGMRR

SEQ ID NO: 1458868 - protein, 22 aa, Mycobacterium tuberculosis
ELNLHLACYRAFDDIGSVIHSH

SEQ ID NO: 1458869 - protein, 19 aa, Mycobacterium tuberculosis
ELPPGLADFDLSKLKFPGK

SEQ ID NO: 1458870 - protein, 21 aa, Mycobacterium tuberculosis
ELPVLPRQRVLVISTGSELAS

SEQ ID NO: 1458871 - protein, 23 aa, Mycobacterium tuberculosis
ELQFGTNHLGHFALTGLVLDHML

SEQ ID NO: 1458872 - protein, 24 aa, Mycobacterium tuberculosis
ELSDLPGAVPRMYVVTRGAQRVLA

SEQ ID NO: 1458873 - protein, 24 aa, Mycobacterium tuberculosis
ELSENLPGYIFSGVAPVVTEMLWD

SEQ ID NO: 1458874 - protein, 25 aa, Mycobacterium tuberculosis
ELWPLRPDVRTLLCSSVMGVWGGHG

SEQ ID NO: 1458875 - protein, 23 aa, Mycobacterium tuberculosis
EMNPNGGMLARFPDLTLPTLDLT

SEQ ID NO: 1458876 - protein, 18 aa, Mycobacterium tuberculosis
EMRLPWDATKQRRFDALM

SEQ ID NO: 1458877 - protein, 29 aa, Mycobacterium tuberculosis
ENGQRLAATIPRARFEVIEGARTFSMVDS

SEQ ID NO: 1458878 - protein, 31 aa, Mycobacterium tuberculosis; identical to SEQ ID NO: 198668

SEQ ID NO: 1458879 - protein, 17 aa, Mycobacterium tuberculosis
ENPAGTVGEIWVQGDNV

SEQ ID NO: 1458880 - protein, 25 aa, Mycobacterium tuberculosis
EPLPEGSGFEFLDKVVGGAVPRQFI

SEQ ID NO: 1458881 - protein, 19 aa, Mycobacterium tuberculosis
EPLRPWKKEQLGGGYQVST

SEQ ID NO: 1458882 - protein, 19 aa, Mycobacterium tuberculosis
EPRYAALVRDCMDTADPRF

SEQ ID NO: 1458883 - protein, 26 aa, Mycobacterium tuberculosis
EQDQPWMISELDLRQMLHVTPGTVLV

SEQ ID NO: 1458884 - protein, 25 aa, Mycobacterium tuberculosis
EQFVKRLGTHAAIFTVPNFLELDYW

SEQ ID NO: 1458885 - protein, 20 aa, Mycobacterium tuberculosis
EQLHDLEWVNALGALTGNMA

SEQ ID NO: 1458886 - protein, 19 aa, Mycobacterium tuberculosis
ERAPAPALHRLTVGALRAV

SEQ ID NO: 1458887 - protein, 18 aa, Mycobacterium tuberculosis
ERAPDLQVAMPILPQQAL

SEQ ID NO: 1458888 - protein, 17 aa, Mycobacterium tuberculosis
ERARIMFMIGTLTPDRV

SEQ ID NO: 1458889 - protein, 26 aa, Mycobacterium tuberculosis
ERDWAPKAYGAWQLHRATADQPLDWF

SEQ ID NO: 1458890 - protein, 20 aa, Mycobacterium tuberculosis
ERFQQVESWLVAKPNTSVLI

SEQ ID NO: 1458891 - protein, 19 aa, Mycobacterium tuberculosis
ERIKALIGTKCRGDRAPEG

SEQ ID NO: 1458892 - protein, 22 aa, Mycobacterium tuberculosis
ERPRGMSYLVVRGRRGGSAMAA

SEQ ID NO: 1458893 - protein, 26 aa, Mycobacterium tuberculosis
ERSCFPSRHARFMVNYATHWTEARED

SEQ ID NO: 1458894 - protein, 26 aa, Mycobacterium tuberculosis
ERVLVHPRPRLSVMAVGGELVDISRT

SEQ ID NO: 1458895 - protein, 24 aa, Mycobacterium tuberculosis
ESCGKCTPCREGTFWLDKIYERLE

SEQ ID NO: 1458896 - protein, 21 aa, Mycobacterium tuberculosis
ESERRYLLCDATFEAWFERDG

SEQ ID NO: 1458897 - protein, 19 aa, Mycobacterium tuberculosis
ESLSREFRGLLDRVPPAKT

SEQ ID NO: 1458898 - protein, 18 aa, Mycobacterium tuberculosis
ETAFKRLLTNDGSNGESG

SEQ ID NO: 1458899 - protein, 24 aa, Mycobacterium tuberculosis
ETDEAGNLISEWDDTPEGFGRIAA

SEQ ID NO: 1458900 - protein, 27 aa, Mycobacterium tuberculosis
ETDKPFLMPVEDVFTITGRGTVVTGRV

SEQ ID NO: 1458901 - protein, 24 aa, Mycobacterium tuberculosis
ETGVRRFALRPVIGIDPAAVSPWW

SEQ ID NO: 1458902 - protein, 23 aa, Mycobacterium tuberculosis
ETMGDFMAATAYEVLRRQLETFT

SEQ ID NO: 1458903 - protein, 34 aa, Mycobacterium tuberculosis; identical to SEQ ID NO: 198852

SEQ ID NO: 1458904 - protein, 32 aa, Mycobacterium tuberculosis; identical to SEQ ID NO: 198862

SEQ ID NO: 1458905 - protein, 19 aa, Mycobacterium tuberculosis
EVAVLKILALQFIMSDPRH

SEQ ID NO: 1458906 - protein, 20 aa, Mycobacterium tuberculosis
EVIKNFKKGFAATGGGSVVP

SEQ ID NO: 1458907 - protein, 19 aa, Mycobacterium tuberculosis
EVLETEYLKRPLIDGPAPE

SEQ ID NO: 1458908 - protein, 25 aa, Mycobacterium tuberculosis
EVLSFLSVSSVDYWAYRPALQQVAA

SEQ ID NO: 1458909 - protein, 21 aa, Mycobacterium tuberculosis
EVNAGVYAFDIAALRSALSRL

SEQ ID NO: 1458910 - protein, 25 aa, Mycobacterium tuberculosis
EVPGAMARLGVWSGDGLQLDLHQPT

SEQ ID NO: 1458911 - protein, 23 aa, Mycobacterium tuberculosis
EVSALTAAQFAAHAQIYQAVSAQ

SEQ ID NO: 1458912 - protein, 18 aa, Mycobacterium tuberculosis
EWVIPRGYSIIINIAQIH

SEQ ID NO: 1458913 - protein, 25 aa, Mycobacterium tuberculosis
EYQRRLRAANALDFDDLIGETVAVL

SEQ ID NO: 1458914 - protein, 31 aa, Mycobacterium tuberculosis; identical to SEQ ID NO: 198944

SEQ ID NO: 1458915 - protein, 18 aa, Mycobacterium tuberculosis
FAERGHLSSKEWPGMLAF

SEQ ID NO: 1458916 - protein, 17 aa, Mycobacterium tuberculosis
FAGIDWRPSELGSPIIE

SEQ ID NO: 1458917 - protein, 18 aa, Mycobacterium tuberculosis
FAGKINRLAIMVRGNLAA

SEQ ID NO: 1458918 - protein, 17 aa, Mycobacterium tuberculosis
FAILAWRGREREDLLAN

SEQ ID NO: 1458919 - protein, 18 aa, Mycobacterium tuberculosis
FALLRAGAIPVMCLPGHR

SEQ ID NO: 1458920 - protein, 17 aa, Mycobacterium tuberculosis
FASRIGVTAQDLTAYLD

SEQ ID NO: 1458921 - protein, 20 aa, Mycobacterium tuberculosis
FAVRQGSGGAGRWRGGDGAV

SEQ ID NO: 1458922 - protein, 17 aa, Mycobacterium tuberculosis
FDAVCFTSSSTVRNLVG

SEQ ID NO: 1458923 - protein, 19 aa, Mycobacterium tuberculosis
FDDHPWNWAAHVAGQRTPR

SEQ ID NO: 1458924 - protein, 23 aa, Mycobacterium tuberculosis
FDIGKLRYHKIVLMADADVDGQH

SEQ ID NO: 1458925 - protein, 19 aa, Mycobacterium tuberculosis
FDPLRPSLVEMGRAVVREG

SEQ ID NO: 1458926 - protein, 23 aa, Mycobacterium tuberculosis
FDPQRLAALLAMPADAEPVAILC

SEQ ID NO: 1458927 - protein, 24 aa, Mycobacterium tuberculosis
FDPSRAMPAYNWMTVAKSALESVN

SEQ ID NO: 1458928 - protein, 23 aa, Mycobacterium tuberculosis
FDRRAILKVFRRVSSGINPDIEL

SEQ ID NO: 1458929 - protein, 18 aa, Mycobacterium tuberculosis
FDTARLAVFDADSGANLT

SEQ ID NO: 1458930 - protein, 22 aa, Mycobacterium tuberculosis
FEGVMMPELFMADAMGATGKPL

SEQ ID NO: 1458931 - protein, 20 aa, Mycobacterium tuberculosis
FEKGRSWPRERTRAKLEEVL

SEQ ID NO: 1458932 - protein, 19 aa, Mycobacterium tuberculosis
FFEFLTDLLDGWVAYFAEH

SEQ ID NO: 1458933 - protein, 25 aa, Mycobacterium tuberculosis
FFPSVREYSVRYGLTERRQAMLPGH

SEQ ID NO: 1458934 - protein, 20 aa, Mycobacterium tuberculosis
FFPTPACARLTEQNLQGFRS

SEQ ID NO: 1458935 - protein, 17 aa, Mycobacterium tuberculosis
FGARWGTQVNRIELARR

SEQ ID NO: 1458936 - protein, 19 aa, Mycobacterium tuberculosis
FGASSAFGGPCRTSTAELL

SEQ ID NO: 1458937 - protein, 23 aa, Mycobacterium tuberculosis
FGNFGGANSGFWNLASATSGASG

SEQ ID NO: 1458938 - protein, 19 aa, Mycobacterium tuberculosis
FGPEVKRRIMIGTYALSAG

SEQ ID NO: 1458939 - protein, 20 aa, Mycobacterium tuberculosis
FGRLPFTMRGIRLEAVGVDD

SEQ ID NO: 1458940 - protein, 18 aa, Mycobacterium tuberculosis
FGSSARNRALLAERAGLV

SEQ ID NO: 1458941 - protein, 19 aa, Mycobacterium tuberculosis
FGSVTSGLVVGWWQGSASA

SEQ ID NO: 1458942 - protein, 18 aa, Mycobacterium tuberculosis
FGTAGSRLDDLAAALPRI

SEQ ID NO: 1458943 - protein, 17 aa, Mycobacterium tuberculosis
FKKGFAATGGGSVVPDE

SEQ ID NO: 1458944 - protein, 21 aa, Mycobacterium tuberculosis
FLDPLIFARRRLIAAGTTRGR

SEQ ID NO: 1458945 - protein, 22 aa, Mycobacterium tuberculosis
FLGSSCIYPKLAPQPIPESALL

SEQ ID NO: 1458946 - protein, 29 aa, Mycobacterium tuberculosis
FLHPDLVWDFRLPRVVSINVSGHKYGLTY

SEQ ID NO: 1458947 - protein, 17 aa, Mycobacterium tuberculosis
FLHRAFDQLLFDIGLHR

SEQ ID NO: 1458948 - protein, 17 aa, Mycobacterium tuberculosis
FLLNQMLVWGFTGQVIS

SEQ ID NO: 1458949 - protein, 17 aa, Mycobacterium tuberculosis
FLPAVARMRALDPVTSE

SEQ ID NO: 1458950 - protein, 26 aa, Mycobacterium tuberculosis
FLRAAARRCDITWPQPQVLCTMRLAR

SEQ ID NO: 1458951 - protein, 20 aa, Mycobacterium tuberculosis
FLRISREITCAQANLMPATA

SEQ ID NO: 1458952 - protein, 29 aa, Mycobacterium tuberculosis
FNIWGRPDLRRWLPLDVYRPLKSTLVTLD

SEQ ID NO: 1458953 - protein, 17 aa, Mycobacterium tuberculosis
FNRRKGVRMSMLVSADA

SEQ ID NO: 1458954 - protein, 33 aa, Mycobacterium tuberculosis; identical to SEQ ID NO: 199273

SEQ ID NO: 1458955 - protein, 20 aa, Mycobacterium tuberculosis
FPTDRGWALRELFDGSRRNG

SEQ ID NO: 1458956 - protein, 24 aa, Mycobacterium tuberculosis
FQAEARQLLDLMVHSVYSNKDAFL

SEQ ID NO: 1458957 - protein, 17 aa, Mycobacterium tuberculosis
FQFTGQRFFRIRGGQLY

SEQ ID NO: 1458958 - protein, 22 aa, Mycobacterium tuberculosis
FQHYLGEPLGGFTGWRPQLPVT

SEQ ID NO: 1458959 - protein, 22 aa, Mycobacterium tuberculosis
FQLGGAAARGGERSCFPSRHAR

SEQ ID NO: 1458960 - protein, 24 aa, Mycobacterium tuberculosis
FQSFPAVAGSSLFAKLHDSAARKS

SEQ ID NO: 1458961 - protein, 24 aa, Mycobacterium tuberculosis
FRAALRELTLLLIYEATRDAPCEP

SEQ ID NO: 1458962 - protein, 18 aa, Mycobacterium tuberculosis
FRALYRLERHQLLDCPIL

SEQ ID NO: 1458963 - protein, 17 aa, Mycobacterium tuberculosis
FRASVWGTGSFTVNDFL

SEQ ID NO: 1458964 - protein, 30 aa, Mycobacterium tuberculosis; identical to SEQ ID NO: 199324

SEQ ID NO: 1458965 - protein, 20 aa, Mycobacterium tuberculosis
FRPLLNLALRRFLRNLRRYT

SEQ ID NO: 1458966 - protein, 20 aa, Mycobacterium tuberculosis
FRRHQVVYQRLAPRCTARDV

SEQ ID NO: 1458967 - protein, 21 aa, Mycobacterium tuberculosis
FSAPLRRAGAVLVTPVPHPGR

SEQ ID NO: 1458968 - protein, 20 aa, Mycobacterium tuberculosis
FSDVLKAMGVYPGLDGAAPV

SEQ ID NO: 1458969 - protein, 17 aa, Mycobacterium tuberculosis
FSETGAIKAKSVIIAAG

SEQ ID NO: 1458970 - protein, 23 aa, Mycobacterium tuberculosis
FSKLFRSEIDWDYLTEPQPELDG

SEQ ID NO: 1458971 - protein, 17 aa, Mycobacterium tuberculosis
FSMVLPSFVNTELIAGT

SEQ ID NO: 1458972 - protein, 17 aa, Mycobacterium tuberculosis
FSNLKARAAVGALDGSL

SEQ ID NO: 1458973 - protein, 24 aa, Mycobacterium tuberculosis
FSSKLELYLAVLHRHVENLVSGVH

SEQ ID NO: 1458974 - protein, 18 aa, Mycobacterium tuberculosis
FSVLCPQGRLVDAPLPAW

SEQ ID NO: 1458975 - protein, 21 aa, Mycobacterium tuberculosis
FTETVTWWQVHRRAMIVAEEL

SEQ ID NO: 1458976 - protein, 18 aa, Mycobacterium tuberculosis
FTHTCFMVTPYEGYVAVA

SEQ ID NO: 1458977 - protein, 21 aa, Mycobacterium tuberculosis
FTIPIIGFESFAFSFHIHTEP

SEQ ID NO: 1458978 - protein, 30 aa, Mycobacterium tuberculosis; identical to SEQ ID NO: 199394

SEQ ID NO: 1458979 - protein, 18 aa, Mycobacterium tuberculosis
FVAHRGMTVLPLAKSASG

SEQ ID NO: 1458980 - protein, 21 aa, Mycobacterium tuberculosis
FVGIAEAYVLNAFRRAGVPMQ

SEQ ID NO: 1458981 - protein, 17 aa, Mycobacterium tuberculosis
FVLSAAVDHAHDLLARA

SEQ ID NO: 1458982 - protein, 19 aa, Mycobacterium tuberculosis
FVNGKSWLVFGPYAGWSPK

SEQ ID NO: 1458983 - protein, 21 aa, Mycobacterium tuberculosis
FVWPRFRRRGLARGLLSTLAR

SEQ ID NO: 1458984 - protein, 24 aa, Mycobacterium tuberculosis
FWDLLCAGRSGIVRVPAQRWDADA

SEQ ID NO: 1458985 - protein, 21 aa, Mycobacterium tuberculosis
FWTFPRSCNPTGGLMSTARDQ

SEQ ID NO: 1458986 - protein, 18 aa, Mycobacterium tuberculosis
FYAQCAIDAGVAFVNALP

SEQ ID NO: 1458987 - protein, 19 aa, Mycobacterium tuberculosis
FYAYAEILLALGRGDEALQ

SEQ ID NO: 1458988 - protein, 18 aa, Mycobacterium tuberculosis
GAADLSFGDAPVVLTAGY

SEQ ID NO: 1458989 - protein, 27 aa, Mycobacterium tuberculosis
GAALARLEARIVLRLLLDRTSVIEAAD

SEQ ID NO: 1458990 - protein, 22 aa, Mycobacterium tuberculosis
GADSLKGLCPFHNEKSPSFHVR

SEQ ID NO: 1458991 - protein, 22 aa, Mycobacterium tuberculosis
GAERMTRVSFGFREPDGGGFNP

SEQ ID NO: 1458992 - protein, 22 aa, Mycobacterium tuberculosis
GAGGYFCAGMDLKAATQKPPGD

SEQ ID NO: 1458993 - protein, 24 aa, Mycobacterium tuberculosis
GAGSIRIPAAWTHLVGIKPQRGRI

SEQ ID NO: 1458994 - protein, 19 aa, Mycobacterium tuberculosis
GALARHIAEELPLLGSCTF

SEQ ID NO: 1458995 - protein, 18 aa, Mycobacterium tuberculosis
GALEAFAIAVAGRRCLDA

SEQ ID NO: 1458996 - protein, 20 aa, Mycobacterium tuberculosis
GAPYVTPLVRKLASENNIDL

SEQ ID NO: 1458997 - protein, 25 aa, Mycobacterium tuberculosis
GARASAMAAWLFGRPAAVPEIARSR

SEQ ID NO: 1458998 - protein, 17 aa, Mycobacterium tuberculosis
GARRKAYNWAVATLKAD

SEQ ID NO: 1458999 - protein, 19 aa, Mycobacterium tuberculosis
GASGFKLHEDWGSTPAAID

SEQ ID NO: 1459000 - protein, 17 aa, Mycobacterium tuberculosis
GASYAARDALAAASYLS

SEQ ID NO: 1459001 - protein, 26 aa, Mycobacterium tuberculosis
GATERYQVLVGWDFEPASEYGTKAAI

SEQ ID NO: 1459002 - protein, 20 aa, Mycobacterium tuberculosis
GCAEAMKGQGARVSVTEIDP

SEQ ID NO: 1459003 - protein, 20 aa, Mycobacterium tuberculosis
GCGYAELSLALAADGYTVVG

SEQ ID NO: 1459004 - protein, 24 aa, Mycobacterium tuberculosis
GDAVEFRLGAAIRDKLAAVSRDLG

SEQ ID NO: 1459005 - protein, 19 aa, Mycobacterium tuberculosis
GDCAMPFEKAVVVPLDPTS

SEQ ID NO: 1459006 - protein, 25 aa, Mycobacterium tuberculosis
GDEFITGVLFYTGARALPFGDRLMA

SEQ ID NO: 1459007 - protein, 26 aa, Mycobacterium tuberculosis
GDERARAALQRWSLMRSDHPVTSVGT

SEQ ID NO: 1459008 - protein, 23 aa, Mycobacterium tuberculosis
GDGFARYWLHNGWVTMGGEKMSK

SEQ ID NO: 1459009 - protein, 17 aa, Mycobacterium tuberculosis
GDGHPVLVLPGLLAGDG

SEQ ID NO: 1459010 - protein, 32 aa, Mycobacterium tuberculosis; identical to SEQ ID NO: 199635

SEQ ID NO: 1459011 - protein, 18 aa, Mycobacterium tuberculosis
GDLPRPGAIVTSAADRVE

SEQ ID NO: 1459012 - protein, 20 aa, Mycobacterium tuberculosis
GDPMGLVNAVGYPLAADVAL

SEQ ID NO: 1459013 - protein, 19 aa, Mycobacterium tuberculosis
GDPRSPGWYHNLKANPDVE

SEQ ID NO: 1459014 - protein, 20 aa, Mycobacterium tuberculosis
GDPYRMAVARAREMTALLRA

SEQ ID NO: 1459015 - protein, 17 aa, Mycobacterium tuberculosis
GDSGLRVAVEALYDAAD

SEQ ID NO: 1459016 - protein, 23 aa, Mycobacterium tuberculosis
GDSRPSLDRWTINLATGAVTAEC

SEQ ID NO: 1459017 - protein, 20 aa, Mycobacterium tuberculosis
GDTVVRGRIDAVFVDPDGGA

SEQ ID NO: 1459018 - protein, 25 aa, Mycobacterium tuberculosis
GEALLSGLLRAGRQVKDLVVAERMP

SEQ ID NO: 1459019 - protein, 17 aa, Mycobacterium tuberculosis
GEAWMHVALSPAVDHKG

SEQ ID NO: 1459020 - protein, 19 aa, Mycobacterium tuberculosis
GEEIRRLVNGAAYLFTNDY

SEQ ID NO: 1459021 - protein, 24 aa, Mycobacterium tuberculosis
GEFREMFAPGAFRRSIAERGHKVK

SEQ ID NO: 1459022 - protein, 19 aa, Mycobacterium tuberculosis
GEGGLRAMRNFLSDSPDDT

SEQ ID NO: 1459023 - protein, 21 aa, Mycobacterium tuberculosis
GEGSSGMGVLRGRTGSRPRLT

SEQ ID NO: 1459024 - protein, 17 aa, Mycobacterium tuberculosis
GEGYFFGIELVKDQATK

SEQ ID NO: 1459025 - protein, 18 aa, Mycobacterium tuberculosis
GELLEWAEIHGGLHRSGT

SEQ ID NO: 1459026 - protein, 29 aa, Mycobacterium tuberculosis
GELLKPFARRYFQAIPGVWARRSSEVAQS

SEQ ID NO: 1459027 - protein, 18 aa, Mycobacterium tuberculosis
GELLRWLGDGNFLLLGYQ

SEQ ID NO: 1459028 - protein, 19 aa, Mycobacterium tuberculosis
GEMRSRLRALDAAARTGSG

SEQ ID NO: 1459029 - protein, 25 aa, Mycobacterium tuberculosis
GETRPGDRWRLSGPHGAFRVDRDGG

SEQ ID NO: 1459030 - protein, 23 aa, Mycobacterium tuberculosis
GEVRGAEVVDLLAALNTGHEGGA

SEQ ID NO: 1459031 - protein, 22 aa, Mycobacterium tuberculosis
GEWQIAALRAYWELPAMMLQFL

SEQ ID NO: 1459032 - protein, 17 aa, Mycobacterium tuberculosis
GFAAYHWERTVGGADYL

SEQ ID NO: 1459033 - protein, 19 aa, Mycobacterium tuberculosis
GFGEIFLDDVFVPDRDVIG

SEQ ID NO: 1459034 - protein, 26 aa, Mycobacterium tuberculosis
GFLVSGDYQGLIGLPLLGIPVTPGYF

SEQ ID NO: 1459035 - protein, 19 aa, Mycobacterium tuberculosis
GFSGRAQVGKGMWTMTELM

SEQ ID NO: 1459036 - protein, 27 aa, Mycobacterium tuberculosis
GGAFILPPSIFHWLNYSVTAYQTGATV

SEQ ID NO: 1459037 - protein, 23 aa, Mycobacterium tuberculosis
GGAYALGSARGYRGLAAQLAAAA

SEQ ID NO: 1459038 - protein, 19 aa, Mycobacterium tuberculosis
GGELPDWYRRCYDPVVALA

SEQ ID NO: 1459039 - protein, 19 aa, Mycobacterium tuberculosis
GGFGHLLILGFDYSDNPGP

SEQ ID NO: 1459040 - protein, 20 aa, Mycobacterium tuberculosis
GGGAHFCLGANLARREIRVA

SEQ ID NO: 1459041 - protein, 29 aa, Mycobacterium tuberculosis
GGGAIRIPLISIPAAPGFGNSTTNPSSGF

SEQ ID NO: 1459042 - protein, 20 aa, Mycobacterium tuberculosis
GGGICHWFHSDVMYRSVLAL

SEQ ID NO: 1459043 - protein, 23 aa, Mycobacterium tuberculosis
GGKALKFYASVRMDVRRVETLKD

SEQ ID NO: 1459044 - protein, 21 aa, Mycobacterium tuberculosis
GGLHPRVALMLDVESGGNPPG

SEQ ID NO: 1459045 - protein, 24 aa, Mycobacterium tuberculosis
GGQAGNIARLSWLAAGYPEEVPGV

SEQ ID NO: 1459046 - protein, 18 aa, Mycobacterium tuberculosis
GGSTARSGGGVWIPNNEV

SEQ ID NO: 1459047 - protein, 18 aa, Mycobacterium tuberculosis
GGTPFPLQLATQVDAPPG

SEQ ID NO: 1459048 - protein, 25 aa, Mycobacterium tuberculosis
GGVGGMGGTGGWLMGNGGMGGAGGV

SEQ ID NO: 1459049 - protein, 18 aa, Mycobacterium tuberculosis
GHAGFLGIERIRELVTDA

SEQ ID NO: 1459050 - protein, 19 aa, Mycobacterium tuberculosis
GHHLRRASAVLQQVSGECE

SEQ ID NO: 1459051 - protein, 24 aa, Mycobacterium tuberculosis
GHIWRRIRAANLPIALSDRLTLDT

SEQ ID NO: 1459052 - protein, 19 aa, Mycobacterium tuberculosis
GHMLGGLPLGQLTNSGGGF

SEQ ID NO: 1459053 - protein, 25 aa, Mycobacterium tuberculosis
GHRRGFLQFRWQRVSRELTEADGPT

SEQ ID NO: 1459054 - protein, 23 aa, Mycobacterium tuberculosis
GHVGDPEFLPLLRRLGRFLPADV

SEQ ID NO: 1459055 - protein, 20 aa, Mycobacterium tuberculosis
GHWPGMGAVAYRELPTYRTA

SEQ ID NO: 1459056 - protein, 17 aa, Mycobacterium tuberculosis
GIAHPPRGGLGHRSKHR

SEQ ID NO: 1459057 - protein, 24 aa, Mycobacterium tuberculosis
GIAKRELRGVPARAVKSPADLDEL

SEQ ID NO: 1459058 - protein, 19 aa, Mycobacterium tuberculosis
GIATWPARAGLAAADTGLN

SEQ ID NO: 1459059 - protein, 20 aa, Mycobacterium tuberculosis
GIDRFPLEMVQRYVNDQRGD

SEQ ID NO: 1459060 - protein, 24 aa, Mycobacterium tuberculosis
GIETKGGVMTRLIERNTTIPTKRS

SEQ ID NO: 1459061 - protein, 23 aa, Mycobacterium tuberculosis
GIGKRVALAYVEAGAQVAIAARH

SEQ ID NO: 1459062 - protein, 21 aa, Mycobacterium tuberculosis
GIPKLRIEEAAARTQARIDSG

SEQ ID NO: 1459063 - protein, 17 aa, Mycobacterium tuberculosis
GIPQIEVTFDIDANGIV

SEQ ID NO: 1459064 - protein, 21 aa, Mycobacterium tuberculosis
GIRRRVAADLQILKRFAQTVE

SEQ ID NO: 1459065 - protein, 23 aa, Mycobacterium tuberculosis
GIRTDFALVHAWQGDRHGNLMYR

SEQ ID NO: 1459066 - protein, 26 aa, Mycobacterium tuberculosis
GISTNARMLIQFGFIERLAVAGDRRT

SEQ ID NO: 1459067 - protein, 18 aa, Mycobacterium tuberculosis
GKICDALLDGARKVAAGC

SEQ ID NO: 1459068 - protein, 20 aa, Mycobacterium tuberculosis
GKIRRAACVEQYRLQQFTRL

SEQ ID NO: 1459069 - protein, 20 aa, Mycobacterium tuberculosis
GKPDYRWAKEQTEARPADDV

SEQ ID NO: 1459070 - protein, 17 aa, Mycobacterium tuberculosis
GKPFGLRPSAILPAYGM

SEQ ID NO: 1459071 - protein, 18 aa, Mycobacterium tuberculosis
GKTTLLSCLGGILRPKSG

SEQ ID NO: 1459072 - protein, 19 aa, Mycobacterium tuberculosis
GLAAALCYGAAGVAMGTRF

SEQ ID NO: 1459073 - protein, 18 aa, Mycobacterium tuberculosis
GLADIEWTVQLLQLQHAH

SEQ ID NO: 1459074 - protein, 18 aa, Mycobacterium tuberculosis
GLAESLGARVFVEVGPGA

SEQ ID NO: 1459075 - protein, 22 aa, Mycobacterium tuberculosis
GLALPMRLALPGSVNRGNAAQA

SEQ ID NO: 1459076 - protein, 31 aa, Mycobacterium tuberculosis; identical to SEQ ID NO: 80303

SEQ ID NO: 1459077 - protein, 20 aa, Mycobacterium tuberculosis
GLCNSAGFGTSGRFWELPFA

SEQ ID NO: 1459078 - protein, 24 aa, Mycobacterium tuberculosis
GLCTYGMTCKAIVDALLDSDATAV

SEQ ID NO: 1459079 - protein, 28 aa, Mycobacterium tuberculosis
GLDSRAFRLQWPIGTTIFELDRPQVLDF

SEQ ID NO: 1459080 - protein, 29 aa, Mycobacterium tuberculosis
GLDSRAYRLDWPAGTIVYEIDQPKVLSYK

SEQ ID NO: 1459081 - protein, 24 aa, Mycobacterium tuberculosis
GLEQPRSEILTFLATREAAHHRLF

SEQ ID NO: 1459082 - protein, 27 aa, Mycobacterium tuberculosis
GLFLSGDYQGLVGLNLVIDMPLPISLG

SEQ ID NO: 1459083 - protein, 18 aa, Mycobacterium tuberculosis
GLGWRQCQTPTPPFALVL

SEQ ID NO: 1459084 - protein, 23 aa, Mycobacterium tuberculosis
GLHFICRDVWLRVASTSTAWTSR

SEQ ID NO: 1459085 - protein, 17 aa, Mycobacterium tuberculosis
GLHPVVAIYSTFLNRAF

SEQ ID NO: 1459086 - protein, 20 aa, Mycobacterium tuberculosis
GLLLARAGVQVTLLEKHGDF

SEQ ID NO: 1459087 - protein, 22 aa, Mycobacterium tuberculosis
GLNIPTGIPLRYDLDSAMRPLV

SEQ ID NO: 1459088 - protein, 31 aa, Mycobacterium tuberculosis; identical to SEQ ID NO: 200064

SEQ ID NO: 1459089 - protein, 24 aa, Mycobacterium tuberculosis
GLQSYEIPRDFIIETTPFTLENGL

SEQ ID NO: 1459090 - protein, 22 aa, Mycobacterium tuberculosis
GLRLRRRSVLASAARRVLGVLP

SEQ ID NO: 1459091 - protein, 25 aa, Mycobacterium tuberculosis
GLRTELRRAPHLGFHIDFDDAKISL

SEQ ID NO: 1459092 - protein, 18 aa, Mycobacterium tuberculosis
GLTGQAWQGPASAAMAAA

SEQ ID NO: 1459093 - protein, 20 aa, Mycobacterium tuberculosis
GLVGGSWQGRSSVAMAAAAA

SEQ ID NO: 1459094 - protein, 22 aa, Mycobacterium tuberculosis
GLWANLACRKRFIGDKLDEALG

SEQ ID NO: 1459095 - protein, 25 aa, Mycobacterium tuberculosis
GMELFCAGTHPFARWSAQKLTDAPR

SEQ ID NO: 1459096 - protein, 19 aa, Mycobacterium tuberculosis
GMFVRASGMALPFADDSVD

SEQ ID NO: 1459097 - protein, 23 aa, Mycobacterium tuberculosis
GNMPQSLVNRACLDIQRGRAGVV

SEQ ID NO: 1459098 - protein, 24 aa, Mycobacterium tuberculosis
GNPHVARLLGAYQFGRPNRSPTDA

SEQ ID NO: 1459099 - protein, 23 aa, Mycobacterium tuberculosis
GNPVCAAAALAVLRVLASDGLVR

SEQ ID NO: 1459100 - protein, 28 aa, Mycobacterium tuberculosis
GNRRPTGQRGFFCWFRVGSDVLVDNAFR

SEQ ID NO: 1459101 - protein, 19 aa, Mycobacterium tuberculosis
GNVFVAGFIGSPAMNLFRL

SEQ ID NO: 1459102 - protein, 17 aa, Mycobacterium tuberculosis
GPAGIGMLQLWVQQPGD

SEQ ID NO: 1459103 - protein, 17 aa, Mycobacterium tuberculosis
GPAGPVLVEASRDAEMI

SEQ ID NO: 1459104 - protein, 22 aa, Mycobacterium tuberculosis
GPARTGSVLAELGVDPNRPMAV

SEQ ID NO: 1459105 - protein, 25 aa, Mycobacterium tuberculosis
GPASLPTALFVDVRELITAPQYAAY

SEQ ID NO: 1459106 - protein, 25 aa, Mycobacterium tuberculosis
GPEPLRMARDLVRVGLDALALDIYR

SEQ ID NO: 1459107 - protein, 18 aa, Mycobacterium tuberculosis
GPEVEVEGIISLKTGGCP

SEQ ID NO: 1459108 - protein, 25 aa, Mycobacterium tuberculosis
GPKTAETAAEFGLRVDVQPDTAAIG

SEQ ID NO: 1459109 - protein, 24 aa, Mycobacterium tuberculosis
GPLAHPGLVCDVAIGQSTLATQRV

SEQ ID NO: 1459110 - protein, 21 aa, Mycobacterium tuberculosis
GPLDWRWRRRGFFGDHGGRWC

SEQ ID NO: 1459111 - protein, 19 aa, Mycobacterium tuberculosis
GPRGVSAFIVEKGTPGLSF

SEQ ID NO: 1459112 - protein, 18 aa, Mycobacterium tuberculosis
GPRVYELLYGDPFPSGVQ

SEQ ID NO: 1459113 - protein, 18 aa, Mycobacterium tuberculosis
GPVAALFLDLDRLKAIND

SEQ ID NO: 1459114 - protein, 28 aa, Mycobacterium tuberculosis
GPVAARLVSRGGFTRGFGRIFSPAHPLS

SEQ ID NO: 1459115 - protein, 26 aa, Mycobacterium tuberculosis
GPVGDGTCYWKRMGNPDGALIDNALS

SEQ ID NO: 1459116 - protein, 20 aa, Mycobacterium tuberculosis
GPVPAGWRTIGRVLDGPARV

SEQ ID NO: 1459117 - protein, 42 aa, Mycobacterium tuberculosis
GPWGREVIGIAAGVVRFIGVDGYRWMIRCVVNGPQETVDALT

SEQ ID NO: 1459118 - protein, 18 aa, Mycobacterium tuberculosis
GQAKLANLLFTYELQRRL

SEQ ID NO: 1459119 - protein, 24 aa, Mycobacterium tuberculosis
GQLAAPRASHEWARGKRDQLIGRA

SEQ ID NO: 1459120 - protein, 21 aa, Mycobacterium tuberculosis
GQLTRSGLLPGDRVALRMGSN

SEQ ID NO: 1459121 - protein, 23 aa, Mycobacterium tuberculosis
GQPRLRPPFPAVAGLYGCPTVIN

SEQ ID NO: 1459122 - protein, 26 aa, Mycobacterium tuberculosis
GQQVGPRVARRFGRVLLELGGNNAAI

SEQ ID NO: 1459123 - protein, 19 aa, Mycobacterium tuberculosis
GRAAGALLFTCNGRGRRMF

SEQ ID NO: 1459124 - protein, 19 aa, Mycobacterium tuberculosis
GRAGGLADVRAWVGELDAA

SEQ ID NO: 1459125 - protein, 25 aa, Mycobacterium tuberculosis
GRELFVDKVWDWKRESGGAIGGQMR

SEQ ID NO: 1459126 - protein, 24 aa, Mycobacterium tuberculosis
GRGRPGRPPLMFRAVRRTDSTGTR

SEQ ID NO: 1459127 - protein, 19 aa, Mycobacterium tuberculosis
GRHDAELIAAVWGADLRIE

SEQ ID NO: 1459128 - protein, 22 aa, Mycobacterium tuberculosis
GRILGVKGRVLPMCPVALQIEA

SEQ ID NO: 1459129 - protein, 18 aa, Mycobacterium tuberculosis
GRLAARGFAAYGTAKAAL

SEQ ID NO: 1459130 - protein, 23 aa, Mycobacterium tuberculosis
GRLAEIKSAPAFFDAENMAVTQY

SEQ ID NO: 1459131 - protein, 18 aa, Mycobacterium tuberculosis
GRLPRPLTLDSFADLPTA

SEQ ID NO: 1459132 - protein, 24 aa, Mycobacterium tuberculosis
GRLSDDELFFFAVLLLVAGYESTA

SEQ ID NO: 1459133 - protein, 18 aa, Mycobacterium tuberculosis
GRMVEMANHTTGWVRMDF

SEQ ID NO: 1459134 - protein, 19 aa, Mycobacterium tuberculosis
GRPASWEQRALHVTSLRDP

SEQ ID NO: 1459135 - protein, 23 aa, Mycobacterium tuberculosis
GRQRCIQEFSWAYIAEQTLDIYR

SEQ ID NO: 1459136 - protein, 25 aa, Mycobacterium tuberculosis
GRRRRCGWFDAVIARYAARVNGITD

SEQ ID NO: 1459137 - protein, 21 aa, Mycobacterium tuberculosis
GRRYLDMFTFVASSALGMNPP

SEQ ID NO: 1459138 - protein, 19 aa, Mycobacterium tuberculosis
GRSRVLAITVRRNGTRIDA

SEQ ID NO: 1459139 - protein, 28 aa, Mycobacterium tuberculosis
GRSVLRPDVDLRRTVGWFTTYYPVPLAC

SEQ ID NO: 1459140 - protein, 18 aa, Mycobacterium tuberculosis
GSACRPLYYLEMPPALFA

SEQ ID NO: 1459141 - protein, 24 aa, Mycobacterium tuberculosis
GSADYRGGDHGVEFVKVAMQPGMP

SEQ ID NO: 1459142 - protein, 28 aa, Mycobacterium tuberculosis
GSAHALGCTIKLLSICERITTDEGSQRV

SEQ ID NO: 1459143 - protein, 24 aa, Mycobacterium tuberculosis
GSAKRITAVMPFYPYARQDKKHRG

SEQ ID NO: 1459144 - protein, 20 aa, Mycobacterium tuberculosis
GSCVPLLKQLLEAEGVEQSK

SEQ ID NO: 1459145 - protein, 32 aa, Mycobacterium tuberculosis; identical to SEQ ID NO: 200392

SEQ ID NO: 1459146 - protein, 22 aa, Mycobacterium tuberculosis
GSGLLVPLGVRRVRAYAPVRTA

SEQ ID NO: 1459147 - protein, 24 aa, Mycobacterium tuberculosis
GSGPMLAAASAWDGLATELASAAV

SEQ ID NO: 1459148 - protein, 17 aa, Mycobacterium tuberculosis
GSGPVGLILTRQGVPVL

SEQ ID NO: 1459149 - protein, 22 aa, Mycobacterium tuberculosis
GSIVIRKLFWRNLPDEQPGLAP

SEQ ID NO: 1459150 - protein, 22 aa, Mycobacterium tuberculosis
GSLHVKMGWAFAADIPLTSITK

SEQ ID NO: 1459151 - protein, 27 aa, Mycobacterium tuberculosis
GSTLSFFRLALRLRRERNEFDGDVDWL

SEQ ID NO: 1459152 - protein, 28 aa, Mycobacterium tuberculosis
GSVEHFNWLEGLGFQFERSYFPGKAVIQ

SEQ ID NO: 1459153 - protein, 17 aa, Mycobacterium tuberculosis
GSVFAAAGHELYLVGGS

SEQ ID NO: 1459154 - protein, 20 aa, Mycobacterium tuberculosis
GSVTAGLVGGSWQGRSSVAM

SEQ ID NO: 1459155 - protein, 25 aa, Mycobacterium tuberculosis
GTAGCNLACKFCQNWDISKSREIDV

SEQ ID NO: 1459156 - protein, 24 aa, Mycobacterium tuberculosis
GTALCAGEKMMLLFESANFDEAVF

SEQ ID NO: 1459157 - protein, 22 aa, Mycobacterium tuberculosis
GTEARLITAMIVREDSMTLYGF

SEQ ID NO: 1459158 - protein, 21 aa, Mycobacterium tuberculosis
GTFRLIDKVFTRWDVQYTPVR

SEQ ID NO: 1459159 - protein, 23 aa, Mycobacterium tuberculosis
GTGKSVFLKSLIGLLRPERGSII

SEQ ID NO: 1459160 - protein, 28 aa, Mycobacterium tuberculosis
GTHRLLQTGVRWKDLGLVVVDEEQRFGV

SEQ ID NO: 1459161 - protein, 23 aa, Mycobacterium tuberculosis
GTPRRLSVLLSDGPVVLFFYPAA

SEQ ID NO: 1459162 - protein, 26 aa, Mycobacterium tuberculosis
GTVALRPDAGPSWLRPLVDNVGQIPD

SEQ ID NO: 1459163 - protein, 18 aa, Mycobacterium tuberculosis
GTVGEIWVQGDNVGLGYW

SEQ ID NO: 1459164 - protein, 20 aa, Mycobacterium tuberculosis
GVDRFTRVRDIAVTDYVTAP

SEQ ID NO: 1459165 - protein, 25 aa, Mycobacterium tuberculosis
GVLLRRLEPNWSITLIERLDAVAAE

SEQ ID NO: 1459166 - protein, 19 aa, Mycobacterium tuberculosis
GVLRRAGVVAARRDGNAMI

SEQ ID NO: 1459167 - protein, 25 aa, Mycobacterium tuberculosis
GVNDFPKYPLNVFATANAIAGILFL

SEQ ID NO: 1459168 - protein, 19 aa, Mycobacterium tuberculosis
GVPGLRHVAGRLVMVDLDA

SEQ ID NO: 1459169 - protein, 24 aa, Mycobacterium tuberculosis
GVPGRSVSRWGGFLDDVAGFDAEF

SEQ ID NO: 1459170 - protein, 27 aa, Mycobacterium tuberculosis
GVPISRIPLTINIRIPVNITLNELPFN

SEQ ID NO: 1459171 - protein, 25 aa, Mycobacterium tuberculosis
GVREFKRLAKATGIDEPRLGLILEI

SEQ ID NO: 1459172 - protein, 23 aa, Mycobacterium tuberculosis
GVRRRLGVDLAEVAGLRPEIAAA

SEQ ID NO: 1459173 - protein, 17 aa, Mycobacterium tuberculosis
GVRRVRAYAPVRTARYC

SEQ ID NO: 1459174 - protein, 26 aa, Mycobacterium tuberculosis
GVVVSGRWPFCSGINHADIMFAGCFV

SEQ ID NO: 1459175 - protein, 18 aa, Mycobacterium tuberculosis
GVYPGLDGAAPVIGGECV

SEQ ID NO: 1459176 - protein, 24 aa, Mycobacterium tuberculosis
GWADPETGSAFGYVHNRLLTLLLF

SEQ ID NO: 1459177 - protein, 19 aa, Mycobacterium tuberculosis
GWCVQAFRFTLDPTAEQAH

SEQ ID NO: 1459178 - protein, 19 aa, Mycobacterium tuberculosis
GWCVQAFRFTLDPTEDQAR

SEQ ID NO: 1459179 - protein, 19 aa, Mycobacterium tuberculosis
GWDKPSFAKELFLGRFPLG

SEQ ID NO: 1459180 - protein, 25 aa, Mycobacterium tuberculosis
GWSAYPRVLDFAAFRSIADEVGAKL

SEQ ID NO: 1459181 - protein, 19 aa, Mycobacterium tuberculosis
GYGHIGLGGTIGWADPETG

SEQ ID NO: 1459182 - protein, 24 aa, Mycobacterium tuberculosis
GYLHCGPCGSGHFVKMVHNGIEYG

SEQ ID NO: 1459183 - protein, 24 aa, Mycobacterium tuberculosis
GYPALVAPLTFLAIAGRRVQLEIF

SEQ ID NO: 1459184 - protein, 20 aa, Mycobacterium tuberculosis
HAALPDYFVSGGRAVPIPYN

SEQ ID NO: 1459185 - protein, 23 aa, Mycobacterium tuberculosis
HAEAALLRLVEERHIPVLMNGMA

SEQ ID NO: 1459186 - protein, 19 aa, Mycobacterium tuberculosis
HAEGAWRRDDVTALSTASL

SEQ ID NO: 1459187 - protein, 18 aa, Mycobacterium tuberculosis
HAEGIIITTGCPSGEVQT

SEQ ID NO: 1459188 - protein, 23 aa, Mycobacterium tuberculosis
HAFEELRMLSLLPSRATTLNDDE

SEQ ID NO: 1459189 - protein, 22 aa, Mycobacterium tuberculosis
HAGEGNHILGFVMGEHSVLMTD

SEQ ID NO: 1459190 - protein, 17 aa, Mycobacterium tuberculosis
HAIDVLGVIVSRIEDAP

SEQ ID NO: 1459191 - protein, 25 aa, Mycobacterium tuberculosis
HAINCTPAYLFRRVADPVGRPTVLY

SEQ ID NO: 1459192 - protein, 17 aa, Mycobacterium tuberculosis
HARVRYTTIQNWSNNVY

SEQ ID NO: 1459193 - protein, 19 aa, Mycobacterium tuberculosis
HAVSYSFARGHRVQYSVIG

SEQ ID NO: 1459194 - protein, 22 aa, Mycobacterium tuberculosis
HCFGCGEGGDVYAFIQKIEHVS

SEQ ID NO: 1459195 - protein, 22 aa, Mycobacterium tuberculosis
HELCGAATRIGPAVWATSQHLC

SEQ ID NO: 1459196 - protein, 21 aa, Mycobacterium tuberculosis
HELIAEAFGGKGYHVSTPTEL

SEQ ID NO: 1459197 - protein, 22 aa, Mycobacterium tuberculosis
HELQRWYQPMFRGVYVSRRSVP

SEQ ID NO: 1459198 - protein, 23 aa, Mycobacterium tuberculosis
HEPRVYRRAVAYGMPGVSVDGND

SEQ ID NO: 1459199 - protein, 23 aa, Mycobacterium tuberculosis
HFLPRILSGEHRWCQGFSEPEAG

SEQ ID NO: 1459200 - protein, 17 aa, Mycobacterium tuberculosis
HGERPLWAWLVLEPGDI

SEQ ID NO: 1459201 - protein, 34 aa, Mycobacterium tuberculosis; identical to SEQ ID NO: 200717

SEQ ID NO: 1459202 - protein, 21 aa, Mycobacterium tuberculosis
HGMPGVPGVPVAAGRASGVLP

SEQ ID NO: 1459203 - protein, 22 aa, Mycobacterium tuberculosis
HGNRLRCYVVGVTRGAREPLIT

SEQ ID NO: 1459204 - protein, 19 aa, Mycobacterium tuberculosis
HHHELGWFARQALRLFDDL

SEQ ID NO: 1459205 - protein, 25 aa, Mycobacterium tuberculosis
HHVFKEWADRYAGRFDMGYERYREI

SEQ ID NO: 1459206 - protein, 29 aa, Mycobacterium tuberculosis
HISTLLLTLLFRFMRPLIENGHVFLAQPP

SEQ ID NO: 1459207 - protein, 28 aa, Mycobacterium tuberculosis
HKGARLTTQVSLAGRFLVYVPGASSTGI

SEQ ID NO: 1459208 - protein, 21 aa, Mycobacterium tuberculosis
HLRGWTLDRLPAVDRAILRVS

SEQ ID NO: 1459209 - protein, 28 aa, Mycobacterium tuberculosis
HLRTSGPHLGGWAVVSGVLHWRHSGKFA

SEQ ID NO: 1459210 - protein, 25 aa, Mycobacterium tuberculosis
HNGELPAVRVGRSFRVHAKAVHDML

SEQ ID NO: 1459211 - protein, 18 aa, Mycobacterium tuberculosis
HPHWDPRHLWLVPITQAV

SEQ ID NO: 1459212 - protein, 18 aa, Mycobacterium tuberculosis
HPIKRARTTFTYVAVAVA

SEQ ID NO: 1459213 - protein, 24 aa, Mycobacterium tuberculosis
HPLGATGLAQCAELTWQLRGTAEA

SEQ ID NO: 1459214 - protein, 19 aa, Mycobacterium tuberculosis
HPRCRGVGAGHRRHIGDCA

SEQ ID NO: 1459215 - protein, 20 aa, Mycobacterium tuberculosis
HPTFPRTRLTPICQLPTAAI

SEQ ID NO: 1459216 - protein, 20 aa, Mycobacterium tuberculosis
HQHLPDILGHSGHRAGNGVF

SEQ ID NO: 1459217 - protein, 27 aa, Mycobacterium tuberculosis
HQVVLWCMGEAHAGVVLDTLANRYGVS

SEQ ID NO: 1459218 - protein, 18 aa, Mycobacterium tuberculosis
HRAEFCIDKLYSPDSARG

SEQ ID NO: 1459219 - protein, 26 aa, Mycobacterium tuberculosis
HRHLLSVLIDREWRHGVRVGVETALL

SEQ ID NO: 1459220 - protein, 24 aa, Mycobacterium tuberculosis
HRVPCAGLVALVMSACSLAVCREV

SEQ ID NO: 1459221 - protein, 27 aa, Mycobacterium tuberculosis
HSAIGRAFMKKVWLRDSRNPSQFTDEV

SEQ ID NO: 1459222 - protein, 23 aa, Mycobacterium tuberculosis
HSDVMYRSVLALLMLTGSMGRNG

SEQ ID NO: 1459223 - protein, 23 aa, Mycobacterium tuberculosis
HSFLGAPFWVGRGFGLNLSVVTD

SEQ ID NO: 1459224 - protein, 31 aa, Mycobacterium tuberculosis; identical to SEQ ID NO: 80871

SEQ ID NO: 1459225 - protein, 26 aa, Mycobacterium tuberculosis
HTDPRVRDGLAWCYARVQIMRYRGYR

SEQ ID NO: 1459226 - protein, 21 aa, Mycobacterium tuberculosis
HVHVVPRWGGDANFITIIGGS

SEQ ID NO: 1459227 - protein, 22 aa, Mycobacterium tuberculosis
HVINISSVFGLFSAPGQAAYNS

SEQ ID NO: 1459228 - protein, 17 aa, Mycobacterium tuberculosis
HWGVFTARVHGGDIAAV

SEQ ID NO: 1459229 - protein, 18 aa, Mycobacterium tuberculosis
HWNVDKADLDGLLDRLSK

SEQ ID NO: 1459230 - protein, 21 aa, Mycobacterium tuberculosis
HYTYKLDWLAALRDTAEGWLR

SEQ ID NO: 1459231 - protein, 26 aa, Mycobacterium tuberculosis
IAAAEARYAEMWAQDAAAMYGYAGSS

SEQ ID NO: 1459232 - protein, 24 aa, Mycobacterium tuberculosis
IAAHNKLLGSFELTGIPPAPRGIP

SEQ ID NO: 1459233 - protein, 25 aa, Mycobacterium tuberculosis
IAAHWRYKEAKGRNGVLHPHAAAEI

SEQ ID NO: 1459234 - protein, 18 aa, Mycobacterium tuberculosis
IAATMGFVVGKLAKAPDG

SEQ ID NO: 1459235 - protein, 19 aa, Mycobacterium tuberculosis
IACGIEAMSRVGLGANAGP

SEQ ID NO: 1459236 - protein, 24 aa, Mycobacterium tuberculosis
IADPRAGLPAAIRVVKQSPLLAIG

SEQ ID NO: 1459237 - protein, 23 aa, Mycobacterium tuberculosis
IAEAEGLQVLGWRSVPTDDSSLG

SEQ ID NO: 1459238 - protein, 24 aa, Mycobacterium tuberculosis
IAGFYASICNAVWDGNVSLAGKDE

SEQ ID NO: 1459239 - protein, 26 aa, Mycobacterium tuberculosis
IAGPAALFDARFQKLGLHPGGGATWM

SEQ ID NO: 1459240 - protein, 17 aa, Mycobacterium tuberculosis
IALRADMDALPMAERTG

SEQ ID NO: 1459241 - protein, 20 aa, Mycobacterium tuberculosis
IALRSQRYFRLLDALDALVS

SEQ ID NO: 1459242 - protein, 18 aa, Mycobacterium tuberculosis
IALTPARLLMVVITDSGR

SEQ ID NO: 1459243 - protein, 17 aa, Mycobacterium tuberculosis
IAPNFAIGAVLSMHFAK

SEQ ID NO: 1459244 - protein, 18 aa, Mycobacterium tuberculosis
IAQLLVQRVELVELVEVS

SEQ ID NO: 1459245 - protein, 20 aa, Mycobacterium tuberculosis
IASPLDAVVTRWTRSTTVID

SEQ ID NO: 1459246 - protein, 20 aa, Mycobacterium tuberculosis
IATFEMRYLQSLPAHLRPGL

SEQ ID NO: 1459247 - protein, 20 aa, Mycobacterium tuberculosis
IATGFGRTGALFAADHAGVS

SEQ ID NO: 1459248 - protein, 26 aa, Mycobacterium tuberculosis
IDDKWTLCQILYWRGVGTCISGDPNA

SEQ ID NO: 1459249 - protein, 17 aa, Mycobacterium tuberculosis
IDGLSVRDVRLATVLSR

SEQ ID NO: 1459250 - protein, 21 aa, Mycobacterium tuberculosis
IDIPITGSFTDLVVDNFTIPI

SEQ ID NO: 1459251 - protein, 26 aa, Mycobacterium tuberculosis
IDPELRRPITELGMVKSIDTGPDGSV

SEQ ID NO: 1459252 - protein, 23 aa, Mycobacterium tuberculosis
IDRMGRRPGVRWAADLLSAADAL

SEQ ID NO: 1459253 - protein, 18 aa, Mycobacterium tuberculosis
IDTIYVWTHDSIGLGEDG

SEQ ID NO: 1459254 - protein, 24 aa, Mycobacterium tuberculosis
IDTRTARMDLVFSLAERFSEGSEP

SEQ ID NO: 1459255 - protein, 25 aa, Mycobacterium tuberculosis
IDVGSRFALTHFGLFGFAVMSCGTL

SEQ ID NO: 1459256 - protein, 19 aa, Mycobacterium tuberculosis
IDVSPEYGYELVAVSDPVG

SEQ ID NO: 1459257 - protein, 17 aa, Mycobacterium tuberculosis
IEEHLRFISPIQNICRT

SEQ ID NO: 1459258 - protein, 20 aa, Mycobacterium tuberculosis
IEFGTRYGGSAVYFANIMRQ

SEQ ID NO: 1459259 - protein, 17 aa, Mycobacterium tuberculosis
IELRPDVDWDKGKTLLW

SEQ ID NO: 1459260 - protein, 22 aa, Mycobacterium tuberculosis
IEMPASVARYVVEKGSITVDGI

SEQ ID NO: 1459261 - protein, 19 aa, Mycobacterium tuberculosis
IERGIPLTMEMAKFIRFIV

SEQ ID NO: 1459262 - protein, 28 aa, Mycobacterium tuberculosis
IERLVRARGCAKWLASEDFSQAIDHLRQ

SEQ ID NO: 1459263 - protein, 25 aa, Mycobacterium tuberculosis
IERTWRYLKVPCVIEFWDENGGAAS

SEQ ID NO: 1459264 - protein, 18 aa, Mycobacterium tuberculosis
IESWDSSGSVYARLMDIE

SEQ ID NO: 1459265 - protein, 18 aa, Mycobacterium tuberculosis
IGAARGRLLISAMAAGAA

SEQ ID NO: 1459266 - protein, 20 aa, Mycobacterium tuberculosis
IGALNSGIGNLGFGNSGNNN

SEQ ID NO: 1459267 - protein, 17 aa, Mycobacterium tuberculosis
IGCKLHLEVPMYHHHVD

SEQ ID NO: 1459268 - protein, 19 aa, Mycobacterium tuberculosis
IGGICAALGAAYGGALGVT

SEQ ID NO: 1459269 - protein, 17 aa, Mycobacterium tuberculosis
IGGSFWPRGIYSVVNHA

SEQ ID NO: 1459270 - protein, 25 aa, Mycobacterium tuberculosis
IGGSMGRYGGVWAHDETRKSFSIAG

SEQ ID NO: 1459271 - protein, 21 aa, Mycobacterium tuberculosis
IGILPRHIPLVAQLVDDAMVR

SEQ ID NO: 1459272 - protein, 25 aa, Mycobacterium tuberculosis
IGLDPVLRVELWDRFTALARRGTTL

SEQ ID NO: 1459273 - protein, 18 aa, Mycobacterium tuberculosis
IGLLANMRLCPNVPAQHA

SEQ ID NO: 1459274 - protein, 19 aa, Mycobacterium tuberculosis
IGLLPRLEGTVHINIGLLG

SEQ ID NO: 1459275 - protein, 18 aa, Mycobacterium tuberculosis
IGPTRIGTVLGILKAYTT

SEQ ID NO: 1459276 - protein, 17 aa, Mycobacterium tuberculosis
IGRACDEIRPGYRKLSA

SEQ ID NO: 1459277 - protein, 28 aa, Mycobacterium tuberculosis
IGRQLVEVPVGFKWFVDGLIGATLGFGG

SEQ ID NO: 1459278 - protein, 22 aa, Mycobacterium tuberculosis
IGSRCVVGAGALLLGDADADGV

SEQ ID NO: 1459279 - protein, 20 aa, Mycobacterium tuberculosis
IGTHRARFADLMLALIDQKV

SEQ ID NO: 1459280 - protein, 17 aa, Mycobacterium tuberculosis
IGVAPAIISLTLLPKLS

SEQ ID NO: 1459281 - protein, 24 aa, Mycobacterium tuberculosis
IGVPRPYWRSKPISVVELHLDPPD

SEQ ID NO: 1459282 - protein, 17 aa, Mycobacterium tuberculosis
IGVSRLVAVVAEQHHDE

SEQ ID NO: 1459283 - protein, 23 aa, Mycobacterium tuberculosis
IGYSCAGTVEFLLDERGEYVFIE

SEQ ID NO: 1459284 - protein, 17 aa, Mycobacterium tuberculosis
IHLATLYHDDVMDEAQV

SEQ ID NO: 1459285 - protein, 23 aa, Mycobacterium tuberculosis
IHPVAACATAAVSVEEGVDKIRL

SEQ ID NO: 1459286 - protein, 25 aa, Mycobacterium tuberculosis
IIYDEVHLLPAPVFRMTADLQSKRR

SEQ ID NO: 1459287 - protein, 19 aa, Mycobacterium tuberculosis
ILDRTPWRAEEVTVIVAPM

SEQ ID NO: 1459288 - protein, 23 aa, Mycobacterium tuberculosis
ILESLPLAGWMTIETTPLSPHPD

SEQ ID NO: 1459289 - protein, 18 aa, Mycobacterium tuberculosis
ILMQTNWARHISVRQVEV

SEQ ID NO: 1459290 - protein, 18 aa, Mycobacterium tuberculosis
IMAARPGAHVTLQQLDLC

SEQ ID NO: 1459291 - protein, 19 aa, Mycobacterium tuberculosis
IMEHGRPASWEQRALHVTS

SEQ ID NO: 1459292 - protein, 25 aa, Mycobacterium tuberculosis
IPAVLGLAFDGGWWVLGIRTPTAAE

SEQ ID NO: 1459293 - protein, 20 aa, Mycobacterium tuberculosis
IPCRTFAAFLDLRYWIKTFT

SEQ ID NO: 1459294 - protein, 19 aa, Mycobacterium tuberculosis
IPGEAALSETLRRRRASGG

SEQ ID NO: 1459295 - protein, 25 aa, Mycobacterium tuberculosis
IPGEPTIVAGLRLRRMVASIVGADL

SEQ ID NO: 1459296 - protein, 20 aa, Mycobacterium tuberculosis
IPGWNICVDFPIKDGLGKFV

SEQ ID NO: 1459297 - protein, 18 aa, Mycobacterium tuberculosis
IPIVPIVIRNAEIVASRN

SEQ ID NO: 1459298 - protein, 22 aa, Mycobacterium tuberculosis
IPVRRVRATHAFHTSAMDPMLG

SEQ ID NO: 1459299 - protein, 24 aa, Mycobacterium tuberculosis
IPVVLRPAVLAKLMAGRTTLMVTG

SEQ ID NO: 1459300 - protein, 17 aa, Mycobacterium tuberculosis
IPWRGYFDLIAFVDEFI

SEQ ID NO: 1459301 - protein, 20 aa, Mycobacterium tuberculosis
IPYPAGHSALLHRIAQHGVL

SEQ ID NO: 1459302 - protein, 26 aa, Mycobacterium tuberculosis
IQKVIRRYRVKGAREAVNLALRTLLG

SEQ ID NO: 1459303 - protein, 25 aa, Mycobacterium tuberculosis
IRECDAICQVVRVFVDDDVTHVTGR

SEQ ID NO: 1459304 - protein, 31 aa, Mycobacterium tuberculosis; identical to SEQ ID NO: 201381

SEQ ID NO: 1459305 - protein, 18 aa, Mycobacterium tuberculosis
IRLQCYEGLTANEALYDW

SEQ ID NO: 1459306 - protein, 22 aa, Mycobacterium tuberculosis
IRTICRRAGLSVRYFYESFTDK

SEQ ID NO: 1459307 - protein, 22 aa, Mycobacterium tuberculosis
IRTRLDRVLDWLGRADVDVLAM

SEQ ID NO: 1459308 - protein, 18 aa, Mycobacterium tuberculosis
IRVTWFDYDGYRDYKQLW

SEQ ID NO: 1459309 - protein, 18 aa, Mycobacterium tuberculosis
IRYLTPRLHEEMMSELRW

SEQ ID NO: 1459310 - protein, 31 aa, Mycobacterium tuberculosis; identical to SEQ ID NO: 201419

SEQ ID NO: 1459311 - protein, 35 aa, Mycobacterium tuberculosis; identical to SEQ ID NO: 201436

SEQ ID NO: 1459312 - protein, 18 aa, Mycobacterium tuberculosis
ISPHPTIPLAPTVAERAA

SEQ ID NO: 1459313 - protein, 21 aa, Mycobacterium tuberculosis
ISPSGPRLAGALGTSLLSLSM

SEQ ID NO: 1459314 - protein, 24 aa, Mycobacterium tuberculosis
ISQNWRLSGLAGEYITPVPAQQRL

SEQ ID NO: 1459315 - protein, 24 aa, Mycobacterium tuberculosis
ISRKRNLVEYGFRLPSACDNRPLT

SEQ ID NO: 1459316 - protein, 22 aa, Mycobacterium tuberculosis
ISRTSWDGIVVVCPPRANDESM

SEQ ID NO: 1459317 - protein, 28 aa, Mycobacterium tuberculosis
ITERRAGWRAARWLAVVINYRAERWSDV

SEQ ID NO: 1459318 - protein, 18 aa, Mycobacterium tuberculosis
ITLARMMSRRQFGQTLFE

SEQ ID NO: 1459319 - protein, 19 aa, Mycobacterium tuberculosis
ITLGTALARLGMFAPALSY

SEQ ID NO: 1459320 - protein, 18 aa, Mycobacterium tuberculosis
ITPHHLWLRAVAAGGQGR

SEQ ID NO: 1459321 - protein, 24 aa, Mycobacterium tuberculosis
IVEEPPEHLIFIFATTEPEKVLPT

SEQ ID NO: 1459322 - protein, 18 aa, Mycobacterium tuberculosis
IVTSMLFSMHGELYKAIA

SEQ ID NO: 1459323 - protein, 18 aa, Mycobacterium tuberculosis
IYAESFRGPQHLVEVQQT

SEQ ID NO: 1459324 - protein, 23 aa, Mycobacterium tuberculosis
KAGFDGVELVKALLFSVFEGGLR

SEQ ID NO: 1459325 - protein, 24 aa, Mycobacterium tuberculosis
KAKKLRVRLPLPKLIVAVENPQLL

SEQ ID NO: 1459326 - protein, 20 aa, Mycobacterium tuberculosis
KALDLPGGQGQHFFFDAGNG

SEQ ID NO: 1459327 - protein, 18 aa, Mycobacterium tuberculosis
KAQFEAAGLTYEHRLIDD

SEQ ID NO: 1459328 - protein, 23 aa, Mycobacterium tuberculosis
KARLRPPIRREGLGLVFETPTDE

SEQ ID NO: 1459329 - protein, 20 aa, Mycobacterium tuberculosis
KARYLRPLLDGEITSCYSMT

SEQ ID NO: 1459330 - protein, 21 aa, Mycobacterium tuberculosis
KATPEMVAFMVRYTSGYLCVP

SEQ ID NO: 1459331 - protein, 21 aa, Mycobacterium tuberculosis
KAVIVSEPFLVAIPILEQKGM

SEQ ID NO: 1459332 - protein, 25 aa, Mycobacterium tuberculosis
KAVVDARRGKMFARLIKNIEVAARV

SEQ ID NO: 1459333 - protein, 24 aa, Mycobacterium tuberculosis
KAYRVAGYRAGWLAITGPKEHASS

SEQ ID NO: 1459334 - protein, 20 aa, Mycobacterium tuberculosis
KDGRQLVIRDLFYDAQSTRQ

SEQ ID NO: 1459335 - protein, 23 aa, Mycobacterium tuberculosis
KDIPLRVKAAAVGLAADEYHAQD

SEQ ID NO: 1459336 - protein, 22 aa, Mycobacterium tuberculosis
KDLLRNTIVSFLRYIDANRASW

SEQ ID NO: 1459337 - protein, 18 aa, Mycobacterium tuberculosis
KDRDIAMVFQSYALYPHM

SEQ ID NO: 1459338 - protein, 27 aa, Mycobacterium tuberculosis
KDRFGAEIRTHYPLELEAEMGVIVQEA

SEQ ID NO: 1459339 - protein, 25 aa, Mycobacterium tuberculosis
KDRGCSFPNCDVPGYLTEVHHVTDF

SEQ ID NO: 1459340 - protein, 19 aa, Mycobacterium tuberculosis
KDTHAHAWALRMSPDGNVW

SEQ ID NO: 1459341 - protein, 20 aa, Mycobacterium tuberculosis
KDVSTAWQLDAYRFEIPVVA

SEQ ID NO: 1459342 - protein, 19 aa, Mycobacterium tuberculosis
KEELARWTPILEQEEVRQV

SEQ ID NO: 1459343 - protein, 20 aa, Mycobacterium tuberculosis
KEGNRFAGVFWSELSSGGVV

SEQ ID NO: 1459344 - protein, 17 aa, Mycobacterium tuberculosis
KELAEAYASMDVFVHSG

SEQ ID NO: 1459345 - protein, 19 aa, Mycobacterium tuberculosis
KENDGWRLITTQLNNERVM

SEQ ID NO: 1459346 - protein, 18 aa, Mycobacterium tuberculosis
KGFKSFAAPTTLRFEPGI

SEQ ID NO: 1459347 - protein, 18 aa, Mycobacterium tuberculosis
KGKAAVICSETTATTPDG

SEQ ID NO: 1459348 - protein, 20 aa, Mycobacterium tuberculosis
KGLPGARARRRGLSDSALGT

SEQ ID NO: 1459349 - protein, 25 aa, Mycobacterium tuberculosis
KHTPLKMCWVPGYSDYYPEAPGGRP

SEQ ID NO: 1459350 - protein, 19 aa, Mycobacterium tuberculosis
KINAAFALGGGRLLTQTVE

SEQ ID NO: 1459351 - protein, 22 aa, Mycobacterium tuberculosis
KKCGHLGGKVLIPTQQHIRTLT

SEQ ID NO: 1459352 - protein, 20 aa, Mycobacterium tuberculosis
KLAAAGCGRIVLTARSQPNP

SEQ ID NO: 1459353 - protein, 17 aa, Mycobacterium tuberculosis
KLAINYGLNKVRFPAPV

SEQ ID NO: 1459354 - protein, 31 aa, Mycobacterium tuberculosis; identical to SEQ ID NO: 201668

SEQ ID NO: 1459355 - protein, 28 aa, Mycobacterium tuberculosis
KLEETFMFYLPRICEHCLNPSCVASCPS

SEQ ID NO: 1459356 - protein, 24 aa, Mycobacterium tuberculosis
KLKWQRSDPEFAYSDRERDGLLEA

SEQ ID NO: 1459357 - protein, 25 aa, Mycobacterium tuberculosis
KLRSPISISTGVLWRDPTAGVVKAG

SEQ ID NO: 1459358 - protein, 18 aa, Mycobacterium tuberculosis
KLTGVPMLGISVLGEAHD

SEQ ID NO: 1459359 - protein, 18 aa, Mycobacterium tuberculosis
KMIIAGWSAYPRQLDFAR

SEQ ID NO: 1459360 - protein, 17 aa, Mycobacterium tuberculosis
KPLGGVTAIGVWGARHA

SEQ ID NO: 1459361 - protein, 17 aa, Mycobacterium tuberculosis
KPLPNPFIVAATQNPIE

SEQ ID NO: 1459362 - protein, 25 aa, Mycobacterium tuberculosis
KPNRKCLRITVGGGRNKVTATFFNA

SEQ ID NO: 1459363 - protein, 17 aa, Mycobacterium tuberculosis
KPSFYTGRGTFSLRLSE

SEQ ID NO: 1459364 - protein, 26 aa, Mycobacterium tuberculosis
KPSRGRLPLEPEYRRLPVGIVANGVL

SEQ ID NO: 1459365 - protein, 20 aa, Mycobacterium tuberculosis
KPVLCRQMEVYAGFLEYTDH

SEQ ID NO: 1459366 - protein, 18 aa, Mycobacterium tuberculosis
KRARRETRQVLRRLIDGM

SEQ ID NO: 1459367 - protein, 20 aa, Mycobacterium tuberculosis
KRKVRFLPYGIAVSVLDDPV

SEQ ID NO: 1459368 - protein, 21 aa, Mycobacterium tuberculosis
KRLCDPMAQQISTVWASSLPE

SEQ ID NO: 1459369 - protein, 25 aa, Mycobacterium tuberculosis
KRTGELIPLCHPLGIEAVTVTLEPQ

SEQ ID NO: 1459370 - protein, 17 aa, Mycobacterium tuberculosis
KRVALVFSAYPTKHARI

SEQ ID NO: 1459371 - protein, 27 aa, Mycobacterium tuberculosis
KSKHPGDALFAFLRSMVLQWGATDRGL

SEQ ID NO: 1459372 - protein, 30 aa, Mycobacterium tuberculosis; identical to SEQ ID NO: 201793

SEQ ID NO: 1459373 - protein, 18 aa, Mycobacterium tuberculosis
KTVRGHLDGIVRMLESDA

SEQ ID NO: 1459374 - protein, 22 aa, Mycobacterium tuberculosis
KVAEGRVAGVHFLMKKNKITEI

SEQ ID NO: 1459375 - protein, 21 aa, Mycobacterium tuberculosis
KVAEVKSGFGPEYTVTDVTPR

SEQ ID NO: 1459376 - protein, 18 aa, Mycobacterium tuberculosis
KVFDAFPLTHYVECVALL

SEQ ID NO: 1459377 - protein, 21 aa, Mycobacterium tuberculosis
KVSELKPAFRPNGTVTAGNAC

SEQ ID NO: 1459378 - protein, 24 aa, Mycobacterium tuberculosis
KVTSRPASPLTEWVARGTVDNIAF

SEQ ID NO: 1459379 - protein, 18 aa, Mycobacterium tuberculosis
KYVLKEYVGYVVEKRFNL

SEQ ID NO: 1459380 - protein, 22 aa, Mycobacterium tuberculosis
LAAAAGELRSLGATLKASNAAA

SEQ ID NO: 1459381 - protein, 22 aa, Mycobacterium tuberculosis
LAAAAKGKWSLASVNVDVAPRV

SEQ ID NO: 1459382 - protein, 21 aa, Mycobacterium tuberculosis
LAAEVMRRFGLTTKRAAVDLA

SEQ ID NO: 1459383 - protein, 17 aa, Mycobacterium tuberculosis
LAARLLAALAARRDAEL

SEQ ID NO: 1459384 - protein, 24 aa, Mycobacterium tuberculosis
LAARVGAPLVLRGIGVRRVTTDRG

SEQ ID NO: 1459385 - protein, 19 aa, Mycobacterium tuberculosis
LADCGYAGATVRHLLDMRS

SEQ ID NO: 1459386 - protein, 22 aa, Mycobacterium tuberculosis
LADPRRGFGMFTFVAASDVLGT

SEQ ID NO: 1459387 - protein, 24 aa, Mycobacterium tuberculosis
LAEHAGRRLIGFSAELGGKNPMIV

SEQ ID NO: 1459388 - protein, 22 aa, Mycobacterium tuberculosis
LAEKPQATRIVAWTDEDHDLTV

SEQ ID NO: 1459389 - protein, 20 aa, Mycobacterium tuberculosis
LAELDRVWGHLPFGAQWYSA

SEQ ID NO: 1459390 - protein, 33 aa, Mycobacterium tuberculosis; identical to SEQ ID NO: 201891

SEQ ID NO: 1459391 - protein, 26 aa, Mycobacterium tuberculosis
LAGELDRWVLRRACNEFSEWQSAGLG

SEQ ID NO: 1459392 - protein, 24 aa, Mycobacterium tuberculosis
LAGLKLLALGGRFIEIGKRDIYSN

SEQ ID NO: 1459393 - protein, 38 aa, Mycobacterium tuberculosis; identical to SEQ ID NO: 201914

SEQ ID NO: 1459394 - protein, 18 aa, Mycobacterium tuberculosis
LAHWTRLYPEVRVDRAIA

SEQ ID NO: 1459395 - protein, 24 aa, Mycobacterium tuberculosis
LAIELARSGAKVAISDVDTDGLAD

SEQ ID NO: 1459396 - protein, 18 aa, Mycobacterium tuberculosis
LAIGQRFVAEGARVVLGD

SEQ ID NO: 1459397 - protein, 17 aa, Mycobacterium tuberculosis
LAIPFDVVVAGVRRQPY

SEQ ID NO: 1459398 - protein, 21 aa, Mycobacterium tuberculosis
LALKPRKAFSPIRVAATGTTV

SEQ ID NO: 1459399 - protein, 18 aa, Mycobacterium tuberculosis
LALTALWRSYGVTPDAVI

SEQ ID NO: 1459400 - protein, 26 aa, Mycobacterium tuberculosis
LAMLRRLMMDDSFFRGELIYVFDGDE

SEQ ID NO: 1459401 - protein, 26 aa, Mycobacterium tuberculosis
LAMSRELGVQFARQGIRVNALCPGPV

SEQ ID NO: 1459402 - protein, 19 aa, Mycobacterium tuberculosis
LAPHALEWDAAKHFPVDVL

SEQ ID NO: 1459403 - protein, 19 aa, Mycobacterium tuberculosis
LARAWTRAAAQDMTGAIAA

SEQ ID NO: 1459404 - protein, 20 aa, Mycobacterium tuberculosis
LAREDLSVWVVTGDGDALSI

SEQ ID NO: 1459405 - protein, 22 aa, Mycobacterium tuberculosis
LARLKEVGVHIAIDDFGTGYSA

SEQ ID NO: 1459406 - protein, 19 aa, Mycobacterium tuberculosis
LARLQEVWLGRQIAEVKSK

SEQ ID NO: 1459407 - protein, 24 aa, Mycobacterium tuberculosis
LARLWPSLLADRYGRGFSVARRLA

SEQ ID NO: 1459408 - protein, 17 aa, Mycobacterium tuberculosis
LASTLARELHDVDRLSA

SEQ ID NO: 1459409 - protein, 20 aa, Mycobacterium tuberculosis
LASVCGSTGWVSSIVGVHNW

SEQ ID NO: 1459410 - protein, 18 aa, Mycobacterium tuberculosis
LASWLQRLQSIPGAASLD

SEQ ID NO: 1459411 - protein, 22 aa, Mycobacterium tuberculosis
LATAAARMVTAWRRQRGQQTPA

SEQ ID NO: 1459412 - protein, 19 aa, Mycobacterium tuberculosis
LAVGRRLRDRYGIDEKPTA

SEQ ID NO: 1459413 - protein, 20 aa, Mycobacterium tuberculosis
LAVQVLKLPRLKAVAHATDC

SEQ ID NO: 1459414 - protein, 20 aa, Mycobacterium tuberculosis
LCDIFARYDVTFSLGDGLRP

SEQ ID NO: 1459415 - protein, 18 aa, Mycobacterium tuberculosis
LCSPTRASLLTGRNATTV

SEQ ID NO: 1459416 - protein, 29 aa, Mycobacterium tuberculosis
LDAELRYKMCVDAVAFARHIGYSCAGTVE

SEQ ID NO: 1459417 - protein, 24 aa, Mycobacterium tuberculosis
LDAMCRRLRSQGVRLVYETARRGT

SEQ ID NO: 1459418 - protein, 18 aa, Mycobacterium tuberculosis
LDDRCRWLAPVPGTDVAI

SEQ ID NO: 1459419 - protein, 24 aa, Mycobacterium tuberculosis
LDFEPRTVWWGSANWTVRAGSHLE

SEQ ID NO: 1459420 - protein, 18 aa, Mycobacterium tuberculosis
LDGSLGMRDARERGTDVV

SEQ ID NO: 1459421 - protein, 19 aa, Mycobacterium tuberculosis
LDHACGLGTGGLFEEDVAE

SEQ ID NO: 1459422 - protein, 17 aa, Mycobacterium tuberculosis
LDLVDSLGFTLSGLQPG

SEQ ID NO: 1459423 - protein, 19 aa, Mycobacterium tuberculosis
LDPDASLGAGWACGVTVVL

SEQ ID NO: 1459424 - protein, 20 aa, Mycobacterium tuberculosis
LDPDLLIGEMVFVPNPSARA

SEQ ID NO: 1459425 - protein, 19 aa, Mycobacterium tuberculosis
LDPPFGIPATVWQKSLLPI

SEQ ID NO: 1459426 - protein, 27 aa, Mycobacterium tuberculosis
LDQRCYRAQGFLFSRPVPGEAMRHMLS

SEQ ID NO: 1459427 - protein, 19 aa, Mycobacterium tuberculosis
LDRLAELGVSEIFGVPGDY

SEQ ID NO: 1459428 - protein, 17 aa, Mycobacterium tuberculosis
LDRRLLLGMLAELPAGA

SEQ ID NO: 1459429 - protein, 17 aa, Mycobacterium tuberculosis
LDTEAIAVVQGDGAVSQ

SEQ ID NO: 1459430 - protein, 24 aa, Mycobacterium tuberculosis
LDTWFSSALWPFSTLGWPDKTAEL

SEQ ID NO: 1459431 - protein, 23 aa, Mycobacterium tuberculosis
LDVRVAAVVTCVDCVRWLPQSLG

SEQ ID NO: 1459432 - protein, 18 aa, Mycobacterium tuberculosis
LEFYDLSHPWGHGAPAWP

SEQ ID NO: 1459433 - protein, 25 aa, Mycobacterium tuberculosis
LEHPDRAVAVLAALPAWTGEPELAP

SEQ ID NO: 1459434 - protein, 23 aa, Mycobacterium tuberculosis
LEIGTGWGELCIRAAARGAHIRS

SEQ ID NO: 1459435 - protein, 28 aa, Mycobacterium tuberculosis
LELGFRSSIQREWQWRLSRGESLQNLQA

SEQ ID NO: 1459436 - protein, 25 aa, Mycobacterium tuberculosis
LELPDIKCVYWAGGNPFHHHQNLPR

SEQ ID NO: 1459437 - protein, 20 aa, Mycobacterium tuberculosis
LEMKDLLVVGDIPGFADSLL

SEQ ID NO: 1459438 - protein, 20 aa, Mycobacterium tuberculosis
LESTMRFLLSAKSAYVDGQV

SEQ ID NO: 1459439 - protein, 18 aa, Mycobacterium tuberculosis
LETLYLIDRIPAWSTNLS

SEQ ID NO: 1459440 - protein, 20 aa, Mycobacterium tuberculosis
LEVLEGRGAGPLKDYVYIDV

SEQ ID NO: 1459441 - protein, 21 aa, Mycobacterium tuberculosis
LEVTTRLAAPLLPLITEIIWR

SEQ ID NO: 1459442 - protein, 28 aa, Mycobacterium tuberculosis
LFESALDPCTRCWELGPDGQWTASPQEG

SEQ ID NO: 1459443 - protein, 30 aa, Mycobacterium tuberculosis; identical to SEQ ID NO: 202254

SEQ ID NO: 1459444 - protein, 17 aa, Mycobacterium tuberculosis
LFLFHLLEYMDVDYELD

SEQ ID NO: 1459445 - protein, 17 aa, Mycobacterium tuberculosis
LFNPGHGNTGFLNAGSF

SEQ ID NO: 1459446 - protein, 18 aa, Mycobacterium tuberculosis
LFRYPGVRSDSSIFTLSF

SEQ ID NO: 1459447 - protein, 19 aa, Mycobacterium tuberculosis
LGAALWRGVELVVASMGGV

SEQ ID NO: 1459448 - protein, 19 aa, Mycobacterium tuberculosis
LGAAVAAAWALEHPDRAVA

SEQ ID NO: 1459449 - protein, 37 aa, Mycobacterium tuberculosis; identical to SEQ ID NO: 202275

SEQ ID NO: 1459450 - protein, 18 aa, Mycobacterium tuberculosis
LGASLLIRAARPVASPAL

SEQ ID NO: 1459451 - protein, 21 aa, Mycobacterium tuberculosis
LGDDLPVAWKHRSERYTEKLA

SEQ ID NO: 1459452 - protein, 24 aa, Mycobacterium tuberculosis
LGDRWTLLIVRELLFGPLRFTEIE

SEQ ID NO: 1459453 - protein, 19 aa, Mycobacterium tuberculosis
LGEALGFDVDTPWRKLPAK

SEQ ID NO: 1459454 - protein, 24 aa, Mycobacterium tuberculosis
LGELRPGSRVNLERAAALGSRLGG

SEQ ID NO: 1459455 - protein, 21 aa, Mycobacterium tuberculosis
LGEQFMQWFLQEQIEEVALMA

SEQ ID NO: 1459456 - protein, 18 aa, Mycobacterium tuberculosis
LGEVNPRLSGASPMTNLT

SEQ ID NO: 1459457 - protein, 18 aa, Mycobacterium tuberculosis
LGFYTGLVDGHFGLQTHN

SEQ ID NO: 1459458 - protein, 28 aa, Mycobacterium tuberculosis
LGGGKRLRPLFAYWGWHAVASREPDPDV

SEQ ID NO: 1459459 - protein, 24 aa, Mycobacterium tuberculosis
LGGKLPFALAERLHISRGEASRRI

SEQ ID NO: 1459460 - protein, 26 aa, Mycobacterium tuberculosis
LGGRWADSFGGLVFDATGITEPAGLK

SEQ ID NO: 1459461 - protein, 28 aa, Mycobacterium tuberculosis
LGIEFPIFAFTHCRDVVVAVSKAGGFGV

SEQ ID NO: 1459462 - protein, 21 aa, Mycobacterium tuberculosis
LGNWFRAAGYDTHYDGKWHIS

SEQ ID NO: 1459463 - protein, 17 aa, Mycobacterium tuberculosis
LGPARLDEVAPRAAAVV

SEQ ID NO: 1459464 - protein, 32 aa, Mycobacterium tuberculosis; identical to SEQ ID NO: 202344

SEQ ID NO: 1459465 - protein, 17 aa, Mycobacterium tuberculosis
LGPNGIGVLYGRRELLA

SEQ ID NO: 1459466 - protein, 18 aa, Mycobacterium tuberculosis
LGQFQFALELAEQVSTTN

SEQ ID NO: 1459467 - protein, 27 aa, Mycobacterium tuberculosis
LGTDRSWRPDVVHAHDWLVAHPAIALA

SEQ ID NO: 1459468 - protein, 19 aa, Mycobacterium tuberculosis
LGTLPNLTWSRLKVNVAVT

SEQ ID NO: 1459469 - protein, 17 aa, Mycobacterium tuberculosis
LGTLTWRQLDERGNALA

SEQ ID NO: 1459470 - protein, 20 aa, Mycobacterium tuberculosis
LGVLPARVAECLAAIEAPLV

SEQ ID NO: 1459471 - protein, 18 aa, Mycobacterium tuberculosis
LHEAELQLAEFIGLDEVK

SEQ ID NO: 1459472 - protein, 17 aa, Mycobacterium tuberculosis
LHGGYGYMREYPVARAY

SEQ ID NO: 1459473 - protein, 26 aa, Mycobacterium tuberculosis
LHKQRTGLPHVTWKYATSIDGRSAAA

SEQ ID NO: 1459474 - protein, 20 aa, Mycobacterium tuberculosis
LIAGVARYDGTPGTIADQDV

SEQ ID NO: 1459475 - protein, 18 aa, Mycobacterium tuberculosis
LINIHHSFLPAFTGAAPY

SEQ ID NO: 1459476 - protein, 24 aa, Mycobacterium tuberculosis
LITVLKGAVLFVTDLARAIPVPTQ

SEQ ID NO: 1459477 - protein, 18 aa, Mycobacterium tuberculosis
LKDRVGLRPDQVSFGKLN

SEQ ID NO: 1459478 - protein, 19 aa, Mycobacterium tuberculosis
LKQLQPFVASSLKQALQYA

SEQ ID NO: 1459479 - protein, 21 aa, Mycobacterium tuberculosis
LLADRFGCRTIVFTGVAGGLD

SEQ ID NO: 1459480 - protein, 19 aa, Mycobacterium tuberculosis
LLAFTAFPKQIWRQIWSNN

SEQ ID NO: 1459481 - protein, 25 aa, Mycobacterium tuberculosis
LLDIGCGWGATMRRAIAQYDVNVVG

SEQ ID NO: 1459482 - protein, 19 aa, Mycobacterium tuberculosis
LLDNIAIEIGTFAGTDRPD

SEQ ID NO: 1459483 - protein, 17 aa, Mycobacterium tuberculosis
LLDRHRPLWELHVVEGL

SEQ ID NO: 1459484 - protein, 21 aa, Mycobacterium tuberculosis
LLEALPQFRFDADACELLAQF

SEQ ID NO: 1459485 - protein, 25 aa, Mycobacterium tuberculosis
LLGLVERLPWLSAVPAYFVGVGVRP

SEQ ID NO: 1459486 - protein, 24 aa, Mycobacterium tuberculosis
LLHLARDIGCVFSIDTDAHAPGQL

SEQ ID NO: 1459487 - protein, 19 aa, Mycobacterium tuberculosis
LLLNRISLAPGEAIFLPAG

SEQ ID NO: 1459488 - protein, 23 aa, Mycobacterium tuberculosis
LLQRPEEVAARRGLPIEDVAPAG

SEQ ID NO: 1459489 - protein, 17 aa, Mycobacterium tuberculosis
LLRSMRSPIPITELQRQ

SEQ ID NO: 1459490 - protein, 25 aa, Mycobacterium tuberculosis
LLSMRTGQGYAEFAVSSFGTDAVIG

SEQ ID NO: 1459491 - protein, 18 aa, Mycobacterium tuberculosis
LLTDWRVTRGRLHEELLA

SEQ ID NO: 1459492 - protein, 18 aa, Mycobacterium tuberculosis
LLTLLLFDIGSFAGLAAL

SEQ ID NO: 1459493 - protein, 23 aa, Mycobacterium tuberculosis
LLYRLCGDRNPLHSDPEFAAAAG

SEQ ID NO: 1459494 - protein, 23 aa, Mycobacterium tuberculosis
LMAEAIVAMFNQFCYLQLSGKRS

SEQ ID NO: 1459495 - protein, 26 aa, Mycobacterium tuberculosis
LMLDDASKIVGCWNGLAKRSGTGIVA

SEQ ID NO: 1459496 - protein, 24 aa, Mycobacterium tuberculosis
LMSRAGYPTACFVSINRHKSVANY

SEQ ID NO: 1459497 - protein, 32 aa, Mycobacterium tuberculosis; identical to SEQ ID NO: 202634

SEQ ID NO: 1459498 - protein, 18 aa, Mycobacterium tuberculosis
LNFISDLNAVAGITFVHT

SEQ ID NO: 1459499 - protein, 24 aa, Mycobacterium tuberculosis
LNSPLSDFFIKWMSRINTWMYRRN

SEQ ID NO: 1459500 - protein, 18 aa, Mycobacterium tuberculosis
LNTGFGNAGFVNTGFDNS

SEQ ID NO: 1459501 - protein, 25 aa, Mycobacterium tuberculosis
LNVSGGVLYRFAVDPDRSAQFLLVV

SEQ ID NO: 1459502 - protein, 22 aa, Mycobacterium tuberculosis
LPAADLRPAYSNADAARQVADG

SEQ ID NO: 1459503 - protein, 19 aa, Mycobacterium tuberculosis
LPADLLIHNRWHRDPHGSI

SEQ ID NO: 1459504 - protein, 19 aa, Mycobacterium tuberculosis
LPALGRSGAFDILLAAYSL

SEQ ID NO: 1459505 - protein, 19 aa, Mycobacterium tuberculosis
LPARGRFSAHTFWDDIKAV

SEQ ID NO: 1459506 - protein, 19 aa, Mycobacterium tuberculosis
LPDPYRPHRSAVLTASLTS

SEQ ID NO: 1459507 - protein, 17 aa, Mycobacterium tuberculosis
LPEDRVVVELSPYDLSR

SEQ ID NO: 1459508 - protein, 21 aa, Mycobacterium tuberculosis
LPGMVKRGAGAVLNIASIAGF

SEQ ID NO: 1459509 - protein, 17 aa, Mycobacterium tuberculosis
LPGRGWVEYEPYGTVLI

SEQ ID NO: 1459510 - protein, 21 aa, Mycobacterium tuberculosis
LPGRRYYGGCEHVDVVENLAR

SEQ ID NO: 1459511 - protein, 24 aa, Mycobacterium tuberculosis
LPHFNLSVGVTDAFLRAVERNGLH

SEQ ID NO: 1459512 - protein, 20 aa, Mycobacterium tuberculosis
LPISVVRPATKYERKAQLGG

SEQ ID NO: 1459513 - protein, 17 aa, Mycobacterium tuberculosis
LPKTRSGKIMRRLLRDV

SEQ ID NO: 1459514 - protein, 17 aa, Mycobacterium tuberculosis
LPLFEPPGDEFFGRYRD

SEQ ID NO: 1459515 - protein, 19 aa, Mycobacterium tuberculosis
LPQTFADLGPTYVKFGQII

SEQ ID NO: 1459516 - protein, 20 aa, Mycobacterium tuberculosis
LPRTIQIEAGVFLWCTPGDA

SEQ ID NO: 1459517 - protein, 24 aa, Mycobacterium tuberculosis
LPSARRLLLFKADGSVSVHADDRA

SEQ ID NO: 1459518 - protein, 21 aa, Mycobacterium tuberculosis
LPSCKELIESIVLDAITHLQT

SEQ ID NO: 1459519 - protein, 19 aa, Mycobacterium tuberculosis
LPSDITFHRWCAALSTRWC

SEQ ID NO: 1459520 - protein, 23 aa, Mycobacterium tuberculosis
LPSRCAEDLFAGWWRLIEALGAV

SEQ ID NO: 1459521 - protein, 18 aa, Mycobacterium tuberculosis
LPTVWDFETDPQYQSKLD

SEQ ID NO: 1459522 - protein, 24 aa, Mycobacterium tuberculosis
LPTYAVICCPAFGAAAKVGTFNPA

SEQ ID NO: 1459523 - protein, 22 aa, Mycobacterium tuberculosis
LPVGGWNCRPTADFGYSACAAA

SEQ ID NO: 1459524 - protein, 21 aa, Mycobacterium tuberculosis
LPVICSHWYGLIPPIKEVRDQ

SEQ ID NO: 1459525 - protein, 20 aa, Mycobacterium tuberculosis
LPVTVFRCDMILADTSYTGQ

SEQ ID NO: 1459526 - protein, 17 aa, Mycobacterium tuberculosis
LPYYVSLFEQMKNEARA

SEQ ID NO: 1459527 - protein, 19 aa, Mycobacterium tuberculosis
LQAPYELVAEVARAGKLPV

SEQ ID NO: 1459528 - protein, 19 aa, Mycobacterium tuberculosis
LQLSTLAPMRPRVGVHTGD

SEQ ID NO: 1459529 - protein, 27 aa, Mycobacterium tuberculosis
LQWGCFRFGIVQGCDHFTFFASVDHVH

SEQ ID NO: 1459530 - protein, 24 aa, Mycobacterium tuberculosis
LRAGVARSGFYFYFDSKYSVLAQI

SEQ ID NO: 1459531 - protein, 20 aa, Mycobacterium tuberculosis
LRDAVNAVARRHRILRTTYP

SEQ ID NO: 1459532 - protein, 24 aa, Mycobacterium tuberculosis
LRDICRRYEVLLIFDEIATGFGRT

SEQ ID NO: 1459533 - protein, 25 aa, Mycobacterium tuberculosis
LRDLASRIYTDFTYRSGSTTISTGV

SEQ ID NO: 1459534 - protein, 21 aa, Mycobacterium tuberculosis
LREAVDFELPAPGSYATGIAF

SEQ ID NO: 1459535 - protein, 23 aa, Mycobacterium tuberculosis
LRELSQRLSAPRVVWVMVPAGNI

SEQ ID NO: 1459536 - protein, 18 aa, Mycobacterium tuberculosis
LRESVVAALARRYGITRL

SEQ ID NO: 1459537 - protein, 24 aa, Mycobacterium tuberculosis
LRFLKEDPWERLATLRAAMPNICL

SEQ ID NO: 1459538 - protein, 28 aa, Mycobacterium tuberculosis
LRGLRMVGRGVLRPGLAVLVGDETVGVT

SEQ ID NO: 1459539 - protein, 28 aa, Mycobacterium tuberculosis
LRKLLAQEWLRFGWFFLVTRRDPKGLWE

SEQ ID NO: 1459540 - protein, 21 aa, Mycobacterium tuberculosis
LRKTFASGRTRSVEWRKQQLR

SEQ ID NO: 1459541 - protein, 20 aa, Mycobacterium tuberculosis
LRLMMKYDPHFFTFLEIPEV

SEQ ID NO: 1459542 - protein, 23 aa, Mycobacterium tuberculosis
LRLRMADLQARVDLLRYALHGIA

SEQ ID NO: 1459543 - protein, 17 aa, Mycobacterium tuberculosis
LRPLHPYGVSKAATDML

SEQ ID NO: 1459544 - protein, 17 aa, Mycobacterium tuberculosis
LRPSRGTHLVFDAKSFA

SEQ ID NO: 1459545 - protein, 18 aa, Mycobacterium tuberculosis
LRQLAIGSEGVFGVITRV

SEQ ID NO: 1459546 - protein, 20 aa, Mycobacterium tuberculosis
LRRELLRDGQAFYVHNRVSS

SEQ ID NO: 1459547 - protein, 22 aa, Mycobacterium tuberculosis
LRSTEAQWARTLAKQTELQAEL

SEQ ID NO: 1459548 - protein, 19 aa, Mycobacterium tuberculosis
LRTAVLDFIDRLRCAERAI

SEQ ID NO: 1459549 - protein, 24 aa, Mycobacterium tuberculosis
LRTPESWLLIDFEGEPGQPLDERR

SEQ ID NO: 1459550 - protein, 17 aa, Mycobacterium tuberculosis
LRTVKREVASAISRSHR

SEQ ID NO: 1459551 - protein, 28 aa, Mycobacterium tuberculosis
LRVAPSASWMLEYYPIRELRQLPDGSCE

SEQ ID NO: 1459552 - protein, 26 aa, Mycobacterium tuberculosis
LRVHARTGLPCPVCGDTVREVSFADK

SEQ ID NO: 1459553 - protein, 18 aa, Mycobacterium tuberculosis
LRVLRNIERVIRDEMNAI

SEQ ID NO: 1459554 - protein, 17 aa, Mycobacterium tuberculosis
LRVPLRETFAGNAKGHG

SEQ ID NO: 1459555 - protein, 17 aa, Mycobacterium tuberculosis
LRWYGLDGVEHTGGPLV

SEQ ID NO: 1459556 - protein, 20 aa, Mycobacterium tuberculosis
LSEAAFRRFVAALDEPDEAA

SEQ ID NO: 1459557 - protein, 22 aa, Mycobacterium tuberculosis
LSEAARQGFTIALVPPSDDPVP

SEQ ID NO: 1459558 - protein, 19 aa, Mycobacterium tuberculosis
LSPEIMGLGPIEASKKALE

SEQ ID NO: 1459559 - protein, 18 aa, Mycobacterium tuberculosis
LSPRGDWRAPSDMSARIW

SEQ ID NO: 1459560 - protein, 25 aa, Mycobacterium tuberculosis
LSRLAAQGWVCLSIDYRVAPHHRWP

SEQ ID NO: 1459561 - protein, 28 aa, Mycobacterium tuberculosis
LSRQDWTPSYCRHRRNLQLIGLNDAEKR

SEQ ID NO: 1459562 - protein, 21 aa, Mycobacterium tuberculosis
LSVEVNGGIGPIVVPDITIPG

SEQ ID NO: 1459563 - protein, 17 aa, Mycobacterium tuberculosis
LSVPPSWAGQANLVSST

SEQ ID NO: 1459564 - protein, 19 aa, Mycobacterium tuberculosis
LTGCAKLFRVGYIDVNQFT

SEQ ID NO: 1459565 - protein, 26 aa, Mycobacterium tuberculosis
LTGGETIDLLARMRGGIDNARRAELI

SEQ ID NO: 1459566 - protein, 26 aa, Mycobacterium tuberculosis
LTGLRQRWALVGGFAVSARSEPRFTR

SEQ ID NO: 1459567 - protein, 24 aa, Mycobacterium tuberculosis
LTGPRWRLGARDLAALWRRALTLS

SEQ ID NO: 1459568 - protein, 22 aa, Mycobacterium tuberculosis
LTIPMFFGAELVKVTPMDFLRD

SEQ ID NO: 1459569 - protein, 19 aa, Mycobacterium tuberculosis
LTPHSKWSFHSTYQDNLYM

SEQ ID NO: 1459570 - protein, 20 aa, Mycobacterium tuberculosis
LTRNLPRLIRPVATVLGPLL

SEQ ID NO: 1459571 - protein, 27 aa, Mycobacterium tuberculosis
LTRTLKGWADRGVRVIGLDAGGGTALD

SEQ ID NO: 1459572 - protein, 18 aa, Mycobacterium tuberculosis
LTSARLAADVADVPTVVI

SEQ ID NO: 1459573 - protein, 19 aa, Mycobacterium tuberculosis
LTSVFRATRAALRYFRDAP

SEQ ID NO: 1459574 - protein, 17 aa, Mycobacterium tuberculosis
LTVRDNVAFGLKIRKRP

SEQ ID NO: 1459575 - protein, 20 aa, Mycobacterium tuberculosis
LTVTCSRDLVLSAPVKLAEG

SEQ ID NO: 1459576 - protein, 26 aa, Mycobacterium tuberculosis
LVAANRSDLVSLVFSNFFGQNAPAIA

SEQ ID NO: 1459577 - protein, 26 aa, Mycobacterium tuberculosis
LVAANRSGLISLVISNLFGQNAPAIA

SEQ ID NO: 1459578 - protein, 20 aa, Mycobacterium tuberculosis
LVEHFILEDWWGRWLGRWTA

SEQ ID NO: 1459579 - protein, 24 aa, Mycobacterium tuberculosis
LVELLEIRAALGPLIGRLAAARST

SEQ ID NO: 1459580 - protein, 19 aa, Mycobacterium tuberculosis
LVNAVGYPLAADVALFTAA

SEQ ID NO: 1459581 - protein, 21 aa, Mycobacterium tuberculosis
LVPQHLMRRLFFTAATVDAAT

SEQ ID NO: 1459582 - protein, 25 aa, Mycobacterium tuberculosis
LVQGGGFAGPLFDGFDNLYVGQPGA

SEQ ID NO: 1459583 - protein, 18 aa, Mycobacterium tuberculosis
LWLDLTYAGSRPVVLTGA

SEQ ID NO: 1459584 - protein, 19 aa, Mycobacterium tuberculosis
LWLNESFATFASVLCQSEA

SEQ ID NO: 1459585 - protein, 26 aa, Mycobacterium tuberculosis
LWRPPLRPGEWRTLGLFAADDNGELE

SEQ ID NO: 1459586 - protein, 26 aa, Mycobacterium tuberculosis
LYIQLYLGGFGLELSDIESLRTWGSK

SEQ ID NO: 1459587 - protein, 17 aa, Mycobacterium tuberculosis
LYLLPGYHGTGAAAALM

SEQ ID NO: 1459588 - protein, 25 aa, Mycobacterium tuberculosis
LYYEAYPAMVHRTLMDIIEECERQA

SEQ ID NO: 1459589 - protein, 20 aa, Mycobacterium tuberculosis
MAAAATPYVGWLAATAALAK

SEQ ID NO: 1459590 - protein, 20 aa, Mycobacterium tuberculosis
MAASMGEFLLAAGTKGKRYA

SEQ ID NO: 1459591 - protein, 18 aa, Mycobacterium tuberculosis
MADEGRNDIRIEAALAKL

SEQ ID NO: 1459592 - protein, 24 aa, Mycobacterium tuberculosis
MAFGGKGRAAIAIGNPDTAKHTAV

SEQ ID NO: 1459593 - protein, 17 aa, Mycobacterium tuberculosis
MAGCDDVYYCVVDTRAW

SEQ ID NO: 1459594 - protein, 17 aa, Mycobacterium tuberculosis
MAGKVMKVRGKIAAGAP

SEQ ID NO: 1459595 - protein, 21 aa, Mycobacterium tuberculosis
MAGPRVKRTLTANGLRQLIAF

SEQ ID NO: 1459596 - protein, 25 aa, Mycobacterium tuberculosis
MALIHKRAHGVAVVILEGRPIGLVR

SEQ ID NO: 1459597 - protein, 18 aa, Mycobacterium tuberculosis
MAVARAREMTALLRAIVE

SEQ ID NO: 1459598 - protein, 21 aa, Mycobacterium tuberculosis
MAVERIELFVDVLLKGGRTAD

SEQ ID NO: 1459599 - protein, 22 aa, Mycobacterium tuberculosis
MAVSRAGDWFGSPVNVASRVTG

SEQ ID NO: 1459600 - protein, 24 aa, Mycobacterium tuberculosis
MDTFGKWVSPARLMVTQFKDYFGL

SEQ ID NO: 1459601 - protein, 18 aa, Mycobacterium tuberculosis
MFVGGRRGSSVTVSDKTL

SEQ ID NO: 1459602 - protein, 19 aa, Mycobacterium tuberculosis
MGRATSGVQGMRFNIDDRL

SEQ ID NO: 1459603 - protein, 22 aa, Mycobacterium tuberculosis
MGSDHIRPAMAINKEINLRFVL

SEQ ID NO: 1459604 - protein, 20 aa, Mycobacterium tuberculosis
MGSGAGRAFNNFAAPRYGFK

SEQ ID NO: 1459605 - protein, 25 aa, Mycobacterium tuberculosis
MGSLARLPLILSDGHLRELALTGKN

SEQ ID NO: 1459606 - protein, 20 aa, Mycobacterium tuberculosis
MLAAAAAWEALAAELQTTAS

SEQ ID NO: 1459607 - protein, 17 aa, Mycobacterium tuberculosis
MLAFLQKRPPRWVQPAT

SEQ ID NO: 1459608 - protein, 20 aa, Mycobacterium tuberculosis
MLAQRVGAWVPLGEVPEVWA

SEQ ID NO: 1459609 - protein, 21 aa, Mycobacterium tuberculosis
MLDYDCPRSALKKATAITPGL

SEQ ID NO: 1459610 - protein, 20 aa, Mycobacterium tuberculosis
MLIAGGRRAVLCGNIGSAVL

SEQ ID NO: 1459611 - protein, 17 aa, Mycobacterium tuberculosis
MLLHQAFAQVEQFTGLP

SEQ ID NO: 1459612 - protein, 20 aa, Mycobacterium tuberculosis
MMPLQEVVRIAADEAGVPPP

SEQ ID NO: 1459613 - protein, 21 aa, Mycobacterium tuberculosis
MMRLECPAGLDLRTPNPEAYE

SEQ ID NO: 1459614 - protein, 23 aa, Mycobacterium tuberculosis
MNAFGIALLCHVLLVETDDGLVL

SEQ ID NO: 1459615 - protein, 24 aa, Mycobacterium tuberculosis
MPDRVKCLHVLIAHSLAKGPGLNP

SEQ ID NO: 1459616 - protein, 29 aa, Mycobacterium tuberculosis
MPRHPIRLARFGPRAALPATAMARRFHTE

SEQ ID NO: 1459617 - protein, 19 aa, Mycobacterium tuberculosis
MQELVRYGVQPDWFELGDR

SEQ ID NO: 1459618 - protein, 25 aa, Mycobacterium tuberculosis
MQLTLTELWRSYGVQPDLVIGHSMG

SEQ ID NO: 1459619 - protein, 27 aa, Mycobacterium tuberculosis
MRDELRSLLRFVLDLLADYGLTDFYLE

SEQ ID NO: 1459620 - protein, 17 aa, Mycobacterium tuberculosis
MRGGNPLAYLDSGATSQ

SEQ ID NO: 1459621 - protein, 23 aa, Mycobacterium tuberculosis
MRLAGNAHFTFRGCEGDALLMLL

SEQ ID NO: 1459622 - protein, 22 aa, Mycobacterium tuberculosis
MRVPLEGGGRLVVELTPDEAAA

SEQ ID NO: 1459623 - protein, 17 aa, Mycobacterium tuberculosis
MRYDLSAGFPLLTTKKV

SEQ ID NO: 1459624 - protein, 20 aa, Mycobacterium tuberculosis
MRYTCERLVRGLDTIAATGN

SEQ ID NO: 1459625 - protein, 22 aa, Mycobacterium tuberculosis
MSDGWLGLLACGDHHLDTLAGA

SEQ ID NO: 1459626 - protein, 22 aa, Mycobacterium tuberculosis
MSPGERLLGLDLANGGHLTHGM

SEQ ID NO: 1459627 - protein, 19 aa, Mycobacterium tuberculosis
MSRSEFFTKAAQRYLHELD

SEQ ID NO: 1459628 - protein, 19 aa, Mycobacterium tuberculosis
MSVAYRLTGTVADAEDIVQ

SEQ ID NO: 1459629 - protein, 18 aa, Mycobacterium tuberculosis
MSVPPSWAAATPAIRTVA

SEQ ID NO: 1459630 - protein, 24 aa, Mycobacterium tuberculosis
MTAHLRPGQLVLIHGGASGIGSHA

SEQ ID NO: 1459631 - protein, 17 aa, Mycobacterium tuberculosis
MTLEMGKTLAAAKAEAL

SEQ ID NO: 1459632 - protein, 27 aa, Mycobacterium tuberculosis
MVAACLKWEGGYVWACKNYDGDVQSDT

SEQ ID NO: 1459633 - protein, 19 aa, Mycobacterium tuberculosis
MVELFPGIVERIDTQLPNW

SEQ ID NO: 1459634 - protein, 23 aa, Mycobacterium tuberculosis
NAAGLPSLMVLTGVNSAWDAVYA

SEQ ID NO: 1459635 - protein, 18 aa, Mycobacterium tuberculosis
NALAEVFAEVGLPEGVLS

SEQ ID NO: 1459636 - protein, 18 aa, Mycobacterium tuberculosis
NAPLVSFDETFKLVKVNP

SEQ ID NO: 1459637 - protein, 17 aa, Mycobacterium tuberculosis
NDGCCSHGAFLSDDDDR

SEQ ID NO: 1459638 - protein, 28 aa, Mycobacterium tuberculosis
NDGKLKYCYNLGGIKHFYAESADPLPAG

SEQ ID NO: 1459639 - protein, 19 aa, Mycobacterium tuberculosis
NDGMLRVRATLVLDGDTLR

SEQ ID NO: 1459640 - protein, 19 aa, Mycobacterium tuberculosis
NDQFLLYAFDGEPTDLERA

SEQ ID NO: 1459641 - protein, 20 aa, Mycobacterium tuberculosis
NEAFASVVLSWARVHEPDMD

SEQ ID NO: 1459642 - protein, 19 aa, Mycobacterium tuberculosis
NEIQIVVTILSLDPGDLYD

SEQ ID NO: 1459643 - protein, 23 aa, Mycobacterium tuberculosis
NEVTEIIPLDGFLDGLALYDELD

SEQ ID NO: 1459644 - protein, 25 aa, Mycobacterium tuberculosis
NFTPKIRFWHVESAPRVRSLAKSLA

SEQ ID NO: 1459645 - protein, 20 aa, Mycobacterium tuberculosis
NGHTAEYFTRMMAGLGEALG

SEQ ID NO: 1459646 - protein, 20 aa, Mycobacterium tuberculosis
NGSPSWSAAPNFAFELAVRK

SEQ ID NO: 1459647 - protein, 24 aa, Mycobacterium tuberculosis
NGTEVLRLGGRIADIVGLAGISHN

SEQ ID NO: 1459648 - protein, 20 aa, Mycobacterium tuberculosis
NGTMRRLHNAVALGLINIDE

SEQ ID NO: 1459649 - protein, 24 aa, Mycobacterium tuberculosis
NHDRELAKLFGPVDRDEWFMTPQT

SEQ ID NO: 1459650 - protein, 25 aa, Mycobacterium tuberculosis
NITQLPLGFMVEFDRAGVLVEAEHL

SEQ ID NO: 1459651 - protein, 24 aa, Mycobacterium tuberculosis
NKYRLIFEKLRLEPGDRLLDVGCG

SEQ ID NO: 1459652 - protein, 18 aa, Mycobacterium tuberculosis
NLADGIVVLEFVDHELGA

SEQ ID NO: 1459653 - protein, 20 aa, Mycobacterium tuberculosis
NLFVPQPSVADWAQLEYYAD

SEQ ID NO: 1459654 - protein, 25 aa, Mycobacterium tuberculosis
NLGAGDPMSGLRQAVAARHGFAQDV

SEQ ID NO: 1459655 - protein, 35 aa, Mycobacterium tuberculosis; identical to SEQ ID NO: 203604

SEQ ID NO: 1459656 - protein, 19 aa, Mycobacterium tuberculosis
NLRRLLSLFEQLREQSQII

SEQ ID NO: 1459657 - protein, 29 aa, Mycobacterium tuberculosis
NLVSPDLVRRLCWEWEDISQSSPDPIAAV

SEQ ID NO: 1459658 - protein, 17 aa, Mycobacterium tuberculosis
NNIGFGLTGDNQIGFGA

SEQ ID NO: 1459659 - protein, 22 aa, Mycobacterium tuberculosis
NNTEARAALAFMDTELRIDYRD

SEQ ID NO: 1459660 - protein, 23 aa, Mycobacterium tuberculosis
NNWESVFGGPAWTRVREPDGNPG

SEQ ID NO: 1459661 - protein, 17 aa, Mycobacterium tuberculosis
NQIGFGGLNSGSGNIGF

SEQ ID NO: 1459662 - protein, 18 aa, Mycobacterium tuberculosis
NRAAYKFIDYDTDPAGFT

SEQ ID NO: 1459663 - protein, 25 aa, Mycobacterium tuberculosis
NRGFLRCVAALARAAAAIGETDEYG

SEQ ID NO: 1459664 - protein, 25 aa, Mycobacterium tuberculosis
NRLMPRFVREFPFNLMLWDLDRRMR

SEQ ID NO: 1459665 - protein, 22 aa, Mycobacterium tuberculosis
NRPLLQPLRAVPVIGDPLADLI

SEQ ID NO: 1459666 - protein, 29 aa, Mycobacterium tuberculosis
NSAIVRPLLRFFFKSWFRVEVSGVENIPR

SEQ ID NO: 1459667 - protein, 22 aa, Mycobacterium tuberculosis
NSDGFGALARRIAGRSLGLVMA

SEQ ID NO: 1459668 - protein, 18 aa, Mycobacterium tuberculosis
NSHLAFGFGTHFCLGNQL

SEQ ID NO: 1459669 - protein, 25 aa, Mycobacterium tuberculosis
NSTRTRFSFELGIAQLGGHAVVVDS

SEQ ID NO: 1459670 - protein, 24 aa, Mycobacterium tuberculosis
NTHGVSWLPLYHDMGLSMIGFPAV

SEQ ID NO: 1459671 - protein, 25 aa, Mycobacterium tuberculosis
NVPRLVPGWTKPIVIGRHAFGDQYR

SEQ ID NO: 1459672 - protein, 24 aa, Mycobacterium tuberculosis
NVQAGLRTDYLFRIANQRGGIVLG

SEQ ID NO: 1459673 - protein, 27 aa, Mycobacterium tuberculosis
NYDMSMARLLYWGCDVWLNNPLRPLEA

SEQ ID NO: 1459674 - protein, 22 aa, Mycobacterium tuberculosis
PAAQAIRFAKEFARNATESGGR

SEQ ID NO: 1459675 - protein, 29 aa, Mycobacterium tuberculosis
PAAVSPWWLQRRLLLCGIRATCPAVDVTN

SEQ ID NO: 1459676 - protein, 28 aa, Mycobacterium tuberculosis
PAEARRVGRRFARLAPIVATHRKLTSAR

SEQ ID NO: 1459677 - protein, 25 aa, Mycobacterium tuberculosis
PAFALGDYEWILAFEAPELDRIVDL

SEQ ID NO: 1459678 - protein, 21 aa, Mycobacterium tuberculosis
PAIKGMWTVPVFGNPSGVTYS

SEQ ID NO: 1459679 - protein, 25 aa, Mycobacterium tuberculosis
PALPTVWPGNAYPLGATYDGAGTNF

SEQ ID NO: 1459680 - protein, 23 aa, Mycobacterium tuberculosis
PALQRRWWAARGRGAFASVDGAR

SEQ ID NO: 1459681 - protein, 25 aa, Mycobacterium tuberculosis
PAMRRAFPSWMAWSPFAPAMRQAVV

SEQ ID NO: 1459682 - protein, 20 aa, Mycobacterium tuberculosis
PAPPVGKYVDAWGGMIQSRG

SEQ ID NO: 1459683 - protein, 18 aa, Mycobacterium tuberculosis
PAPVYNMAVALRLRGYLD

SEQ ID NO: 1459684 - protein, 18 aa, Mycobacterium tuberculosis
PAQADWLDPMIALSFAAA

SEQ ID NO: 1459685 - protein, 22 aa, Mycobacterium tuberculosis
PAREPRPVLAPTPASSEPTVAA

SEQ ID NO: 1459686 - protein, 23 aa, Mycobacterium tuberculosis
PCTMCAGALVLARVARLVFGAWE

SEQ ID NO: 1459687 - protein, 22 aa, Mycobacterium tuberculosis
PDAHLYCAIAIFGDKVTALQLV

SEQ ID NO: 1459688 - protein, 18 aa, Mycobacterium tuberculosis
PDDFEVPPMPAPVEPQGP

SEQ ID NO: 1459689 - protein, 18 aa, Mycobacterium tuberculosis
PDDTWLASWSRAEAAVPH

SEQ ID NO: 1459690 - protein, 26 aa, Mycobacterium tuberculosis
PDGPHFECWTVLGAWAEQTSHIEIGA

SEQ ID NO: 1459691 - protein, 24 aa, Mycobacterium tuberculosis
PDGPRAVVDVGLIGGRTRQNLAHR

SEQ ID NO: 1459692 - protein, 27 aa, Mycobacterium tuberculosis
PDGVAGWLLLCCGAMLDGAREALSIAE

SEQ ID NO: 1459693 - protein, 18 aa, Mycobacterium tuberculosis
PDIGPLFYEPTVLTNVAP

SEQ ID NO: 1459694 - protein, 17 aa, Mycobacterium tuberculosis
PDLCGFAGESLGFTSGG

SEQ ID NO: 1459695 - protein, 19 aa, Mycobacterium tuberculosis
PDLPGPLSTVSPWLDQTIR

SEQ ID NO: 1459696 - protein, 21 aa, Mycobacterium tuberculosis
PDLRLPGSVAEILASPAGPKV

SEQ ID NO: 1459697 - protein, 17 aa, Mycobacterium tuberculosis
PDQFDWLATRLEIARKL

SEQ ID NO: 1459698 - protein, 24 aa, Mycobacterium tuberculosis
PDQLRRAQKVFARTGGLHAAALFG

SEQ ID NO: 1459699 - protein, 23 aa, Mycobacterium tuberculosis
PDRPLWECWIIEGLNGNRWAILI

SEQ ID NO: 1459700 - protein, 23 aa, Mycobacterium tuberculosis
PDRQRLENVVIRFAGDSGDGMQL

SEQ ID NO: 1459701 - protein, 17 aa, Mycobacterium tuberculosis
PDTMTWVTALLPVARGV

SEQ ID NO: 1459702 - protein, 27 aa, Mycobacterium tuberculosis
PEADGFQWSFAGPRRLRGIRGDVRLFR

SEQ ID NO: 1459703 - protein, 26 aa, Mycobacterium tuberculosis
PEGSAFPWCRQSAVVQWYVNTPSDGQ

SEQ ID NO: 1459704 - protein, 21 aa, Mycobacterium tuberculosis
PEISEQLLRVLARRLRRTNNN

SEQ ID NO: 1459705 - protein, 22 aa, Mycobacterium tuberculosis
PELAGRWELPGGKVAAGETERA

SEQ ID NO: 1459706 - protein, 22 aa, Mycobacterium tuberculosis
PEPTFVPVLGRIAAGGPILAEE

SEQ ID NO: 1459707 - protein, 18 aa, Mycobacterium tuberculosis
PEQLGMNDVKSWVAFGAS

SEQ ID NO: 1459708 - protein, 23 aa, Mycobacterium tuberculosis
PERLPGNHPLAAHFNVYQWLTVL

SEQ ID NO: 1459709 - protein, 24 aa, Mycobacterium tuberculosis
PERTSALNATWRSATCRVLAAATG

SEQ ID NO: 1459710 - protein, 17 aa, Mycobacterium tuberculosis
PETAQGIFVNFANVVTT

SEQ ID NO: 1459711 - protein, 22 aa, Mycobacterium tuberculosis
PETPARPVLVVDFGAQYAQLIA

SEQ ID NO: 1459712 - protein, 17 aa, Mycobacterium tuberculosis
PEVSAALSPLGLTLPEF

SEQ ID NO: 1459713 - protein, 23 aa, Mycobacterium tuberculosis
PEVVEATLALPVRDLVADGEAIA

SEQ ID NO: 1459714 - protein, 17 aa, Mycobacterium tuberculosis
PEVYGGAGVHVTELVAY

SEQ ID NO: 1459715 - protein, 18 aa, Mycobacterium tuberculosis
PFAEPGWFHTDDLGALES

SEQ ID NO: 1459716 - protein, 17 aa, Mycobacterium tuberculosis
PFRGWSAADLEHVTPEQ

SEQ ID NO: 1459717 - protein, 34 aa, Mycobacterium tuberculosis; identical to SEQ ID NO: 203989

SEQ ID NO: 1459718 - protein, 18 aa, Mycobacterium tuberculosis
PGDAYWLLRHAIACPDPV

SEQ ID NO: 1459719 - protein, 20 aa, Mycobacterium tuberculosis
PGDSLTLRYAGARGAVIQST

SEQ ID NO: 1459720 - protein, 21 aa, Mycobacterium tuberculosis
PGEVPARMEALGALGGLDRAA

SEQ ID NO: 1459721 - protein, 23 aa, Mycobacterium tuberculosis
PGHICPISMTYAVVPALRYNSEL

SEQ ID NO: 1459722 - protein, 24 aa, Mycobacterium tuberculosis
PGILRVRFGEVEARGVALTPRGRE

SEQ ID NO: 1459723 - protein, 19 aa, Mycobacterium tuberculosis
PGKLPAIRQQIWTLIRAAK

SEQ ID NO: 1459724 - protein, 20 aa, Mycobacterium tuberculosis
PGLEEVRIAVGYRWDPDTRE

SEQ ID NO: 1459725 - protein, 19 aa, Mycobacterium tuberculosis
PGLIDELGTLTWRQLDERG

SEQ ID NO: 1459726 - protein, 22 aa, Mycobacterium tuberculosis
PGLMHVRFGPYHVRDVKFVAAF

SEQ ID NO: 1459727 - protein, 20 aa, Mycobacterium tuberculosis
PGPSSARGAEEFVEVSWDEL

SEQ ID NO: 1459728 - protein, 22 aa, Mycobacterium tuberculosis
PGVDLRAGIACQLRDLGVESID

SEQ ID NO: 1459729 - protein, 27 aa, Mycobacterium tuberculosis
PGVSCVKPAGALYAFPRLDPEVYDIDD

SEQ ID NO: 1459730 - protein, 18 aa, Mycobacterium tuberculosis
PGWLWPHPPEALAPRYVD

SEQ ID NO: 1459731 - protein, 25 aa, Mycobacterium tuberculosis
PHECCRLRKVVPLGKTLRGYSAWVT

SEQ ID NO: 1459732 - protein, 23 aa, Mycobacterium tuberculosis
PHGSRPGIDLVVAAEAGMTTGMP

SEQ ID NO: 1459733 - protein, 18 aa, Mycobacterium tuberculosis
PHLCSRAFITEQYDRYVR

SEQ ID NO: 1459734 - protein, 18 aa, Mycobacterium tuberculosis
PHTRPPIGELLRGYEETV

SEQ ID NO: 1459735 - protein, 19 aa, Mycobacterium tuberculosis
PIERLEELVPVYSELLSLL

SEQ ID NO: 1459736 - protein, 23 aa, Mycobacterium tuberculosis
PILHRRRREFKARAAEKPAPSDR

SEQ ID NO: 1459737 - protein, 29 aa, Mycobacterium tuberculosis
PIPDERFRYGFAIAPELVRTVLRDNEPDW

SEQ ID NO: 1459738 - protein, 18 aa, Mycobacterium tuberculosis
PIPYVYPVDLRFVLAPPV

SEQ ID NO: 1459739 - protein, 24 aa, Mycobacterium tuberculosis
PIRIDRFELLAARRRDQLIDIDVE

SEQ ID NO: 1459740 - protein, 21 aa, Mycobacterium tuberculosis
PKGTLGLTVAEPIKVARNDDG

SEQ ID NO: 1459741 - protein, 19 aa, Mycobacterium tuberculosis
PKITLACEVCKHRNYITKK

SEQ ID NO: 1459742 - protein, 18 aa, Mycobacterium tuberculosis
PKLAGRVVDARWDGPQAG

SEQ ID NO: 1459743 - protein, 19 aa, Mycobacterium tuberculosis
PKSALGAGLGLRSAISSGL

SEQ ID NO: 1459744 - protein, 17 aa, Mycobacterium tuberculosis
PLACGLPALPQGNNPVS

SEQ ID NO: 1459745 - protein, 23 aa, Mycobacterium tuberculosis
PLAVDHFRYFAAAIRAQEGALSQ

SEQ ID NO: 1459746 - protein, 18 aa, Mycobacterium tuberculosis
PLGLRVLRNIERVIRDEM

SEQ ID NO: 1459747 - protein, 18 aa, Mycobacterium tuberculosis
PLGSWLAALPDERLTQLL

SEQ ID NO: 1459748 - protein, 24 aa, Mycobacterium tuberculosis
PLMSNEIFGPILPVVTVKSLDDAI

SEQ ID NO: 1459749 - protein, 17 aa, Mycobacterium tuberculosis
PLQRLVRALLGFDAKLS

SEQ ID NO: 1459750 - protein, 20 aa, Mycobacterium tuberculosis
PLSRLPMIPGTSLKGKVRTL

SEQ ID NO: 1459751 - protein, 23 aa, Mycobacterium tuberculosis
PLVIPGRPVARVDTQRARDLLVQ

SEQ ID NO: 1459752 - protein, 26 aa, Mycobacterium tuberculosis
PNSFTIPGFQIRVLLGPAAVLVNEMI

SEQ ID NO: 1459753 - protein, 20 aa, Mycobacterium tuberculosis
PNYDAVASIAWLGYDAPDGL

SEQ ID NO: 1459754 - protein, 21 aa, Mycobacterium tuberculosis
PPATYFSGGKLQWILENVDGV

SEQ ID NO: 1459755 - protein, 19 aa, Mycobacterium tuberculosis
PPAVAPWPGPTGERADWWW

SEQ ID NO: 1459756 - protein, 23 aa, Mycobacterium tuberculosis
PPDLRIPFDPREVIARIVDGSEF

SEQ ID NO: 1459757 - protein, 21 aa, Mycobacterium tuberculosis
PPDVRISLSPLDFVTEGRSLI

SEQ ID NO: 1459758 - protein, 26 aa, Mycobacterium tuberculosis
PPGGWPEPLRTAALAGRGAARPTAQL

SEQ ID NO: 1459759 - protein, 21 aa, Mycobacterium tuberculosis
PPTQWTRWRQPVIGMPSTPRF

SEQ ID NO: 1459760 - protein, 19 aa, Mycobacterium tuberculosis
PQTQIAVRNEWGWAEAHLD

SEQ ID NO: 1459761 - protein, 33 aa, Mycobacterium tuberculosis; identical to SEQ ID NO: 204305

SEQ ID NO: 1459762 - protein, 25 aa, Mycobacterium tuberculosis
PRCGQCAACATDGRTPCEPGSAANK

SEQ ID NO: 1459763 - protein, 19 aa, Mycobacterium tuberculosis
PREAPACDARYWADNLRHT

SEQ ID NO: 1459764 - protein, 19 aa, Mycobacterium tuberculosis
PREQPVCDGAYWVDNLRNT

SEQ ID NO: 1459765 - protein, 19 aa, Mycobacterium tuberculosis
PRFEVPRSSSSVIPHSPAA

SEQ ID NO: 1459766 - protein, 19 aa, Mycobacterium tuberculosis
PRGASFSWYSYSPTRVRYP

SEQ ID NO: 1459767 - protein, 23 aa, Mycobacterium tuberculosis
PRGRRKTRIGYVVSDKMQKTIVV

SEQ ID NO: 1459768 - protein, 20 aa, Mycobacterium tuberculosis
PRLRAVLVPHALRLREAALL

SEQ ID NO: 1459769 - protein, 20 aa, Mycobacterium tuberculosis
PRLRGWGESMSRQAGGRAGG

SEQ ID NO: 1459770 - protein, 22 aa, Mycobacterium tuberculosis
PRPARPELVVLCDVSGSVAGFS

SEQ ID NO: 1459771 - protein, 26 aa, Mycobacterium tuberculosis
PRPAWLDRCAAMNRHAIAAVREQLAA

SEQ ID NO: 1459772 - protein, 20 aa, Mycobacterium tuberculosis
PRQGKTVLFLGRYDEPRKGM

SEQ ID NO: 1459773 - protein, 18 aa, Mycobacterium tuberculosis
PRRAVLVRPPRGLTATGL

SEQ ID NO: 1459774 - protein, 20 aa, Mycobacterium tuberculosis
PRSALAAPVLPVFARMWRGY

SEQ ID NO: 1459775 - protein, 21 aa, Mycobacterium tuberculosis
PRSLHWLRPITPTFRPSWPDH

SEQ ID NO: 1459776 - protein, 17 aa, Mycobacterium tuberculosis
PRSSLLVLGDGRTNYRN

SEQ ID NO: 1459777 - protein, 25 aa, Mycobacterium tuberculosis
PSAEVWRHIPSWEFHRANVDPGRAR

SEQ ID NO: 1459778 - protein, 33 aa, Mycobacterium tuberculosis; identical to SEQ ID NO: 204387

SEQ ID NO: 1459779 - protein, 20 aa, Mycobacterium tuberculosis
PSINPGLNFYFGQPQVTLLS

SEQ ID NO: 1459780 - protein, 23 aa, Mycobacterium tuberculosis
PSLHAGHLVPLLTLRRFQRAGHR

SEQ ID NO: 1459781 - protein, 18 aa, Mycobacterium tuberculosis
PSNLRKQLKGAPMPAPRA

SEQ ID NO: 1459782 - protein, 17 aa, Mycobacterium tuberculosis
PSSGYVYTTGWRLATTD

SEQ ID NO: 1459783 - protein, 20 aa, Mycobacterium tuberculosis
PSSLREAFGHFPTGVVAIAA

SEQ ID NO: 1459784 - protein, 21 aa, Mycobacterium tuberculosis
PSVRLAALARLFAVASNPTHR

SEQ ID NO: 1459785 - protein, 18 aa, Mycobacterium tuberculosis
PTAQDWADLVGTIHYEVV

SEQ ID NO: 1459786 - protein, 26 aa, Mycobacterium tuberculosis
PTDRPRCAYLPFGGGRRICIGQSFAL

SEQ ID NO: 1459787 - protein, 21 aa, Mycobacterium tuberculosis
PTEPNALVFPSYRGGHLPIEE

SEQ ID NO: 1459788 - protein, 23 aa, Mycobacterium tuberculosis
PTQKEIFIPGGQMFRDLTRLSAA

SEQ ID NO: 1459789 - protein, 24 aa, Mycobacterium tuberculosis
PVAELRSGGLGVREFKRLAKATGI

SEQ ID NO: 1459790 - protein, 24 aa, Mycobacterium tuberculosis
PVAPGLYSWLPLGLRVLRNIERVI

SEQ ID NO: 1459791 - protein, 29 aa, Mycobacterium tuberculosis
PVDVDGFVFPTCRWVHPIGPGNRSLPFPT

SEQ ID NO: 1459792 - protein, 24 aa, Mycobacterium tuberculosis
PVFPTYRLDHQFEVIRLVGELTDV

SEQ ID NO: 1459793 - protein, 22 aa, Mycobacterium tuberculosis
PVKQRLRIAVVTRSVLREASPE

SEQ ID NO: 1459794 - protein, 23 aa, Mycobacterium tuberculosis
PVKTRKCVFCAKKDQAIDYKDTA

SEQ ID NO: 1459795 - protein, 20 aa, Mycobacterium tuberculosis
PVPAVVKLHRWLTESLDHLH

SEQ ID NO: 1459796 - protein, 18 aa, Mycobacterium tuberculosis
PWHIGLYGNAGGLGPTQG

SEQ ID NO: 1459797 - protein, 19 aa, Mycobacterium tuberculosis
PYGDVFLIIDGWPGFVGEF

SEQ ID NO: 1459798 - protein, 26 aa, Mycobacterium tuberculosis
PYGRRFPFSLVFARIYAARGYHVVLQ

SEQ ID NO: 1459799 - protein, 19 aa, Mycobacterium tuberculosis
PYSLLMGSIRVADEVSVAF

SEQ ID NO: 1459800 - protein, 28 aa, Mycobacterium tuberculosis
QADEFTCSSCFLVQHRSRLASEKNGVMI

SEQ ID NO: 1459801 - protein, 24 aa, Mycobacterium tuberculosis
QAEGGAAAARWICDNRDALDGNQW

SEQ ID NO: 1459802 - protein, 17 aa, Mycobacterium tuberculosis
QAILRSARRHEAADQRR

SEQ ID NO: 1459803 - protein, 18 aa, Mycobacterium tuberculosis
QALGAPPQRRQWWIDRVK

SEQ ID NO: 1459804 - protein, 17 aa, Mycobacterium tuberculosis
QALLAKRHTEVMPVTRF

SEQ ID NO: 1459805 - protein, 27 aa, Mycobacterium tuberculosis
QALTIPSFIPEDFTFLDAIFAGYATVG

SEQ ID NO: 1459806 - protein, 19 aa, Mycobacterium tuberculosis
QALVREGLRNVAAGANPLG

SEQ ID NO: 1459807 - protein, 24 aa, Mycobacterium tuberculosis
QCDLRVVAPDAFFQFPTSKYGLAL

SEQ ID NO: 1459808 - protein, 20 aa, Mycobacterium tuberculosis
QCPAYSPGDMRLISLIANGQ

SEQ ID NO: 1459809 - protein, 38 aa, Mycobacterium tuberculosis; identical to SEQ ID NO: 204618

SEQ ID NO: 1459810 - protein, 18 aa, Mycobacterium tuberculosis
QDFYGTVFGWAFESAGPD

SEQ ID NO: 1459811 - protein, 20 aa, Mycobacterium tuberculosis
QDGNALVGMVVSGGTVEYDA

SEQ ID NO: 1459812 - protein, 26 aa, Mycobacterium tuberculosis
QDLCTDGAEVLWRFAERSGEGSPDDL

SEQ ID NO: 1459813 - protein, 20 aa, Mycobacterium tuberculosis
QEILFPALLPRAPYETTNRW

SEQ ID NO: 1459814 - protein, 20 aa, Mycobacterium tuberculosis
QELAEYRWRSGQAREKYEQI

SEQ ID NO: 1459815 - protein, 24 aa, Mycobacterium tuberculosis
QEQDGIKFLCPVPGYDRHFAITET

SEQ ID NO: 1459816 - protein, 17 aa, Mycobacterium tuberculosis
QFAGERVLGQGFDRDVL

SEQ ID NO: 1459817 - protein, 19 aa, Mycobacterium tuberculosis
QFTLPGRSLMFVRNVGHLM

SEQ ID NO: 1459818 - protein, 28 aa, Mycobacterium tuberculosis
QFVHAVALAEVWRSCGVLPDLTVGHSLG

SEQ ID NO: 1459819 - protein, 23 aa, Mycobacterium tuberculosis
QGDGGRCMVVFQPHLYSRTKAFA

SEQ ID NO: 1459820 - protein, 22 aa, Mycobacterium tuberculosis
QGVPISGILFGGRRKTTVPLVT

SEQ ID NO: 1459821 - protein, 25 aa, Mycobacterium tuberculosis
QHPDFLRLFYLLSMERSQDPAVAAV

SEQ ID NO: 1459822 - protein, 29 aa, Mycobacterium tuberculosis
QHVKPGKGPAFVRTKLKNVLSGKVVDKTF

SEQ ID NO: 1459823 - protein, 17 aa, Mycobacterium tuberculosis
QLAARAYTASGLSHNLA

SEQ ID NO: 1459824 - protein, 27 aa, Mycobacterium tuberculosis
QLADYGFAWRDIARVVGVSVPAITKWR

SEQ ID NO: 1459825 - protein, 24 aa, Mycobacterium tuberculosis
QLIRARRGVILACGGFEHNEQMRI

SEQ ID NO: 1459826 - protein, 19 aa, Mycobacterium tuberculosis
QLLYWTQVLMISRGLSLDD

SEQ ID NO: 1459827 - protein, 25 aa, Mycobacterium tuberculosis
QLMKAALPFGLWVPVLPGTRQVTVG

SEQ ID NO: 1459828 - protein, 18 aa, Mycobacterium tuberculosis
QMLVWGFTGQVISAVLDV

SEQ ID NO: 1459829 - protein, 23 aa, Mycobacterium tuberculosis
QNLPRLRRALSRVDTIVVHEQYW

SEQ ID NO: 1459830 - protein, 23 aa, Mycobacterium tuberculosis
QPLDWFCLFSSGAALLGSPGQGA

SEQ ID NO: 1459831 - protein, 17 aa, Mycobacterium tuberculosis
QPLGVILAVMPWNFPLW

SEQ ID NO: 1459832 - protein, 18 aa, Mycobacterium tuberculosis
QQKRIALDTIADVEASGL

SEQ ID NO: 1459833 - protein, 27 aa, Mycobacterium tuberculosis
QQPRPADCLRPLQIHALISEVLKTLPL

SEQ ID NO: 1459834 - protein, 26 aa, Mycobacterium tuberculosis
QQRCPPRQFERARVVVFAGDHGVARS

SEQ ID NO: 1459835 - protein, 28 aa, Mycobacterium tuberculosis
QRAKNMFALGLLSWMYGRELEHSEAFIR

SEQ ID NO: 1459836 - protein, 19 aa, Mycobacterium tuberculosis
QRALVRMLREAGAVELHVR

SEQ ID NO: 1459837 - protein, 20 aa, Mycobacterium tuberculosis
QRDRFLFKINVGYPSPEEER

SEQ ID NO: 1459838 - protein, 19 aa, Mycobacterium tuberculosis
QRQALLFLRADRLQYFVSC

SEQ ID NO: 1459839 - protein, 19 aa, Mycobacterium tuberculosis
QRQGFRWPSATVKTIMRAN

SEQ ID NO: 1459840 - protein, 22 aa, Mycobacterium tuberculosis
QRQLEMRLNRQLADIEKLQVNV

SEQ ID NO: 1459841 - protein, 25 aa, Mycobacterium tuberculosis
QRQQRCLDGARILAGRLTQPDVAER

SEQ ID NO: 1459842 - protein, 18 aa, Mycobacterium tuberculosis
QRRQWWIDRVKACYSLLV

SEQ ID NO: 1459843 - protein, 28 aa, Mycobacterium tuberculosis
QRSSRYPGGLALRFARVVRYRADKDPAE

SEQ ID NO: 1459844 - protein, 28 aa, Mycobacterium tuberculosis
QRVKANLFYRGLRFHRFPAVGDTLYTRT

SEQ ID NO: 1459845 - protein, 22 aa, Mycobacterium tuberculosis
QSIGVPEPLKLAGTAEQKRRFL

SEQ ID NO: 1459846 - protein, 24 aa, Mycobacterium tuberculosis
QSLPANDPNTAWLRGQVADLQAHV

SEQ ID NO: 1459847 - protein, 19 aa, Mycobacterium tuberculosis
QTISAWLAGDVRLDPDQLV

SEQ ID NO: 1459848 - protein, 24 aa, Mycobacterium tuberculosis
QTPPAGRCRPTLSARANRGRRLAE

SEQ ID NO: 1459849 - protein, 25 aa, Mycobacterium tuberculosis
QTPTLLFPFAAPRVVGDLSEAGSRA

SEQ ID NO: 1459850 - protein, 24 aa, Mycobacterium tuberculosis
QTSGWSLTAQDVFNNVARTCIEAM

SEQ ID NO: 1459851 - protein, 17 aa, Mycobacterium tuberculosis
QVAMPILPQQALLYRLC

SEQ ID NO: 1459852 - protein, 18 aa, Mycobacterium tuberculosis
QVGMPRAVVITKLDHARA

SEQ ID NO: 1459853 - protein, 22 aa, Mycobacterium tuberculosis
QVMAALVLRAGDTFDPDAFEAF

SEQ ID NO: 1459854 - protein, 20 aa, Mycobacterium tuberculosis
QVNVRQALTLADQATAAGDA

SEQ ID NO: 1459855 - protein, 20 aa, Mycobacterium tuberculosis
QVPAAVRFLSCEPLLGPLDG

SEQ ID NO: 1459856 - protein, 17 aa, Mycobacterium tuberculosis
QVPDEFLREAVDFELPA

SEQ ID NO: 1459857 - protein, 22 aa, Mycobacterium tuberculosis
QVSRLKSSVAMELVRKQRGLTV

SEQ ID NO: 1459858 - protein, 24 aa, Mycobacterium tuberculosis
QVTLEPGSAIAWIVRLTGGFEETE

SEQ ID NO: 1459859 - protein, 17 aa, Mycobacterium tuberculosis
QVVSIPTLILFKDGQPV

SEQ ID NO: 1459860 - protein, 28 aa, Mycobacterium tuberculosis
QWADAIDHLLRLCAGPRGRVMSRAAARH

SEQ ID NO: 1459861 - protein, 21 aa, Mycobacterium tuberculosis
QWERRYNRVAAYGQAKLANLL

SEQ ID NO: 1459862 - protein, 18 aa, Mycobacterium tuberculosis
RAAATRDWDCWVQHYTPD

SEQ ID NO: 1459863 - protein, 17 aa, Mycobacterium tuberculosis
RAADPVFMLTGPIPATR

SEQ ID NO: 1459864 - protein, 20 aa, Mycobacterium tuberculosis
RAADRLELAEGLRALAAGRE

SEQ ID NO: 1459865 - protein, 21 aa, Mycobacterium tuberculosis
RAAKCRTRNLPLIGAPANPGP

SEQ ID NO: 1459866 - protein, 18 aa, Mycobacterium tuberculosis
RAAQTDWAKRPVIERAAV

SEQ ID NO: 1459867 - protein, 23 aa, Mycobacterium tuberculosis
RAELARLVAPLAVAAAVDDPIHP

SEQ ID NO: 1459868 - protein, 21 aa, Mycobacterium tuberculosis
RAGKHLVCTVFDLMLAHYGVA

SEQ ID NO: 1459869 - protein, 19 aa, Mycobacterium tuberculosis
RAIGLFRYQLIWEAADAAH

SEQ ID NO: 1459870 - protein, 25 aa, Mycobacterium tuberculosis
RAKLARKEKIMGFGHRVYRHGDSRV

SEQ ID NO: 1459871 - protein, 23 aa, Mycobacterium tuberculosis
RALCLRLLTARSRTRAELAGQLA

SEQ ID NO: 1459872 - protein, 24 aa, Mycobacterium tuberculosis
RALEHGVEVIGYWGEAVATPAQAR

SEQ ID NO: 1459873 - protein, 17 aa, Mycobacterium tuberculosis
RAMLRPGDHVVIPDDAY

SEQ ID NO: 1459874 - protein, 19 aa, Mycobacterium tuberculosis
RANLGLKARIIGIDDSDCA

SEQ ID NO: 1459875 - protein, 18 aa, Mycobacterium tuberculosis
RAPALRPSPVRVFVTGQG

SEQ ID NO: 1459876 - protein, 18 aa, Mycobacterium tuberculosis
RAQWRMPMGPVVNLTRWM

SEQ ID NO: 1459877 - protein, 18 aa, Mycobacterium tuberculosis
RARLIERINNLRVGHSLD

SEQ ID NO: 1459878 - protein, 20 aa, Mycobacterium tuberculosis
RARLRIFFEFLRGADETGTS

SEQ ID NO: 1459879 - protein, 21 aa, Mycobacterium tuberculosis
RARTRTGASIVAIVRDEDVLA

SEQ ID NO: 1459880 - protein, 18 aa, Mycobacterium tuberculosis
RARYACFDHACADDGQAY

SEQ ID NO: 1459881 - protein, 18 aa, Mycobacterium tuberculosis
RASELGMSRSEFFTKAAQ

SEQ ID NO: 1459882 - protein, 25 aa, Mycobacterium tuberculosis
RASILVDADDGWSYAVAEGTAQLTP

SEQ ID NO: 1459883 - protein, 18 aa, Mycobacterium tuberculosis
RAVERNGLHRLVNPRTGK

SEQ ID NO: 1459884 - protein, 21 aa, Mycobacterium tuberculosis
RAVIIGTGFSGLGMAIALQKQ

SEQ ID NO: 1459885 - protein, 23 aa, Mycobacterium tuberculosis
RAVRRWTEFYKHESCGKCTPCRE

SEQ ID NO: 1459886 - protein, 21 aa, Mycobacterium tuberculosis
RAVSAALEIGCRLIDTAYAYG

SEQ ID NO: 1459887 - protein, 28 aa, Mycobacterium tuberculosis
RAVVTRYELVPGFPRFDVDDVYLGNGVS

SEQ ID NO: 1459888 - protein, 25 aa, Mycobacterium tuberculosis
RAVYRLTGELAEWFGIGAGTLRQGD

SEQ ID NO: 1459889 - protein, 20 aa, Mycobacterium tuberculosis
RCLGATFAMVEMRVVLREIL

SEQ ID NO: 1459890 - protein, 24 aa, Mycobacterium tuberculosis
RCVDYARGRFDAIVPDEVIAQLPY

SEQ ID NO: 1459891 - protein, 22 aa, Mycobacterium tuberculosis
RDALPRIAQAVVVAATRNYGVP

SEQ ID NO: 1459892 - protein, 17 aa, Mycobacterium tuberculosis
RDGGRGVLRLEYSAHPS

SEQ ID NO: 1459893 - protein, 24 aa, Mycobacterium tuberculosis
RDGVHWSRIRLADRAHLEPWEPSA

SEQ ID NO: 1459894 - protein, 24 aa, Mycobacterium tuberculosis
RDIRFVRLWFTDVLGFLKSVAIAP

SEQ ID NO: 1459895 - protein, 20 aa, Mycobacterium tuberculosis
RDKRSLVFPVKRLADLGFRV

SEQ ID NO: 1459896 - protein, 21 aa, Mycobacterium tuberculosis
RDPMAMLPFLGYNVGDYFQHW

SEQ ID NO: 1459897 - protein, 24 aa, Mycobacterium tuberculosis
RDRLKELGESVAIAAAPPDSYSVH

SEQ ID NO: 1459898 - protein, 18 aa, Mycobacterium tuberculosis
RDRRMPYTVGLLGSVPRL

SEQ ID NO: 1459899 - protein, 20 aa, Mycobacterium tuberculosis
RDSDEVLVPFVRAIVTSVSL

SEQ ID NO: 1459900 - protein, 19 aa, Mycobacterium tuberculosis
RDTLGFSVLHVVRDNPTSI

SEQ ID NO: 1459901 - protein, 19 aa, Mycobacterium tuberculosis
REAERLWRNHQLPPVGDVT

SEQ ID NO: 1459902 - protein, 24 aa, Mycobacterium tuberculosis
REAKTRLGDPVLAWADIQADPERR

SEQ ID NO: 1459903 - protein, 18 aa, Mycobacterium tuberculosis
REALDLVDSLGFTLSGLQ

SEQ ID NO: 1459904 - protein, 24 aa, Mycobacterium tuberculosis
REALKSALQYPALAGPVFDALTVE

SEQ ID NO: 1459905 - protein, 18 aa, Mycobacterium tuberculosis
REDFRLLAAEHRVVPVTR

SEQ ID NO: 1459906 - protein, 22 aa, Mycobacterium tuberculosis
REFMLHPVMMDIALQTLGATRT

SEQ ID NO: 1459907 - protein, 28 aa, Mycobacterium tuberculosis
REGVNLTFLPFFAKAVIDALKIHPNINA

SEQ ID NO: 1459908 - protein, 21 aa, Mycobacterium tuberculosis
REIQTRGAVTIVIAEEGDETV

SEQ ID NO: 1459909 - protein, 23 aa, Mycobacterium tuberculosis
RELKLGSGGLRDVEFAVQLLQLV

SEQ ID NO: 1459910 - protein, 19 aa, Mycobacterium tuberculosis
RELPRVAAIIEPDVSKIGV

SEQ ID NO: 1459911 - protein, 20 aa, Mycobacterium tuberculosis
RELRPSAAVVELPGLGHYPQ

SEQ ID NO: 1459912 - protein, 22 aa, Mycobacterium tuberculosis
RENRLRTALAALDNFDFDYVFV

SEQ ID NO: 1459913 - protein, 24 aa, Mycobacterium tuberculosis
REPKPMVYSGLYPVDGSDYPNLRD

SEQ ID NO: 1459914 - protein, 23 aa, Mycobacterium tuberculosis
RFATCCRALGIAVYQRKRPPDLA

SEQ ID NO: 1459915 - protein, 18 aa, Mycobacterium tuberculosis
RFDVDDVYLGNGVSELIT

SEQ ID NO: 1459916 - protein, 24 aa, Mycobacterium tuberculosis
RFIDALRSSINFDQSPKDLLRNTI

SEQ ID NO: 1459917 - protein, 21 aa, Mycobacterium tuberculosis
RFVLAEARLAAYARELGEEPV

SEQ ID NO: 1459918 - protein, 24 aa, Mycobacterium tuberculosis
RFYERKEIRDIVAYLRVLDNPGDA

SEQ ID NO: 1459919 - protein, 17 aa, Mycobacterium tuberculosis
RFYGFLGGETDQWYPDL

SEQ ID NO: 1459920 - protein, 18 aa, Mycobacterium tuberculosis
RGAHGVAVYNGETVTECA

SEQ ID NO: 1459921 - protein, 19 aa, Mycobacterium tuberculosis
RGDLAELTQCFAPDVEQFV

SEQ ID NO: 1459922 - protein, 17 aa, Mycobacterium tuberculosis
RGDVLELIDDIKDAIPG

SEQ ID NO: 1459923 - protein, 18 aa, Mycobacterium tuberculosis
RGGRRANVPITRRGGLSF

SEQ ID NO: 1459924 - protein, 17 aa, Mycobacterium tuberculosis
RGIEQYCKPGANFTYNS

SEQ ID NO: 1459925 - protein, 25 aa, Mycobacterium tuberculosis
RGQDGHWRLGPAITELATHVDDPLL

SEQ ID NO: 1459926 - protein, 24 aa, Mycobacterium tuberculosis
RGQGSVLVPFSWQGVSLHAAGASA

SEQ ID NO: 1459927 - protein, 21 aa, Mycobacterium tuberculosis
RGRDMPVGVLVGSWHTIEGLV

SEQ ID NO: 1459928 - protein, 19 aa, Mycobacterium tuberculosis
RGRPAKRYRLTAAGRAKLD

SEQ ID NO: 1459929 - protein, 20 aa, Mycobacterium tuberculosis
RGSGCGLSGAARPVEGGLLI

SEQ ID NO: 1459930 - protein, 17 aa, Mycobacterium tuberculosis
RGVLVEMYREAKTRLGD

SEQ ID NO: 1459931 - protein, 19 aa, Mycobacterium tuberculosis
RGVPPMPVVDAIRRGAQAI

SEQ ID NO: 1459932 - protein, 17 aa, Mycobacterium tuberculosis
RHFRPEFFAAMRELCDE

SEQ ID NO: 1459933 - protein, 27 aa, Mycobacterium tuberculosis
RHIEWKHGVCDALGWPHADQADIAAAW

SEQ ID NO: 1459934 - protein, 23 aa, Mycobacterium tuberculosis
RIEEARGALIEGIIEESEDESLM

SEQ ID NO: 1459935 - protein, 20 aa, Mycobacterium tuberculosis
RIGAEVRDGDILVGKVTPKG

SEQ ID NO: 1459936 - protein, 26 aa, Mycobacterium tuberculosis
RIIARMLAVMLRRRMQEAGMDTGGVE

SEQ ID NO: 1459937 - protein, 25 aa, Mycobacterium tuberculosis
RINLDRPAYVYPIFEQALRIAYGES

SEQ ID NO: 1459938 - protein, 18 aa, Mycobacterium tuberculosis
RIPSLPDLDGIRVLRSFD

SEQ ID NO: 1459939 - protein, 18 aa, Mycobacterium tuberculosis
RIRELIREGARIALNPSP

SEQ ID NO: 1459940 - protein, 27 aa, Mycobacterium tuberculosis
RISEFAEIMGFYGLSYWYPFQVTALGL

SEQ ID NO: 1459941 - protein, 31 aa, Mycobacterium tuberculosis; identical to SEQ ID NO: 205431

SEQ ID NO: 1459942 - protein, 23 aa, Mycobacterium tuberculosis
RITPELIKALGAVRRHHDELMRL

SEQ ID NO: 1459943 - protein, 19 aa, Mycobacterium tuberculosis
RIVSLRLVTAGGEVLSLSE

SEQ ID NO: 1459944 - protein, 19 aa, Mycobacterium tuberculosis
RKAIELITLRGFHRDRDLA

SEQ ID NO: 1459945 - protein, 28 aa, Mycobacterium tuberculosis
RKAVLAVGSVCWLVGCSSGASSTTASTG

SEQ ID NO: 1459946 - protein, 20 aa, Mycobacterium tuberculosis
RKLPAKARKAILEGADEQVH

SEQ ID NO: 1459947 - protein, 17 aa, Mycobacterium tuberculosis
RKLQAIIVKTHQGAAEM

SEQ ID NO: 1459948 - protein, 23 aa, Mycobacterium tuberculosis
RKLRDAWLTARRDLVDRRNRARE

SEQ ID NO: 1459949 - protein, 26 aa, Mycobacterium tuberculosis
RKQLTWSTERPSLWHFRDRGGAEVDL

SEQ ID NO: 1459950 - protein, 18 aa, Mycobacterium tuberculosis
RKQPGAQVFATFDGDGQH

SEQ ID NO: 1459951 - protein, 24 aa, Mycobacterium tuberculosis
RKQVFRKLEHGVFCGDTLGEHGEN

SEQ ID NO: 1459952 - protein, 19 aa, Mycobacterium tuberculosis
RKTVRAFAEREILPHVDEW

SEQ ID NO: 1459953 - protein, 17 aa, Mycobacterium tuberculosis
RLAHWLWQRGARLLARA

SEQ ID NO: 1459954 - protein, 20 aa, Mycobacterium tuberculosis
RLAPKGTGAVLSFELAGGIE

SEQ ID NO: 1459955 - protein, 17 aa, Mycobacterium tuberculosis
RLARPSETATRFVADPF

SEQ ID NO: 1459956 - protein, 24 aa, Mycobacterium tuberculosis
RLAYPEVRAALAAAARNHDLTESE

SEQ ID NO: 1459957 - protein, 31 aa, Mycobacterium tuberculosis; identical to SEQ ID NO: 205517

SEQ ID NO: 1459958 - protein, 18 aa, Mycobacterium tuberculosis
RLGLLPMYAVNQDKHGTA

SEQ ID NO: 1459959 - protein, 18 aa, Mycobacterium tuberculosis
RLGLPRAGRWREVLNTDA

SEQ ID NO: 1459960 - protein, 20 aa, Mycobacterium tuberculosis
RLLNAICSYLGISTRLANSW

SEQ ID NO: 1459961 - protein, 23 aa, Mycobacterium tuberculosis
RLMVTQFKDYFGLAHDLPKWASE

SEQ ID NO: 1459962 - protein, 23 aa, Mycobacterium tuberculosis
RLPEFDKPALIAWSADDVFFALE

SEQ ID NO: 1459963 - protein, 20 aa, Mycobacterium tuberculosis
RLPRKGPWQQKVIKELPQTF

SEQ ID NO: 1459964 - protein, 20 aa, Mycobacterium tuberculosis
RLPTVRDLAGQLGVAANTVA

SEQ ID NO: 1459965 - protein, 17 aa, Mycobacterium tuberculosis
RLQAERPGDAVLSEEAH

SEQ ID NO: 1459966 - protein, 20 aa, Mycobacterium tuberculosis
RLQVRYVIVSAVSGAMGGSA

SEQ ID NO: 1459967 - protein, 23 aa, Mycobacterium tuberculosis
RLRRRDMGVGELLGMVQAGLNHT

SEQ ID NO: 1459968 - protein, 22 aa, Mycobacterium tuberculosis
RLSALARNAAELALIPDTNHLE

SEQ ID NO: 1459969 - protein, 24 aa, Mycobacterium tuberculosis
RLSDGQARMWFVQMADPSGALLNI

SEQ ID NO: 1459970 - protein, 18 aa, Mycobacterium tuberculosis
RLYHQRLPLDMATPVIDG

SEQ ID NO: 1459971 - protein, 19 aa, Mycobacterium tuberculosis
RMAAKLAGFGYVVLLPDVY

SEQ ID NO: 1459972 - protein, 18 aa, Mycobacterium tuberculosis
RMSKRAGTVLTLDDLVEA

SEQ ID NO: 1459973 - protein, 24 aa, Mycobacterium tuberculosis
RMVGRNVLHALGFDAFGLPAEQYA

SEQ ID NO: 1459974 - protein, 25 aa, Mycobacterium tuberculosis
RNDVCPDKLTWIMPRDSWLIDRATL

SEQ ID NO: 1459975 - protein, 17 aa, Mycobacterium tuberculosis
RPDAIVFTGDLADKGEP

SEQ ID NO: 1459976 - protein, 24 aa, Mycobacterium tuberculosis
RPDPDWDGRTGLVTDLLDERMLAS

SEQ ID NO: 1459977 - protein, 22 aa, Mycobacterium tuberculosis
RPDQLAKLAARIMDCLNPDGDY

SEQ ID NO: 1459978 - protein, 24 aa, Mycobacterium tuberculosis
RPEARWRQAREWLGERGYDSTLSY

SEQ ID NO: 1459979 - protein, 21 aa, Mycobacterium tuberculosis
RPEVESVLAGVGRLFAEGVAV

SEQ ID NO: 1459980 - protein, 19 aa, Mycobacterium tuberculosis
RPFYFGVLTWYMDRVLELV

SEQ ID NO: 1459981 - protein, 19 aa, Mycobacterium tuberculosis
RPLAIPVIVLAGQVSLDKS

SEQ ID NO: 1459982 - protein, 19 aa, Mycobacterium tuberculosis
RPPGRPEVIAKLDAEGLLP

SEQ ID NO: 1459983 - protein, 21 aa, Mycobacterium tuberculosis
RPPLMKRIVLQTGARLSRRGR

SEQ ID NO: 1459984 - protein, 24 aa, Mycobacterium tuberculosis
RPPRGRVTLHWGPRYDAHLLIPEV

SEQ ID NO: 1459985 - protein, 22 aa, Mycobacterium tuberculosis
RPPVRRLGGGLVEIPRAPDIDP

SEQ ID NO: 1459986 - protein, 21 aa, Mycobacterium tuberculosis
RPSAWIAEGLLVYLSAEAQQR

SEQ ID NO: 1459987 - protein, 17 aa, Mycobacterium tuberculosis
RPSSSRDTAFFWDGVKA

SEQ ID NO: 1459988 - protein, 19 aa, Mycobacterium tuberculosis
RPSTTCYRKASSTPTGSPS

SEQ ID NO: 1459989 - protein, 31 aa, Mycobacterium tuberculosis; identical to SEQ ID NO: 205737

SEQ ID NO: 1459990 - protein, 26 aa, Mycobacterium tuberculosis
RPVPHWPKYWIQALAKHFQRQLKPSP

SEQ ID NO: 1459991 - protein, 23 aa, Mycobacterium tuberculosis
RQKGLPGARARRRGLSDAALGTP

SEQ ID NO: 1459992 - protein, 19 aa, Mycobacterium tuberculosis
RQRVAAAGFGHRVEIDLCD

SEQ ID NO: 1459993 - protein, 39 aa, Mycobacterium tuberculosis; identical to SEQ ID NO: 205784

SEQ ID NO: 1459994 - protein, 17 aa, Mycobacterium tuberculosis
RQVISLHGADPARIDVV

SEQ ID NO: 1459995 - protein, 18 aa, Mycobacterium tuberculosis
RRAAQVIADRTGIGEHDV

SEQ ID NO: 1459996 - protein, 18 aa, Mycobacterium tuberculosis
RRAFDMMCERALSRQTRH

SEQ ID NO: 1459997 - protein, 20 aa, Mycobacterium tuberculosis
RRASKPGARLYMFEFGEHNV

SEQ ID NO: 1459998 - protein, 21 aa, Mycobacterium tuberculosis
RRATTWCRELLTATGRSSDFA

SEQ ID NO: 1459999 - protein, 17 aa, Mycobacterium tuberculosis
RRDGFAVGEDYTVTDRS

SEQ ID NO: 1460000 - protein, 18 aa, Mycobacterium tuberculosis
RREAPVYWHRPTEHTPDG

SEQ ID NO: 1460001 - protein, 20 aa, Mycobacterium tuberculosis
RRFPDAAVVRLERDYRSTPQ

SEQ ID NO: 1460002 - protein, 28 aa, Mycobacterium tuberculosis
RRGPAHSAFTLPELIGLTAGADVVLDPG

SEQ ID NO: 1460003 - protein, 18 aa, Mycobacterium tuberculosis
RRHGTLLAAHFGEDKGMR

SEQ ID NO: 1460004 - protein, 18 aa, Mycobacterium tuberculosis
RRHIHRYPELGRQEYATT

SEQ ID NO: 1460005 - protein, 21 aa, Mycobacterium tuberculosis
RRILRRLGYAAYGWGLGRNIG

SEQ ID NO: 1460006 - protein, 20 aa, Mycobacterium tuberculosis
RRKAYNWTVATLKADIDAWQ

SEQ ID NO: 1460007 - protein, 19 aa, Mycobacterium tuberculosis
RRKLVNAGFTRKRVKDKEA

SEQ ID NO: 1460008 - protein, 17 aa, Mycobacterium tuberculosis
RRLAWWTGALTLGVAKI

SEQ ID NO: 1460009 - protein, 18 aa, Mycobacterium tuberculosis
RRLMTWRGGYHGDTFLAM

SEQ ID NO: 1460010 - protein, 19 aa, Mycobacterium tuberculosis
RRLSRLPVVAAVGKYDATL

SEQ ID NO: 1460011 - protein, 20 aa, Mycobacterium tuberculosis
RRMPWRLHVFTPVHDVPGVS

SEQ ID NO: 1460012 - protein, 23 aa, Mycobacterium tuberculosis
RRNRGAAARCRICNNELNTSAAV

SEQ ID NO: 1460013 - protein, 18 aa, Mycobacterium tuberculosis
RRQLGWSQQAPRLFHYRD

SEQ ID NO: 1460014 - protein, 20 aa, Mycobacterium tuberculosis
RRRFEHPAMLSADRAFAAVP

SEQ ID NO: 1460015 - protein, 21 aa, Mycobacterium tuberculosis
RRRPLDPARRAAFETLRAVSA

SEQ ID NO: 1460016 - protein, 21 aa, Mycobacterium tuberculosis
RRSGASWSDIGKSMGVTKQAA

SEQ ID NO: 1460017 - protein, 25 aa, Mycobacterium tuberculosis
RRSKFPYRWWWVALTDEAFPRLSVI

SEQ ID NO: 1460018 - protein, 30 aa, Mycobacterium tuberculosis; identical to SEQ ID NO: 195639

SEQ ID NO: 1460019 - protein, 23 aa, Mycobacterium tuberculosis
RRTGATLRWYGVTDDGRIDLDSL

SEQ ID NO: 1460020 - protein, 17 aa, Mycobacterium tuberculosis
RSAWQCALDYARQRTQF

SEQ ID NO: 1460021 - protein, 24 aa, Mycobacterium tuberculosis
RSEVLNIGDAILFYTDGLIERPGR

SEQ ID NO: 1460022 - protein, 18 aa, Mycobacterium tuberculosis
RSGAHLVRHPINLGQGAA

SEQ ID NO: 1460023 - protein, 32 aa, Mycobacterium tuberculosis; identical to SEQ ID NO: 205963

SEQ ID NO: 1460024 - protein, 22 aa, Mycobacterium tuberculosis
RSRAGFLPWRAAHAARAHLRLV

SEQ ID NO: 1460025 - protein, 21 aa, Mycobacterium tuberculosis
RSRGSMKAGVFSDGALAEPAD

SEQ ID NO: 1460026 - protein, 20 aa, Mycobacterium tuberculosis
RSRLDAELVGNVSIRVVDIG

SEQ ID NO: 1460027 - protein, 17 aa, Mycobacterium tuberculosis
RSTTVAMDFGRITLGED

SEQ ID NO: 1460028 - protein, 24 aa, Mycobacterium tuberculosis
RSVKRHMGSDWSIEIDGKKYTAPE

SEQ ID NO: 1460029 - protein, 19 aa, Mycobacterium tuberculosis
RTFPMPSPFLVMATQNPIE

SEQ ID NO: 1460030 - protein, 23 aa, Mycobacterium tuberculosis
RTGDLIPLCHPLGLDAVSVTITP

SEQ ID NO: 1460031 - protein, 21 aa, Mycobacterium tuberculosis
RTGTLTVCTMVPMRSVPHRVV

SEQ ID NO: 1460032 - protein, 20 aa, Mycobacterium tuberculosis
RTGTYGINWYAFDPGSPFGG

SEQ ID NO: 1460033 - protein, 25 aa, Mycobacterium tuberculosis
RTIFKRLYDAGLIYRAERLVNWSPV

SEQ ID NO: 1460034 - protein, 19 aa, Mycobacterium tuberculosis
RTLTANGLRQLIAFISRMT

SEQ ID NO: 1460035 - protein, 18 aa, Mycobacterium tuberculosis
RTMKEGWIVYARSTTIQA

SEQ ID NO: 1460036 - protein, 24 aa, Mycobacterium tuberculosis
RTPPRGRCLRAPESARLGRRSAAH

SEQ ID NO: 1460037 - protein, 20 aa, Mycobacterium tuberculosis
RTQSSWELVTDALARSRSGV

SEQ ID NO: 1460038 - protein, 25 aa, Mycobacterium tuberculosis
RTQWWGRQMLIWGVHVHVGIRSAHK

SEQ ID NO: 1460039 - protein, 23 aa, Mycobacterium tuberculosis
RTSEAYRVMSMLAMDDPAHLRMR

SEQ ID NO: 1460040 - protein, 18 aa, Mycobacterium tuberculosis
RTSHRFGKVIGTLAEAIR

SEQ ID NO: 1460041 - protein, 18 aa, Mycobacterium tuberculosis
RVAPNVGVSQRFFTSQCN

SEQ ID NO: 1460042 - protein, 24 aa, Mycobacterium tuberculosis
RVELRSCSRRGAAIDVVAARAREN

SEQ ID NO: 1460043 - protein, 17 aa, Mycobacterium tuberculosis
RVIAEFNGGTPFPLQLA

SEQ ID NO: 1460044 - protein, 27 aa, Mycobacterium tuberculosis
RVKRGMAEMLKGGVIMDVVTPEQARIA

SEQ ID NO: 1460045 - protein, 24 aa, Mycobacterium tuberculosis
RVLGDPALPHLFFVEGGALAVENA

SEQ ID NO: 1460046 - protein, 25 aa, Mycobacterium tuberculosis
RVLSGYIASVNIMFAIDPFTRDTGA

SEQ ID NO: 1460047 - protein, 25 aa, Mycobacterium tuberculosis
RVPGADAFRSWRLLVSKYGTQAPGP

SEQ ID NO: 1460048 - protein, 19 aa, Mycobacterium tuberculosis
RVRELRPLYLPPDPASRDI

SEQ ID NO: 1460049 - protein, 29 aa, Mycobacterium tuberculosis
RVRGAALPWQDLRAAFTERGWLDLTHTRR

SEQ ID NO: 1460050 - protein, 23 aa, Mycobacterium tuberculosis
RVRLCKRDGELFARPQQLPQTDD

SEQ ID NO: 1460051 - protein, 22 aa, Mycobacterium tuberculosis
RVRTEPPLPGTRYTQIAVLEDG

SEQ ID NO: 1460052 - protein, 25 aa, Mycobacterium tuberculosis
RVSAELRAAGFTLPPSQANFVWLPL

SEQ ID NO: 1460053 - protein, 19 aa, Mycobacterium tuberculosis
RWFLMASPILRGGNLIVTE

SEQ ID NO: 1460054 - protein, 27 aa, Mycobacterium tuberculosis
RWFPNFCTGELITAIAMTEPGTGSDLQ

SEQ ID NO: 1460055 - protein, 28 aa, Mycobacterium tuberculosis
RYACELYDLPTLWQIAAHNPWLSVSPVS

SEQ ID NO: 1460056 - protein, 18 aa, Mycobacterium tuberculosis
RYRIGCKRILNSSTYYPA

SEQ ID NO: 1460057 - protein, 26 aa, Mycobacterium tuberculosis
RYVDLVCSWGPMILGHAHPAVVEAVA

SEQ ID NO: 1460058 - protein, 17 aa, Mycobacterium tuberculosis
SAARAAALITIADPQRP

SEQ ID NO: 1460059 - protein, 19 aa, Mycobacterium tuberculosis
SAETLRARGLWYIDGAGNA

SEQ ID NO: 1460060 - protein, 20 aa, Mycobacterium tuberculosis
SAGPPCFLAPELRHLNDDGS

SEQ ID NO: 1460061 - protein, 18 aa, Mycobacterium tuberculosis
SAGVKVLMALPVGMGCSD

SEQ ID NO: 1460062 - protein, 20 aa, Mycobacterium tuberculosis
SALLRTFAGAGFTNLLVRSR

SEQ ID NO: 1460063 - protein, 21 aa, Mycobacterium tuberculosis
SALQNAASIAGLFLTTEAVVA

SEQ ID NO: 1460064 - protein, 23 aa, Mycobacterium tuberculosis
SAPPRLVGQVIDALRGYASITVV

SEQ ID NO: 1460065 - protein, 25 aa, Mycobacterium tuberculosis
SAQISRAGGWLSQHCEPPYAPLWIA

SEQ ID NO: 1460066 - protein, 20 aa, Mycobacterium tuberculosis
SAQWCPRPWPDRPRRRLTTP

SEQ ID NO: 1460067 - protein, 17 aa, Mycobacterium tuberculosis
SASASWAANGKITSDDR

SEQ ID NO: 1460068 - protein, 18 aa, Mycobacterium tuberculosis
SAVPAYFVGVGVRPEHAP

SEQ ID NO: 1460069 - protein, 21 aa, Mycobacterium tuberculosis
SDADGLRALFTTWITAPQPDI

SEQ ID NO: 1460070 - protein, 17 aa, Mycobacterium tuberculosis
SDALRQISFRLAADDDQ

SEQ ID NO: 1460071 - protein, 31 aa, Mycobacterium tuberculosis; identical to SEQ ID NO: 206283

SEQ ID NO: 1460072 - protein, 24 aa, Mycobacterium tuberculosis
SDFGQIRIGPDFSLVELPAKLPRA

SEQ ID NO: 1460073 - protein, 17 aa, Mycobacterium tuberculosis
SDIKRELSQAAGVLNAD

SEQ ID NO: 1460074 - protein, 22 aa, Mycobacterium tuberculosis
SDYTPLMLCAKMIHALARLPQQ

SEQ ID NO: 1460075 - protein, 24 aa, Mycobacterium tuberculosis
SEANLDQLIGFFINIVVLRNDLRG

SEQ ID NO: 1460076 - protein, 40 aa, Mycobacterium tuberculosis; identical to SEQ ID NO: 206323

SEQ ID NO: 1460077 - protein, 20 aa, Mycobacterium tuberculosis
SECMHIFGGAGYLVDETTLG

SEQ ID NO: 1460078 - protein, 18 aa, Mycobacterium tuberculosis
SEPMIIGKAFAVKVNANI

SEQ ID NO: 1460079 - protein, 23 aa, Mycobacterium tuberculosis
SEVAGRLAAQVGAYHLMRTQGGR

SEQ ID NO: 1460080 - protein, 23 aa, Mycobacterium tuberculosis
SFRSELRLLYLTVTDPASGNLIS

SEQ ID NO: 1460081 - protein, 19 aa, Mycobacterium tuberculosis
SGAIWRPVDPAPRLLPAPE

SEQ ID NO: 1460082 - protein, 25 aa, Mycobacterium tuberculosis
SGERLAVGVPKAFYQLDGQTLIERA

SEQ ID NO: 1460083 - protein, 22 aa, Mycobacterium tuberculosis
SGFPVTIKGLSRFTDAAESRAV

SEQ ID NO: 1460084 - protein, 20 aa, Mycobacterium tuberculosis
SGILNRGADISGVYNTGALG

SEQ ID NO: 1460085 - protein, 17 aa, Mycobacterium tuberculosis
SGRMYCGPGSGPMLAAA

SEQ ID NO: 1460086 - protein, 23 aa, Mycobacterium tuberculosis
SGRRAALAMVRRHRLLETFLVNE

SEQ ID NO: 1460087 - protein, 19 aa, Mycobacterium tuberculosis
SGTQLRGGIEVVDVPHIDG

SEQ ID NO: 1460088 - protein, 21 aa, Mycobacterium tuberculosis
SHDIPRFVSLWQSGRLPVESL

SEQ ID NO: 1460089 - protein, 20 aa, Mycobacterium tuberculosis
SHFRLDWSTPQDVGRKAIAQ

SEQ ID NO: 1460090 - protein, 18 aa, Mycobacterium tuberculosis
SHGGALSPRGDWRAPSDM

SEQ ID NO: 1460091 - protein, 19 aa, Mycobacterium tuberculosis
SILIRGLMNYTFWMPNGSP

SEQ ID NO: 1460092 - protein, 25 aa, Mycobacterium tuberculosis
SKTGERARCAPMHALEQLADYGFAW

SEQ ID NO: 1460093 - protein, 33 aa, Mycobacterium tuberculosis; identical to SEQ ID NO: 206498

SEQ ID NO: 1460094 - protein, 19 aa, Mycobacterium tuberculosis
SLGFLMARFNIWGRPDLRR

SEQ ID NO: 1460095 - protein, 17 aa, Mycobacterium tuberculosis
SLLAAGITAVSGRFCGG

SEQ ID NO: 1460096 - protein, 18 aa, Mycobacterium tuberculosis
SLLLDGLRRIGIDRLAPT

SEQ ID NO: 1460097 - protein, 18 aa, Mycobacterium tuberculosis
SLLMPAFTRAALRGYRDM

SEQ ID NO: 1460098 - protein, 24 aa, Mycobacterium tuberculosis
SLTPDVRNGIDFKIADLSLADFGR

SEQ ID NO: 1460099 - protein, 21 aa, Mycobacterium tuberculosis
SLYLDDRVKVVAFTHHSNVTG

SEQ ID NO: 1460100 - protein, 17 aa, Mycobacterium tuberculosis
SMCARLYGKRAAENRTK

SEQ ID NO: 1460101 - protein, 23 aa, Mycobacterium tuberculosis
SMGRNGGGWAHYVGQEKVRPLTG

SEQ ID NO: 1460102 - protein, 30 aa, Mycobacterium tuberculosis; identical to SEQ ID NO: 206547

SEQ ID NO: 1460103 - protein, 18 aa, Mycobacterium tuberculosis
SNICTAQVLLAVLAAMYA

SEQ ID NO: 1460104 - protein, 22 aa, Mycobacterium tuberculosis
SPDKLRRVVAHMMEKPESVQHW

SEQ ID NO: 1460105 - protein, 22 aa, Mycobacterium tuberculosis
SPEEMYKYLVAVSREPDHDKIR

SEQ ID NO: 1460106 - protein, 25 aa, Mycobacterium tuberculosis
SPGAFCLTCGAPVREPTDIMRDVAA

SEQ ID NO: 1460107 - protein, 19 aa, Mycobacterium tuberculosis
SPIGKRNGWLSGLHATELL

SEQ ID NO: 1460108 - protein, 21 aa, Mycobacterium tuberculosis
SPLNLLRWTSARSIKETFVAA

SEQ ID NO: 1460109 - protein, 18 aa, Mycobacterium tuberculosis
SPMLRCQRTVEPLAEALC

SEQ ID NO: 1460110 - protein, 33 aa, Mycobacterium tuberculosis; identical to SEQ ID NO: 206587

SEQ ID NO: 1460111 - protein, 22 aa, Mycobacterium tuberculosis
SPRSFCAGVERAIETVKRVLDV

SEQ ID NO: 1460112 - protein, 20 aa, Mycobacterium tuberculosis
SPRSVARWTAGQVVPQRLNK

SEQ ID NO: 1460113 - protein, 17 aa, Mycobacterium tuberculosis
SPVRVFVTGQGWRHLPD

SEQ ID NO: 1460114 - protein, 22 aa, Mycobacterium tuberculosis
SQTRRRVAVLGGNRIPFARSDG

SEQ ID NO: 1460115 - protein, 30 aa, Mycobacterium tuberculosis; identical to SEQ ID NO: 206618

SEQ ID NO: 1460116 - protein, 21 aa, Mycobacterium tuberculosis
SREEQDRWGVRSQNRAEEAIK

SEQ ID NO: 1460117 - protein, 22 aa, Mycobacterium tuberculosis
SREVGLSVLQVWQALTEAVSRR

SEQ ID NO: 1460118 - protein, 24 aa, Mycobacterium tuberculosis
SRGEPHRDICLIPSSAHGTNAASA

SEQ ID NO: 1460119 - protein, 20 aa, Mycobacterium tuberculosis
SRGPLLSGMFGTFPVAQTFH

SEQ ID NO: 1460120 - protein, 28 aa, Mycobacterium tuberculosis
SRGPLRYAGWSSCFRREAGSHGKDTRGI

SEQ ID NO: 1460121 - protein, 26 aa, Mycobacterium tuberculosis
SRKLARNTFYGMARWQASLEKKQGFL

SEQ ID NO: 1460122 - protein, 17 aa, Mycobacterium tuberculosis
SRLAELMQRAFTELQTE

SEQ ID NO: 1460123 - protein, 19 aa, Mycobacterium tuberculosis
SRLHPLATMERTFIAPSRF

SEQ ID NO: 1460124 - protein, 23 aa, Mycobacterium tuberculosis
SRRPDRPGVRQLLRHGATDRVLL

SEQ ID NO: 1460125 - protein, 19 aa, Mycobacterium tuberculosis
SRSASIGYRASMDVTGPSE

SEQ ID NO: 1460126 - protein, 21 aa, Mycobacterium tuberculosis
SRTGKMLPPKLGLMSYVADAY

SEQ ID NO: 1460127 - protein, 20 aa, Mycobacterium tuberculosis
SRTKLLRLFPTIFKGAHVEL

SEQ ID NO: 1460128 - protein, 20 aa, Mycobacterium tuberculosis
SSLGSAPRQAFVFPGQGGHW

SEQ ID NO: 1460129 - protein, 18 aa, Mycobacterium tuberculosis
SSSLVAVHLACQSLRGRE

SEQ ID NO: 1460130 - protein, 20 aa, Mycobacterium tuberculosis
SSWINRLYWNLADYAGSPVR

SEQ ID NO: 1460131 - protein, 19 aa, Mycobacterium tuberculosis
STEVISNFASYLAIVLRVD

SEQ ID NO: 1460132 - protein, 20 aa, Mycobacterium tuberculosis
STLIVEPWMGPAAAAMAAAA

SEQ ID NO: 1460133 - protein, 25 aa, Mycobacterium tuberculosis
STLQRPSMRGVPFTFVRVDRAGNMS

SEQ ID NO: 1460134 - protein, 26 aa, Mycobacterium tuberculosis
STVVRRMRLQPGRMFLVDTAQGRIVS

SEQ ID NO: 1460135 - protein, 23 aa, Mycobacterium tuberculosis
SVAPCLFTKGGAVTWHIPESTAP

SEQ ID NO: 1460136 - protein, 25 aa, Mycobacterium tuberculosis
SVEVICAELLRLRDRFVSAAPEITP

SEQ ID NO: 1460137 - protein, 21 aa, Mycobacterium tuberculosis
SVGGPVFERGLRVVAATRGDP

SEQ ID NO: 1460138 - protein, 27 aa, Mycobacterium tuberculosis
SVLADCWRIAAKSLRPLPVAHKEMSEE

SEQ ID NO: 1460139 - protein, 23 aa, Mycobacterium tuberculosis
SVPSIILGGIDWFRSMGSEKSPG

SEQ ID NO: 1460140 - protein, 25 aa, Mycobacterium tuberculosis
SVRDVRLATVLSRCSYLRDGIVVRD

SEQ ID NO: 1460141 - protein, 24 aa, Mycobacterium tuberculosis
SVRGCDAFVLQSCPAPVNRWLMEQ

SEQ ID NO: 1460142 - protein, 25 aa, Mycobacterium tuberculosis
SVSGELRNDIELHLRRGIESDALRL

SEQ ID NO: 1460143 - protein, 31 aa, Mycobacterium tuberculosis; identical to SEQ ID NO: 206779

SEQ ID NO: 1460144 - protein, 17 aa, Mycobacterium tuberculosis
SVTTGLTGQAWQGPASA

SEQ ID NO: 1460145 - protein, 22 aa, Mycobacterium tuberculosis
SVVINPFFDWAYDRSPRTPYHE

SEQ ID NO: 1460146 - protein, 19 aa, Mycobacterium tuberculosis
SWGDVAMMLSLPYQGLGNA

SEQ ID NO: 1460147 - protein, 28 aa, Mycobacterium tuberculosis
SYLGFNEFRAIAGIGEMFDTLLVYENFP

SEQ ID NO: 1460148 - protein, 20 aa, Mycobacterium tuberculosis
SYSESFGLVAVEAQACGTPV

SEQ ID NO: 1460149 - protein, 28 aa, Mycobacterium tuberculosis
TAAELAPRVVATVPQLVQLAPHAVQMSQ

SEQ ID NO: 1460150 - protein, 17 aa, Mycobacterium tuberculosis
TAAKREYEASVSRAQAE

SEQ ID NO: 1460151 - protein, 18 aa, Mycobacterium tuberculosis
TAFVYIGEICRYLLNQPA

SEQ ID NO: 1460152 - protein, 17 aa, Mycobacterium tuberculosis
TAIEEIVRWTSPSPSKR

SEQ ID NO: 1460153 - protein, 17 aa, Mycobacterium tuberculosis
TALAMAMGHVILSECYV

SEQ ID NO: 1460154 - protein, 18 aa, Mycobacterium tuberculosis
TALAYGIVVAGQLAGLPV

SEQ ID NO: 1460155 - protein, 24 aa, Mycobacterium tuberculosis
TALEFRPKVIIAGWSAYPRVLDFA

SEQ ID NO: 1460156 - protein, 18 aa, Mycobacterium tuberculosis
TALGCYAEPGWARERGWP

SEQ ID NO: 1460157 - protein, 21 aa, Mycobacterium tuberculosis
TAVACPRFVDFVERGVTSGRQ

SEQ ID NO: 1460158 - protein, 22 aa, Mycobacterium tuberculosis
TAVEEIVRWASPVVYMRRTLTQ

SEQ ID NO: 1460159 - protein, 21 aa, Mycobacterium tuberculosis
TAVRWKNVLRQAAVYSACQKW

SEQ ID NO: 1460160 - protein, 17 aa, Mycobacterium tuberculosis
TAYFGERQRAVGGAGRF

SEQ ID NO: 1460161 - protein, 23 aa, Mycobacterium tuberculosis
TCVGRLRYLGLVLYDVDQVLQAA

SEQ ID NO: 1460162 - protein, 18 aa, Mycobacterium tuberculosis
TDADFKAAGAQLVGTADQ

SEQ ID NO: 1460163 - protein, 28 aa, Mycobacterium tuberculosis
TDARRREVYWARYCDGIRTVGPAVNAAA

SEQ ID NO: 1460164 - protein, 18 aa, Mycobacterium tuberculosis
TDCHLIALAARYGGRLVT

SEQ ID NO: 1460165 - protein, 23 aa, Mycobacterium tuberculosis
TDDARFGIPLGKLGVTTGFTEAD

SEQ ID NO: 1460166 - protein, 19 aa, Mycobacterium tuberculosis
TDIWDKGKAAVICSETTAT

SEQ ID NO: 1460167 - protein, 25 aa, Mycobacterium tuberculosis
TDLTLEEGVVFNAEISAAIEERLSR

SEQ ID NO: 1460168 - protein, 19 aa, Mycobacterium tuberculosis
TDSYIKLVFVDDDVDVGRL

SEQ ID NO: 1460169 - protein, 25 aa, Mycobacterium tuberculosis
TEACGDCPRVVLGSPLAGESLDEVL

SEQ ID NO: 1460170 - protein, 17 aa, Mycobacterium tuberculosis
TEALVRWQHPTRGLLAP

SEQ ID NO: 1460171 - protein, 22 aa, Mycobacterium tuberculosis
TEGRTALRFLPMEELIAAFLPV

SEQ ID NO: 1460172 - protein, 22 aa, Mycobacterium tuberculosis
TELRAIAGLVLVAGFETTVNLL

SEQ ID NO: 1460173 - protein, 17 aa, Mycobacterium tuberculosis
TEMPARIADDFLAGLHR

SEQ ID NO: 1460174 - protein, 21 aa, Mycobacterium tuberculosis
TEPIEVWSFDVMSFVDHTATM

SEQ ID NO: 1460175 - protein, 18 aa, Mycobacterium tuberculosis
TEVSCKFRPQAVGAELAA

SEQ ID NO: 1460176 - protein, 22 aa, Mycobacterium tuberculosis
TFLEIPEVLSIVDRVLSETAIL

SEQ ID NO: 1460177 - protein, 24 aa, Mycobacterium tuberculosis
TFRGCEGDALLMLLDANGIECSTG

SEQ ID NO: 1460178 - protein, 20 aa, Mycobacterium tuberculosis
TGAIVKRPRVVVDASGNESI

SEQ ID NO: 1460179 - protein, 26 aa, Mycobacterium tuberculosis
TGDLVCWRADGQLEFLGRTDDQVKIR

SEQ ID NO: 1460180 - protein, 23 aa, Mycobacterium tuberculosis
TGFPEAVAAHWLTTEERHGLGND

SEQ ID NO: 1460181 - protein, 22 aa, Mycobacterium tuberculosis
TGGLGGLGLFLAEKMAAAGCGR

SEQ ID NO: 1460182 - protein, 22 aa, Mycobacterium tuberculosis
TGGVEPWAYLIVGGVQLATHSW

SEQ ID NO: 1460183 - protein, 31 aa, Mycobacterium tuberculosis; identical to SEQ ID NO: 207030

SEQ ID NO: 1460184 - protein, 20 aa, Mycobacterium tuberculosis
TGIDEPRLGLILEIAAAAGL

SEQ ID NO: 1460185 - protein, 26 aa, Mycobacterium tuberculosis
TGKSELWPDLNLGLPFTYHQGYQSSP

SEQ ID NO: 1460186 - protein, 17 aa, Mycobacterium tuberculosis
TGLPWPDVHDAGTVSLL

SEQ ID NO: 1460187 - protein, 26 aa, Mycobacterium tuberculosis
TGNWASIVPHTWLWAMPMSGPTGGEI

SEQ ID NO: 1460188 - protein, 24 aa, Mycobacterium tuberculosis
TGPELLSRAAALNWDTTAPATVLV

SEQ ID NO: 1460189 - protein, 25 aa, Mycobacterium tuberculosis
TGQRAAGLSQIWSRQLGRAIGPDSS

SEQ ID NO: 1460190 - protein, 18 aa, Mycobacterium tuberculosis
TGSAELDASVAMDTFGKW

SEQ ID NO: 1460191 - protein, 20 aa, Mycobacterium tuberculosis
TGVMWKRFSETGAIKAKSVI

SEQ ID NO: 1460192 - protein, 23 aa, Mycobacterium tuberculosis
THEVWKAGQPVSLSPTEFTLLRY

SEQ ID NO: 1460193 - protein, 25 aa, Mycobacterium tuberculosis
THIESRPAVTLSWIREFPSLGAAAY

SEQ ID NO: 1460194 - protein, 23 aa, Mycobacterium tuberculosis
THPEELRDLLGTVYRLTAAGELP

SEQ ID NO: 1460195 - protein, 23 aa, Mycobacterium tuberculosis
THSPDRFVTYHVMNPYDDGIGLD

SEQ ID NO: 1460196 - protein, 18 aa, Mycobacterium tuberculosis
THYLRVYLAQLRRKLEDD

SEQ ID NO: 1460197 - protein, 18 aa, Mycobacterium tuberculosis
TIATSLRGALGSAPASVS

SEQ ID NO: 1460198 - protein, 17 aa, Mycobacterium tuberculosis
TIDRPSAHEILSAKLAP

SEQ ID NO: 1460199 - protein, 17 aa, Mycobacterium tuberculosis
TIHKHKVNLLFFTGDAM

SEQ ID NO: 1460200 - protein, 18 aa, Mycobacterium tuberculosis
TIKSALLTAYRHTQGHQT

SEQ ID NO: 1460201 - protein, 21 aa, Mycobacterium tuberculosis
TKADLYAAVDAMRADMRELLE

SEQ ID NO: 1460202 - protein, 22 aa, Mycobacterium tuberculosis
TLACARMGWNVYDTEVISLVTA

SEQ ID NO: 1460203 - protein, 20 aa, Mycobacterium tuberculosis
TLATWKRLCDPMAQQISTVW

SEQ ID NO: 1460204 - protein, 25 aa, Mycobacterium tuberculosis
TLAVSFSECNAGLVVDEVDADLLAA

SEQ ID NO: 1460205 - protein, 26 aa, Mycobacterium tuberculosis
TLDKSLGRPAIKSFIVPREHPGVTVE

SEQ ID NO: 1460206 - protein, 18 aa, Mycobacterium tuberculosis
TLELGGKSPNIFFADVLA

SEQ ID NO: 1460207 - protein, 26 aa, Mycobacterium tuberculosis
TLGPKGRNVVLEKKWGAPTITNDGVS

SEQ ID NO: 1460208 - protein, 23 aa, Mycobacterium tuberculosis
TLLYKKSSVMFGIDLAKRDIAKG

SEQ ID NO: 1460209 - protein, 20 aa, Mycobacterium tuberculosis
TLPHRPGVYLFRGPSGEVLY

SEQ ID NO: 1460210 - protein, 21 aa, Mycobacterium tuberculosis
TLRAGIELDDGPAFVDDFAVV

SEQ ID NO: 1460211 - protein, 17 aa, Mycobacterium tuberculosis
TLRDVLGGAGWDIESLE

SEQ ID NO: 1460212 - protein, 27 aa, Mycobacterium tuberculosis
TLRRARPVLEPMAGKIIHCGAAGAGQA

SEQ ID NO: 1460213 - protein, 18 aa, Mycobacterium tuberculosis
TLTTLVLRGQGGFGGARG

SEQ ID NO: 1460214 - protein, 24 aa, Mycobacterium tuberculosis
TMVLPELRALANRAGVKGTSGMRK

SEQ ID NO: 1460215 - protein, 24 aa, Mycobacterium tuberculosis
TNALCAAAVALECGASVEQVAAAL

SEQ ID NO: 1460216 - protein, 23 aa, Mycobacterium tuberculosis
TNIAGLLRDGAGTAAINLGLANH

SEQ ID NO: 1460217 - protein, 24 aa, Mycobacterium tuberculosis
TNLNPVWKVGFQVTEALRANTDGR

SEQ ID NO: 1460218 - protein, 18 aa, Mycobacterium tuberculosis
TNRWTLRPADPVGAVTVV

SEQ ID NO: 1460219 - protein, 21 aa, Mycobacterium tuberculosis
TNVVTAWRLLRSVDPHLRTRR

SEQ ID NO: 1460220 - protein, 23 aa, Mycobacterium tuberculosis
TPLPPIRALVCNAGLQVVSGIAF

SEQ ID NO: 1460221 - protein, 24 aa, Mycobacterium tuberculosis
TPTSTRGASALSLSLLSISRSGNT

SEQ ID NO: 1460222 - protein, 18 aa, Mycobacterium tuberculosis
TPVSWLPFYHDMGLMLGI

SEQ ID NO: 1460223 - protein, 25 aa, Mycobacterium tuberculosis
TQALERLETLLALIEGWVQTVVTAA

SEQ ID NO: 1460224 - protein, 18 aa, Mycobacterium tuberculosis
TQGKVIPDLITWWCERDG

SEQ ID NO: 1460225 - protein, 17 aa, Mycobacterium tuberculosis
TQLSGILNRGADISGVY

SEQ ID NO: 1460226 - protein, 17 aa, Mycobacterium tuberculosis
TQVESMILPPIAHQVKV

SEQ ID NO: 1460227 - protein, 26 aa, Mycobacterium tuberculosis
TRAGVLRFVVLDGLAKPGRMVGPDPG

SEQ ID NO: 1460228 - protein, 19 aa, Mycobacterium tuberculosis
TRARERWEALTALAELVDD

SEQ ID NO: 1460229 - protein, 19 aa, Mycobacterium tuberculosis
TRDAIEALAPYGLGTAYVN

SEQ ID NO: 1460230 - protein, 17 aa, Mycobacterium tuberculosis
TRDAPCEPVPIRTPLAE

SEQ ID NO: 1460231 - protein, 23 aa, Mycobacterium tuberculosis
TRDEVRAALAAGDWSSASESKLL

SEQ ID NO: 1460232 - protein, 17 aa, Mycobacterium tuberculosis
TRKNAHGDTEWLPPPHL

SEQ ID NO: 1460233 - protein, 20 aa, Mycobacterium tuberculosis
TRNGRIGVIGTRATITSHAY

SEQ ID NO: 1460234 - protein, 28 aa, Mycobacterium tuberculosis
TRNRALGLLYRWVEHAFGGREHALTGAY

SEQ ID NO: 1460235 - protein, 21 aa, Mycobacterium tuberculosis
TRPALRDPLILPSMCTEWAPR

SEQ ID NO: 1460236 - protein, 20 aa, Mycobacterium tuberculosis
TRPPSCLGIEFPVGPLMFPL

SEQ ID NO: 1460237 - protein, 20 aa, Mycobacterium tuberculosis
TRPSALVAIAALSRLGAVAV

SEQ ID NO: 1460238 - protein, 21 aa, Mycobacterium tuberculosis
TRPTNIGGLGFSMKWNMGWMH

SEQ ID NO: 1460239 - protein, 25 aa, Mycobacterium tuberculosis
TRRDRLFGSWHYWWQAHLLDCLVDA

SEQ ID NO: 1460240 - protein, 20 aa, Mycobacterium tuberculosis
TRRVRRHRAVLRAADRLELA

SEQ ID NO: 1460241 - protein, 18 aa, Mycobacterium tuberculosis
TRTAVCQPGLYNAEVKEA

SEQ ID NO: 1460242 - protein, 20 aa, Mycobacterium tuberculosis
TRWAPELCKVAVLDDAAGPL

SEQ ID NO: 1460243 - protein, 23 aa, Mycobacterium tuberculosis
TSAGLPYERCVGVTYQQLHADRD

SEQ ID NO: 1460244 - protein, 18 aa, Mycobacterium tuberculosis
TSFYDWYADLPVASPQVF

SEQ ID NO: 1460245 - protein, 28 aa, Mycobacterium tuberculosis
TSGYLCVPLDGAICDRLGLLPMYAVNQD

SEQ ID NO: 1460246 - protein, 25 aa, Mycobacterium tuberculosis
TSTAELLAGNGLRYNRFHTTALCSP

SEQ ID NO: 1460247 - protein, 29 aa, Mycobacterium tuberculosis
TTSGYPRVIKRWRRGKPLADAETIFEGAG

SEQ ID NO: 1460248 - protein, 19 aa, Mycobacterium tuberculosis
TTVTWQWTIHPRSALAAPV

SEQ ID NO: 1460249 - protein, 18 aa, Mycobacterium tuberculosis
TVAATVFTRPEIAAVGVP

SEQ ID NO: 1460250 - protein, 25 aa, Mycobacterium tuberculosis
TVFIPAFLRYDLRPVTGEWQIAALR

SEQ ID NO: 1460251 - protein, 25 aa, Mycobacterium tuberculosis
TVGECARCLSPVRGRVQVALTELFA

SEQ ID NO: 1460252 - protein, 18 aa, Mycobacterium tuberculosis
TVHLPQRVPMGFHGNWAP

SEQ ID NO: 1460253 - protein, 18 aa, Mycobacterium tuberculosis
TVIDVLRGKLEFESGEEG

SEQ ID NO: 1460254 - protein, 25 aa, Mycobacterium tuberculosis
TVILARLVARAMLQLPAQRTHRIRA

SEQ ID NO: 1460255 - protein, 22 aa, Mycobacterium tuberculosis
TVLDRLSSWVVFTPVQNVTGVP

SEQ ID NO: 1460256 - protein, 26 aa, Mycobacterium tuberculosis
TVNAVKLRLGIGYVIQNAGLMPHQRV

SEQ ID NO: 1460257 - protein, 26 aa, Mycobacterium tuberculosis
TVSLRLPVRAPFAFEGVFGHLAATAV

SEQ ID NO: 1460258 - protein, 17 aa, Mycobacterium tuberculosis
TYFFSDPAARDFVAGVA

SEQ ID NO: 1460259 - protein, 21 aa, Mycobacterium tuberculosis
TYRQETIRIFGLPESSLADTL

SEQ ID NO: 1460260 - protein, 19 aa, Mycobacterium tuberculosis
VAAEADWPDAYRVNRYVRG

SEQ ID NO: 1460261 - protein, 20 aa, Mycobacterium tuberculosis
VAAEARLRYLADHDDLTGLH

SEQ ID NO: 1460262 - protein, 25 aa, Mycobacterium tuberculosis
VAALIGVGADEMWDIRNRGVIPAGA

SEQ ID NO: 1460263 - protein, 25 aa, Mycobacterium tuberculosis
VAAPELAPGRALRCAEAVARGDASA

SEQ ID NO: 1460264 - protein, 18 aa, Mycobacterium tuberculosis
VAARPPAAVVLFSPLIDL

SEQ ID NO: 1460265 - protein, 24 aa, Mycobacterium tuberculosis
VADQRGASLVVDWPASVQQQVRRI

SEQ ID NO: 1460266 - protein, 26 aa, Mycobacterium tuberculosis
VAEALGEHVFDFFLRNKRTEWANYRS

SEQ ID NO: 1460267 - protein, 17 aa, Mycobacterium tuberculosis
VAEVMLGHIAGRPATRK

SEQ ID NO: 1460268 - protein, 25 aa, Mycobacterium tuberculosis
VAGALCLPDAAMLVAARGRLMQALP

SEQ ID NO: 1460269 - protein, 25 aa, Mycobacterium tuberculosis
VAGRRMAETVARRGGIVILPQDLPI

SEQ ID NO: 1460270 - protein, 22 aa, Mycobacterium tuberculosis
VAHDQCDAWTGLAAAGDQSIGV

SEQ ID NO: 1460271 - protein, 20 aa, Mycobacterium tuberculosis
VAHPTIRWVGSANELNAGYA

SEQ ID NO: 1460272 - protein, 26 aa, Mycobacterium tuberculosis
VAIFRARPSPFYIMDEVEAALDDVNL

SEQ ID NO: 1460273 - protein, 23 aa, Mycobacterium tuberculosis
VALCDRRGSYIFGRRTLPQMDLA

SEQ ID NO: 1460274 - protein, 26 aa, Mycobacterium tuberculosis
VALQPYGGVWLHSWLDRDLGISGRLS

SEQ ID NO: 1460275 - protein, 18 aa, Mycobacterium tuberculosis
VALVVGLELEKTVPGDTA

SEQ ID NO: 1460276 - protein, 23 aa, Mycobacterium tuberculosis
VAQACAFINYARGHYGVAADASN

SEQ ID NO: 1460277 - protein, 17 aa, Mycobacterium tuberculosis
VARENRLRTALAALDNF

SEQ ID NO: 1460278 - protein, 27 aa, Mycobacterium tuberculosis
VARTIVELCALWAVHLHFDPSPEPWSI

SEQ ID NO: 1460279 - protein, 24 aa, Mycobacterium tuberculosis
VASARWPAARFAVRNVAVQGPNAV

SEQ ID NO: 1460280 - protein, 25 aa, Mycobacterium tuberculosis
VAVLEGRLAAWAIELDAAAGRGVSA

SEQ ID NO: 1460281 - protein, 19 aa, Mycobacterium tuberculosis
VCEPFLVRAGMVARTPRGR

SEQ ID NO: 1460282 - protein, 30 aa, Mycobacterium tuberculosis; identical to SEQ ID NO: 207576

SEQ ID NO: 1460283 - protein, 26 aa, Mycobacterium tuberculosis
VDADEWRQELPLIEEWLQFVGEKLPT

SEQ ID NO: 1460284 - protein, 27 aa, Mycobacterium tuberculosis
VDALCARFRISGLPVVDDDGALVGIIT

SEQ ID NO: 1460285 - protein, 23 aa, Mycobacterium tuberculosis
VDALRKTGLLGLVLPREIGGMGS

SEQ ID NO: 1460286 - protein, 18 aa, Mycobacterium tuberculosis
VDAPRLGLPLAQELSAYL

SEQ ID NO: 1460287 - protein, 23 aa, Mycobacterium tuberculosis
VDAYLSPVLRRYINQVADQMRGV

SEQ ID NO: 1460288 - protein, 19 aa, Mycobacterium tuberculosis
VDCPEEYIGAVTQLMAARK

SEQ ID NO: 1460289 - protein, 18 aa, Mycobacterium tuberculosis
VDERVVAFVGRIQPLKAP

SEQ ID NO: 1460290 - protein, 23 aa, Mycobacterium tuberculosis
VDGAIGRGGWFIGTGGMATIGGG

SEQ ID NO: 1460291 - protein, 19 aa, Mycobacterium tuberculosis
VDLRDDWPQALRDSGFDAA

SEQ ID NO: 1460292 - protein, 17 aa, Mycobacterium tuberculosis
VDMTKIVGLRARAKAAF

SEQ ID NO: 1460293 - protein, 19 aa, Mycobacterium tuberculosis
VDTAVLCDRCQGKGTNGDS

SEQ ID NO: 1460294 - protein, 18 aa, Mycobacterium tuberculosis
VEGILDCAELLVVALCDR

SEQ ID NO: 1460295 - protein, 17 aa, Mycobacterium tuberculosis
VEHIGMIEVAQLRARVS

SEQ ID NO: 1460296 - protein, 19 aa, Mycobacterium tuberculosis
VELSARVAWMSESQLASEI

SEQ ID NO: 1460297 - protein, 21 aa, Mycobacterium tuberculosis
VEMRNRLKSATGLALSPTLIF

SEQ ID NO: 1460298 - protein, 23 aa, Mycobacterium tuberculosis
VEPSAPLPAFWVNIARKKILHAA

SEQ ID NO: 1460299 - protein, 22 aa, Mycobacterium tuberculosis
VEREFRGVFTALFPGGEGRLRL

SEQ ID NO: 1460300 - protein, 27 aa, Mycobacterium tuberculosis
VERLQRLRLPWWHLWRAAEAAGAATPK

SEQ ID NO: 1460301 - protein, 20 aa, Mycobacterium tuberculosis
VESLPLIASSIMSKKLAEGA

SEQ ID NO: 1460302 - protein, 19 aa, Mycobacterium tuberculosis
VEVEARLAVRTAEERANAV

SEQ ID NO: 1460303 - protein, 19 aa, Mycobacterium tuberculosis
VGAKLLVDMAHFAGLVAAG

SEQ ID NO: 1460304 - protein, 17 aa, Mycobacterium tuberculosis
VGAPAHRIADQSVVVTM

SEQ ID NO: 1460305 - protein, 22 aa, Mycobacterium tuberculosis
VGAVDCRGGAPGTRETDLLDPA

SEQ ID NO: 1460306 - protein, 17 aa, Mycobacterium tuberculosis
VGEIAAYAIAGVIAADD

SEQ ID NO: 1460307 - protein, 18 aa, Mycobacterium tuberculosis
VGEICRRLDGIPLAIEFA

SEQ ID NO: 1460308 - protein, 26 aa, Mycobacterium tuberculosis
VGELGRSAAGYALWCNGIEDFAELRR

SEQ ID NO: 1460309 - protein, 17 aa, Mycobacterium tuberculosis
VGFAIFRIEVNLPVDGR

SEQ ID NO: 1460310 - protein, 18 aa, Mycobacterium tuberculosis
VGGGVLLLSCQLAAEGFD

SEQ ID NO: 1460311 - protein, 23 aa, Mycobacterium tuberculosis
VGGLRGGFEYARTGNPTRAALEA

SEQ ID NO: 1460312 - protein, 19 aa, Mycobacterium tuberculosis
VGGLSGARPLVAWLDALAT

SEQ ID NO: 1460313 - protein, 19 aa, Mycobacterium tuberculosis
VGGPLPGLGADLLAVVARL

SEQ ID NO: 1460314 - protein, 17 aa, Mycobacterium tuberculosis
VGHSLDPKADYGPLVTG

SEQ ID NO: 1460315 - protein, 23 aa, Mycobacterium tuberculosis
VGPDLRLPIYIGDDLTDEDAFDA

SEQ ID NO: 1460316 - protein, 22 aa, Mycobacterium tuberculosis
VGPTIAAAVTEWFAVDWHREIV

SEQ ID NO: 1460317 - protein, 20 aa, Mycobacterium tuberculosis
VHELVRRWSGHMVTSQGDGF

SEQ ID NO: 1460318 - protein, 17 aa, Mycobacterium tuberculosis
VHTEFRKLVSRGFTPRQ

SEQ ID NO: 1460319 - protein, 22 aa, Mycobacterium tuberculosis
VHVPQCPRRWRYLSPAIPADPN

SEQ ID NO: 1460320 - protein, 26 aa, Mycobacterium tuberculosis
VHWVAPPEAVWACRSLAATHYASGGW

SEQ ID NO: 1460321 - protein, 25 aa, Mycobacterium tuberculosis
VHYPERLGALVLTSCDAFEHFPPPI

SEQ ID NO: 1460322 - protein, 18 aa, Mycobacterium tuberculosis
VIADEIWAPVVYGSRHVA

SEQ ID NO: 1460323 - protein, 17 aa, Mycobacterium tuberculosis
VIAELRRQLGWSQQAPR

SEQ ID NO: 1460324 - protein, 24 aa, Mycobacterium tuberculosis
VILQEIFRRFTITAAGPSKGETPL

SEQ ID NO: 1460325 - protein, 18 aa, Mycobacterium tuberculosis
VILRQAACARGVPVLMAT

SEQ ID NO: 1460326 - protein, 18 aa, Mycobacterium tuberculosis
VIVESAVLLGQSNAHTLV

SEQ ID NO: 1460327 - protein, 20 aa, Mycobacterium tuberculosis
VKAGAILVNVNFRYVEGELR

SEQ ID NO: 1460328 - protein, 21 aa, Mycobacterium tuberculosis
VKDQGLWAAHLRPELGGQGFG

SEQ ID NO: 1460329 - protein, 21 aa, Mycobacterium tuberculosis
VKGFFEKTFAPLGLKKIQAEV

SEQ ID NO: 1460330 - protein, 18 aa, Mycobacterium tuberculosis
VKPARGGSSIGVSRVSSW

SEQ ID NO: 1460331 - protein, 24 aa, Mycobacterium tuberculosis
VKPRRFTAKLSYRGRAFATVPIEV

SEQ ID NO: 1460332 - protein, 26 aa, Mycobacterium tuberculosis
VLGPSGVWELFWPDFPCDGLYKFRVH

SEQ ID NO: 1460333 - protein, 24 aa, Mycobacterium tuberculosis
VLLSDPWACSRFAEHDVVVPLVVI

SEQ ID NO: 1460334 - protein, 28 aa, Mycobacterium tuberculosis
VLPRSDWATKICELRKPVRLEVVTAVQG

SEQ ID NO: 1460335 - protein, 18 aa, Mycobacterium tuberculosis
VMLGAALLARNAVEKGLT

SEQ ID NO: 1460336 - protein, 26 aa, Mycobacterium tuberculosis
VMRDYRLRVSDALSKLTPWKAPPPIA

SEQ ID NO: 1460337 - protein, 21 aa, Mycobacterium tuberculosis
VNARYLRICVLTQYKSHSLDR

SEQ ID NO: 1460338 - protein, 24 aa, Mycobacterium tuberculosis
VNASYRMEQGFTFELNLAGVADEH

SEQ ID NO: 1460339 - protein, 17 aa, Mycobacterium tuberculosis
VNGTAMRESFAERGVTL

SEQ ID NO: 1460340 - protein, 18 aa, Mycobacterium tuberculosis
VNPPKPPPAIKIDPPPPP

SEQ ID NO: 1460341 - protein, 19 aa, Mycobacterium tuberculosis
VNVKPKFAVDAMVATIGQE

SEQ ID NO: 1460342 - protein, 23 aa, Mycobacterium tuberculosis
VNWDVREGVFAPGVIDAMFTHQV

SEQ ID NO: 1460343 - protein, 17 aa, Mycobacterium tuberculosis
VPAESKVAIGQSVELAF

SEQ ID NO: 1460344 - protein, 20 aa, Mycobacterium tuberculosis
VPAHVAANFEGLVVRVDDTD

SEQ ID NO: 1460345 - protein, 20 aa, Mycobacterium tuberculosis
VPAITKWRKGAGVTGENRLK

SEQ ID NO: 1460346 - protein, 21 aa, Mycobacterium tuberculosis
VPARLHPGSFYALPQSPQLFK

SEQ ID NO: 1460347 - protein, 19 aa, Mycobacterium tuberculosis
VPDFFRIPYDPHLATGLAV

SEQ ID NO: 1460348 - protein, 25 aa, Mycobacterium tuberculosis
VPEGDFVRWKKLRGGIGALTTHLSQ

SEQ ID NO: 1460349 - protein, 18 aa, Mycobacterium tuberculosis
VPGASYWYAHTDQWRYDG

SEQ ID NO: 1460350 - protein, 26 aa, Mycobacterium tuberculosis
VPHRPVAEYFVWFKGEYDVDDTDRLL

SEQ ID NO: 1460351 - protein, 27 aa, Mycobacterium tuberculosis
VPLWTTRAKRWLRRRTGAEHPAVAWAT

SEQ ID NO: 1460352 - protein, 17 aa, Mycobacterium tuberculosis
VPNDQFLLYAFDGEPTD

SEQ ID NO: 1460353 - protein, 18 aa, Mycobacterium tuberculosis
VPPSWAWPKPAVAPPVLF

SEQ ID NO: 1460354 - protein, 17 aa, Mycobacterium tuberculosis
VPSLRLVGYGGSRAIAA

SEQ ID NO: 1460355 - protein, 18 aa, Mycobacterium tuberculosis
VPVGSAPTPSGWEVTTHG

SEQ ID NO: 1460356 - protein, 17 aa, Mycobacterium tuberculosis
VPVLPGRGPQLRLYDSA

SEQ ID NO: 1460357 - protein, 29 aa, Mycobacterium tuberculosis
VQAIKEAGWWRLGLAEEIGGMPAPPPLAW

SEQ ID NO: 1460358 - protein, 25 aa, Mycobacterium tuberculosis
VQANRVRTWLLAVSNVFGQNAPAIA

SEQ ID NO: 1460359 - protein, 19 aa, Mycobacterium tuberculosis
VQDIGWDEQWQCDRCSVVH

SEQ ID NO: 1460360 - protein, 27 aa, Mycobacterium tuberculosis
VQLAVYRLAWAALRGCPTSSVRTAFYY

SEQ ID NO: 1460361 - protein, 17 aa, Mycobacterium tuberculosis
VQLVLCAGAADTPEVAD

SEQ ID NO: 1460362 - protein, 17 aa, Mycobacterium tuberculosis
VRASVIDRGQWKDHRDG

SEQ ID NO: 1460363 - protein, 21 aa, Mycobacterium tuberculosis
VRAWARLWERCAIDLTGNTEE

SEQ ID NO: 1460364 - protein, 18 aa, Mycobacterium tuberculosis
VRDMRFEAMLLLDDQTPV

SEQ ID NO: 1460365 - protein, 24 aa, Mycobacterium tuberculosis
VRGGALAPGTVRQWLAEHAGDGRR

SEQ ID NO: 1460366 - protein, 18 aa, Mycobacterium tuberculosis
VRHGLADMYGFIPVDREP

SEQ ID NO: 1460367 - protein, 20 aa, Mycobacterium tuberculosis
VRIGGRWRSGTAYLLPDDDP

SEQ ID NO: 1460368 - protein, 23 aa, Mycobacterium tuberculosis
VRIPDPIAALGNRMQGHSDRLPY

SEQ ID NO: 1460369 - protein, 25 aa, Mycobacterium tuberculosis
VRKGTMKSQPWILAYEDHNVDAGLA

SEQ ID NO: 1460370 - protein, 25 aa, Mycobacterium tuberculosis
VRLGGPRLKDVAGLSLTKLFVGSEG

SEQ ID NO: 1460371 - protein, 17 aa, Mycobacterium tuberculosis
VRPPRGLTATGLAALLR

SEQ ID NO: 1460372 - protein, 26 aa, Mycobacterium tuberculosis
VRRYIAKYTICPAIAHGMDHLIGSVE

SEQ ID NO: 1460373 - protein, 25 aa, Mycobacterium tuberculosis
VRTVEPWGVVTEKGRWYLVGHDRDR

SEQ ID NO: 1460374 - protein, 18 aa, Mycobacterium tuberculosis
VRVLKPGGRFVFAGEPTT

SEQ ID NO: 1460375 - protein, 27 aa, Mycobacterium tuberculosis
VRVTLVIRGSCLLRHCDDTICERFTRI

SEQ ID NO: 1460376 - protein, 21 aa, Mycobacterium tuberculosis
VRYPYARGVLVEMYREAKTRL

SEQ ID NO: 1460377 - protein, 19 aa, Mycobacterium tuberculosis
VSAAVELVHNFTLLHDDVM

SEQ ID NO: 1460378 - protein, 23 aa, Mycobacterium tuberculosis
VSCGHVARSLWAVIVDPDTGPEA

SEQ ID NO: 1460379 - protein, 21 aa, Mycobacterium tuberculosis
VSIGAILAVPGIRAALREATA

SEQ ID NO: 1460380 - protein, 17 aa, Mycobacterium tuberculosis
VSRLFAEQWTRAAEEAA

SEQ ID NO: 1460381 - protein, 18 aa, Mycobacterium tuberculosis
VTAVRSRLMAPLSGQGTM

SEQ ID NO: 1460382 - protein, 21 aa, Mycobacterium tuberculosis
VTDLGAAFARLMRTEDARPVV

SEQ ID NO: 1460383 - protein, 22 aa, Mycobacterium tuberculosis
VTDRPSFIALRTVIGYPAPNLM

SEQ ID NO: 1460384 - protein, 21 aa, Mycobacterium tuberculosis
VTELLPFGRPQLAGGPLGSVA

SEQ ID NO: 1460385 - protein, 27 aa, Mycobacterium tuberculosis
VTEVRLFLRRVPALAFLPNRRPAEPNQ

SEQ ID NO: 1460386 - protein, 17 aa, Mycobacterium tuberculosis
VTGLRLMTRMVQTGSSL

SEQ ID NO: 1460387 - protein, 19 aa, Mycobacterium tuberculosis
VTIAKLWELFVAEDATLVE

SEQ ID NO: 1460388 - protein, 26 aa, Mycobacterium tuberculosis
VTLGPRGRHVVLAKAFGGPTVTNDGV

SEQ ID NO: 1460389 - protein, 18 aa, Mycobacterium tuberculosis
VTLRRARASGAVLMKPST

SEQ ID NO: 1460390 - protein, 24 aa, Mycobacterium tuberculosis
VTMRNRLRLAATHAVRTSADVVRS

SEQ ID NO: 1460391 - protein, 25 aa, Mycobacterium tuberculosis
VTNCGNSWPMARLTLALSPATLPKM

SEQ ID NO: 1460392 - protein, 25 aa, Mycobacterium tuberculosis
VTQRHLRRLWALPGTQLAVVAWPST

SEQ ID NO: 1460393 - protein, 19 aa, Mycobacterium tuberculosis
VTVGEVWVHDNARWAEYLR

SEQ ID NO: 1460394 - protein, 25 aa, Mycobacterium tuberculosis
VTVIDPRWVLPVSDGVRELAVQHKL

SEQ ID NO: 1460395 - protein, 25 aa, Mycobacterium tuberculosis
VVAAARGRPVVDFGARRAHGTDAAC

SEQ ID NO: 1460396 - protein, 29 aa, Mycobacterium tuberculosis
VVAADWPLLAAAYRTRGALRIVDDLLPAP

SEQ ID NO: 1460397 - protein, 24 aa, Mycobacterium tuberculosis
VVGFIWEVLGRIGIGRKDALVSLG

SEQ ID NO: 1460398 - protein, 26 aa, Mycobacterium tuberculosis
VVGLVGEKARYMWVSTFHSTCVRILR

SEQ ID NO: 1460399 - protein, 17 aa, Mycobacterium tuberculosis
VVPRASMPKFLSTARGL

SEQ ID NO: 1460400 - protein, 27 aa, Mycobacterium tuberculosis
VVPSSKLGGLWTAVSPHLSPLSNVSSI

SEQ ID NO: 1460401 - protein, 18 aa, Mycobacterium tuberculosis
VVRKAYRPSHEKLAWARR

SEQ ID NO: 1460402 - protein, 18 aa, Mycobacterium tuberculosis
VWRTDGYCHCMFTALDTL

SEQ ID NO: 1460403 - protein, 27 aa, Mycobacterium tuberculosis
VYGNTRLGLFPFRRGLTFYYLDLALMS

SEQ ID NO: 1460404 - protein, 21 aa, Mycobacterium tuberculosis
VYLTRPSLFHFTRTGEEFSWR

SEQ ID NO: 1460405 - protein, 17 aa, Mycobacterium tuberculosis
VYPRAAFEQLARRASKA

SEQ ID NO: 1460406 - protein, 24 aa, Mycobacterium tuberculosis
VYRRPHTRRWAGPAFLLNQMLVWG

SEQ ID NO: 1460407 - protein, 23 aa, Mycobacterium tuberculosis
WAAEACGEYAPDLDIVGAVLGSP

SEQ ID NO: 1460408 - protein, 19 aa, Mycobacterium tuberculosis
WAAGAQRGQPIYLMGPGGA

SEQ ID NO: 1460409 - protein, 20 aa, Mycobacterium tuberculosis
WAAPSTRPVSALSPAGLTTL

SEQ ID NO: 1460410 - protein, 25 aa, Mycobacterium tuberculosis
WADKYRGRFDVGWDALREETFARQK

SEQ ID NO: 1460411 - protein, 17 aa, Mycobacterium tuberculosis
WAKAHWRALEFNYSAAA

SEQ ID NO: 1460412 - protein, 25 aa, Mycobacterium tuberculosis
WANGVRRIATEAGITVIAGMFTPTG

SEQ ID NO: 1460413 - protein, 20 aa, Mycobacterium tuberculosis
WAQDVAAMFGYHSAASAVAT

SEQ ID NO: 1460414 - protein, 20 aa, Mycobacterium tuberculosis
WCAHSGWKVDAAKGVPDWAA

SEQ ID NO: 1460415 - protein, 17 aa, Mycobacterium tuberculosis
WDPNSTYVRKPPYFEGM

SEQ ID NO: 1460416 - protein, 19 aa, Mycobacterium tuberculosis
WDQRLCLVPNGDLFRAIRH

SEQ ID NO: 1460417 - protein, 21 aa, Mycobacterium tuberculosis
WERVVEAFAPAHVVEFFATTD

SEQ ID NO: 1460418 - protein, 26 aa, Mycobacterium tuberculosis
WEVQGRGELALAVLVEQMRREGFELT

SEQ ID NO: 1460419 - protein, 19 aa, Mycobacterium tuberculosis
WFDIEPCYVYHPLNAYSEC

SEQ ID NO: 1460420 - protein, 18 aa, Mycobacterium tuberculosis
WGSSYGPIGEACRRARRR

SEQ ID NO: 1460421 - protein, 35 aa, Mycobacterium tuberculosis; identical to SEQ ID NO: 212034

SEQ ID NO: 1460422 - protein, 20 aa, Mycobacterium tuberculosis
WIPAGCWHQHKFHGHTQFHG

SEQ ID NO: 1460423 - protein, 18 aa, Mycobacterium tuberculosis
WKLVRTFDDPATWTEPGV

SEQ ID NO: 1460424 - protein, 20 aa, Mycobacterium tuberculosis
WLGRDRFVLSAGHSSLTLYI

SEQ ID NO: 1460425 - protein, 24 aa, Mycobacterium tuberculosis
WLNSYYDDMAWLALALERADRVAG

SEQ ID NO: 1460426 - protein, 20 aa, Mycobacterium tuberculosis
WLPETMAYTAVRWKNVLRQA

SEQ ID NO: 1460427 - protein, 29 aa, Mycobacterium tuberculosis
WLPMKRTALALHHLVCTRFRSDALQIIAF

SEQ ID NO: 1460428 - protein, 21 aa, Mycobacterium tuberculosis
WLSGQLGRPLSLIAETDRNDP

SEQ ID NO: 1460429 - protein, 23 aa, Mycobacterium tuberculosis
WLSSPYSHWAFQHVEDFMPTTVI

SEQ ID NO: 1460430 - protein, 21 aa, Mycobacterium tuberculosis
WLTVLLRRDLGLLVTIGVPGG

SEQ ID NO: 1460431 - protein, 24 aa, Mycobacterium tuberculosis
WMLQSRLKALRIFDRKPIPKWGSN

SEQ ID NO: 1460432 - protein, 18 aa, Mycobacterium tuberculosis
WNIGIGITGNGQIGFGKP

SEQ ID NO: 1460433 - protein, 26 aa, Mycobacterium tuberculosis
WNLLGWPSINVPAGFTSDGLPIGVQL

SEQ ID NO: 1460434 - protein, 18 aa, Mycobacterium tuberculosis
WPAPDHLRLVTLPWSRDL

SEQ ID NO: 1460435 - protein, 17 aa, Mycobacterium tuberculosis
WPCPDRCDRASSWFHNH

SEQ ID NO: 1460436 - protein, 31 aa, Mycobacterium tuberculosis; identical to SEQ ID NO: 210366

SEQ ID NO: 1460437 - protein, 18 aa, Mycobacterium tuberculosis
WPQPQVLCTMRLARRVLS

SEQ ID NO: 1460438 - protein, 21 aa, Mycobacterium tuberculosis
WPRELTEAFANMGTEIFETMF

SEQ ID NO: 1460439 - protein, 20 aa, Mycobacterium tuberculosis
WPTIELPGFVAGNGHWALTK

SEQ ID NO: 1460440 - protein, 21 aa, Mycobacterium tuberculosis
WPTSRGFERFYGFLGGETDQW

SEQ ID NO: 1460441 - protein, 20 aa, Mycobacterium tuberculosis
WQAIEASGRFCVNVLTEKQK

SEQ ID NO: 1460442 - protein, 17 aa, Mycobacterium tuberculosis
WQVLLAVSAELAGERSR

SEQ ID NO: 1460443 - protein, 17 aa, Mycobacterium tuberculosis
WQVTRTAVRFIGRLPRK

SEQ ID NO: 1460444 - protein, 18 aa, Mycobacterium tuberculosis
WRAAMWSKPAGHGINAPD

SEQ ID NO: 1460445 - protein, 19 aa, Mycobacterium tuberculosis
WRHGAAVSVGLVFAAELAR

SEQ ID NO: 1460446 - protein, 17 aa, Mycobacterium tuberculosis
WRIPDVNALPPIKHTFA

SEQ ID NO: 1460447 - protein, 17 aa, Mycobacterium tuberculosis
WRPWRSYATQHLWTTLE

SEQ ID NO: 1460448 - protein, 17 aa, Mycobacterium tuberculosis
WRVVEAVDEPSAITTLA

SEQ ID NO: 1460449 - protein, 20 aa, Mycobacterium tuberculosis
WSAAPNFAFELAVRKTTDAD

SEQ ID NO: 1460450 - protein, 18 aa, Mycobacterium tuberculosis
WSALCGIVEAGGSLEKFR

SEQ ID NO: 1460451 - protein, 22 aa, Mycobacterium tuberculosis
WSDPCKGIPALDAHLVDEVAER

SEQ ID NO: 1460452 - protein, 19 aa, Mycobacterium tuberculosis
WSNRIERGLVHITGVTRLE

SEQ ID NO: 1460453 - protein, 17 aa, Mycobacterium tuberculosis
WTIHPRSALAAPVLPVF

SEQ ID NO: 1460454 - protein, 17 aa, Mycobacterium tuberculosis
WTIVSGLEIDEFSRGRI

SEQ ID NO: 1460455 - protein, 19 aa, Mycobacterium tuberculosis
WTNPDCRRAGTVHLGGTFA

SEQ ID NO: 1460456 - protein, 18 aa, Mycobacterium tuberculosis
WVLGPSMTYTCAVFPNAE

SEQ ID NO: 1460457 - protein, 18 aa, Mycobacterium tuberculosis
WVNRFRWNRCTTGDTRAG

SEQ ID NO: 1460458 - protein, 20 aa, Mycobacterium tuberculosis
WWPECSKEAYADGIAGAVDA

SEQ ID NO: 1460459 - protein, 19 aa, Mycobacterium tuberculosis
WYEGPTWLQRVLRALPAAG

SEQ ID NO: 1460460 - protein, 18 aa, Mycobacterium tuberculosis
YADALIWTPAHLAVDVAV

SEQ ID NO: 1460461 - protein, 18 aa, Mycobacterium tuberculosis
YALATGIIDETGFPEAVA

SEQ ID NO: 1460462 - protein, 18 aa, Mycobacterium tuberculosis
YARSRFTIAARAAGLPSA

SEQ ID NO: 1460463 - protein, 19 aa, Mycobacterium tuberculosis
YDFFNMWRVRPAGLRVIGA

SEQ ID NO: 1460464 - protein, 17 aa, Mycobacterium tuberculosis
YDIPGACEHLRQFTEAL

SEQ ID NO: 1460465 - protein, 27 aa, Mycobacterium tuberculosis
YDLSHPWGHGAPAWPYFEDVQIERLHG

SEQ ID NO: 1460466 - protein, 19 aa, Mycobacterium tuberculosis
YDYSARFGDYQVIVIANPL

SEQ ID NO: 1460467 - protein, 21 aa, Mycobacterium tuberculosis
YELFARAVIPYFKGQLAAPRA

SEQ ID NO: 1460468 - protein, 30 aa, Mycobacterium tuberculosis; identical to SEQ ID NO: 208764

SEQ ID NO: 1460469 - protein, 27 aa, Mycobacterium tuberculosis
YEVKGCIAHGGLGWIYLALDRNVNGRP

SEQ ID NO: 1460470 - protein, 19 aa, Mycobacterium tuberculosis
YFGDRRKAFLEDLAVVTGG

SEQ ID NO: 1460471 - protein, 23 aa, Mycobacterium tuberculosis
YGAALRFAPPLVITAQEIDCAVR

SEQ ID NO: 1460472 - protein, 21 aa, Mycobacterium tuberculosis
YGDCSKLAAITGWQQEICLTQ

SEQ ID NO: 1460473 - protein, 18 aa, Mycobacterium tuberculosis
YGLAAADGVMRWLEEHRR

SEQ ID NO: 1460474 - protein, 24 aa, Mycobacterium tuberculosis
YGLAWRTKRLIVFDVDSTLVQGEV

SEQ ID NO: 1460475 - protein, 17 aa, Mycobacterium tuberculosis
YGLDGRLRGAPHMAANL

SEQ ID NO: 1460476 - protein, 17 aa, Mycobacterium tuberculosis
YGPWECDGVRRAGVSSF

SEQ ID NO: 1460477 - protein, 17 aa, Mycobacterium tuberculosis
YGVCSLDAIGGQTIGDT

SEQ ID NO: 1460478 - protein, 18 aa, Mycobacterium tuberculosis
YHEFWSCTVSILDSKVID

SEQ ID NO: 1460479 - protein, 26 aa, Mycobacterium tuberculosis
YHGVVFAELGPPAFALKARVQLLRDY

SEQ ID NO: 1460480 - protein, 26 aa, Mycobacterium tuberculosis
YKSYRGMGSLGAMRGRGGATSYSKDR

SEQ ID NO: 1460481 - protein, 24 aa, Mycobacterium tuberculosis
YLEKTRGAIDFNRPGIPIIASLPS

SEQ ID NO: 1460482 - protein, 19 aa, Mycobacterium tuberculosis
YLGAIGMAAVEAHERELVA

SEQ ID NO: 1460483 - protein, 18 aa, Mycobacterium tuberculosis
YLGISTRLANSWDYELAD

SEQ ID NO: 1460484 - protein, 17 aa, Mycobacterium tuberculosis
YLMRALPRVARAVSSNP

SEQ ID NO: 1460485 - protein, 25 aa, Mycobacterium tuberculosis
YLPHAPWPWGVIDQAARVLLPASTT

SEQ ID NO: 1460486 - protein, 17 aa, Mycobacterium tuberculosis
YLRCLRVLTAGRGYPMV

SEQ ID NO: 1460487 - protein, 24 aa, Mycobacterium tuberculosis
YLRMDDFPARLVVVPGEHDRLLEA

SEQ ID NO: 1460488 - protein, 18 aa, Mycobacterium tuberculosis
YMIGSSFGSIIGSLVARE

SEQ ID NO: 1460489 - protein, 25 aa, Mycobacterium tuberculosis
YMIRVKEMWESMKIVEQCLDKLRPG

SEQ ID NO: 1460490 - protein, 21 aa, Mycobacterium tuberculosis
YNRGWFPQVFSIIDGQKVGVT

SEQ ID NO: 1460491 - protein, 18 aa, Mycobacterium tuberculosis
YPDVRVHRSLVCDKPARW

SEQ ID NO: 1460492 - protein, 20 aa, Mycobacterium tuberculosis
YPNQRLRLETSTERLTTRVI

SEQ ID NO: 1460493 - protein, 21 aa, Mycobacterium tuberculosis
YPPEAIDWLLPAAARRVLDLG

SEQ ID NO: 1460494 - protein, 21 aa, Mycobacterium tuberculosis
YPRQLDFARFRAIADEVDAVL

SEQ ID NO: 1460495 - protein, 22 aa, Mycobacterium tuberculosis
YPSTLGYKGFPKSCCTSLNEVI

SEQ ID NO: 1460496 - protein, 27 aa, Mycobacterium tuberculosis
YQAAMFDGRFVGFADFLIRDGHRYRVA

SEQ ID NO: 1460497 - protein, 19 aa, Mycobacterium tuberculosis
YQEVITMHECRSAKQLATV

SEQ ID NO: 1460498 - protein, 20 aa, Mycobacterium tuberculosis
YQMYRLLAVAKYEERYVIPT

SEQ ID NO: 1460499 - protein, 21 aa, Mycobacterium tuberculosis
YQPWLDRLLAMSWDDSEHRKI

SEQ ID NO: 1460500 - protein, 17 aa, Mycobacterium tuberculosis
YRFLLRRNRRLYGVAYT

SEQ ID NO: 1460501 - protein, 20 aa, Mycobacterium tuberculosis
YRLIPKHSIGMALDDCHDGY

SEQ ID NO: 1460502 - protein, 24 aa, Mycobacterium tuberculosis
YRPWAGEIRARHTGSLVSDRAGAI

SEQ ID NO: 1460503 - protein, 27 aa, Mycobacterium tuberculosis
YRRFLERRLRETFGFDGSPIRVNVRVR

SEQ ID NO: 1460504 - protein, 17 aa, Mycobacterium tuberculosis
YRRLPVGIVANGVLTRT

SEQ ID NO: 1460505 - protein, 19 aa, Mycobacterium tuberculosis
YRVFAELSPHPLLTHAVEQ

SEQ ID NO: 1460506 - protein, 26 aa, Mycobacterium tuberculosis
YSPAELACALGLFPPTAEQAAVIAAP

SEQ ID NO: 1460507 - protein, 21 aa, Mycobacterium tuberculosis
YSPRVEGVHLRFGPVARGGLR

SEQ ID NO: 1460508 - protein, 17 aa, Mycobacterium tuberculosis
YTALEAIMRPGATELDI

SEQ ID NO: 1460509 - protein, 24 aa, Mycobacterium tuberculosis
YTRTLDILERFYGLVLTDCGTGLL

SEQ ID NO: 1460510 - protein, 20 aa, Mycobacterium tuberculosis
YVHNRLLTLLLFDIGSFAGL

SEQ ID NO: 1460511 - protein, 18 aa, Mycobacterium tuberculosis
YVVALPMRVRFRGITTRE

SEQ ID NO: 1460512 - protein, 25 aa, Mycobacterium tuberculosis
YVVEKRFNLSWSIEGTRSRTGKMLP

SEQ ID NO: 1460513 - protein, 17 aa, Mycobacterium tuberculosis
YWPAPAVANYALSGEAV

SEQ ID NO: 1460514 - protein, 26 aa, Mycobacterium tuberculosis
AAAHGGPHYLCLAIHAMVTDDSSRQI

SEQ ID NO: 1460515 - protein, 17 aa, Mycobacterium tuberculosis
AACEFKNQVLVKIYNRK

SEQ ID NO: 1460516 - protein, 21 aa, Mycobacterium tuberculosis
AACGLRRLIPLYATVETALAP

SEQ ID NO: 1460517 - protein, 22 aa, Mycobacterium tuberculosis
AADELSGLFVPTDVCDEDAVNG

SEQ ID NO: 1460518 - protein, 25 aa, Mycobacterium tuberculosis
AAEDPRVAGLIARVQLPPSPAGAVQ

SEQ ID NO: 1460519 - protein, 17 aa, Mycobacterium tuberculosis
AAERRRYVEVFAAGQGG

SEQ ID NO: 1460520 - protein, 19 aa, Mycobacterium tuberculosis
AAGEAFGRAAEPWEVAATI

SEQ ID NO: 1460521 - protein, 23 aa, Mycobacterium tuberculosis
AAGVCFPDLLLTKGEYQLKLTPP

SEQ ID NO: 1460522 - protein, 26 aa, Mycobacterium tuberculosis
AAKRAFSEPVALNWAADGTDVDFGAL

SEQ ID NO: 1460523 - protein, 23 aa, Mycobacterium tuberculosis
AALARSRATLVLHLAAAQIDAIV

SEQ ID NO: 1460524 - protein, 25 aa, Mycobacterium tuberculosis
AALASRVRKAPGFALLGEKGQSRDL

SEQ ID NO: 1460525 - protein, 23 aa, Mycobacterium tuberculosis
AALDIPILQGLCLTSPRDQWCAN

SEQ ID NO: 1460526 - protein, 20 aa, Mycobacterium tuberculosis
AALGRYGRLDGVLVASGSNH

SEQ ID NO: 1460527 - protein, 17 aa, Mycobacterium tuberculosis
AALWRRALTLSGESPST

SEQ ID NO: 1460528 - protein, 26 aa, Mycobacterium tuberculosis
AAMARTCVDAGWLLSLSGTVSFRNAR

SEQ ID NO: 1460529 - protein, 19 aa, Mycobacterium tuberculosis
AAMASRLVGAVLIGRDRAA

SEQ ID NO: 1460530 - protein, 17 aa, Mycobacterium tuberculosis
AAPGLGLVRVAAELGGD

SEQ ID NO: 1460531 - protein, 19 aa, Mycobacterium tuberculosis
AASVGSLSVPPAWAAANQA

SEQ ID NO: 1460532 - protein, 20 aa, Mycobacterium tuberculosis
AAYRRRLCRESAKARNVDRV

SEQ ID NO: 1460533 - protein, 21 aa, Mycobacterium tuberculosis
ADADDAPAWWDGTVVEHIRVS

SEQ ID NO: 1460534 - protein, 25 aa, Mycobacterium tuberculosis
ADAEFPDAIVVPGFVDMHVHGGGGA

SEQ ID NO: 1460535 - protein, 25 aa, Mycobacterium tuberculosis
ADAGSGRYMLRCRVGERIRVCDWLP

SEQ ID NO: 1460536 - protein, 25 aa, Mycobacterium tuberculosis
ADDRYAFSFSGLKTAVARYVESHAA

SEQ ID NO: 1460537 - protein, 19 aa, Mycobacterium tuberculosis
ADEPIEFALRLSNAIAAEV

SEQ ID NO: 1460538 - protein, 18 aa, Mycobacterium tuberculosis
ADGRGECEFIIRLLPDGV

SEQ ID NO: 1460539 - protein, 35 aa, Mycobacterium tuberculosis; identical to SEQ ID NO: 195991

SEQ ID NO: 1460540 - protein, 19 aa, Mycobacterium tuberculosis
ADGSLRHPPVPAVWQDKSV

SEQ ID NO: 1460541 - protein, 21 aa, Mycobacterium tuberculosis
ADIASAVAFLVSDAASWITGE

SEQ ID NO: 1460542 - protein, 17 aa, Mycobacterium tuberculosis
ADIWPVIDRDPAVRVVL

SEQ ID NO: 1460543 - protein, 20 aa, Mycobacterium tuberculosis
ADMRRMRAAAAKLVETEISD

SEQ ID NO: 1460544 - protein, 29 aa, Mycobacterium tuberculosis
ADPATISAFVVRISCHLRIQNQAADDDVK

SEQ ID NO: 1460545 - protein, 24 aa, Mycobacterium tuberculosis
ADQRTRVFFCNSGAEANEAAFKLS

SEQ ID NO: 1460546 - protein, 17 aa, Mycobacterium tuberculosis
ADTAVDVVIPYDRGDLV

SEQ ID NO: 1460547 - protein, 19 aa, Mycobacterium tuberculosis
ADVAHPVYLLYGVERTEDL

SEQ ID NO: 1460548 - protein, 17 aa, Mycobacterium tuberculosis
ADVMARVIGFHLNRGVL

SEQ ID NO: 1460549 - protein, 23 aa, Mycobacterium tuberculosis
ADVSLPVVRAFIHRIKERARGAE

SEQ ID NO: 1460550 - protein, 20 aa, Mycobacterium tuberculosis
ADVVARFLPYFTDVIVGDLR

SEQ ID NO: 1460551 - protein, 22 aa, Mycobacterium tuberculosis
AEADLFYSDFVERVAEGRKMTT

SEQ ID NO: 1460552 - protein, 19 aa, Mycobacterium tuberculosis
AEAIWEMPPYTGWYQGAQA

SEQ ID NO: 1460553 - protein, 32 aa, Mycobacterium tuberculosis; identical to SEQ ID NO: 196091

SEQ ID NO: 1460554 - protein, 24 aa, Mycobacterium tuberculosis
AEFDRAGADIVLLDLMLPGMSGTD

SEQ ID NO: 1460555 - protein, 25 aa, Mycobacterium tuberculosis
AEFGCKEALFTLGDRPEARWRQARE

SEQ ID NO: 1460556 - protein, 18 aa, Mycobacterium tuberculosis
AEHLLDWLGKQQHLSPEG

SEQ ID NO: 1460557 - protein, 18 aa, Mycobacterium tuberculosis
AEIDAVCELIDFWRFNVA

SEQ ID NO: 1460558 - protein, 18 aa, Mycobacterium tuberculosis
AELLGWRASVHTDELARI

SEQ ID NO: 1460559 - protein, 19 aa, Mycobacterium tuberculosis
AELRHRLESKIVMTRLADE

SEQ ID NO: 1460560 - protein, 17 aa, Mycobacterium tuberculosis
AEMLRRNGIPCDDVRKH

SEQ ID NO: 1460561 - protein, 23 aa, Mycobacterium tuberculosis
AEPVAVVGIGCRFPGDVDGPESF

SEQ ID NO: 1460562 - protein, 25 aa, Mycobacterium tuberculosis
AEQARFAMRMVRRPVHDPARYDQIW

SEQ ID NO: 1460563 - protein, 20 aa, Mycobacterium tuberculosis
AERALALMVNRVRNRVAFGR

SEQ ID NO: 1460564 - protein, 23 aa, Mycobacterium tuberculosis
AERMRHGMYWSGDLAYRDSEGWI

SEQ ID NO: 1460565 - protein, 18 aa, Mycobacterium tuberculosis
AETRRLLTEAPFGSRNPD

SEQ ID NO: 1460566 - protein, 25 aa, Mycobacterium tuberculosis
AFQSVVWGLTVGSWIGSSAGLMVAA

SEQ ID NO: 1460567 - protein, 19 aa, Mycobacterium tuberculosis
AGAITPFALLQLADRGQFF

SEQ ID NO: 1460568 - protein, 24 aa, Mycobacterium tuberculosis
AGATYRLVKRSGFVASSTYADMPL

SEQ ID NO: 1460569 - protein, 18 aa, Mycobacterium tuberculosis
AGETGCRIVLPEGADPFV

SEQ ID NO: 1460570 - protein, 18 aa, Mycobacterium tuberculosis
AGIRRWLDSPSLMVADMF

SEQ ID NO: 1460571 - protein, 18 aa, Mycobacterium tuberculosis
AGKRLAPHALEWDAAKHF

SEQ ID NO: 1460572 - protein, 24 aa, Mycobacterium tuberculosis
AGKRLPVPLFPGFDTLGTLEYITK

SEQ ID NO: 1460573 - protein, 25 aa, Mycobacterium tuberculosis
AGNPEIRPAHLLMALLTQNDGIAAP

SEQ ID NO: 1460574 - protein, 20 aa, Mycobacterium tuberculosis
AGSVPVELNVSAGFDVTELP

SEQ ID NO: 1460575 - protein, 30 aa, Mycobacterium tuberculosis; identical to SEQ ID NO: 196409

SEQ ID NO: 1460576 - protein, 19 aa, Mycobacterium tuberculosis
AGVAQCWHQLVGDTGEIVS

SEQ ID NO: 1460577 - protein, 25 aa, Mycobacterium tuberculosis
AGVLKGEVKDVLLLDVTPLSLGIET

SEQ ID NO: 1460578 - protein, 25 aa, Mycobacterium tuberculosis
AGVLLRYVPLTAKRVTGIVSRGGSI

SEQ ID NO: 1460579 - protein, 17 aa, Mycobacterium tuberculosis
AGVSRVYLAGPEKALGD

SEQ ID NO: 1460580 - protein, 20 aa, Mycobacterium tuberculosis
AGVVCPVHLGIMRGALQTWG

SEQ ID NO: 1460581 - protein, 26 aa, Mycobacterium tuberculosis
AGWPNLAAELQLAFQQLLVGDYNAAV

SEQ ID NO: 1460582 - protein, 23 aa, Mycobacterium tuberculosis
AHTRPDQLVAMPALPTTPIGKID

SEQ ID NO: 1460583 - protein, 25 aa, Mycobacterium tuberculosis
AIARFKRLDGYDVRFLTGTDEHGLK

SEQ ID NO: 1460584 - protein, 17 aa, Mycobacterium tuberculosis
AIEDAWAATRWVAEHGR

SEQ ID NO: 1460585 - protein, 20 aa, Mycobacterium tuberculosis
AIELGRLGGLGVLNGEGLIG

SEQ ID NO: 1460586 - protein, 22 aa, Mycobacterium tuberculosis
AILAGEAHFAIGYTEPEAGTDL

SEQ ID NO: 1460587 - protein, 19 aa, Mycobacterium tuberculosis
AIQVPPNGLPVILGPDHPI

SEQ ID NO: 1460588 - protein, 18 aa, Mycobacterium tuberculosis
AKEALNFIDVQRVNASYR

SEQ ID NO: 1460589 - protein, 18 aa, Mycobacterium tuberculosis
AKLLHAFGECTVPRVTLV

SEQ ID NO: 1460590 - protein, 20 aa, Mycobacterium tuberculosis
AKMLRLAVDEVFQMQSEARA

SEQ ID NO: 1460591 - protein, 20 aa, Mycobacterium tuberculosis
AKQAPGWRVSTSVDENHTHT

SEQ ID NO: 1460592 - protein, 25 aa, Mycobacterium tuberculosis
ALAKLWAQSCEWEPVTPKSLRLLQV

SEQ ID NO: 1460593 - protein, 24 aa, Mycobacterium tuberculosis
ALARRAALRPGDTVLVLGAAGGVG

SEQ ID NO: 1460594 - protein, 26 aa, Mycobacterium tuberculosis
ALARVHPRATGIVLMLGDQPQVAPAT

SEQ ID NO: 1460595 - protein, 22 aa, Mycobacterium tuberculosis
ALCVGMCGQLIYVNRAAEVVAA

SEQ ID NO: 1460596 - protein, 20 aa, Mycobacterium tuberculosis
ALDASLLLVVLTRFLPPDDP

SEQ ID NO: 1460597 - protein, 19 aa, Mycobacterium tuberculosis
ALEDGYRVFTELTPHPLLT

SEQ ID NO: 1460598 - protein, 27 aa, Mycobacterium tuberculosis
ALELDWYEHLGLCPKGEAEALLRSGAT

SEQ ID NO: 1460599 - protein, 25 aa, Mycobacterium tuberculosis
ALINRYATVCGMTGTALAAGEQLRQ

SEQ ID NO: 1460600 - protein, 18 aa, Mycobacterium tuberculosis
ALLDACFQSVGAHPDSQS

SEQ ID NO: 1460601 - protein, 18 aa, Mycobacterium tuberculosis
ALPLLRPQQVIMLGRPTL

SEQ ID NO: 1460602 - protein, 21 aa, Mycobacterium tuberculosis
ALRLGKPLQFHVGFGDRDADL

SEQ ID NO: 1460603 - protein, 32 aa, Mycobacterium tuberculosis; identical to SEQ ID NO: 209090

SEQ ID NO: 1460604 - protein, 27 aa, Mycobacterium tuberculosis
AMIDVIRFWLGLGIDGFRLDAVPYLFE

SEQ ID NO: 1460605 - protein, 20 aa, Mycobacterium tuberculosis
AMLGWPLRTFECTVPPGRLG

SEQ ID NO: 1460606 - protein, 17 aa, Mycobacterium tuberculosis
AMPWQWVGQELPQFSSA

SEQ ID NO: 1460607 - protein, 21 aa, Mycobacterium tuberculosis
AMSAKSDWAALPFDERAAVFL

SEQ ID NO: 1460608 - protein, 18 aa, Mycobacterium tuberculosis
AMVTDRRVLLTLPISHVY

SEQ ID NO: 1460609 - protein, 24 aa, Mycobacterium tuberculosis
ANAVPTAAAYRWRGAARALRRLAN

SEQ ID NO: 1460610 - protein, 28 aa, Mycobacterium tuberculosis
ANDWPSPPTHFVITLGVRGARYVGADGV

SEQ ID NO: 1460611 - protein, 22 aa, Mycobacterium tuberculosis
ANHTTGWVRMDFVVPSRGLIGW

SEQ ID NO: 1460612 - protein, 19 aa, Mycobacterium tuberculosis
ANIGSIMGIGFPPWTGGSA

SEQ ID NO: 1460613 - protein, 32 aa, Mycobacterium tuberculosis; identical to SEQ ID NO: 196736

SEQ ID NO: 1460614 - protein, 21 aa, Mycobacterium tuberculosis
ANNPLRLGGCLNSESAEKAAR

SEQ ID NO: 1460615 - protein, 20 aa, Mycobacterium tuberculosis
ANNSGFWNTAFAGIGNSGLQ

SEQ ID NO: 1460616 - protein, 22 aa, Mycobacterium tuberculosis
ANRGRLRSLVASNLLGQNAPAI

SEQ ID NO: 1460617 - protein, 20 aa, Mycobacterium tuberculosis
ANRLAHWFRQAGLREDDVVA

SEQ ID NO: 1460618 - protein, 21 aa, Mycobacterium tuberculosis
APDLRGRISMASMAAAEMGHY

SEQ ID NO: 1460619 - protein, 17 aa, Mycobacterium tuberculosis
APGHMLGGLPLGQLTNS

SEQ ID NO: 1460620 - protein, 18 aa, Mycobacterium tuberculosis
APGSFSWHVLTALADDVQ

SEQ ID NO: 1460621 - protein, 18 aa, Mycobacterium tuberculosis
APMPAPRAILAAAVEGAQ

SEQ ID NO: 1460622 - protein, 19 aa, Mycobacterium tuberculosis
APNFAYALLAKRLRRQAKP

SEQ ID NO: 1460623 - protein, 18 aa, Mycobacterium tuberculosis
APPDVREFVLGKLNSGEW

SEQ ID NO: 1460624 - protein, 20 aa, Mycobacterium tuberculosis
APPYPPSILLTGIIVNKLGQ

SEQ ID NO: 1460625 - protein, 18 aa, Mycobacterium tuberculosis
AQIAHEFTYGRWDCDLAT

SEQ ID NO: 1460626 - protein, 20 aa, Mycobacterium tuberculosis
AQRPELWNLYNGRHHKGEHI

SEQ ID NO: 1460627 - protein, 17 aa, Mycobacterium tuberculosis
AQVGLGFTAVIEAEVGA

SEQ ID NO: 1460628 - protein, 19 aa, Mycobacterium tuberculosis
ARAFSGVKIACVGESTADR

SEQ ID NO: 1460629 - protein, 21 aa, Mycobacterium tuberculosis
ARDRGATMIFTRTKRTAQKVA

SEQ ID NO: 1460630 - protein, 26 aa, Mycobacterium tuberculosis
ARFVRLCDAFGIPLVVVVDVPGYLPG

SEQ ID NO: 1460631 - protein, 17 aa, Mycobacterium tuberculosis
ARGGIKTNWVISMPPGQ

SEQ ID NO: 1460632 - protein, 17 aa, Mycobacterium tuberculosis
ARIDLGYEQLRVGVEYD

SEQ ID NO: 1460633 - protein, 24 aa, Mycobacterium tuberculosis
ARLGPARTAGICAISPALFTSFTG

SEQ ID NO: 1460634 - protein, 22 aa, Mycobacterium tuberculosis
ARPAETVRGWLRRFAERVEAVR

SEQ ID NO: 1460635 - protein, 27 aa, Mycobacterium tuberculosis
ARQRRFGVSYWTVFDEWAGRASAMRDI

SEQ ID NO: 1460636 - protein, 19 aa, Mycobacterium tuberculosis
ARRGPGRVPDGIDVHLLPF

SEQ ID NO: 1460637 - protein, 21 aa, Mycobacterium tuberculosis
ARRITGWVAALGTGVCASDAI

SEQ ID NO: 1460638 - protein, 33 aa, Mycobacterium tuberculosis; identical to SEQ ID NO: 197006

SEQ ID NO: 1460639 - protein, 18 aa, Mycobacterium tuberculosis
ARSRRWRAGCGVRTDSSL

SEQ ID NO: 1460640 - protein, 21 aa, Mycobacterium tuberculosis
ARTQQLLGWYSRVVTNLDEYY

SEQ ID NO: 1460641 - protein, 25 aa, Mycobacterium tuberculosis
ARVASAAAVLADWMSGPGAAAPLAD

SEQ ID NO: 1460642 - protein, 34 aa, Mycobacterium tuberculosis; identical to SEQ ID NO: 197069

SEQ ID NO: 1460643 - protein, 22 aa, Mycobacterium tuberculosis
ASEIKRKGVLIGDTVVIRKAGD

SEQ ID NO: 1460644 - protein, 18 aa, Mycobacterium tuberculosis
ASHSIASYVGALAFTEQR

SEQ ID NO: 1460645 - protein, 20 aa, Mycobacterium tuberculosis
ASLGGFNFGGATIGHNNVGI

SEQ ID NO: 1460646 - protein, 18 aa, Mycobacterium tuberculosis
ASRLRIAADGIDWPTTGR

SEQ ID NO: 1460647 - protein, 23 aa, Mycobacterium tuberculosis
ASVLKQLVAYVGLERFLAGLRDY

SEQ ID NO: 1460648 - protein, 27 aa, Mycobacterium tuberculosis
ASYAMPDVHWGYGFPIGGVAATDVDND

SEQ ID NO: 1460649 - protein, 23 aa, Mycobacterium tuberculosis
ATALEGSGWTVAAEEAGPVTGMM

SEQ ID NO: 1460650 - protein, 17 aa, Mycobacterium tuberculosis
ATLPRAFIIGPDGSTTV

SEQ ID NO: 1460651 - protein, 17 aa, Mycobacterium tuberculosis
ATLPWLGDHRIHNVAAL

SEQ ID NO: 1460652 - protein, 25 aa, Mycobacterium tuberculosis
ATRLRIPAERWVYPQAGTDAHDTPA

SEQ ID NO: 1460653 - protein, 20 aa, Mycobacterium tuberculosis
ATRRSWAVLGEMAELGEDAI

SEQ ID NO: 1460654 - protein, 23 aa, Mycobacterium tuberculosis
ATSTWPDMKIVNNIEVTGQAPPG

SEQ ID NO: 1460655 - protein, 25 aa, Mycobacterium tuberculosis
ATVPVGILCLEFLVHAWDFAIATGS

SEQ ID NO: 1460656 - protein, 23 aa, Mycobacterium tuberculosis
AVAISALQWRGSQTSDPVETPVE

SEQ ID NO: 1460657 - protein, 24 aa, Mycobacterium tuberculosis
AVAVLRRLAPRARITGGVDRVELA

SEQ ID NO: 1460658 - protein, 22 aa, Mycobacterium tuberculosis
AVGSLRSGECDLALAGGVTVNA

SEQ ID NO: 1460659 - protein, 24 aa, Mycobacterium tuberculosis
AVSIELADGLGLPVLSVASMLARP

SEQ ID NO: 1460660 - protein, 24 aa, Mycobacterium tuberculosis
AVSSPRVLSDLFWMGRYGERAENM

SEQ ID NO: 1460661 - protein, 18 aa, Mycobacterium tuberculosis
AVTEWFAVDWHREIVDKW

SEQ ID NO: 1460662 - protein, 19 aa, Mycobacterium tuberculosis
AWSGSRFAQRPVLPEDIHR

SEQ ID NO: 1460663 - protein, 33 aa, Mycobacterium tuberculosis; identical to SEQ ID NO: 197350

SEQ ID NO: 1460664 - protein, 19 aa, Mycobacterium tuberculosis
AWTTANWEWFDPVHSHRIL

SEQ ID NO: 1460665 - protein, 20 aa, Mycobacterium tuberculosis
AWVGPRRFSGSSGQLAREWV

SEQ ID NO: 1460666 - protein, 18 aa, Mycobacterium tuberculosis
AYGVRPGAVIGHSMGESA

SEQ ID NO: 1460667 - protein, 17 aa, Mycobacterium tuberculosis
AYRSIYVRKRLRCGNRH

SEQ ID NO: 1460668 - protein, 20 aa, Mycobacterium tuberculosis
CAGADLSALGAGVGDPAEPR

SEQ ID NO: 1460669 - protein, 18 aa, Mycobacterium tuberculosis
CDGTSALRYRELVAEVGG

SEQ ID NO: 1460670 - protein, 25 aa, Mycobacterium tuberculosis
CDRPIADVCPVEWARMANRSVLQWD

SEQ ID NO: 1460671 - protein, 21 aa, Mycobacterium tuberculosis
CETRSAWSFNRYAHLHTERHE

SEQ ID NO: 1460672 - protein, 19 aa, Mycobacterium tuberculosis
CFTGAPLTHDLCVHGNPVV

SEQ ID NO: 1460673 - protein, 18 aa, Mycobacterium tuberculosis
CGLIDRIGFRDQAYARMA

SEQ ID NO: 1460674 - protein, 17 aa, Mycobacterium tuberculosis
CGVLPDLTVGHSLGEVA

SEQ ID NO: 1460675 - protein, 24 aa, Mycobacterium tuberculosis
CPTYKRIRILGGHRLGMMMRIAVR

SEQ ID NO: 1460676 - protein, 26 aa, Mycobacterium tuberculosis
CREGHCGACACTLRAGKVNMGVNDVL

SEQ ID NO: 1460677 - protein, 25 aa, Mycobacterium tuberculosis
CSAPGCDVPGYYCEVHHVTPYAQCR

SEQ ID NO: 1460678 - protein, 24 aa, Mycobacterium tuberculosis
CSYLNKLLWILTGNFAKKGGQHLH

SEQ ID NO: 1460679 - protein, 18 aa, Mycobacterium tuberculosis
CVDLRRTFVPSKGFGLLP

SEQ ID NO: 1460680 - protein, 23 aa, Mycobacterium tuberculosis
CVSCPIRRQCLAAALQRAEPWGV

SEQ ID NO: 1460681 - protein, 20 aa, Mycobacterium tuberculosis
CVSHQLPVWTLRLYLTGKRL

SEQ ID NO: 1460682 - protein, 25 aa, Mycobacterium tuberculosis
DAELRRRRWSLCPAKRDNSVSAGQR

SEQ ID NO: 1460683 - protein, 19 aa, Mycobacterium tuberculosis
DAGDCAVLARALVACGCGS

SEQ ID NO: 1460684 - protein, 17 aa, Mycobacterium tuberculosis
DAHILVLCGPIWLGDNS

SEQ ID NO: 1460685 - protein, 17 aa, Mycobacterium tuberculosis
DALDRMREQAARIGRAT

SEQ ID NO: 1460686 - protein, 18 aa, Mycobacterium tuberculosis
DALFARARARGITPAMTL

SEQ ID NO: 1460687 - protein, 25 aa, Mycobacterium tuberculosis
DALINRVVPIPGLRSTEAQWARTLA

SEQ ID NO: 1460688 - protein, 23 aa, Mycobacterium tuberculosis
DAPLCSGPGCPNKLLSTEAKAAG

SEQ ID NO: 1460689 - protein, 17 aa, Mycobacterium tuberculosis
DAPQLAPAVAWVKKRAG

SEQ ID NO: 1460690 - protein, 30 aa, Mycobacterium tuberculosis; identical to SEQ ID NO: 197600

SEQ ID NO: 1460691 - protein, 20 aa, Mycobacterium tuberculosis
DAVLYTRAGPEIGVASTKTF

SEQ ID NO: 1460692 - protein, 27 aa, Mycobacterium tuberculosis
DCRTPTIAAVQGWCIGGAVDLISAVDI

SEQ ID NO: 1460693 - protein, 21 aa, Mycobacterium tuberculosis
DDALMKITHVLRGEDLLPSTP

SEQ ID NO: 1460694 - protein, 26 aa, Mycobacterium tuberculosis
DDGRITLWRDYFDVYDMFKGLLRGLV

SEQ ID NO: 1460695 - protein, 20 aa, Mycobacterium tuberculosis
DDKPWFAIGGINAQRLPAVL

SEQ ID NO: 1460696 - protein, 23 aa, Mycobacterium tuberculosis
DDPDAFAATGGWQSFRVPCLPSD

SEQ ID NO: 1460697 - protein, 19 aa, Mycobacterium tuberculosis
DDVTVRFLLTAGAIGSLFK

SEQ ID NO: 1460698 - protein, 23 aa, Mycobacterium tuberculosis
DDWPGMFLLAAASFTDFIGPESA

SEQ ID NO: 1460699 - protein, 23 aa, Mycobacterium tuberculosis
DEFTYPLKWGWLDVDEVVDVLRA

SEQ ID NO: 1460700 - protein, 26 aa, Mycobacterium tuberculosis
DEHGRWPRSVGLSVWGTSAMRTAGDD

SEQ ID NO: 1460701 - protein, 30 aa, Mycobacterium tuberculosis; identical to SEQ ID NO: 197724

SEQ ID NO: 1460702 - protein, 19 aa, Mycobacterium tuberculosis
DFAAACERARVVFLGPPAR

SEQ ID NO: 1460703 - protein, 17 aa, Mycobacterium tuberculosis
DFACPLPAEISAVPAAL

SEQ ID NO: 1460704 - protein, 24 aa, Mycobacterium tuberculosis
DFMGSCAYAVLAQESVRCRRRGVN

SEQ ID NO: 1460705 - protein, 19 aa, Mycobacterium tuberculosis
DGAPIPVQFSCKGANVAPP

SEQ ID NO: 1460706 - protein, 27 aa, Mycobacterium tuberculosis
DGAWRDPRVWWQLRNPFTPSWGEPYVD

SEQ ID NO: 1460707 - protein, 20 aa, Mycobacterium tuberculosis
DGDNVWPGILGFDDTVIPQV

SEQ ID NO: 1460708 - protein, 26 aa, Mycobacterium tuberculosis
DGIERGRIAILLKVHHALIDGEGGLR

SEQ ID NO: 1460709 - protein, 27 aa, Mycobacterium tuberculosis
DGVLGRLWLARGGTYALANIRGGGEYG

SEQ ID NO: 1460710 - protein, 26 aa, Mycobacterium tuberculosis
DGVVAGIHLEGPWLSPARCGAHDHTR

SEQ ID NO: 1460711 - protein, 30 aa, Mycobacterium tuberculosis; identical to SEQ ID NO: 210668

SEQ ID NO: 1460712 - protein, 18 aa, Mycobacterium tuberculosis
DIEPEWLSSVSTIGVTAG

SEQ ID NO: 1460713 - protein, 20 aa, Mycobacterium tuberculosis
DIGRLRWQFERIARGVPVAA

SEQ ID NO: 1460714 - protein, 23 aa, Mycobacterium tuberculosis
DIPRAGVEYGQLLAVLPLQRMLP

SEQ ID NO: 1460715 - protein, 22 aa, Mycobacterium tuberculosis
DKIARIGIRVADVLDPEQLTHK

SEQ ID NO: 1460716 - protein, 20 aa, Mycobacterium tuberculosis
DLAAIAGFCAQAAVRRTPLL

SEQ ID NO: 1460717 - protein, 26 aa, Mycobacterium tuberculosis
DLNQLWMCGLPGYSPGDLIDFEFCGD

SEQ ID NO: 1460718 - protein, 23 aa, Mycobacterium tuberculosis
DLTDYLLEMGIRVRYLHSEVDTL

SEQ ID NO: 1460719 - protein, 20 aa, Mycobacterium tuberculosis
DLTRRIALRQTVDMVRVTME

SEQ ID NO: 1460720 - protein, 19 aa, Mycobacterium tuberculosis
DLVLALRWVHDNIAEFGGD

SEQ ID NO: 1460721 - protein, 24 aa, Mycobacterium tuberculosis
DMILGLRMITPVGVLDLGRVPASA

SEQ ID NO: 1460722 - protein, 21 aa, Mycobacterium tuberculosis
DMMAAFADQAALAWRLATAQR

SEQ ID NO: 1460723 - protein, 17 aa, Mycobacterium tuberculosis
DPADRLIYATAIEHGWR

SEQ ID NO: 1460724 - protein, 18 aa, Mycobacterium tuberculosis
DPATGVTVGPIFSSGSII

SEQ ID NO: 1460725 - protein, 26 aa, Mycobacterium tuberculosis
DPDAVGGLYVHWIVTGIAPGSGSTAD

SEQ ID NO: 1460726 - protein, 27 aa, Mycobacterium tuberculosis
DPDTCIECPQGSVGEIWVQGGNVASGY

SEQ ID NO: 1460727 - protein, 20 aa, Mycobacterium tuberculosis
DPMVREWLTVLLRRDLGLLV

SEQ ID NO: 1460728 - protein, 24 aa, Mycobacterium tuberculosis
DPQQRLLLETSWEAIEHAGLDPAS

SEQ ID NO: 1460729 - protein, 18 aa, Mycobacterium tuberculosis
DPRRAHVSLSKHPYQIGV

SEQ ID NO: 1460730 - protein, 17 aa, Mycobacterium tuberculosis
DPSYHGVVFAELGPPAF

SEQ ID NO: 1460731 - protein, 19 aa, Mycobacterium tuberculosis
DQRVVDWLVDKFKGTSGID

SEQ ID NO: 1460732 - protein, 24 aa, Mycobacterium tuberculosis
DRAARYGDRVFLKFGDQQLTYRDA

SEQ ID NO: 1460733 - protein, 22 aa, Mycobacterium tuberculosis
DRDGVLTSFDWTRAEEDVRRIT

SEQ ID NO: 1460734 - protein, 23 aa, Mycobacterium tuberculosis
DRDGVRIPMQWTPDRNAGFSTAN

SEQ ID NO: 1460735 - protein, 18 aa, Mycobacterium tuberculosis
DRELWRKLIDAGILSSAA

SEQ ID NO: 1460736 - protein, 17 aa, Mycobacterium tuberculosis
DRHPGWHALRKIAARIT

SEQ ID NO: 1460737 - protein, 21 aa, Mycobacterium tuberculosis
DRLQYFVSCLVYMPRDRYTTA

SEQ ID NO: 1460738 - protein, 18 aa, Mycobacterium tuberculosis
DRLSGRRLTLGVASDGPR

SEQ ID NO: 1460739 - protein, 24 aa, Mycobacterium tuberculosis
DRMIGIDATHAWASVWTPQQPGRF

SEQ ID NO: 1460740 - protein, 20 aa, Mycobacterium tuberculosis
DRRVLEFGGRLYTAKDSRTT

SEQ ID NO: 1460741 - protein, 17 aa, Mycobacterium tuberculosis
DRYEVHHGVRITDSALV

SEQ ID NO: 1460742 - protein, 25 aa, Mycobacterium tuberculosis
DSIEHARTWPGHMGAAMANAYSANP

SEQ ID NO: 1460743 - protein, 23 aa, Mycobacterium tuberculosis
DSMRAGLQALAWIAHQPEATRRS

SEQ ID NO: 1460744 - protein, 22 aa, Mycobacterium tuberculosis
DSPARGGRHLGFAKALVYEMPH

SEQ ID NO: 1460745 - protein, 23 aa, Mycobacterium tuberculosis
DSVSCPRSGEVIVRKAPSQEDHW

SEQ ID NO: 1460746 - protein, 17 aa, Mycobacterium tuberculosis
DTCETRSAWSFNRYAHL

SEQ ID NO: 1460747 - protein, 36 aa, Mycobacterium tuberculosis; identical to SEQ ID NO: 79016

SEQ ID NO: 1460748 - protein, 24 aa, Mycobacterium tuberculosis
DTPTLFTGVEWLEAARAAGIDAVE

SEQ ID NO: 1460749 - protein, 26 aa, Mycobacterium tuberculosis
DVDPGKRVVFTWGWEDHGDPPPGGST

SEQ ID NO: 1460750 - protein, 20 aa, Mycobacterium tuberculosis
DVLLGLGWLAPSHVDQWRQG

SEQ ID NO: 1460751 - protein, 22 aa, Mycobacterium tuberculosis
DVNGIVFNRAFTGAVQTIYDAS

SEQ ID NO: 1460752 - protein, 25 aa, Mycobacterium tuberculosis
DVQRYEVVDLLSLLADKSLVVTDDS

SEQ ID NO: 1460753 - protein, 18 aa, Mycobacterium tuberculosis
DVSDFGHRLLAYLRAADA

SEQ ID NO: 1460754 - protein, 23 aa, Mycobacterium tuberculosis
DWAAKGTLLLGVRAVIAESFERI

SEQ ID NO: 1460755 - protein, 23 aa, Mycobacterium tuberculosis
DYWYRNVRQTVLFDQAVRNACEQ

SEQ ID NO: 1460756 - protein, 23 aa, Mycobacterium tuberculosis
EAAKGVAMPLRLTSPAPCTNCHG

SEQ ID NO: 1460757 - protein, 19 aa, Mycobacterium tuberculosis
EAEGLRYRSVLGLADLGLD

SEQ ID NO: 1460758 - protein, 22 aa, Mycobacterium tuberculosis
EAGPRDKNRFIGVPAAFSKLFR

SEQ ID NO: 1460759 - protein, 19 aa, Mycobacterium tuberculosis
EAGQLARLVGPSGHPVFRH

SEQ ID NO: 1460760 - protein, 26 aa, Mycobacterium tuberculosis
EALYAEMWAQDALAMYGYAAASGAAG

SEQ ID NO: 1460761 - protein, 18 aa, Mycobacterium tuberculosis
EAVDEFKKIIGVIQASGH

SEQ ID NO: 1460762 - protein, 19 aa, Mycobacterium tuberculosis
EDVRFSGGLATAIADGDSV

SEQ ID NO: 1460763 - protein, 21 aa, Mycobacterium tuberculosis
EDWMTRLLLGFGSDVRVLAPE

SEQ ID NO: 1460764 - protein, 18 aa, Mycobacterium tuberculosis
EFAEDWVNLVALAVNEEN

SEQ ID NO: 1460765 - protein, 23 aa, Mycobacterium tuberculosis
EFTRTGFTGGLNWYRNFDRNWET

SEQ ID NO: 1460766 - protein, 22 aa, Mycobacterium tuberculosis
EGEVRQGVLALSAWSESDTPEL

SEQ ID NO: 1460767 - protein, 22 aa, Mycobacterium tuberculosis
EGGPRPTHFAGVLTVVLKLLQI

SEQ ID NO: 1460768 - protein, 18 aa, Mycobacterium tuberculosis
EGLAAVLRGAADQARAAV

SEQ ID NO: 1460769 - protein, 23 aa, Mycobacterium tuberculosis
EGTEFRPGVNVGVDISAEKLRAD

SEQ ID NO: 1460770 - protein, 26 aa, Mycobacterium tuberculosis
EGVEGLRMTWGRAVILEAMRRYLQQR

SEQ ID NO: 1460771 - protein, 27 aa, Mycobacterium tuberculosis
EGVSRAELIRLLLNRALTTAGDDLASD

SEQ ID NO: 1460772 - protein, 30 aa, Mycobacterium tuberculosis; identical to SEQ ID NO: 198549

SEQ ID NO: 1460773 - protein, 18 aa, Mycobacterium tuberculosis
EKGPRLGVLGVVVEIDGR

SEQ ID NO: 1460774 - protein, 29 aa, Mycobacterium tuberculosis
EKHDLAFGTSRWSSKLVHGGLRYLASGNV

SEQ ID NO: 1460775 - protein, 17 aa, Mycobacterium tuberculosis
EKPRIPDVCDALGVPWL

SEQ ID NO: 1460776 - protein, 21 aa, Mycobacterium tuberculosis
EKPSLPAHIGMTLRSRGFTDQ

SEQ ID NO: 1460777 - protein, 17 aa, Mycobacterium tuberculosis
ELAKALADFLFDDERAM

SEQ ID NO: 1460778 - protein, 23 aa, Mycobacterium tuberculosis
ELAPRPTTPFAQALRLALIDAAP

SEQ ID NO: 1460779 - protein, 26 aa, Mycobacterium tuberculosis
ELIDFWRFNVAFARQILEQQPISGPG

SEQ ID NO: 1460780 - protein, 25 aa, Mycobacterium tuberculosis
ELKLDRKIAERRVFPAVDVNPSGTR

SEQ ID NO: 1460781 - protein, 21 aa, Mycobacterium tuberculosis
ELLEFPGGILGVALNLDEHSV

SEQ ID NO: 1460782 - protein, 20 aa, Mycobacterium tuberculosis
ELLGGIPLAGFFAAGEIGPI

SEQ ID NO: 1460783 - protein, 18 aa, Mycobacterium tuberculosis
ELNRLFTAWVETVYHRSV

SEQ ID NO: 1460784 - protein, 24 aa, Mycobacterium tuberculosis
ELQHLDIGNALALGNVGGVNLGLA

SEQ ID NO: 1460785 - protein, 21 aa, Mycobacterium tuberculosis
ELQTRMFACFAAGALAAGCEY

SEQ ID NO: 1460786 - protein, 21 aa, Mycobacterium tuberculosis
ELSASPGFRRANLPPLNVPLA

SEQ ID NO: 1460787 - protein, 19 aa, Mycobacterium tuberculosis
EMAFKIAGSQVLKKAAALA

SEQ ID NO: 1460788 - protein, 18 aa, Mycobacterium tuberculosis
EMDPSGAGKWLLISDCAA

SEQ ID NO: 1460789 - protein, 18 aa, Mycobacterium tuberculosis
ENLRRWSGMHRRDGMAGW

SEQ ID NO: 1460790 - protein, 17 aa, Mycobacterium tuberculosis
ENMPTGGTLLRWSAPLR

SEQ ID NO: 1460791 - protein, 30 aa, Mycobacterium tuberculosis; identical to SEQ ID NO: 198675

SEQ ID NO: 1460792 - protein, 23 aa, Mycobacterium tuberculosis
EQIDPRWAKLVEMLGPESDTLRG

SEQ ID NO: 1460793 - protein, 24 aa, Mycobacterium tuberculosis
EQIIAVDGAHLWHPYSSIGREAVS

SEQ ID NO: 1460794 - protein, 21 aa, Mycobacterium tuberculosis
ERIGWERSIRVLSARVAELRP

SEQ ID NO: 1460795 - protein, 32 aa, Mycobacterium tuberculosis; identical to SEQ ID NO: 198754

SEQ ID NO: 1460796 - protein, 18 aa, Mycobacterium tuberculosis
ERLVARIAALPVNQLIMV

SEQ ID NO: 1460797 - protein, 24 aa, Mycobacterium tuberculosis
ERPGRGAVVGVDWRTPLTDAAARV

SEQ ID NO: 1460798 - protein, 21 aa, Mycobacterium tuberculosis
ERYARCLGSAVNPVLRQGNSD

SEQ ID NO: 1460799 - protein, 22 aa, Mycobacterium tuberculosis
ESLDGWPVNFALLGKGNTVNPD

SEQ ID NO: 1460800 - protein, 23 aa, Mycobacterium tuberculosis
ESLHRLRGLGRRTVLPGHGPDLL

SEQ ID NO: 1460801 - protein, 21 aa, Mycobacterium tuberculosis
ESPVALPVPAYMPFFDVLHVT

SEQ ID NO: 1460802 - protein, 24 aa, Mycobacterium tuberculosis
ESRKAIHFQEWWVRYRAQVPTHSF

SEQ ID NO: 1460803 - protein, 24 aa, Mycobacterium tuberculosis
ESVCSGLADRWWQGPSSRMMAAQA

SEQ ID NO: 1460804 - protein, 22 aa, Mycobacterium tuberculosis
EVAAGIAGLIKTILCLKNKALP

SEQ ID NO: 1460805 - protein, 18 aa, Mycobacterium tuberculosis
EVAALGVNIDFIRGISDY

SEQ ID NO: 1460806 - protein, 29 aa, Mycobacterium tuberculosis
EVARAQVCAAWHIAELPAAAGRDADGILA

SEQ ID NO: 1460807 - protein, 22 aa, Mycobacterium tuberculosis
EVEINIACSLGMLTAEQVDQLA

SEQ ID NO: 1460808 - protein, 25 aa, Mycobacterium tuberculosis
EVIGDRFGVCGYCMGGRMSVVVAGR

SEQ ID NO: 1460809 - protein, 20 aa, Mycobacterium tuberculosis
EVLAQREFCAPFELSRDAPL

SEQ ID NO: 1460810 - protein, 22 aa, Mycobacterium tuberculosis
EVLRILRRRSLAALRAQAEPVS

SEQ ID NO: 1460811 - protein, 23 aa, Mycobacterium tuberculosis
EVSALTAAHFAAHAAMYQSVSAR

SEQ ID NO: 1460812 - protein, 21 aa, Mycobacterium tuberculosis
EVTGVPILFASTGEKLEDFDV

SEQ ID NO: 1460813 - protein, 23 aa, Mycobacterium tuberculosis
EWPDRLRRLLSKQVGLILRRTID

SEQ ID NO: 1460814 - protein, 23 aa, Mycobacterium tuberculosis
EYEIKDVWYVVGLRGTGSNTLVV

SEQ ID NO: 1460815 - protein, 18 aa, Mycobacterium tuberculosis
FADLAEVMAGVFAARRSS

SEQ ID NO: 1460816 - protein, 24 aa, Mycobacterium tuberculosis
FADRKPVCYRMHPDNVPALTALRP

SEQ ID NO: 1460817 - protein, 26 aa, Mycobacterium tuberculosis
FADTHARVGLLPTWGLSVRLPQKVGI

SEQ ID NO: 1460818 - protein, 17 aa, Mycobacterium tuberculosis
FADVPWRGNRINRIRYF

SEQ ID NO: 1460819 - protein, 21 aa, Mycobacterium tuberculosis
FAKLLFTNPVKAFQFLVDLIL

SEQ ID NO: 1460820 - protein, 21 aa, Mycobacterium tuberculosis
FALPVCRRPGAKTVTALGGGY

SEQ ID NO: 1460821 - protein, 25 aa, Mycobacterium tuberculosis
FAPRFHPSYRHAAAVRREIGVPTVF

SEQ ID NO: 1460822 - protein, 17 aa, Mycobacterium tuberculosis
FARHGFTEIEGTPVTAE

SEQ ID NO: 1460823 - protein, 25 aa, Mycobacterium tuberculosis
FATHPFGPVAVAGFVVYRLDDGPAV

SEQ ID NO: 1460824 - protein, 19 aa, Mycobacterium tuberculosis
FAVATWNGLVWINLDADAE

SEQ ID NO: 1460825 - protein, 23 aa, Mycobacterium tuberculosis
FDEVFARMWELYLAYSEAGFRSG

SEQ ID NO: 1460826 - protein, 19 aa, Mycobacterium tuberculosis
FDFVREIIEQGAIPDDVTI

SEQ ID NO: 1460827 - protein, 26 aa, Mycobacterium tuberculosis
FDPSKPCAWLAEGLVRYLPARAQDLL

SEQ ID NO: 1460828 - protein, 23 aa, Mycobacterium tuberculosis
FDQGENFAFLGGRDWDPSQSTLP

SEQ ID NO: 1460829 - protein, 18 aa, Mycobacterium tuberculosis
FDRLRNLAAIKDVAARPT

SEQ ID NO: 1460830 - protein, 17 aa, Mycobacterium tuberculosis
FENAIAVVMAFGGSTNA

SEQ ID NO: 1460831 - protein, 19 aa, Mycobacterium tuberculosis
FGCRMGICQSCVVDLVEGH

SEQ ID NO: 1460832 - protein, 19 aa, Mycobacterium tuberculosis
FGLHQALRLGKPLQFHVGF

SEQ ID NO: 1460833 - protein, 17 aa, Mycobacterium tuberculosis
FGNRIARTATYIKGDPH

SEQ ID NO: 1460834 - protein, 22 aa, Mycobacterium tuberculosis
FGRLQRHVAMIVVAQFAATLTD

SEQ ID NO: 1460835 - protein, 25 aa, Mycobacterium tuberculosis
FGSAAYWRRHIRQAVRFADSVRFAQ

SEQ ID NO: 1460836 - protein, 25 aa, Mycobacterium tuberculosis
FGSPESRKWLCDMFADARMLAHDTG

SEQ ID NO: 1460837 - protein, 28 aa, Mycobacterium tuberculosis
FGVYLHVPFCLTRCGYCDFNTYTPAQLG

SEQ ID NO: 1460838 - protein, 18 aa, Mycobacterium tuberculosis
FIDACHARRLGVLIDAVF

SEQ ID NO: 1460839 - protein, 24 aa, Mycobacterium tuberculosis
FIMPTTCPECGSPLAPEKEGDADI

SEQ ID NO: 1460840 - protein, 21 aa, Mycobacterium tuberculosis
FKMAAELAYLEFGDLIDAMVT

SEQ ID NO: 1460841 - protein, 18 aa, Mycobacterium tuberculosis
FLGLRPPPPQRYPLSEAQ

SEQ ID NO: 1460842 - protein, 25 aa, Mycobacterium tuberculosis
FLGRYCTGYERFERYLLGLDDGIPK

SEQ ID NO: 1460843 - protein, 24 aa, Mycobacterium tuberculosis
FLKSKLRTGGLLLNHCITRHDNRS

SEQ ID NO: 1460844 - protein, 18 aa, Mycobacterium tuberculosis
FLLQRPLLTAIRRTEPTV

SEQ ID NO: 1460845 - protein, 26 aa, Mycobacterium tuberculosis
FLPMEELIAAFLPVLFPGMEIVEHHA

SEQ ID NO: 1460846 - protein, 29 aa, Mycobacterium tuberculosis
FMEVAKLRAGRLLWSELVAQFAPKSAKSL

SEQ ID NO: 1460847 - protein, 19 aa, Mycobacterium tuberculosis
FPDPWPKARHHKRRLLQPA

SEQ ID NO: 1460848 - protein, 17 aa, Mycobacterium tuberculosis
FPITPLFPLAGPVGLVP

SEQ ID NO: 1460849 - protein, 17 aa, Mycobacterium tuberculosis
FPKQIWRQIWSNNPQER

SEQ ID NO: 1460850 - protein, 17 aa, Mycobacterium tuberculosis
FPLMPRIFMAVRRESRF

SEQ ID NO: 1460851 - protein, 20 aa, Mycobacterium tuberculosis
FPPAGTLSGIAKRELRGVPA

SEQ ID NO: 1460852 - protein, 17 aa, Mycobacterium tuberculosis
FPQIGGFANTPPAFINT

SEQ ID NO: 1460853 - protein, 23 aa, Mycobacterium tuberculosis
FQPQLRVLVDLGYADYGPGGNYA

SEQ ID NO: 1460854 - protein, 17 aa, Mycobacterium tuberculosis
FQRTRSGYDPVAVNHYI

SEQ ID NO: 1460855 - protein, 19 aa, Mycobacterium tuberculosis
FRGALAVDAHMRRHKTTKA

SEQ ID NO: 1460856 - protein, 19 aa, Mycobacterium tuberculosis
FRKHPRARAGWDRATGRIP

SEQ ID NO: 1460857 - protein, 17 aa, Mycobacterium tuberculosis
FRLIAEEALTLMAGAAT

SEQ ID NO: 1460858 - protein, 25 aa, Mycobacterium tuberculosis
FRLLPPRTMRALLARICEQEGVVVD

SEQ ID NO: 1460859 - protein, 19 aa, Mycobacterium tuberculosis
FRNARELREAVPLMPVEQL

SEQ ID NO: 1460860 - protein, 20 aa, Mycobacterium tuberculosis
FSDFPDRPDNLLAVANAAIG

SEQ ID NO: 1460861 - protein, 25 aa, Mycobacterium tuberculosis
FSRQRLRDLGLWGLTNFDRVDFVYT

SEQ ID NO: 1460862 - protein, 17 aa, Mycobacterium tuberculosis
FTANPWLSGYMSQALNL

SEQ ID NO: 1460863 - protein, 17 aa, Mycobacterium tuberculosis
FTTVWNAVVSELNGDPK

SEQ ID NO: 1460864 - protein, 24 aa, Mycobacterium tuberculosis
FVGELRAGLRAADCALFVIAANEG

SEQ ID NO: 1460865 - protein, 19 aa, Mycobacterium tuberculosis
FVKIFCRRSTGVVIGGVVV

SEQ ID NO: 1460866 - protein, 26 aa, Mycobacterium tuberculosis
FVLPNAWDVPSALAYLAEGFTAIGTT

SEQ ID NO: 1460867 - protein, 25 aa, Mycobacterium tuberculosis
FVPAFSGLFAPYWRSDARGAIVGLS

SEQ ID NO: 1460868 - protein, 27 aa, Mycobacterium tuberculosis
FVRTSGYLPGPHDVYVSMNMVRKNGMR

SEQ ID NO: 1460869 - protein, 26 aa, Mycobacterium tuberculosis
FVSGEGCVMLALKRLPDALADGDRIL

SEQ ID NO: 1460870 - protein, 18 aa, Mycobacterium tuberculosis
FVTDGKMFIIGRIKDLLI

SEQ ID NO: 1460871 - protein, 17 aa, Mycobacterium tuberculosis
FVVYPSDHELIAHTLWI

SEQ ID NO: 1460872 - protein, 23 aa, Mycobacterium tuberculosis
GAAPRARVPAVRESIYSSIDDLQ

SEQ ID NO: 1460873 - protein, 21 aa, Mycobacterium tuberculosis
GACLNREMSRFIDALRSSINF

SEQ ID NO: 1460874 - protein, 19 aa, Mycobacterium tuberculosis
GADPARFDGSIGVYGTSSP

SEQ ID NO: 1460875 - protein, 30 aa, Mycobacterium tuberculosis
GADRLGCGCGRADCAAGKRPAAPPVVIHLI

SEQ ID NO: 1460876 - protein, 27 aa, Mycobacterium tuberculosis
GAIPPDGPWGIWASRRIIAGLMGTFGP

SEQ ID NO: 1460877 - protein, 22 aa, Mycobacterium tuberculosis
GALARIRLPGGMITAAQLATLA

SEQ ID NO: 1460878 - protein, 17 aa, Mycobacterium tuberculosis
GALEGLDNLTFVINCNL

SEQ ID NO: 1460879 - protein, 21 aa, Mycobacterium tuberculosis
GALTGGMCWEALNNIAASRRP

SEQ ID NO: 1460880 - protein, 18 aa, Mycobacterium tuberculosis
GAMVCPFPPHTTTIRSAK

SEQ ID NO: 1460881 - protein, 17 aa, Mycobacterium tuberculosis
GAPQGMRIVNQRQFDRL

SEQ ID NO: 1460882 - protein, 19 aa, Mycobacterium tuberculosis
GARGRRLDVRQARTAVHQT

SEQ ID NO: 1460883 - protein, 30 aa, Mycobacterium tuberculosis; identical to SEQ ID NO: 199558

SEQ ID NO: 1460884 - protein, 25 aa, Mycobacterium tuberculosis
GAVGLCALRSAFIHGAATVFAVDRV

SEQ ID NO: 1460885 - protein, 18 aa, Mycobacterium tuberculosis
GAVSRAHRGVLFLDECAE

SEQ ID NO: 1460886 - protein, 30 aa, Mycobacterium tuberculosis; identical to SEQ ID NO: 209387

SEQ ID NO: 1460887 - protein, 26 aa, Mycobacterium tuberculosis
GCVNQTRILAPRSRYDEIVAAVTNFV

SEQ ID NO: 1460888 - protein, 25 aa, Mycobacterium tuberculosis
GDDIAEVLALLGVRPVWDDASRRVI

SEQ ID NO: 1460889 - protein, 17 aa, Mycobacterium tuberculosis
GDIDGLERVRFTSPHPA

SEQ ID NO: 1460890 - protein, 23 aa, Mycobacterium tuberculosis
GDQRVSLSAGQSWSVTATGPTEV

SEQ ID NO: 1460891 - protein, 19 aa, Mycobacterium tuberculosis
GDTAAMRPFLLVASFVNPH

SEQ ID NO: 1460892 - protein, 26 aa, Mycobacterium tuberculosis
GDTDLAWSRITYWRALLTSAVDQPPH

SEQ ID NO: 1460893 - protein, 19 aa, Mycobacterium tuberculosis
GDVAYGWAMEDTSGIVKLI

SEQ ID NO: 1460894 - protein, 18 aa, Mycobacterium tuberculosis
GEGAVGRWWARQPELTAA

SEQ ID NO: 1460895 - protein, 21 aa, Mycobacterium tuberculosis
GEGTLTAASWLSEENVPVVGV

SEQ ID NO: 1460896 - protein, 23 aa, Mycobacterium tuberculosis
GEHRKSLTFALRFRAPDRTLTED

SEQ ID NO: 1460897 - protein, 17 aa, Mycobacterium tuberculosis
GELFASFDVDAFEVPHG

SEQ ID NO: 1460898 - protein, 19 aa, Mycobacterium tuberculosis
GELRRFQHYLGEPLGGFTG

SEQ ID NO: 1460899 - protein, 20 aa, Mycobacterium tuberculosis
GEMWAQDAAAMFGYAATAAT

SEQ ID NO: 1460900 - protein, 17 aa, Mycobacterium tuberculosis
GEPFCVREDARILYHAA

SEQ ID NO: 1460901 - protein, 23 aa, Mycobacterium tuberculosis
GESFGARRRLALSTVGASGATAG

SEQ ID NO: 1460902 - protein, 22 aa, Mycobacterium tuberculosis
GFPNCNGRIPADTALLPEVLAE

SEQ ID NO: 1460903 - protein, 20 aa, Mycobacterium tuberculosis
GFRFDLASTLARELHDVDRL

SEQ ID NO: 1460904 - protein, 19 aa, Mycobacterium tuberculosis
GGDAWVRAMMLVDAGVDVL

SEQ ID NO: 1460905 - protein, 23 aa, Mycobacterium tuberculosis
GGESARSRVCFTMAEVRETVAEL

SEQ ID NO: 1460906 - protein, 19 aa, Mycobacterium tuberculosis
GGESSRPGATRVDPAVETS

SEQ ID NO: 1460907 - protein, 19 aa, Mycobacterium tuberculosis
GGGSSGVWNSGLSSAIGNS

SEQ ID NO: 1460908 - protein, 20 aa, Mycobacterium tuberculosis
GGGTMTHAWLLTGPPGSGRS

SEQ ID NO: 1460909 - protein, 18 aa, Mycobacterium tuberculosis
GGKARPDIGPLFYEPTVL

SEQ ID NO: 1460910 - protein, 19 aa, Mycobacterium tuberculosis
GGLGHRSKHRGPRHLTDSR

SEQ ID NO: 1460911 - protein, 18 aa, Mycobacterium tuberculosis
GGMGLRLKGSDTLYSCLP

SEQ ID NO: 1460912 - protein, 24 aa, Mycobacterium tuberculosis
GGTDLRWSGSFTEKVRGTGPVMRA

SEQ ID NO: 1460913 - protein, 18 aa, Mycobacterium tuberculosis
GGVYLDIPGDVLGQAVEA

SEQ ID NO: 1460914 - protein, 25 aa, Mycobacterium tuberculosis
GGYHVLRAAWPHFREQSYGRVVVAT

SEQ ID NO: 1460915 - protein, 18 aa, Mycobacterium tuberculosis
GHALLLGARGRRLDVRQA

SEQ ID NO: 1460916 - protein, 22 aa, Mycobacterium tuberculosis
GHPESLVNWDALAALTGTIVLL

SEQ ID NO: 1460917 - protein, 19 aa, Mycobacterium tuberculosis
GHPLFAHITLLRSERSPIA

SEQ ID NO: 1460918 - protein, 18 aa, Mycobacterium tuberculosis
GIPSYACPTYKRIRILGG

SEQ ID NO: 1460919 - protein, 18 aa, Mycobacterium tuberculosis
GIRLKLNPLKEVIRGKRL

SEQ ID NO: 1460920 - protein, 24 aa, Mycobacterium tuberculosis
GIRVDGNDVLACYAVMAEAAARAR

SEQ ID NO: 1460921 - protein, 23 aa, Mycobacterium tuberculosis
GITLEQINFGFTIDIAGIPLLAG

SEQ ID NO: 1460922 - protein, 21 aa, Mycobacterium tuberculosis
GIYQCRACGAELFRSTEKFES

SEQ ID NO: 1460923 - protein, 17 aa, Mycobacterium tuberculosis
GKTAFVFAGQGSQWLGM

SEQ ID NO: 1460924 - protein, 27 aa, Mycobacterium tuberculosis
GKVLPAMLKRQLQLLLPLVEDRFVESV

SEQ ID NO: 1460925 - protein, 22 aa, Mycobacterium tuberculosis
GLIKTILCLKNKALPATLHYTS

SEQ ID NO: 1460926 - protein, 23 aa, Mycobacterium tuberculosis
GLLDRLSKQPGIHAVHVSNGDKP

SEQ ID NO: 1460927 - protein, 24 aa, Mycobacterium tuberculosis
GLLSRRLRIPAALAGVGAGLAIAD

SEQ ID NO: 1460928 - protein, 20 aa, Mycobacterium tuberculosis
GLPRRLRWVSPLVPLVAGPL

SEQ ID NO: 1460929 - protein, 24 aa, Mycobacterium tuberculosis
GLRTRLFAAPGWLVSPGVRTALPA

SEQ ID NO: 1460930 - protein, 25 aa, Mycobacterium tuberculosis
GMALAFRAGAPLKDMEFVQYHPTGL

SEQ ID NO: 1460931 - protein, 24 aa, Mycobacterium tuberculosis
GMATGDLLGCFGLTEPDVGSDPAA

SEQ ID NO: 1460932 - protein, 24 aa, Mycobacterium tuberculosis
GMGGSIPFIAEFAAAFPQATILVT

SEQ ID NO: 1460933 - protein, 23 aa, Mycobacterium tuberculosis
GMQRVFFGWAQIWRTKSRAAEAI

SEQ ID NO: 1460934 - protein, 17 aa, Mycobacterium tuberculosis
GNFDWTQGRFPGFTTPD

SEQ ID NO: 1460935 - protein, 24 aa, Mycobacterium tuberculosis
GNGGNGAQGGWLIGNGGQGGDSGA

SEQ ID NO: 1460936 - protein, 29 aa, Mycobacterium tuberculosis
GNPNRPDGGILTRFGFSIPQLGFTLSGAT

SEQ ID NO: 1460937 - protein, 37 aa, Mycobacterium tuberculosis; identical to SEQ ID NO: 200164

SEQ ID NO: 1460938 - protein, 17 aa, Mycobacterium tuberculosis
GPDRVALLSLLRSTPLT

SEQ ID NO: 1460939 - protein, 18 aa, Mycobacterium tuberculosis
GPLPPRWVTVHPNNPERA

SEQ ID NO: 1460940 - protein, 25 aa, Mycobacterium tuberculosis
GPQGKRLGKTTGWVHRASLKAKGVH

SEQ ID NO: 1460941 - protein, 23 aa, Mycobacterium tuberculosis
GPRGCGKTSSARILARSLNCAQG

SEQ ID NO: 1460942 - protein, 19 aa, Mycobacterium tuberculosis
GQAVGGAFVRLLDSSDEFT

SEQ ID NO: 1460943 - protein, 23 aa, Mycobacterium tuberculosis
GQEDRPGAPFGEYAEGWLKQRGI

SEQ ID NO: 1460944 - protein, 25 aa, Mycobacterium tuberculosis
GQGLMKNAYVGRTFIQPSQTIRQLG

SEQ ID NO: 1460945 - protein, 19 aa, Mycobacterium tuberculosis
GQTQFAAPVWMPRAKRTSI

SEQ ID NO: 1460946 - protein, 24 aa, Mycobacterium tuberculosis
GRAKIVKFSGCYHGHVDALLADAG

SEQ ID NO: 1460947 - protein, 19 aa, Mycobacterium tuberculosis
GREHIKEIQAFFKELSAAV

SEQ ID NO: 1460948 - protein, 20 aa, Mycobacterium tuberculosis
GRGEGFCAGFDLSAYAEGSS

SEQ ID NO: 1460949 - protein, 17 aa, Mycobacterium tuberculosis
GRGGPRCMSCPAARDPL

SEQ ID NO: 1460950 - protein, 24 aa, Mycobacterium tuberculosis
GRGVTVGRPLGLLLTRRSENATVT

SEQ ID NO: 1460951 - protein, 17 aa, Mycobacterium tuberculosis
GRLTFGIVYTYARPNWW

SEQ ID NO: 1460952 - protein, 19 aa, Mycobacterium tuberculosis
GRNPFWDRLSRAMYRLARP

SEQ ID NO: 1460953 - protein, 25 aa, Mycobacterium tuberculosis
GRRDLFRPAVFRSLWGRVEDAISAG

SEQ ID NO: 1460954 - protein, 23 aa, Mycobacterium tuberculosis
GRRLSGTVTPVFGGRTVSVTYSK

SEQ ID NO: 1460955 - protein, 24 aa, Mycobacterium tuberculosis
GRRRVAMLRDWLDAELAEPSVTVL

SEQ ID NO: 1460956 - protein, 22 aa, Mycobacterium tuberculosis
GRYADAWIPIVVVRPSDYSRAL

SEQ ID NO: 1460957 - protein, 18 aa, Mycobacterium tuberculosis
GSAMQAVWIVAQQHGLAV

SEQ ID NO: 1460958 - protein, 22 aa, Mycobacterium tuberculosis
GSAPMLAAAAAWDDLASELHCA

SEQ ID NO: 1460959 - protein, 25 aa, Mycobacterium tuberculosis
GSGGDGGNGGWLFGSGASGGNGGQG

SEQ ID NO: 1460960 - protein, 26 aa, Mycobacterium tuberculosis
GSGGNGGAGGWIYGHGGHGGAGGNGG

SEQ ID NO: 1460961 - protein, 24 aa, Mycobacterium tuberculosis
GSGPLRPAAAQVFAAVQAAAIPVV

SEQ ID NO: 1460962 - protein, 29 aa, Mycobacterium tuberculosis
GSILADKALRLAIAKGIDRYTIARVAQYG

SEQ ID NO: 1460963 - protein, 18 aa, Mycobacterium tuberculosis
GSILRYTTFTPKHMGVMF

SEQ ID NO: 1460964 - protein, 29 aa, Mycobacterium tuberculosis
GSNMSGFFGGPPVFNLGLANRGVVNILGN

SEQ ID NO: 1460965 - protein, 20 aa, Mycobacterium tuberculosis
GSRMRPDVVIAFMDQFGDVI

SEQ ID NO: 1460966 - protein, 21 aa, Mycobacterium tuberculosis
GSSVLDSWGPTIFAGPRASPS

SEQ ID NO: 1460967 - protein, 19 aa, Mycobacterium tuberculosis
GTCRARGLLDAVIGAAAER

SEQ ID NO: 1460968 - protein, 20 aa, Mycobacterium tuberculosis
GTEVCPWLADHKVFGQPIMP

SEQ ID NO: 1460969 - protein, 17 aa, Mycobacterium tuberculosis
GTTSFGPKHEFRCDQSL

SEQ ID NO: 1460970 - protein, 18 aa, Mycobacterium tuberculosis
GTVTRWLKQEGDTVELDE

SEQ ID NO: 1460971 - protein, 17 aa, Mycobacterium tuberculosis
GVAQRLAATVADAVSTA

SEQ ID NO: 1460972 - protein, 23 aa, Mycobacterium tuberculosis
GVDEARALYEWNHAKQILRIQAG

SEQ ID NO: 1460973 - protein, 20 aa, Mycobacterium tuberculosis
GVGPGDVVGIMLRNSPSTVL

SEQ ID NO: 1460974 - protein, 19 aa, Mycobacterium tuberculosis
GVPTPGLGRISGVRLQING

SEQ ID NO: 1460975 - protein, 21 aa, Mycobacterium tuberculosis
GVREIFEFATVTALAGHIDTL

SEQ ID NO: 1460976 - protein, 19 aa, Mycobacterium tuberculosis
GVSARFAIAAAETVAAAAR

SEQ ID NO: 1460977 - protein, 18 aa, Mycobacterium tuberculosis
GVTDWLVETGIGYDVSGM

SEQ ID NO: 1460978 - protein, 18 aa, Mycobacterium tuberculosis
GWGEFGAFVEYQSAQACA

SEQ ID NO: 1460979 - protein, 17 aa, Mycobacterium tuberculosis
GWMSLAGAMGGHTVVAK

SEQ ID NO: 1460980 - protein, 18 aa, Mycobacterium tuberculosis
GWPVPAAAAAVIGPAGVL

SEQ ID NO: 1460981 - protein, 18 aa, Mycobacterium tuberculosis
GYDMVQRLTAQPKYVQAG

SEQ ID NO: 1460982 - protein, 17 aa, Mycobacterium tuberculosis
GYRELREADRWPDKPGR

SEQ ID NO: 1460983 - protein, 26 aa, Mycobacterium tuberculosis
GYRLAISELTGAYWAGPAAASMVAAV

SEQ ID NO: 1460984 - protein, 21 aa, Mycobacterium tuberculosis
GYVMPHWPRPWGRAAGAVEQL

SEQ ID NO: 1460985 - protein, 24 aa, Mycobacterium tuberculosis
GYVPGDGGGLVLLKPVQAALDDGD

SEQ ID NO: 1460986 - protein, 22 aa, Mycobacterium tuberculosis
HAGGAAAAYRWLAKSLVANDVD

SEQ ID NO: 1460987 - protein, 28 aa, Mycobacterium tuberculosis
HAPPERLLRCIEAVLACREALAVNVKPK

SEQ ID NO: 1460988 - protein, 32 aa, Mycobacterium tuberculosis; identical to SEQ ID NO: 211033

SEQ ID NO: 1460989 - protein, 21 aa, Mycobacterium tuberculosis
HGEFRAIGYTSIYEDVEHVAL

SEQ ID NO: 1460990 - protein, 20 aa, Mycobacterium tuberculosis
HGESGKVIGIRVFSREDEDE

SEQ ID NO: 1460991 - protein, 20 aa, Mycobacterium tuberculosis
HGTVLLAVRGLRMGTGTSER

SEQ ID NO: 1460992 - protein, 26 aa, Mycobacterium tuberculosis
HHRAATRARLWPRSMTTLSTHDTKRG

SEQ ID NO: 1460993 - protein, 18 aa, Mycobacterium tuberculosis
HLNPRIPEDLAFAESRIR

SEQ ID NO: 1460994 - protein, 18 aa, Mycobacterium tuberculosis
HLTEYGVRVLGGLSALNS

SEQ ID NO: 1460995 - protein, 19 aa, Mycobacterium tuberculosis
HLTLVPALRDALAQVGRPD

SEQ ID NO: 1460996 - protein, 18 aa, Mycobacterium tuberculosis
HMLDTLRAFDAVAHELSG

SEQ ID NO: 1460997 - protein, 17 aa, Mycobacterium tuberculosis
HPAVCAAVSALSYEGRL

SEQ ID NO: 1460998 - protein, 20 aa, Mycobacterium tuberculosis
HPPFRWQRRYAEGFSDQVAA

SEQ ID NO: 1460999 - protein, 28 aa, Mycobacterium tuberculosis
HQISRAGWSGVRWRNLTGGIVALHAGYK

SEQ ID NO: 1461000 - protein, 25 aa, Mycobacterium tuberculosis
HRKVVVFRPLYAVGGQELGYLPGSE

SEQ ID NO: 1461001 - protein, 21 aa, Mycobacterium tuberculosis
HRLFLQCAWHALEDAGADPAR

SEQ ID NO: 1461002 - protein, 17 aa, Mycobacterium tuberculosis
HRQSLSASASWAANGKI

SEQ ID NO: 1461003 - protein, 19 aa, Mycobacterium tuberculosis
HRRGIRIITDLVMNHTSES

SEQ ID NO: 1461004 - protein, 18 aa, Mycobacterium tuberculosis
HRRLAITGVNEYPNLGEP

SEQ ID NO: 1461005 - protein, 18 aa, Mycobacterium tuberculosis
HRSSEPGHGLALAALGLD

SEQ ID NO: 1461006 - protein, 21 aa, Mycobacterium tuberculosis
HSRYHTPVSLIGWSLGGIFAR

SEQ ID NO: 1461007 - protein, 24 aa, Mycobacterium tuberculosis
HTGTAKFAYSWAVGPAVGRSGKAP

SEQ ID NO: 1461008 - protein, 19 aa, Mycobacterium tuberculosis
HTMMFQEMVNRVGADVPGL

SEQ ID NO: 1461009 - protein, 22 aa, Mycobacterium tuberculosis
HVAEALTLLRCSPGIGKAKNVV

SEQ ID NO: 1461010 - protein, 24 aa, Mycobacterium tuberculosis
HVAQRLCALAGESDERVALAVAVA

SEQ ID NO: 1461011 - protein, 18 aa, Mycobacterium tuberculosis
HVSLSKHPYQIGVFGSGT

SEQ ID NO: 1461012 - protein, 17 aa, Mycobacterium tuberculosis
HVTRPGQYEAPLGITLR

SEQ ID NO: 1461013 - protein, 19 aa, Mycobacterium tuberculosis
HVYAKLGLASRVQLVDEAA

SEQ ID NO: 1461014 - protein, 17 aa, Mycobacterium tuberculosis
IAGELVSLYAKRQASPG

SEQ ID NO: 1461015 - protein, 24 aa, Mycobacterium tuberculosis
IAHTLWIAHCWFMEAWDSTPRIAF

SEQ ID NO: 1461016 - protein, 24 aa, Mycobacterium tuberculosis
IATVVDWMLLAAINALIAGDQSGA

SEQ ID NO: 1461017 - protein, 20 aa, Mycobacterium tuberculosis
IAYALAGTMDFDFQTQPLGQ

SEQ ID NO: 1461018 - protein, 19 aa, Mycobacterium tuberculosis
ICSTEGGFLTSWQPDEFDA

SEQ ID NO: 1461019 - protein, 24 aa, Mycobacterium tuberculosis
IDPYLRPLYDALYDMMDPELIPKL

SEQ ID NO: 1461020 - protein, 17 aa, Mycobacterium tuberculosis
IDRLRCAERAIAVARRG

SEQ ID NO: 1461021 - protein, 19 aa, Mycobacterium tuberculosis
IELTLEMAAETGLQVDEIG

SEQ ID NO: 1461022 - protein, 23 aa, Mycobacterium tuberculosis
IEPLEPGFGYTLGNSLRRTLLSS

SEQ ID NO: 1461023 - protein, 24 aa, Mycobacterium tuberculosis
IEVIPDVLRHRLVLTYDALADEIS

SEQ ID NO: 1461024 - protein, 24 aa, Mycobacterium tuberculosis
IFSRADAQAGWLLHAEGILRPGSV

SEQ ID NO: 1461025 - protein, 18 aa, Mycobacterium tuberculosis
IGAGSGWRQLDVVAQTGS

SEQ ID NO: 1461026 - protein, 19 aa, Mycobacterium tuberculosis
IGGLPRGRVIEIYGPESSG

SEQ ID NO: 1461027 - protein, 25 aa, Mycobacterium tuberculosis
IGIGLLVDGRWRWRSYSLTSSPAAS

SEQ ID NO: 1461028 - protein, 22 aa, Mycobacterium tuberculosis
IGRVAPVERIRLVNSGTEATMS

SEQ ID NO: 1461029 - protein, 17 aa, Mycobacterium tuberculosis
IGVVGLLNVQYALKDDV

SEQ ID NO: 1461030 - protein, 19 aa, Mycobacterium tuberculosis
IIENPAWYTAYTPYQPEIS

SEQ ID NO: 1461031 - protein, 21 aa, Mycobacterium tuberculosis
IINSGFGWHEARVPTIVTSVP

SEQ ID NO: 1461032 - protein, 23 aa, Mycobacterium tuberculosis
IKDWQIKICDTIADNASAAGFVL

SEQ ID NO: 1461033 - protein, 21 aa, Mycobacterium tuberculosis
IKEQMIHWWGPIIDEYYASSE

SEQ ID NO: 1461034 - protein, 21 aa, Mycobacterium tuberculosis
IKQEILAGIGGVRAIRAYTAV

SEQ ID NO: 1461035 - protein, 27 aa, Mycobacterium tuberculosis
ILQRYKDLQDIIAILGIDELSEEDKQL

SEQ ID NO: 1461036 - protein, 17 aa, Mycobacterium tuberculosis
ILRALRINLTVRGYQVI

SEQ ID NO: 1461037 - protein, 17 aa, Mycobacterium tuberculosis
INPEDIISGAFELAQQV

SEQ ID NO: 1461038 - protein, 21 aa, Mycobacterium tuberculosis
IPDPPPPGAVVVFSAHGVSPA

SEQ ID NO: 1461039 - protein, 25 aa, Mycobacterium tuberculosis
IPEGLLNYLALLGWSIADDHDLFGL

SEQ ID NO: 1461040 - protein, 18 aa, Mycobacterium tuberculosis
IPTKMFVYAAEVAKTIRG

SEQ ID NO: 1461041 - protein, 17 aa, Mycobacterium tuberculosis
IPVTPGYFNLTGGPSSG

SEQ ID NO: 1461042 - protein, 18 aa, Mycobacterium tuberculosis
IQGLRAAFEVSQTSRSAP

SEQ ID NO: 1461043 - protein, 24 aa, Mycobacterium tuberculosis
IQWAIRLARRGAVIVVDNVIRGGG

SEQ ID NO: 1461044 - protein, 25 aa, Mycobacterium tuberculosis
IRDFARASFSYGLNAKWPVYLSTKN

SEQ ID NO: 1461045 - protein, 19 aa, Mycobacterium tuberculosis
IRDKGGRAVANYDSVATED

SEQ ID NO: 1461046 - protein, 19 aa, Mycobacterium tuberculosis
IRLLTRIAFGFRSPQALIA

SEQ ID NO: 1461047 - protein, 19 aa, Mycobacterium tuberculosis
IRQRIVGIAGIDTRAVVRH

SEQ ID NO: 1461048 - protein, 22 aa, Mycobacterium tuberculosis
IRRAPGPSWYHFTLNGAPGSIL

SEQ ID NO: 1461049 - protein, 22 aa, Mycobacterium tuberculosis
IRRRLKSFTVFRQRGDAFADRL

SEQ ID NO: 1461050 - protein, 21 aa, Mycobacterium tuberculosis
IRTMKHSLAWVDRSGSLAELN

SEQ ID NO: 1461051 - protein, 18 aa, Mycobacterium tuberculosis
ISEQGITAAEEFLSDPEV

SEQ ID NO: 1461052 - protein, 25 aa, Mycobacterium tuberculosis
ISGDLRVDFPWLGTVVQAYLRRTLA

SEQ ID NO: 1461053 - protein, 17 aa, Mycobacterium tuberculosis
ISLAPGEAIFLPAGNLH

SEQ ID NO: 1461054 - protein, 20 aa, Mycobacterium tuberculosis
ISMYPRMWAASGVDYPTLLA

SEQ ID NO: 1461055 - protein, 23 aa, Mycobacterium tuberculosis
ISQGRLEALLNFQTLVTDLTGLE

SEQ ID NO: 1461056 - protein, 17 aa, Mycobacterium tuberculosis
ISRTAFLHVDYRRITPI

SEQ ID NO: 1461057 - protein, 23 aa, Mycobacterium tuberculosis
ITQVKVRSVLTCATSTGVCATCY

SEQ ID NO: 1461058 - protein, 20 aa, Mycobacterium tuberculosis
ITVGRISYLLGLRGPAVAVD

SEQ ID NO: 1461059 - protein, 17 aa, Mycobacterium tuberculosis
IWHEGWFANTIHAATPA

SEQ ID NO: 1461060 - protein, 24 aa, Mycobacterium tuberculosis
IYRFNGQTSVFWPGRGPCYRCLHP

SEQ ID NO: 1461061 - protein, 21 aa, Mycobacterium tuberculosis
IYSNGLWRDAPLRRREAMRPG

SEQ ID NO: 1461062 - protein, 19 aa, Mycobacterium tuberculosis
KAAVIHLTKAMAVELAPHK

SEQ ID NO: 1461063 - protein, 23 aa, Mycobacterium tuberculosis
KAGIATHVAAFWAHGGRPPVGVT

SEQ ID NO: 1461064 - protein, 18 aa, Mycobacterium tuberculosis
KAIGYGMPGIRVDGNDVL

SEQ ID NO: 1461065 - protein, 24 aa, Mycobacterium tuberculosis
KDGRPKPVPIWAALDTDRGDRLLV

SEQ ID NO: 1461066 - protein, 20 aa, Mycobacterium tuberculosis
KELAHLGIRVNAIAPGLIRS

SEQ ID NO: 1461067 - protein, 23 aa, Mycobacterium tuberculosis
KEMQRTEGFTALIDANRGCFAAF

SEQ ID NO: 1461068 - protein, 19 aa, Mycobacterium tuberculosis
KFVRSETIPEFLAALEKPR

SEQ ID NO: 1461069 - protein, 20 aa, Mycobacterium tuberculosis
KGANVAPPLTWSSPAGAAEL

SEQ ID NO: 1461070 - protein, 19 aa, Mycobacterium tuberculosis
KGAVAGRCVIRGKIVETEE

SEQ ID NO: 1461071 - protein, 19 aa, Mycobacterium tuberculosis
KGISIRRAPGPSWYHFTLN

SEQ ID NO: 1461072 - protein, 17 aa, Mycobacterium tuberculosis
KGLSRLVRQNCDEVVSI

SEQ ID NO: 1461073 - protein, 17 aa, Mycobacterium tuberculosis
KGQQVAWIRQVDGQQTV

SEQ ID NO: 1461074 - protein, 19 aa, Mycobacterium tuberculosis
KLGPDFLVELLEIRAALGP

SEQ ID NO: 1461075 - protein, 19 aa, Mycobacterium tuberculosis
KLKELIPRQQFEVPVQAAI

SEQ ID NO: 1461076 - protein, 24 aa, Mycobacterium tuberculosis
KLQPARYRQLLQHILQHVADGKLE

SEQ ID NO: 1461077 - protein, 19 aa, Mycobacterium tuberculosis
KMTVYRLVHNGELPAVRVG

SEQ ID NO: 1461078 - protein, 21 aa, Mycobacterium tuberculosis
KNAKGDTEWLPPAHLDHGQPR

SEQ ID NO: 1461079 - protein, 23 aa, Mycobacterium tuberculosis
KNGIEPCIARAKAYAPFADLIWM

SEQ ID NO: 1461080 - protein, 26 aa, Mycobacterium tuberculosis
KNVDAFLAVCRKWEVLATVIGEVTDG

SEQ ID NO: 1461081 - protein, 24 aa, Mycobacterium tuberculosis
KPSYGMAEAVVYLATTKAGSPPTS

SEQ ID NO: 1461082 - protein, 20 aa, Mycobacterium tuberculosis
KQDGQWRIAYRRLRNDRLVS

SEQ ID NO: 1461083 - protein, 23 aa, Mycobacterium tuberculosis
KRELDALGWRRSGAFREKDGRQL

SEQ ID NO: 1461084 - protein, 19 aa, Mycobacterium tuberculosis
KRLASPAQRIMLYAKDSGC

SEQ ID NO: 1461085 - protein, 19 aa, Mycobacterium tuberculosis
KRRDMLFDHVGALAATVMG

SEQ ID NO: 1461086 - protein, 26 aa, Mycobacterium tuberculosis
KSASSLGLDGTEVFDITGIDVLNDGK

SEQ ID NO: 1461087 - protein, 23 aa, Mycobacterium tuberculosis
KSEIEEALRYGVVKMNVDTDTQY

SEQ ID NO: 1461088 - protein, 18 aa, Mycobacterium tuberculosis
KSVMPLRSSIHPVAPTLR

SEQ ID NO: 1461089 - protein, 25 aa, Mycobacterium tuberculosis
KTRELRVSPLVLKRTKIDNICYEMG

SEQ ID NO: 1461090 - protein, 18 aa, Mycobacterium tuberculosis
KTRKNAKGDTEWLPPAHL

SEQ ID NO: 1461091 - protein, 20 aa, Mycobacterium tuberculosis
KVVDDEFPGRVLLAEANQWP

SEQ ID NO: 1461092 - protein, 19 aa, Mycobacterium tuberculosis
KVVGCGALHVLWSDLGEIR

SEQ ID NO: 1461093 - protein, 24 aa, Mycobacterium tuberculosis
LAAELCLPLVLVIDAAGPALSAAA

SEQ ID NO: 1461094 - protein, 21 aa, Mycobacterium tuberculosis
LAAGGLYRQWALARRAQGDLW

SEQ ID NO: 1461095 - protein, 25 aa, Mycobacterium tuberculosis
LAARMACPYLNPGRYVQGRPLVQGM

SEQ ID NO: 1461096 - protein, 18 aa, Mycobacterium tuberculosis
LADGLPAYGSCAGMILLA

SEQ ID NO: 1461097 - protein, 23 aa, Mycobacterium tuberculosis
LADVRRYGATYANYVGKPLSYVL

SEQ ID NO: 1461098 - protein, 24 aa, Mycobacterium tuberculosis
LAERLMEFFGGIPILDGIGSTEVG

SEQ ID NO: 1461099 - protein, 23 aa, Mycobacterium tuberculosis
LAFQCVDDLIGIWGDPGVTGKPV

SEQ ID NO: 1461100 - protein, 17 aa, Mycobacterium tuberculosis
LAGCGYSVCDTADEISV

SEQ ID NO: 1461101 - protein, 19 aa, Mycobacterium tuberculosis
LAGLIDRIARDEVRHEEFF

SEQ ID NO: 1461102 - protein, 20 aa, Mycobacterium tuberculosis
LAGLLDEWTPVIAGAELGEH

SEQ ID NO: 1461103 - protein, 24 aa, Mycobacterium tuberculosis
LAGLSSPRIVGWIMRTDSSDLPWH

SEQ ID NO: 1461104 - protein, 23 aa, Mycobacterium tuberculosis
LAHQIHWLLLRFGVGSTVRDYDP

SEQ ID NO: 1461105 - protein, 24 aa, Mycobacterium tuberculosis
LAIFDRGKALALYHTKRLASPAQR

SEQ ID NO: 1461106 - protein, 18 aa, Mycobacterium tuberculosis
LAPSALYRMFYKARKAAG

SEQ ID NO: 1461107 - protein, 26 aa, Mycobacterium tuberculosis
LARAFLMYVTQRWPDVLSTAAEDLPP

SEQ ID NO: 1461108 - protein, 17 aa, Mycobacterium tuberculosis
LARAYGIEVSDFEDEPV

SEQ ID NO: 1461109 - protein, 25 aa, Mycobacterium tuberculosis
LASDPEGWIRCQLDGVPTEQSLRFT

SEQ ID NO: 1461110 - protein, 18 aa, Mycobacterium tuberculosis
LASMPGIDFDALYRGESP

SEQ ID NO: 1461111 - protein, 23 aa, Mycobacterium tuberculosis
LCEIKDVQIRDGLHILGQNPTGE

SEQ ID NO: 1461112 - protein, 18 aa, Mycobacterium tuberculosis
LCGPVAMVDAARTWLDHN

SEQ ID NO: 1461113 - protein, 27 aa, Mycobacterium tuberculosis
LCPRRSRCTGCGVTHVLLPVSALLRRA

SEQ ID NO: 1461114 - protein, 23 aa, Mycobacterium tuberculosis
LDALTLSVLRSWLAATAGAGAAR

SEQ ID NO: 1461115 - protein, 17 aa, Mycobacterium tuberculosis
LDAPICLTWELTYACNL

SEQ ID NO: 1461116 - protein, 27 aa, Mycobacterium tuberculosis
LDARAYRLPWPAGTVVYEIDQPQVIDF

SEQ ID NO: 1461117 - protein, 18 aa, Mycobacterium tuberculosis
LDARQWFQSFPAVAGSSL

SEQ ID NO: 1461118 - protein, 26 aa, Mycobacterium tuberculosis
LDASTFLGRLALIRIYNGRIRKGQQV

SEQ ID NO: 1461119 - protein, 21 aa, Mycobacterium tuberculosis
LDDARLASYDGVNRVNPPLRE

SEQ ID NO: 1461120 - protein, 20 aa, Mycobacterium tuberculosis
LDGFCSASLMVDHPACRRAV

SEQ ID NO: 1461121 - protein, 25 aa, Mycobacterium tuberculosis
LDGYPRLHLKLSVIGVAAGVAGLLS

SEQ ID NO: 1461122 - protein, 17 aa, Mycobacterium tuberculosis
LDKMGWRSSDTAELCYT

SEQ ID NO: 1461123 - protein, 25 aa, Mycobacterium tuberculosis
LDLLPTVRGAFCLTFMDENTLYACR

SEQ ID NO: 1461124 - protein, 21 aa, Mycobacterium tuberculosis
LDPLFEVLEKHVPPPKGEPDA

SEQ ID NO: 1461125 - protein, 18 aa, Mycobacterium tuberculosis
LDQLQRPAPVYNMAVALR

SEQ ID NO: 1461126 - protein, 22 aa, Mycobacterium tuberculosis
LDRGPEMLSFVLKHTPLKMCWV

SEQ ID NO: 1461127 - protein, 20 aa, Mycobacterium tuberculosis
LDTSVAISWIGKETGREVVA

SEQ ID NO: 1461128 - protein, 30 aa, Mycobacterium tuberculosis; identical to SEQ ID NO: 202168

SEQ ID NO: 1461129 - protein, 17 aa, Mycobacterium tuberculosis
LEDAFGFTETVDQLTAI

SEQ ID NO: 1461130 - protein, 20 aa, Mycobacterium tuberculosis
LEDWWGRWLGRWTAEEHLHA

SEQ ID NO: 1461131 - protein, 20 aa, Mycobacterium tuberculosis
LEIPVATALAAARAAQSADA

SEQ ID NO: 1461132 - protein, 18 aa, Mycobacterium tuberculosis
LEPLEVTSRWIAGENPET

SEQ ID NO: 1461133 - protein, 24 aa, Mycobacterium tuberculosis
LERIGFAAQHIWDGSARRVLAHAT

SEQ ID NO: 1461134 - protein, 19 aa, Mycobacterium tuberculosis
LERTFPLALSALIQEAIAA

SEQ ID NO: 1461135 - protein, 26 aa, Mycobacterium tuberculosis
LFFSLPWYYRSGYDVLLYTLPFHGQR

SEQ ID NO: 1461136 - protein, 22 aa, Mycobacterium tuberculosis
LFPGGEGRLRLTEPDDMLTTGI

SEQ ID NO: 1461137 - protein, 23 aa, Mycobacterium tuberculosis
LFRESYRAFLDRHVAPYHDEWEK

SEQ ID NO: 1461138 - protein, 19 aa, Mycobacterium tuberculosis
LFSHVPWLASQLLGAVEAY

SEQ ID NO: 1461139 - protein, 22 aa, Mycobacterium tuberculosis
LGALRMLAGDVIEMATGEGKTL

SEQ ID NO: 1461140 - protein, 18 aa, Mycobacterium tuberculosis
LGAVPRVLVWDGEGAIGR

SEQ ID NO: 1461141 - protein, 18 aa, Mycobacterium tuberculosis
LGGTIGWADPETGSAFGY

SEQ ID NO: 1461142 - protein, 24 aa, Mycobacterium tuberculosis
LGGTRTAVMMGVYFNEYQSMLAAS

SEQ ID NO: 1461143 - protein, 17 aa, Mycobacterium tuberculosis
LGLDFLRHIERCAVLVH

SEQ ID NO: 1461144 - protein, 25 aa, Mycobacterium tuberculosis
LGLGAIKPRPVVVGGEVVARPTMTL

SEQ ID NO: 1461145 - protein, 23 aa, Mycobacterium tuberculosis
LGLIKVVLALKHGVVPRNLHFTR

SEQ ID NO: 1461146 - protein, 18 aa, Mycobacterium tuberculosis
LGQWPFTSGPGFGHTRNP

SEQ ID NO: 1461147 - protein, 22 aa, Mycobacterium tuberculosis
LGRIKTILCGSERVHPATLKRF

SEQ ID NO: 1461148 - protein, 19 aa, Mycobacterium tuberculosis
LGVEASLRSLARVAPTQRH

SEQ ID NO: 1461149 - protein, 22 aa, Mycobacterium tuberculosis
LGVHNFYFWPDPRASLCDIARA

SEQ ID NO: 1461150 - protein, 21 aa, Mycobacterium tuberculosis
LGVPTFRMLRALRGFDPDVVH

SEQ ID NO: 1461151 - protein, 17 aa, Mycobacterium tuberculosis
LGWRAQHSQSHYAAAKA

SEQ ID NO: 1461152 - protein, 23 aa, Mycobacterium tuberculosis
LHHPPMRTFLGVPVRIRDEVFGN

SEQ ID NO: 1461153 - protein, 19 aa, Mycobacterium tuberculosis
LHHTYSFLGVETYRQVSSE

SEQ ID NO: 1461154 - protein, 21 aa, Mycobacterium tuberculosis
LHQTYLRLGHSVDLIEPISGL

SEQ ID NO: 1461155 - protein, 25 aa, Mycobacterium tuberculosis
LHRAFKMLAEDGIDLQTCGLVAVGH

SEQ ID NO: 1461156 - protein, 27 aa, Mycobacterium tuberculosis
LHTHLPWLAHHGRWPVGEEWLYQSWAA

SEQ ID NO: 1461157 - protein, 31 aa, Mycobacterium tuberculosis; identical to SEQ ID NO: 202426

SEQ ID NO: 1461158 - protein, 17 aa, Mycobacterium tuberculosis
LIADGVVDTRAFSKNSD

SEQ ID NO: 1461159 - protein, 17 aa, Mycobacterium tuberculosis
LIRRPGIVHTRAQLLER

SEQ ID NO: 1461160 - protein, 19 aa, Mycobacterium tuberculosis
LITAPQYAAYDIWESLFTG

SEQ ID NO: 1461161 - protein, 19 aa, Mycobacterium tuberculosis
LKAEFFKTLAHPARIRILE

SEQ ID NO: 1461162 - protein, 18 aa, Mycobacterium tuberculosis
LLAAEYDEFLAGSAELQV

SEQ ID NO: 1461163 - protein, 17 aa, Mycobacterium tuberculosis
LLAERLGVRQTIGLGTV

SEQ ID NO: 1461164 - protein, 30 aa, Mycobacterium tuberculosis; identical to SEQ ID NO: 202501

SEQ ID NO: 1461165 - protein, 22 aa, Mycobacterium tuberculosis
LLIELRAAISRVLAEQGKTDWA

SEQ ID NO: 1461166 - protein, 24 aa, Mycobacterium tuberculosis
LLNGPRYWLMNAIEKAPQGPPVTK

SEQ ID NO: 1461167 - protein, 20 aa, Mycobacterium tuberculosis
LLRALAVSDLDPFIDLLSEG

SEQ ID NO: 1461168 - protein, 20 aa, Mycobacterium tuberculosis
LLRECTVLGKLATHAEQGRL

SEQ ID NO: 1461169 - protein, 24 aa, Mycobacterium tuberculosis
LLSKHIRLIAAFDHRHIFLDPNPD

SEQ ID NO: 1461170 - protein, 17 aa, Mycobacterium tuberculosis
LLVADLAYVRGMVYRQL

SEQ ID NO: 1461171 - protein, 25 aa, Mycobacterium tuberculosis
LLVSAEGWHSLSIAYAETADELAAL

SEQ ID NO: 1461172 - protein, 17 aa, Mycobacterium tuberculosis
LLWSFAPPPRPRPVDGS

SEQ ID NO: 1461173 - protein, 21 aa, Mycobacterium tuberculosis
LNALVGLARPGKFGGDVSHLN

SEQ ID NO: 1461174 - protein, 19 aa, Mycobacterium tuberculosis
LNPGPATRLVFDLDPGEGV

SEQ ID NO: 1461175 - protein, 18 aa, Mycobacterium tuberculosis
LPADIIITATGLNLQLFG

SEQ ID NO: 1461176 - protein, 23 aa, Mycobacterium tuberculosis
LPANHRYLGPVLWSPDVKPPTWW

SEQ ID NO: 1461177 - protein, 25 aa, Mycobacterium tuberculosis
LPRLKPRVFYDLVVEVALIRPGPIQ

SEQ ID NO: 1461178 - protein, 17 aa, Mycobacterium tuberculosis
LPRWSMIDQALGLGSPD

SEQ ID NO: 1461179 - protein, 17 aa, Mycobacterium tuberculosis
LPSHPGHEIAARQMRGF

SEQ ID NO: 1461180 - protein, 24 aa, Mycobacterium tuberculosis
LPTRPRATLVLRKDADHSINRLRL

SEQ ID NO: 1461181 - protein, 22 aa, Mycobacterium tuberculosis
LPWMADLVGEFALRAPPAEQIA

SEQ ID NO: 1461182 - protein, 19 aa, Mycobacterium tuberculosis
LQHALWREAIALVAEGVCD

SEQ ID NO: 1461183 - protein, 17 aa, Mycobacterium tuberculosis
LRAEGLLAVTGDGAHAA

SEQ ID NO: 1461184 - protein, 17 aa, Mycobacterium tuberculosis
LRAGAIARFAPVMDEVV

SEQ ID NO: 1461185 - protein, 18 aa, Mycobacterium tuberculosis
LRAGGRRRLILIHAPSGF

SEQ ID NO: 1461186 - protein, 19 aa, Mycobacterium tuberculosis
LRAPIQQMIDFMAARTAFF

SEQ ID NO: 1461187 - protein, 24 aa, Mycobacterium tuberculosis
LRDITPAAVRRWYATTAVGTPTMR

SEQ ID NO: 1461188 - protein, 30 aa, Mycobacterium tuberculosis; identical to SEQ ID NO: 202854

SEQ ID NO: 1461189 - protein, 32 aa, Mycobacterium tuberculosis; identical to SEQ ID NO: 202855

SEQ ID NO: 1461190 - protein, 21 aa, Mycobacterium tuberculosis
LRGFFVWAYEMDRVRDYVADS

SEQ ID NO: 1461191 - protein, 19 aa, Mycobacterium tuberculosis
LRGGMRNNIGLELKVAESE

SEQ ID NO: 1461192 - protein, 19 aa, Mycobacterium tuberculosis
LRGLLTELHRAGAALDYSA

SEQ ID NO: 1461193 - protein, 21 aa, Mycobacterium tuberculosis
LRGRNTLKWNYFGPDVVPLWL

SEQ ID NO: 1461194 - protein, 20 aa, Mycobacterium tuberculosis
LRKYLGAYLAVLGHTDVVSF

SEQ ID NO: 1461195 - protein, 18 aa, Mycobacterium tuberculosis
LRLPDVRALLDAQLAGRP

SEQ ID NO: 1461196 - protein, 21 aa, Mycobacterium tuberculosis
LRLWRERFMQRRDGLAHLGFD

SEQ ID NO: 1461197 - protein, 19 aa, Mycobacterium tuberculosis
LRPLKALAARMACPYLNPG

SEQ ID NO: 1461198 - protein, 17 aa, Mycobacterium tuberculosis
LRPRKLREAGALWERLT

SEQ ID NO: 1461199 - protein, 17 aa, Mycobacterium tuberculosis
LRSVPIVGNPLANLVQP

SEQ ID NO: 1461200 - protein, 24 aa, Mycobacterium tuberculosis
LRTGEAPEQFAWSLVVTASDLSRR

SEQ ID NO: 1461201 - protein, 20 aa, Mycobacterium tuberculosis
LRVPDSHLIYVARPDDPADM

SEQ ID NO: 1461202 - protein, 18 aa, Mycobacterium tuberculosis
LRVQFWVCGVFEVDDGRI

SEQ ID NO: 1461203 - protein, 17 aa, Mycobacterium tuberculosis
LRWPGDPSLDAGIDVRS

SEQ ID NO: 1461204 - protein, 27 aa, Mycobacterium tuberculosis
LSADRIVLCAGAIQSAHLLMLSGVGEE

SEQ ID NO: 1461205 - protein, 24 aa, Mycobacterium tuberculosis
LSLDEACLLMFARRDLTAAEASAA

SEQ ID NO: 1461206 - protein, 25 aa, Mycobacterium tuberculosis
LSREVIRVARMLNRLTATRLTAAAT

SEQ ID NO: 1461207 - protein, 25 aa, Mycobacterium tuberculosis
LSSLRAVAVGGDWVRPDLARRLQVQ

SEQ ID NO: 1461208 - protein, 19 aa, Mycobacterium tuberculosis
LSVPPDWAARARWANPAAW

SEQ ID NO: 1461209 - protein, 18 aa, Mycobacterium tuberculosis
LSVQLSGWMLMEAAHSAA

SEQ ID NO: 1461210 - protein, 24 aa, Mycobacterium tuberculosis
LTAEARSGVDVVRLVAGDPLTVDA

SEQ ID NO: 1461211 - protein, 24 aa, Mycobacterium tuberculosis
LTALDRLRFAAGNFYVNDKPTGAV

SEQ ID NO: 1461212 - protein, 28 aa, Mycobacterium tuberculosis
LTATLLTARCPVLFAPAMHTEMWLHPAT

SEQ ID NO: 1461213 - protein, 29 aa, Mycobacterium tuberculosis
LTAWSRAQAAWLWSRRRGVIAGQSAAAMH

SEQ ID NO: 1461214 - protein, 24 aa, Mycobacterium tuberculosis
LTDRRTRQSFALSARAVINAAGVW

SEQ ID NO: 1461215 - protein, 19 aa, Mycobacterium tuberculosis
LTEAFLWEEHRRVTKTATV

SEQ ID NO: 1461216 - protein, 19 aa, Mycobacterium tuberculosis
LTGAIAEYLADVTIHVSLT

SEQ ID NO: 1461217 - protein, 17 aa, Mycobacterium tuberculosis
LTLNEIHAFIKDPLGRP

SEQ ID NO: 1461218 - protein, 17 aa, Mycobacterium tuberculosis
LTLNFGVANQGGLNAGI

SEQ ID NO: 1461219 - protein, 26 aa, Mycobacterium tuberculosis
LTMVRRLPPGAIWQVIAIGKANMELT

SEQ ID NO: 1461220 - protein, 21 aa, Mycobacterium tuberculosis
LTPLVPMPGRFIYAGIADRLV

SEQ ID NO: 1461221 - protein, 33 aa, Mycobacterium tuberculosis; identical to SEQ ID NO: 203136

SEQ ID NO: 1461222 - protein, 18 aa, Mycobacterium tuberculosis
LTTRVIDLIMPIGKGQRA

SEQ ID NO: 1461223 - protein, 24 aa, Mycobacterium tuberculosis
LTTSGFRPATFAAIVDGIVESVEH

SEQ ID NO: 1461224 - protein, 18 aa, Mycobacterium tuberculosis
LVALPARLANTVAGAALG

SEQ ID NO: 1461225 - protein, 17 aa, Mycobacterium tuberculosis
LVDVALFAIAQVVQPTE

SEQ ID NO: 1461226 - protein, 23 aa, Mycobacterium tuberculosis
LVGASRKRFLGALLAGPDGVMRP

SEQ ID NO: 1461227 - protein, 18 aa, Mycobacterium tuberculosis
LVLDECHHLLATWGALVS

SEQ ID NO: 1461228 - protein, 24 aa, Mycobacterium tuberculosis
LVPVLRPRGLFAHDVDLAGEATPT

SEQ ID NO: 1461229 - protein, 20 aa, Mycobacterium tuberculosis
LVSGRASFELTQKALMAGIP

SEQ ID NO: 1461230 - protein, 25 aa, Mycobacterium tuberculosis
LVSRISAFLRPDWTRTVRARRFAAA

SEQ ID NO: 1461231 - protein, 25 aa, Mycobacterium tuberculosis
LVYRADSLVNWCPGLGTVLANEEVT

SEQ ID NO: 1461232 - protein, 19 aa, Mycobacterium tuberculosis
LWDKLTGWVTGLFSRGWSN

SEQ ID NO: 1461233 - protein, 18 aa, Mycobacterium tuberculosis
LYDEVLRVVQHWVNHGVK

SEQ ID NO: 1461234 - protein, 31 aa, Mycobacterium tuberculosis; identical to SEQ ID NO: 203240

SEQ ID NO: 1461235 - protein, 19 aa, Mycobacterium tuberculosis
LYSRLARHRIALKLVDRCA

SEQ ID NO: 1461236 - protein, 23 aa, Mycobacterium tuberculosis
MARRMGPGLVHLHLCDGSGLPAD

SEQ ID NO: 1461237 - protein, 25 aa, Mycobacterium tuberculosis
MDFVVPSRGLIGWRTDFLTETRGSG

SEQ ID NO: 1461238 - protein, 25 aa, Mycobacterium tuberculosis
MDSRLWRLLLAPGRGIGRLITGVMG

SEQ ID NO: 1461239 - protein, 19 aa, Mycobacterium tuberculosis
MGGRMSVVVAGRLPDRVAA

SEQ ID NO: 1461240 - protein, 18 aa, Mycobacterium tuberculosis
MGIDKLRVIHTGMDPVVA

SEQ ID NO: 1461241 - protein, 19 aa, Mycobacterium tuberculosis
MGLMVGLFIPLFVGCPVIL

SEQ ID NO: 1461242 - protein, 18 aa, Mycobacterium tuberculosis
MGVLPAERLGSVSDGDRV

SEQ ID NO: 1461243 - protein, 27 aa, Mycobacterium tuberculosis
MIVDEPFMLPAHIDFAALKVKFDGGTL

SEQ ID NO: 1461244 - protein, 18 aa, Mycobacterium tuberculosis
MLEAAVIAGLTSEGVDAL

SEQ ID NO: 1461245 - protein, 18 aa, Mycobacterium tuberculosis
MLLDEGRLQDGEPYLAGT

SEQ ID NO: 1461246 - protein, 19 aa, Mycobacterium tuberculosis
MLRSIYLQSLVHKRTAQPV

SEQ ID NO: 1461247 - protein, 28 aa, Mycobacterium tuberculosis
MPDPYQAFVLMAAWLAMRYGELTELRRK

SEQ ID NO: 1461248 - protein, 21 aa, Mycobacterium tuberculosis
MPMVPPGAMGARGEGSGQEKP

SEQ ID NO: 1461249 - protein, 17 aa, Mycobacterium tuberculosis
MRAGRRAAQDLCAKTRV

SEQ ID NO: 1461250 - protein, 17 aa, Mycobacterium tuberculosis
MRDLLAYMENVVSDALG

SEQ ID NO: 1461251 - protein, 18 aa, Mycobacterium tuberculosis
MREGLAWLESILEREGDN

SEQ ID NO: 1461252 - protein, 20 aa, Mycobacterium tuberculosis
MRLAAIGAHVQRFAGPGDRV

SEQ ID NO: 1461253 - protein, 17 aa, Mycobacterium tuberculosis
MRNPVRFQQAIASAGSG

SEQ ID NO: 1461254 - protein, 21 aa, Mycobacterium tuberculosis
MRVVVCRRLGPAKGQRRWRPL

SEQ ID NO: 1461255 - protein, 17 aa, Mycobacterium tuberculosis
MTEILTSMCARLYGKRA

SEQ ID NO: 1461256 - protein, 24 aa, Mycobacterium tuberculosis
MTGVAASYARWLTTAAAQAEQAAG

SEQ ID NO: 1461257 - protein, 35 aa, Mycobacterium tuberculosis; identical to SEQ ID NO: 203459

SEQ ID NO: 1461258 - protein, 19 aa, Mycobacterium tuberculosis
MVDAAASYIGWLSTSAAHA

SEQ ID NO: 1461259 - protein, 20 aa, Mycobacterium tuberculosis
MVRWNKIRWRCREDYCKLGP

SEQ ID NO: 1461260 - protein, 18 aa, Mycobacterium tuberculosis
MYSVMWSEHCSYKSSKVH

SEQ ID NO: 1461261 - protein, 20 aa, Mycobacterium tuberculosis
NEVRAALLHLRDVMVECEQR

SEQ ID NO: 1461262 - protein, 22 aa, Mycobacterium tuberculosis
NFRDVLVALGIYPGAAELGAEG

SEQ ID NO: 1461263 - protein, 24 aa, Mycobacterium tuberculosis
NGERTGNVCLVTLGLNLFSRGVDP

SEQ ID NO: 1461264 - protein, 19 aa, Mycobacterium tuberculosis
NGFWPVYRRVADPVKPRGN

SEQ ID NO: 1461265 - protein, 26 aa, Mycobacterium tuberculosis
NGGSGGRGGLLFGNGGNGSVGGMGGQ

SEQ ID NO: 1461266 - protein, 28 aa, Mycobacterium tuberculosis
NGLDFMGCCAVAVLAHEAERCRRRGVDV

SEQ ID NO: 1461267 - protein, 20 aa, Mycobacterium tuberculosis
NGRIRKGQQVAWIRQVDGQQ

SEQ ID NO: 1461268 - protein, 19 aa, Mycobacterium tuberculosis
NIVDPLALTAGDLVVHDQH

SEQ ID NO: 1461269 - protein, 21 aa, Mycobacterium tuberculosis
NKPTTAAFCDAEFERMRVEAL

SEQ ID NO: 1461270 - protein, 28 aa, Mycobacterium tuberculosis
NLVIDMPLPISLGVNIPIDIPITASAGN

SEQ ID NO: 1461271 - protein, 25 aa, Mycobacterium tuberculosis
NMDDARWDAVLAVNLLAPLRLTEGL

SEQ ID NO: 1461272 - protein, 17 aa, Mycobacterium tuberculosis
NPECHLMVVLVDERPEE

SEQ ID NO: 1461273 - protein, 22 aa, Mycobacterium tuberculosis
NPPRTVSVSTLMDGRIDHVELS

SEQ ID NO: 1461274 - protein, 18 aa, Mycobacterium tuberculosis
NPYLPPYYHPGLNAPEIR

SEQ ID NO: 1461275 - protein, 19 aa, Mycobacterium tuberculosis
NPYLTFAVLLAAGLRGVEK

SEQ ID NO: 1461276 - protein, 17 aa, Mycobacterium tuberculosis
NQWPGDVVEYFGDPNTG

SEQ ID NO: 1461277 - protein, 35 aa, Mycobacterium tuberculosis
NSGNYSNGFFWRGDYQGLIGFSGTLTIPAAGLDLN

SEQ ID NO: 1461278 - protein, 18 aa, Mycobacterium tuberculosis
NSGTGNWGIGNSGNSYNT

SEQ ID NO: 1461279 - protein, 19 aa, Mycobacterium tuberculosis
NSGTGNWGIGNSGSGNTGI

SEQ ID NO: 1461280 - protein, 18 aa, Mycobacterium tuberculosis
NSKECYSSGLADLAQGLA

SEQ ID NO: 1461281 - protein, 32 aa, Mycobacterium tuberculosis; identical to SEQ ID NO: 203690

SEQ ID NO: 1461282 - protein, 24 aa, Mycobacterium tuberculosis
NTECPPGTIGEIWVHGDNVAGGYW

SEQ ID NO: 1461283 - protein, 18 aa, Mycobacterium tuberculosis
NTTIPTKRSETFTTADDN

SEQ ID NO: 1461284 - protein, 24 aa, Mycobacterium tuberculosis
NTVRYRLKRITDFTGRDPTQPRDA

SEQ ID NO: 1461285 - protein, 18 aa, Mycobacterium tuberculosis
NVVGRLPGRYAVAALGIG

SEQ ID NO: 1461286 - protein, 18 aa, Mycobacterium tuberculosis
NWMRAREALIKTDIFGSA

SEQ ID NO: 1461287 - protein, 19 aa, Mycobacterium tuberculosis
NWSIRRLSSLVGHGRARAM

SEQ ID NO: 1461288 - protein, 18 aa, Mycobacterium tuberculosis
NYSVGFANSGNYHIGIAN

SEQ ID NO: 1461289 - protein, 21 aa, Mycobacterium tuberculosis
PAELRLRNLLRPNQFPYQSKT

SEQ ID NO: 1461290 - protein, 29 aa, Mycobacterium tuberculosis
PAERLRALRRACAAGALATLVSGAGDCAP

SEQ ID NO: 1461291 - protein, 17 aa, Mycobacterium tuberculosis
PAGRPFIAAGLAIAAVG

SEQ ID NO: 1461292 - protein, 18 aa, Mycobacterium tuberculosis
PALQLSRALLGNQGLGGT

SEQ ID NO: 1461293 - protein, 27 aa, Mycobacterium tuberculosis
PAMNFFPARLTAIGLTLPFGEVTLAPE

SEQ ID NO: 1461294 - protein, 20 aa, Mycobacterium tuberculosis
PAPQRLRVLALALAGERTVV

SEQ ID NO: 1461295 - protein, 25 aa, Mycobacterium tuberculosis
PARLKVGIISAGRVGTALGVALQRA

SEQ ID NO: 1461296 - protein, 26 aa, Mycobacterium tuberculosis
PATTREMIKTGGFDAVCFTSSSTVRN

SEQ ID NO: 1461297 - protein, 26 aa, Mycobacterium tuberculosis
PAVLGIKVARRLLANVAHVAVFDTAF

SEQ ID NO: 1461298 - protein, 20 aa, Mycobacterium tuberculosis
PAVRDCAVFGLADDRLGQRV

SEQ ID NO: 1461299 - protein, 24 aa, Mycobacterium tuberculosis
PAYVRRAPLLDGIDEFDAGFFGFP

SEQ ID NO: 1461300 - protein, 18 aa, Mycobacterium tuberculosis
PDAIAALWSDDLLTRVAI

SEQ ID NO: 1461301 - protein, 25 aa, Mycobacterium tuberculosis
PDAPVLPTLCRAAAALLGSTAADVR

SEQ ID NO: 1461302 - protein, 19 aa, Mycobacterium tuberculosis
PDATLRLVVDPRKDEVVVE

SEQ ID NO: 1461303 - protein, 26 aa, Mycobacterium tuberculosis
PDEFARRLPFMAAKRAFSEPVALNWA

SEQ ID NO: 1461304 - protein, 20 aa, Mycobacterium tuberculosis
PDMADRVAALAAHAPPERLL

SEQ ID NO: 1461305 - protein, 20 aa, Mycobacterium tuberculosis
PDTWVLWNLTGGPRGGVHVT

SEQ ID NO: 1461306 - protein, 20 aa, Mycobacterium tuberculosis
PEAGVVCGVGKPAGKTAFVF

SEQ ID NO: 1461307 - protein, 26 aa, Mycobacterium tuberculosis
PEFDFPRLRTLLCTEAIAAADLMSAI

SEQ ID NO: 1461308 - protein, 21 aa, Mycobacterium tuberculosis
PEGFLSTHLVAGVKPGTIVRL

SEQ ID NO: 1461309 - protein, 19 aa, Mycobacterium tuberculosis
PEGLRPDDAMIMFTGGTTG

SEQ ID NO: 1461310 - protein, 18 aa, Mycobacterium tuberculosis
PELAFAEHRSCAKAQALV

SEQ ID NO: 1461311 - protein, 23 aa, Mycobacterium tuberculosis
PERCARVAGLAVRHARLRQVAPA

SEQ ID NO: 1461312 - protein, 21 aa, Mycobacterium tuberculosis
PESFLGGAYHPVFAAGPAADH

SEQ ID NO: 1461313 - protein, 20 aa, Mycobacterium tuberculosis
PETPVAVVAFASWPQQRTLR

SEQ ID NO: 1461314 - protein, 17 aa, Mycobacterium tuberculosis
PGDHKPVEDFLSRDHAG

SEQ ID NO: 1461315 - protein, 21 aa, Mycobacterium tuberculosis
PGELRRPVVHADDLVAVSAKQ

SEQ ID NO: 1461316 - protein, 27 aa, Mycobacterium tuberculosis
PGNSLFITVNCWGRLVTGVGAALGKGA

SEQ ID NO: 1461317 - protein, 24 aa, Mycobacterium tuberculosis
PGPWRLDPLPLVISAADWEVLEAG

SEQ ID NO: 1461318 - protein, 22 aa, Mycobacterium tuberculosis
PGQRIPSRWLDSGVIVQADTLA

SEQ ID NO: 1461319 - protein, 18 aa, Mycobacterium tuberculosis
PGTRRMYSNYGFTVLAES

SEQ ID NO: 1461320 - protein, 23 aa, Mycobacterium tuberculosis
PGYGEMFSALGFDGLVRSARSRA

SEQ ID NO: 1461321 - protein, 18 aa, Mycobacterium tuberculosis
PHHRWPRHILDVKTAIAW

SEQ ID NO: 1461322 - protein, 19 aa, Mycobacterium tuberculosis
PHIVGAALFEALAETTTWD

SEQ ID NO: 1461323 - protein, 26 aa, Mycobacterium tuberculosis
PHQISRAGNMLSVFFGETPVTDFASA

SEQ ID NO: 1461324 - protein, 19 aa, Mycobacterium tuberculosis
PIARSVMDAALLLDATTTV

SEQ ID NO: 1461325 - protein, 22 aa, Mycobacterium tuberculosis
PKKQVRCVYVAIGQKGTTIAAV

SEQ ID NO: 1461326 - protein, 21 aa, Mycobacterium tuberculosis
PKPDAPVRYRFHFPRQQRGRF

SEQ ID NO: 1461327 - protein, 20 aa, Mycobacterium tuberculosis
PKPPFAQRVPDWLWAAPRKL

SEQ ID NO: 1461328 - protein, 24 aa, Mycobacterium tuberculosis
PKTLIQHLIRWVISAGEFGEKVGE

SEQ ID NO: 1461329 - protein, 20 aa, Mycobacterium tuberculosis
PKYAEAGIRAIDLTPAAVGP

SEQ ID NO: 1461330 - protein, 18 aa, Mycobacterium tuberculosis
PLDRSHTAAIIWYDDPDD

SEQ ID NO: 1461331 - protein, 28 aa, Mycobacterium tuberculosis
PLLAEADVPWVLMHWRAVSADTPHVPVR

SEQ ID NO: 1461332 - protein, 18 aa, Mycobacterium tuberculosis
PLLVACDLQRPAAVNQLQ

SEQ ID NO: 1461333 - protein, 19 aa, Mycobacterium tuberculosis
PLRGLISICAAGGQGVAAI

SEQ ID NO: 1461334 - protein, 25 aa, Mycobacterium tuberculosis
PMADLTRRALLRWGAGAGAGAAGVW

SEQ ID NO: 1461335 - protein, 21 aa, Mycobacterium tuberculosis
PMDRVICGDVGYGKTEIAVRA

SEQ ID NO: 1461336 - protein, 25 aa, Mycobacterium tuberculosis
PPAEVPVRCAAGSDAAWLRAELNNE

SEQ ID NO: 1461337 - protein, 25 aa, Mycobacterium tuberculosis
PPGHVGVAWRGTWHGGLQFTTKCCA

SEQ ID NO: 1461338 - protein, 23 aa, Mycobacterium tuberculosis
PPGTGAPEVHRWWTSLTSEERQR

SEQ ID NO: 1461339 - protein, 18 aa, Mycobacterium tuberculosis
PPPGYDITALLQAHPHAV

SEQ ID NO: 1461340 - protein, 17 aa, Mycobacterium tuberculosis
PPPQLVAVWAEERGFAG

SEQ ID NO: 1461341 - protein, 22 aa, Mycobacterium tuberculosis
PPQLRAVTNWVGPVGTGARLAN

SEQ ID NO: 1461342 - protein, 19 aa, Mycobacterium tuberculosis
PPQQETVGFVGFQIPGLER

SEQ ID NO: 1461343 - protein, 19 aa, Mycobacterium tuberculosis
PPTDVPITPCELTAAKNAA

SEQ ID NO: 1461344 - protein, 24 aa, Mycobacterium tuberculosis
PPWLTDLGKALGLTGHTWSSDGSG

SEQ ID NO: 1461345 - protein, 19 aa, Mycobacterium tuberculosis
PQLRVRGVDGLRVADASVM

SEQ ID NO: 1461346 - protein, 18 aa, Mycobacterium tuberculosis
PQPAIPNMPLDLGASQSE

SEQ ID NO: 1461347 - protein, 18 aa, Mycobacterium tuberculosis
PQSNHAFGAEPGVAPMSD

SEQ ID NO: 1461348 - protein, 19 aa, Mycobacterium tuberculosis
PRFLPTTGPITMRSTALMN

SEQ ID NO: 1461349 - protein, 19 aa, Mycobacterium tuberculosis
PRIDVTVRISGFFRDAFPH

SEQ ID NO: 1461350 - protein, 28 aa, Mycobacterium tuberculosis
PRIPEDLAFAESRIRPSTIAAEDVLHDM

SEQ ID NO: 1461351 - protein, 17 aa, Mycobacterium tuberculosis
PRLMCMTRMSTFDEDEI

SEQ ID NO: 1461352 - protein, 22 aa, Mycobacterium tuberculosis
PRPGAFAYRPDPRLGSANAALS

SEQ ID NO: 1461353 - protein, 22 aa, Mycobacterium tuberculosis
PRQRGIPFIFVRTDKAGNISKR

SEQ ID NO: 1461354 - protein, 22 aa, Mycobacterium tuberculosis
PRRRRCRAKRWGGAAPVTRAGD

SEQ ID NO: 1461355 - protein, 17 aa, Mycobacterium tuberculosis
PSILLTGIIVNKLGQRF

SEQ ID NO: 1461356 - protein, 28 aa, Mycobacterium tuberculosis
PSKSGLTWTQRLVSLLVFDGPDLPGPLS

SEQ ID NO: 1461357 - protein, 19 aa, Mycobacterium tuberculosis
PSPTLPLLLPLKQIGVPDW

SEQ ID NO: 1461358 - protein, 28 aa, Mycobacterium tuberculosis
PTKGIFTSSFGYRWGVLHAGIDLANAIG

SEQ ID NO: 1461359 - protein, 23 aa, Mycobacterium tuberculosis
PTQKRPSIVNGRRIQSKRQVFEV

SEQ ID NO: 1461360 - protein, 23 aa, Mycobacterium tuberculosis
PTTGRPRRAGVSSFGVSGTNAHV

SEQ ID NO: 1461361 - protein, 30 aa, Mycobacterium tuberculosis; identical to SEQ ID NO: 204476

SEQ ID NO: 1461362 - protein, 20 aa, Mycobacterium tuberculosis
PTYRMRAIRMLECAMPNRLV

SEQ ID NO: 1461363 - protein, 17 aa, Mycobacterium tuberculosis
PVDGRWVLVVTGGAGTI

SEQ ID NO: 1461364 - protein, 20 aa, Mycobacterium tuberculosis
PVMRAALGGAVRFFAGQLVK

SEQ ID NO: 1461365 - protein, 17 aa, Mycobacterium tuberculosis
PVPEFPDRPALELDGWA

SEQ ID NO: 1461366 - protein, 19 aa, Mycobacterium tuberculosis
PVSAIAWGAWGEVGRATFL

SEQ ID NO: 1461367 - protein, 17 aa, Mycobacterium tuberculosis
PYFQISAMLPKNTRPTS

SEQ ID NO: 1461368 - protein, 17 aa, Mycobacterium tuberculosis
PYMPTDLPAWYDVAMTH

SEQ ID NO: 1461369 - protein, 17 aa, Mycobacterium tuberculosis
QAALRIEQLEQMVLEQF

SEQ ID NO: 1461370 - protein, 27 aa, Mycobacterium tuberculosis
QACFRCPQCTERLRASDDLLLVGGMRV

SEQ ID NO: 1461371 - protein, 18 aa, Mycobacterium tuberculosis
QADALMLLYLLSSDELIG

SEQ ID NO: 1461372 - protein, 17 aa, Mycobacterium tuberculosis
QAKLANLLFTYELQRRL

SEQ ID NO: 1461373 - protein, 28 aa, Mycobacterium tuberculosis
QALDFFFRKIVRDHGKALQFVLAQVTHT

SEQ ID NO: 1461374 - protein, 26 aa, Mycobacterium tuberculosis
QDLAAECWMHIGIDLFWFALPPEQLD

SEQ ID NO: 1461375 - protein, 18 aa, Mycobacterium tuberculosis
QDYGDVAYGWAMEDTSGI

SEQ ID NO: 1461376 - protein, 18 aa, Mycobacterium tuberculosis
QDYRRYGGVEFYSAIAAG

SEQ ID NO: 1461377 - protein, 23 aa, Mycobacterium tuberculosis
QEITRGRCAAIAVPSNGVEKLVA

SEQ ID NO: 1461378 - protein, 25 aa, Mycobacterium tuberculosis
QEKTGEAWVDFQLYGGHTRGEFENA

SEQ ID NO: 1461379 - protein, 27 aa, Mycobacterium tuberculosis
QELADLLPGCAGLRVVESVYGHDGFLV

SEQ ID NO: 1461380 - protein, 24 aa, Mycobacterium tuberculosis
QGEGFRACKRCRPDASPGSPEWNV

SEQ ID NO: 1461381 - protein, 25 aa, Mycobacterium tuberculosis
QGHASPGIYARAFLEGRLTAEQLDG

SEQ ID NO: 1461382 - protein, 18 aa, Mycobacterium tuberculosis
QGLAQGYALRLADRLVDN

SEQ ID NO: 1461383 - protein, 19 aa, Mycobacterium tuberculosis
QGVPFVLPNAWDVPSALAY

SEQ ID NO: 1461384 - protein, 17 aa, Mycobacterium tuberculosis
QHGGRLLVRLAGVADRD

SEQ ID NO: 1461385 - protein, 25 aa, Mycobacterium tuberculosis
QKDIDFAFGVGQLFANVPYAQLILE

SEQ ID NO: 1461386 - protein, 23 aa, Mycobacterium tuberculosis
QKEKLAELTTRWQNEKNAIEIVR

SEQ ID NO: 1461387 - protein, 25 aa, Mycobacterium tuberculosis
QLALTELWRSYGVIPDAVIGHSMGE

SEQ ID NO: 1461388 - protein, 23 aa, Mycobacterium tuberculosis
QLAPELARALLPMHDTPLGPAAA

SEQ ID NO: 1461389 - protein, 24 aa, Mycobacterium tuberculosis
QLARASVMALSYVAQSARGIYQPA

SEQ ID NO: 1461390 - protein, 22 aa, Mycobacterium tuberculosis
QLGGHIWADGGIRHPRDVALAL

SEQ ID NO: 1461391 - protein, 19 aa, Mycobacterium tuberculosis
QLLERCWDAAYEARSNIVD

SEQ ID NO: 1461392 - protein, 19 aa, Mycobacterium tuberculosis
QLMIACNLGAEPTCVPVSG

SEQ ID NO: 1461393 - protein, 30 aa, Mycobacterium tuberculosis; identical to SEQ ID NO: 209934

SEQ ID NO: 1461394 - protein, 21 aa, Mycobacterium tuberculosis
QLPGHKVYPWVAEVRHSTPGV

SEQ ID NO: 1461395 - protein, 19 aa, Mycobacterium tuberculosis
QLRLERVVLVGVWTEGSAA

SEQ ID NO: 1461396 - protein, 17 aa, Mycobacterium tuberculosis
QNARLAARLTGWRIDIR

SEQ ID NO: 1461397 - protein, 25 aa, Mycobacterium tuberculosis
QNFGELISGGFNFGNTVSGLVNAST

SEQ ID NO: 1461398 - protein, 25 aa, Mycobacterium tuberculosis
QPLLAPRLREFALREGLADAQLRLA

SEQ ID NO: 1461399 - protein, 22 aa, Mycobacterium tuberculosis
QPWEPVPACARPRPVTAGEVVA

SEQ ID NO: 1461400 - protein, 18 aa, Mycobacterium tuberculosis
QQFSRVRVFAFIDSTDEV

SEQ ID NO: 1461401 - protein, 17 aa, Mycobacterium tuberculosis
QREAFAWHIDLAKRTGK

SEQ ID NO: 1461402 - protein, 19 aa, Mycobacterium tuberculosis
QRLLPRPLDHTIIQVAVAI

SEQ ID NO: 1461403 - protein, 25 aa, Mycobacterium tuberculosis
QRQQTLRASIDWSHALLTETEQILF

SEQ ID NO: 1461404 - protein, 32 aa, Mycobacterium tuberculosis; identical to SEQ ID NO: 204846

SEQ ID NO: 1461405 - protein, 17 aa, Mycobacterium tuberculosis
QSFEFATIGGFAATRSS

SEQ ID NO: 1461406 - protein, 21 aa, Mycobacterium tuberculosis
QSGANYHLAWAIAAISTRRSR

SEQ ID NO: 1461407 - protein, 19 aa, Mycobacterium tuberculosis
QTAAGLWLEACAAKQFRTS

SEQ ID NO: 1461408 - protein, 23 aa, Mycobacterium tuberculosis
QTALPRECLLLFGQEGPGITDDA

SEQ ID NO: 1461409 - protein, 21 aa, Mycobacterium tuberculosis
QTLTGRPLIGNGANGVAGTGQ

SEQ ID NO: 1461410 - protein, 23 aa, Mycobacterium tuberculosis
QVTTRVFRNLGLANVGEGNVGNG

SEQ ID NO: 1461411 - protein, 21 aa, Mycobacterium tuberculosis
QWERRYRRVAAYGQAKLANLL

SEQ ID NO: 1461412 - protein, 19 aa, Mycobacterium tuberculosis
RAACTKLGTEHLVGTTLNV

SEQ ID NO: 1461413 - protein, 17 aa, Mycobacterium tuberculosis
RAAEVVEAELLRLDNRL

SEQ ID NO: 1461414 - protein, 22 aa, Mycobacterium tuberculosis
RAAGLRVGDTVAVLGPKTGEQV

SEQ ID NO: 1461415 - protein, 23 aa, Mycobacterium tuberculosis
RAARAGSAPAHFARQAGSSLRTA

SEQ ID NO: 1461416 - protein, 26 aa, Mycobacterium tuberculosis
RAEPRLAELGGRFWFGLDDGRADVSG

SEQ ID NO: 1461417 - protein, 20 aa, Mycobacterium tuberculosis
RAGGRYSVYLWALLAMAAAR

SEQ ID NO: 1461418 - protein, 19 aa, Mycobacterium tuberculosis
RAGKVAALLPGRDPYHPSQ

SEQ ID NO: 1461419 - protein, 21 aa, Mycobacterium tuberculosis
RAGQGCRRCGTLIAYDTTDER

SEQ ID NO: 1461420 - protein, 19 aa, Mycobacterium tuberculosis
RAGVKPSLALFAADYLLNQ

SEQ ID NO: 1461421 - protein, 25 aa, Mycobacterium tuberculosis
RAIIANRVSFAFGLRGPSVTIDSGQ

SEQ ID NO: 1461422 - protein, 17 aa, Mycobacterium tuberculosis
RAIKARAKLEAKLSAKN

SEQ ID NO: 1461423 - protein, 19 aa, Mycobacterium tuberculosis
RAPALRWGMGSLQEIDHVP

SEQ ID NO: 1461424 - protein, 19 aa, Mycobacterium tuberculosis
RARGELMGIGMSFFTEAVG

SEQ ID NO: 1461425 - protein, 19 aa, Mycobacterium tuberculosis
RARIEAIVASGAHRGNAAQ

SEQ ID NO: 1461426 - protein, 26 aa, Mycobacterium tuberculosis
RARLFPRGLAAFIELRDQRCRTPYCD

SEQ ID NO: 1461427 - protein, 18 aa, Mycobacterium tuberculosis
RATDTVAGISGRVQLTHG

SEQ ID NO: 1461428 - protein, 17 aa, Mycobacterium tuberculosis
RATLRRLGITDVADLRS

SEQ ID NO: 1461429 - protein, 17 aa, Mycobacterium tuberculosis
RAVMIGRAYLWGLAANG

SEQ ID NO: 1461430 - protein, 18 aa, Mycobacterium tuberculosis
RAVWEKFGEFGLDARAFS

SEQ ID NO: 1461431 - protein, 23 aa, Mycobacterium tuberculosis
RCPSEHWEVVRIEMPASVARYVV

SEQ ID NO: 1461432 - protein, 29 aa, Mycobacterium tuberculosis
RCRSRARLLGLRLRRLRYLRTAAARRPQV

SEQ ID NO: 1461433 - protein, 29 aa, Mycobacterium tuberculosis
RCSKGSFYLRPIVRPVILVAGGTGLSAIL

SEQ ID NO: 1461434 - protein, 23 aa, Mycobacterium tuberculosis
RDAMPTFRQVFLAGASGMALERR

SEQ ID NO: 1461435 - protein, 26 aa, Mycobacterium tuberculosis
RDGRDAGRRRPPVLSEAEFLARREAV

SEQ ID NO: 1461436 - protein, 17 aa, Mycobacterium tuberculosis
RDIPVLIGGGGERKTLR

SEQ ID NO: 1461437 - protein, 23 aa, Mycobacterium tuberculosis
RDLPCHTGIRLLGGGSHALGRVN

SEQ ID NO: 1461438 - protein, 20 aa, Mycobacterium tuberculosis
RDLTAPPVWFIKTIGDAVML

SEQ ID NO: 1461439 - protein, 22 aa, Mycobacterium tuberculosis
RELERGGFRMAVDAAVQAAKSR

SEQ ID NO: 1461440 - protein, 25 aa, Mycobacterium tuberculosis
RELHVVNVLPRRGIGKVDRAALVRR

SEQ ID NO: 1461441 - protein, 20 aa, Mycobacterium tuberculosis
REQPLPLGLRRLLTDLHNAG

SEQ ID NO: 1461442 - protein, 18 aa, Mycobacterium tuberculosis
RERVAPLIAKYRLAGDHR

SEQ ID NO: 1461443 - protein, 18 aa, Mycobacterium tuberculosis
RERWRIVLVDEFQDTDPM

SEQ ID NO: 1461444 - protein, 17 aa, Mycobacterium tuberculosis
REVHCSRATIYRRAGGK

SEQ ID NO: 1461445 - protein, 21 aa, Mycobacterium tuberculosis
RFGSPELQQGWGVSAVSGDRI

SEQ ID NO: 1461446 - protein, 28 aa, Mycobacterium tuberculosis
RFGTELPPLEGIYLAAFAGRPALLSEMT

SEQ ID NO: 1461447 - protein, 21 aa, Mycobacterium tuberculosis
RFLLTAGAIGSLFKERASISG

SEQ ID NO: 1461448 - protein, 25 aa, Mycobacterium tuberculosis
RFVACPFGGSGARMYRTGDLVCWRA

SEQ ID NO: 1461449 - protein, 21 aa, Mycobacterium tuberculosis
RGATALRGIWGFYGDHKPHGD

SEQ ID NO: 1461450 - protein, 24 aa, Mycobacterium tuberculosis
RGERDAVAGRRCGGLVRAVNDLTE

SEQ ID NO: 1461451 - protein, 23 aa, Mycobacterium tuberculosis
RGGGAALPFKRRLFGQIVAAAVR

SEQ ID NO: 1461452 - protein, 17 aa, Mycobacterium tuberculosis
RGGYAGMLVGSVGETVA

SEQ ID NO: 1461453 - protein, 24 aa, Mycobacterium tuberculosis
RGHPMWECYIIDGIERGRIAILLK

SEQ ID NO: 1461454 - protein, 17 aa, Mycobacterium tuberculosis
RGINIPVVDHATGRVAV

SEQ ID NO: 1461455 - protein, 18 aa, Mycobacterium tuberculosis
RGKDRPVLVVGRDRSVLL

SEQ ID NO: 1461456 - protein, 26 aa, Mycobacterium tuberculosis
RGRLPVVAGCVFRYIAYHGRSRENGY

SEQ ID NO: 1461457 - protein, 18 aa, Mycobacterium tuberculosis
RGYPRAVNNLALQALVAA

SEQ ID NO: 1461458 - protein, 19 aa, Mycobacterium tuberculosis
RHGKELTWSQVLMAANTPM

SEQ ID NO: 1461459 - protein, 17 aa, Mycobacterium tuberculosis
RHHTVLKGLGRKVGEAP

SEQ ID NO: 1461460 - protein, 23 aa, Mycobacterium tuberculosis
RIDHIIGLFRLWWIPDGAPPTQG

SEQ ID NO: 1461461 - protein, 22 aa, Mycobacterium tuberculosis
RINGVNRLACKVLMRDLLPKKK

SEQ ID NO: 1461462 - protein, 20 aa, Mycobacterium tuberculosis
RINHAYLFSGPRGCGKTSSA

SEQ ID NO: 1461463 - protein, 27 aa, Mycobacterium tuberculosis
RIRARVAAALPEYMLPAAYVVLDEIPI

SEQ ID NO: 1461464 - protein, 20 aa, Mycobacterium tuberculosis
RISGAKAWLGTALALKPLLS

SEQ ID NO: 1461465 - protein, 25 aa, Mycobacterium tuberculosis
RIVVLGDAWELLKFFNDDQYVIDPK

SEQ ID NO: 1461466 - protein, 19 aa, Mycobacterium tuberculosis
RKHPHSMGEWSMASRTHVA

SEQ ID NO: 1461467 - protein, 25 aa, Mycobacterium tuberculosis
RKRDIYKFAAGSVFSRPFQGGILDV

SEQ ID NO: 1461468 - protein, 18 aa, Mycobacterium tuberculosis
RKRLAGKGVDAHRIEIPD

SEQ ID NO: 1461469 - protein, 17 aa, Mycobacterium tuberculosis
RLAGLVAHQEVLFGTEG

SEQ ID NO: 1461470 - protein, 22 aa, Mycobacterium tuberculosis
RLAKRIAAIVASAIEYEIKDPG

SEQ ID NO: 1461471 - protein, 18 aa, Mycobacterium tuberculosis
RLAQLRPGDPILGEEGGG

SEQ ID NO: 1461472 - protein, 21 aa, Mycobacterium tuberculosis
RLDAEILALVKRRAEVSKAIG

SEQ ID NO: 1461473 - protein, 24 aa, Mycobacterium tuberculosis
RLGDVRLAERLARAALDRSDALAA

SEQ ID NO: 1461474 - protein, 20 aa, Mycobacterium tuberculosis
RLGLILEIAAAAGLIASGMP

SEQ ID NO: 1461475 - protein, 25 aa, Mycobacterium tuberculosis
RLGRPEELAGLYLYLASEASSYMTG

SEQ ID NO: 1461476 - protein, 26 aa, Mycobacterium tuberculosis
RLHNGTVYRWNRPVYDVVDGRPHLRL

SEQ ID NO: 1461477 - protein, 19 aa, Mycobacterium tuberculosis
RLNQNYLRDIRLIRRGKID

SEQ ID NO: 1461478 - protein, 21 aa, Mycobacterium tuberculosis
RLRAEAFTTPELMSAAEIADE

SEQ ID NO: 1461479 - protein, 24 aa, Mycobacterium tuberculosis
RLRDGRWHWHWDPAMMTAPGHDPQ

SEQ ID NO: 1461480 - protein, 19 aa, Mycobacterium tuberculosis
RLRWKGYLKPGSRDDASEI

SEQ ID NO: 1461481 - protein, 19 aa, Mycobacterium tuberculosis
RLSLTDFPPNFNILHIDGN

SEQ ID NO: 1461482 - protein, 20 aa, Mycobacterium tuberculosis
RLSSLVGHGRARAMLLSAEK

SEQ ID NO: 1461483 - protein, 23 aa, Mycobacterium tuberculosis
RLVKEGKPAFAVVGVDGGNTYWH

SEQ ID NO: 1461484 - protein, 25 aa, Mycobacterium tuberculosis
RLWQRLCTELELPALHVPPEHGGLG

SEQ ID NO: 1461485 - protein, 22 aa, Mycobacterium tuberculosis
RMASLRGLLKFRTGVRPPVPLD

SEQ ID NO: 1461486 - protein, 19 aa, Mycobacterium tuberculosis
RMYCGPGSGPMLAAAAAWD

SEQ ID NO: 1461487 - protein, 23 aa, Mycobacterium tuberculosis
RNQIELFTALLLSLPGSPVLYYG

SEQ ID NO: 1461488 - protein, 18 aa, Mycobacterium tuberculosis
RNVSRGLVDVALFAIAQV

SEQ ID NO: 1461489 - protein, 20 aa, Mycobacterium tuberculosis
RPFDAIALVSVRLCHVQTDP

SEQ ID NO: 1461490 - protein, 19 aa, Mycobacterium tuberculosis
RPHLRLENRVLPAGPTVVD

SEQ ID NO: 1461491 - protein, 18 aa, Mycobacterium tuberculosis
RPLPSAWLNYAALDVELL

SEQ ID NO: 1461492 - protein, 25 aa, Mycobacterium tuberculosis
RPQSAPFDLCIEAMGAIDTQQRLGV

SEQ ID NO: 1461493 - protein, 19 aa, Mycobacterium tuberculosis
RPVHDPARYDQIWKDHVLA

SEQ ID NO: 1461494 - protein, 20 aa, Mycobacterium tuberculosis
RQALADGIIDCVATDHAPHA

SEQ ID NO: 1461495 - protein, 25 aa, Mycobacterium tuberculosis
RQHAPTLDGARDWARQQIDALPPEL

SEQ ID NO: 1461496 - protein, 24 aa, Mycobacterium tuberculosis
RQLNAVAVAAGWRNDDGGEFLDNY

SEQ ID NO: 1461497 - protein, 25 aa, Mycobacterium tuberculosis
RQLVELVCFHAAIVLGRKSSHDIDP

SEQ ID NO: 1461498 - protein, 22 aa, Mycobacterium tuberculosis
RRANVPITRRGGLSFDLRRINP

SEQ ID NO: 1461499 - protein, 21 aa, Mycobacterium tuberculosis
RRAVLCGNIGSAVLDVLDEPA

SEQ ID NO: 1461500 - protein, 18 aa, Mycobacterium tuberculosis
RRFRDAFTATAHFQVNEA

SEQ ID NO: 1461501 - protein, 20 aa, Mycobacterium tuberculosis
RRGIGKVDRAALVRRFAGEA

SEQ ID NO: 1461502 - protein, 23 aa, Mycobacterium tuberculosis
RRHLSYKTGWYGSQLVVADRWFP

SEQ ID NO: 1461503 - protein, 20 aa, Mycobacterium tuberculosis
RRKAYNWTVATLKADIQAWH

SEQ ID NO: 1461504 - protein, 19 aa, Mycobacterium tuberculosis
RRLALLLTFPRFLPTTGPI

SEQ ID NO: 1461505 - protein, 22 aa, Mycobacterium tuberculosis
RRLARECPVEADLVIGVPESGT

SEQ ID NO: 1461506 - protein, 18 aa, Mycobacterium tuberculosis
RRLLSWARAAGFDDVTPT

SEQ ID NO: 1461507 - protein, 20 aa, Mycobacterium tuberculosis
RRLPEELARVDALLDDPAFF

SEQ ID NO: 1461508 - protein, 20 aa, Mycobacterium tuberculosis
RRLREMRDLLAYMENVVSDA

SEQ ID NO: 1461509 - protein, 25 aa, Mycobacterium tuberculosis
RRMRQEITEVIALQERLGLDVLVHG

SEQ ID NO: 1461510 - protein, 20 aa, Mycobacterium tuberculosis
RRPAYVVVMDALRRMEYRGY

SEQ ID NO: 1461511 - protein, 20 aa, Mycobacterium tuberculosis
RRRCRAKRWGGAAPVTRAGD

SEQ ID NO: 1461512 - protein, 18 aa, Mycobacterium tuberculosis
RRRIPLVAEISNFDPEAP

SEQ ID NO: 1461513 - protein, 18 aa, Mycobacterium tuberculosis
RRSFWIQREHLLQAIKDV

SEQ ID NO: 1461514 - protein, 17 aa, Mycobacterium tuberculosis
RRSPNCSPWPPPLTSHP

SEQ ID NO: 1461515 - protein, 20 aa, Mycobacterium tuberculosis
RRVIHAAAPCPVQIKEQMIH

SEQ ID NO: 1461516 - protein, 24 aa, Mycobacterium tuberculosis
RSGEEMARLFAWCPEAVTAAAELG

SEQ ID NO: 1461517 - protein, 25 aa, Mycobacterium tuberculosis
RSIAREGLLPGGLRVRRRAKVWYDR

SEQ ID NO: 1461518 - protein, 20 aa, Mycobacterium tuberculosis
RSLAHAVLMMIPEAWERHES

SEQ ID NO: 1461519 - protein, 19 aa, Mycobacterium tuberculosis
RSLEHLVDVVLHFEGDRNG

SEQ ID NO: 1461520 - protein, 23 aa, Mycobacterium tuberculosis
RSLNATKVFAWPDAEVAVMGAKA

SEQ ID NO: 1461521 - protein, 22 aa, Mycobacterium tuberculosis
RSLPAVGIDGVYAACDADGRVI

SEQ ID NO: 1461522 - protein, 21 aa, Mycobacterium tuberculosis
RSLRVRLGIHPVYKTVDTCAA

SEQ ID NO: 1461523 - protein, 23 aa, Mycobacterium tuberculosis
RSPWLRTGDLGFIVGDEFYIVGR

SEQ ID NO: 1461524 - protein, 27 aa, Mycobacterium tuberculosis
RSSKEPGRFCWRDKWHRSAYYTTAHLI

SEQ ID NO: 1461525 - protein, 19 aa, Mycobacterium tuberculosis
RSYAASVHRATRPGATLLL

SEQ ID NO: 1461526 - protein, 25 aa, Mycobacterium tuberculosis
RSYYADFEGVLAFLQRKMSQTESEQ

SEQ ID NO: 1461527 - protein, 20 aa, Mycobacterium tuberculosis
RTATHLPLRLVYSDGTATGA

SEQ ID NO: 1461528 - protein, 22 aa, Mycobacterium tuberculosis
RTGGADAGWHLKLPAGPDKRTE

SEQ ID NO: 1461529 - protein, 18 aa, Mycobacterium tuberculosis
RTKIDNICYEMGQCELSI

SEQ ID NO: 1461530 - protein, 26 aa, Mycobacterium tuberculosis
RVAEPPCAQLAALVRCVGPVEAADRV

SEQ ID NO: 1461531 - protein, 26 aa, Mycobacterium tuberculosis
RVGYFRFELDAGLWLLATGSESELGL

SEQ ID NO: 1461532 - protein, 17 aa, Mycobacterium tuberculosis
RVLLVLDHCEHLLDACA

SEQ ID NO: 1461533 - protein, 26 aa, Mycobacterium tuberculosis
RVPCLPSDRLLNLLIYIKGYLDGTLT

SEQ ID NO: 1461534 - protein, 20 aa, Mycobacterium tuberculosis
RVVAFVGRIQPLKAPDIVLR

SEQ ID NO: 1461535 - protein, 17 aa, Mycobacterium tuberculosis
RVVNPRWMAAMRRHGYK

SEQ ID NO: 1461536 - protein, 23 aa, Mycobacterium tuberculosis
RWMAAMRRHGYKGAFEMAATVDY

SEQ ID NO: 1461537 - protein, 18 aa, Mycobacterium tuberculosis
RWREYCLSSVTTHDLPPT

SEQ ID NO: 1461538 - protein, 26 aa, Mycobacterium tuberculosis
RYGPAFRGLTAMWARGEEIFAEVRLP

SEQ ID NO: 1461539 - protein, 18 aa, Mycobacterium tuberculosis
RYIDYWGTAVTAFDLHAP

SEQ ID NO: 1461540 - protein, 18 aa, Mycobacterium tuberculosis
SAADPFVIALAMVNNATV

SEQ ID NO: 1461541 - protein, 28 aa, Mycobacterium tuberculosis
SAADWEVLEAGLVQRSRLLDAILADLYG

SEQ ID NO: 1461542 - protein, 20 aa, Mycobacterium tuberculosis
SAAVARQQVAPWWRRRPHRS

SEQ ID NO: 1461543 - protein, 18 aa, Mycobacterium tuberculosis
SAELRWVAENEVADLPLH

SEQ ID NO: 1461544 - protein, 21 aa, Mycobacterium tuberculosis
SAKPRGFLTGRITGAQTGAVL

SEQ ID NO: 1461545 - protein, 20 aa, Mycobacterium tuberculosis
SALDDGYRVFAELSPHPLLT

SEQ ID NO: 1461546 - protein, 25 aa, Mycobacterium tuberculosis
SALQPLWSQGRMREGLAWLESILER

SEQ ID NO: 1461547 - protein, 24 aa, Mycobacterium tuberculosis
SAQACAWLASAIETAYCAPPPVRR

SEQ ID NO: 1461548 - protein, 23 aa, Mycobacterium tuberculosis
SARVAELRPVYLPPDPASRTTYV

SEQ ID NO: 1461549 - protein, 22 aa, Mycobacterium tuberculosis
SCAKAQALVAERGFEITTAAGG

SEQ ID NO: 1461550 - protein, 18 aa, Mycobacterium tuberculosis
SCLSRCCRLDCRRRGPAV

SEQ ID NO: 1461551 - protein, 20 aa, Mycobacterium tuberculosis
SCPAEKRRDMLFDHVGALAA

SEQ ID NO: 1461552 - protein, 24 aa, Mycobacterium tuberculosis
SCTPEALRAFGIRECADAARALDN

SEQ ID NO: 1461553 - protein, 24 aa, Mycobacterium tuberculosis
SDAARRWPDRLAVADAGDRPGHGG

SEQ ID NO: 1461554 - protein, 27 aa, Mycobacterium tuberculosis
SDALAARLPLAYALGWQGRGREADAVL

SEQ ID NO: 1461555 - protein, 17 aa, Mycobacterium tuberculosis
SDDRYLCINPFFHNFGY

SEQ ID NO: 1461556 - protein, 20 aa, Mycobacterium tuberculosis
SDEFSGVVVLTGSNTGTPHQ

SEQ ID NO: 1461557 - protein, 21 aa, Mycobacterium tuberculosis
SDGRGPVLVHALEGFSDAGHA

SEQ ID NO: 1461558 - protein, 20 aa, Mycobacterium tuberculosis
SDHVLQHWTVDISIDEHEGL

SEQ ID NO: 1461559 - protein, 28 aa, Mycobacterium tuberculosis
SDLAVLGYYEWREGLLRGLAAHHAGMLP

SEQ ID NO: 1461560 - protein, 24 aa, Mycobacterium tuberculosis
SDNTRWTNNFAILAGDYRFATASQ

SEQ ID NO: 1461561 - protein, 19 aa, Mycobacterium tuberculosis
SDPRGGYPPETGGYPPQPG

SEQ ID NO: 1461562 - protein, 18 aa, Mycobacterium tuberculosis
SDRPRSVIWVTGRGTAET

SEQ ID NO: 1461563 - protein, 20 aa, Mycobacterium tuberculosis
SEGMPGSLVHRLRTQYRDYV

SEQ ID NO: 1461564 - protein, 23 aa, Mycobacterium tuberculosis
SEHRVWRADTEIRLSHKEFTLLE

SEQ ID NO: 1461565 - protein, 17 aa, Mycobacterium tuberculosis
SELRWPGDPSLDAGIDV

SEQ ID NO: 1461566 - protein, 17 aa, Mycobacterium tuberculosis
SETFPGLAGLGDLIVTC

SEQ ID NO: 1461567 - protein, 19 aa, Mycobacterium tuberculosis
SGAPEHRAAAIVKATTFFD

SEQ ID NO: 1461568 - protein, 25 aa, Mycobacterium tuberculosis
SGELPQRHIGVGWAALRSLPPPAPQ

SEQ ID NO: 1461569 - protein, 25 aa, Mycobacterium tuberculosis
SGILNRGAGISGVYNTGALGVVTAA

SEQ ID NO: 1461570 - protein, 26 aa, Mycobacterium tuberculosis
SGKQRSRLALWSRRLLGEAITQAQLV

SEQ ID NO: 1461571 - protein, 24 aa, Mycobacterium tuberculosis
SGKVRRAECVKLYRHNEFTRLDAK

SEQ ID NO: 1461572 - protein, 25 aa, Mycobacterium tuberculosis
SGLDSRAYRLPWPTRTVVYEIDQPK

SEQ ID NO: 1461573 - protein, 19 aa, Mycobacterium tuberculosis
SGQEPFVFHGQFTPDRVGL

SEQ ID NO: 1461574 - protein, 17 aa, Mycobacterium tuberculosis
SGSSRDWAAKGTLLLGV

SEQ ID NO: 1461575 - protein, 17 aa, Mycobacterium tuberculosis
SGTPGADFHPSLDTSAI

SEQ ID NO: 1461576 - protein, 26 aa, Mycobacterium tuberculosis
SGVELRNRLQMAIGLPGLSLPRTLIF

SEQ ID NO: 1461577 - protein, 20 aa, Mycobacterium tuberculosis
SHVYPTGASLYFTVVAGQRG

SEQ ID NO: 1461578 - protein, 35 aa, Mycobacterium tuberculosis; identical to SEQ ID NO: 206461

SEQ ID NO: 1461579 - protein, 25 aa, Mycobacterium tuberculosis
SKARAGGLVEGRRLTKVLGLPGPHR

SEQ ID NO: 1461580 - protein, 20 aa, Mycobacterium tuberculosis
SKRIAPIVVLTAFSQRDLVE

SEQ ID NO: 1461581 - protein, 19 aa, Mycobacterium tuberculosis
SKYRGEFEERLKAVLDDIK

SEQ ID NO: 1461582 - protein, 23 aa, Mycobacterium tuberculosis
SLEAFQSGLSWLIILRKRENFRR

SEQ ID NO: 1461583 - protein, 22 aa, Mycobacterium tuberculosis
SLMDAWAGPVVMQLMEAAKPFV

SEQ ID NO: 1461584 - protein, 19 aa, Mycobacterium tuberculosis
SLRDKRTGLAVLDCAADVV

SEQ ID NO: 1461585 - protein, 20 aa, Mycobacterium tuberculosis
SLRLPRDHYVRCDSNDYSVH

SEQ ID NO: 1461586 - protein, 19 aa, Mycobacterium tuberculosis
SLYGAWSANPFPFLRQIIA

SEQ ID NO: 1461587 - protein, 24 aa, Mycobacterium tuberculosis
SMDTEWPLPLLDLARIASDRGDAE

SEQ ID NO: 1461588 - protein, 22 aa, Mycobacterium tuberculosis
SNVVDALAWVMGEQGAKTLRGG

SEQ ID NO: 1461589 - protein, 18 aa, Mycobacterium tuberculosis
SPGFTLYSLSGHVTRPGQ

SEQ ID NO: 1461590 - protein, 17 aa, Mycobacterium tuberculosis
SQFRGSELIAEKWNLSR

SEQ ID NO: 1461591 - protein, 24 aa, Mycobacterium tuberculosis
SQGRSEVRILFAFDPARQAIMLAA

SEQ ID NO: 1461592 - protein, 19 aa, Mycobacterium tuberculosis
SREIYEAPGAMVLITAHTE

SEQ ID NO: 1461593 - protein, 26 aa, Mycobacterium tuberculosis
SREPIGMAGEITWRVPSMSITDEAVE

SEQ ID NO: 1461594 - protein, 19 aa, Mycobacterium tuberculosis
SRLRGVRDFILNRHAAPPQ

SEQ ID NO: 1461595 - protein, 20 aa, Mycobacterium tuberculosis
SRMGRIAWSWFRHPVKSHEF

SEQ ID NO: 1461596 - protein, 18 aa, Mycobacterium tuberculosis
SRVLKWIVDRIEHKAGGA

SEQ ID NO: 1461597 - protein, 28 aa, Mycobacterium tuberculosis
SRYGIDAHIDRVRWDDVVSRVFGRIDPI

SEQ ID NO: 1461598 - protein, 25 aa, Mycobacterium tuberculosis
SRYLSPRVEVEVGFILAADLPGAGC

SEQ ID NO: 1461599 - protein, 26 aa, Mycobacterium tuberculosis
SSARGVTFSRGWLPFLPTSDPPAHTR

SEQ ID NO: 1461600 - protein, 24 aa, Mycobacterium tuberculosis
SSEPIAIVGMSCRFPGGVDSPEGL

SEQ ID NO: 1461601 - protein, 24 aa, Mycobacterium tuberculosis
SSNSALVVPVRFAGVHVYGDITRG

SEQ ID NO: 1461602 - protein, 24 aa, Mycobacterium tuberculosis
SSSEPIAVIGMGCRFPGGVNNPEQ

SEQ ID NO: 1461603 - protein, 18 aa, Mycobacterium tuberculosis
SSSLVAVHLACQSLRLRE

SEQ ID NO: 1461604 - protein, 32 aa, Mycobacterium tuberculosis; identical to SEQ ID NO: 206717

SEQ ID NO: 1461605 - protein, 17 aa, Mycobacterium tuberculosis
STGLYRYSLLDIIDIAD

SEQ ID NO: 1461606 - protein, 25 aa, Mycobacterium tuberculosis
STLPPEINSALIFGGAGSEPMSAAA

SEQ ID NO: 1461607 - protein, 26 aa, Mycobacterium tuberculosis
SVLAYPRVVWIAGGLLKGASLHAEVA

SEQ ID NO: 1461608 - protein, 23 aa, Mycobacterium tuberculosis
SVTSELTSGAWLGPSAAAMMAVA

SEQ ID NO: 1461609 - protein, 25 aa, Mycobacterium tuberculosis
SYANRFGYNVVRDFTGHGIGTTFHN

SEQ ID NO: 1461610 - protein, 22 aa, Mycobacterium tuberculosis
SYLFQPGHRIRIAIAGADASHF

SEQ ID NO: 1461611 - protein, 37 aa, Mycobacterium tuberculosis
SYQCAIDAMSSRCFPSYALRRRAKALGSLTQMELLMI

SEQ ID NO: 1461612 - protein, 21 aa, Mycobacterium tuberculosis
TAALLARCTGLRTCTTRLTRS

SEQ ID NO: 1461613 - protein, 21 aa, Mycobacterium tuberculosis
TAALSGLVDRFGLAGERLDMV

SEQ ID NO: 1461614 - protein, 19 aa, Mycobacterium tuberculosis
TAEAMYLTSGYVYGSAAVA

SEQ ID NO: 1461615 - protein, 26 aa, Mycobacterium tuberculosis
TAFAESVPMWGPRGAALIQAIPEATQ

SEQ ID NO: 1461616 - protein, 18 aa, Mycobacterium tuberculosis
TAFFDEYFLATADAGVRQ

SEQ ID NO: 1461617 - protein, 25 aa, Mycobacterium tuberculosis
TAGCVIGGTAWDFANGNRVPKASLD

SEQ ID NO: 1461618 - protein, 17 aa, Mycobacterium tuberculosis
TAHWYGRTLHFGVREHA

SEQ ID NO: 1461619 - protein, 24 aa, Mycobacterium tuberculosis
TAIQARAAALAFEQAYAMTLPPPV

SEQ ID NO: 1461620 - protein, 23 aa, Mycobacterium tuberculosis
TAKRLGANPGRCVVIDSCQTGLR

SEQ ID NO: 1461621 - protein, 20 aa, Mycobacterium tuberculosis
TALDLARRYPVGKAVAAIDA

SEQ ID NO: 1461622 - protein, 19 aa, Mycobacterium tuberculosis
TAPLKEWVEPNAVKLDPAK

SEQ ID NO: 1461623 - protein, 19 aa, Mycobacterium tuberculosis
TAVGMPTFAGRAIAASLGL

SEQ ID NO: 1461624 - protein, 17 aa, Mycobacterium tuberculosis
TAVRRRVTWAFHDRRGR

SEQ ID NO: 1461625 - protein, 21 aa, Mycobacterium tuberculosis
TCSPTRYGGVKGAHRIDLDAI

SEQ ID NO: 1461626 - protein, 20 aa, Mycobacterium tuberculosis
TDADGGPALVEFAGRACYQS

SEQ ID NO: 1461627 - protein, 25 aa, Mycobacterium tuberculosis
TDELDFLRLAVFDALLVLQADTAPV

SEQ ID NO: 1461628 - protein, 24 aa, Mycobacterium tuberculosis
TDMFWPGWRMAPSPAQLAFLQQVD

SEQ ID NO: 1461629 - protein, 19 aa, Mycobacterium tuberculosis
TDMVLRLAAGMERRTTHGG

SEQ ID NO: 1461630 - protein, 17 aa, Mycobacterium tuberculosis
TDVAIMLGLAYVLATES

SEQ ID NO: 1461631 - protein, 22 aa, Mycobacterium tuberculosis
TEAELRAIVDIAARHGARVIAD

SEQ ID NO: 1461632 - protein, 25 aa, Mycobacterium tuberculosis
TEALTNWYVRRSRSRFWAEDADAID

SEQ ID NO: 1461633 - protein, 22 aa, Mycobacterium tuberculosis
TEELPAYCAVALAGLDDLPDTI

SEQ ID NO: 1461634 - protein, 18 aa, Mycobacterium tuberculosis
TELVYRYLDTEAIAVVQG

SEQ ID NO: 1461635 - protein, 28 aa, Mycobacterium tuberculosis
TEPGYRPSVKLAAFVRARDLTCRAPGCD

SEQ ID NO: 1461636 - protein, 21 aa, Mycobacterium tuberculosis
TEQSLRFTAALDELLAPLAEP

SEQ ID NO: 1461637 - protein, 37 aa, Mycobacterium tuberculosis; identical to SEQ ID NO: 206975

SEQ ID NO: 1461638 - protein, 18 aa, Mycobacterium tuberculosis
TFETEFFARHGFTEIEGT

SEQ ID NO: 1461639 - protein, 19 aa, Mycobacterium tuberculosis
TFQRCKLNWAEAGSGEHAR

SEQ ID NO: 1461640 - protein, 23 aa, Mycobacterium tuberculosis
TFSEAYKNAALDVMNKMRALNQF

SEQ ID NO: 1461641 - protein, 17 aa, Mycobacterium tuberculosis
TGAAVALMVLRAAVAAL

SEQ ID NO: 1461642 - protein, 29 aa, Mycobacterium tuberculosis
TGAVYAELAAQGWGGRWLVVGADVDPGRL

SEQ ID NO: 1461643 - protein, 20 aa, Mycobacterium tuberculosis
TGHVLLPGFVDLHTHLREPG

SEQ ID NO: 1461644 - protein, 18 aa, Mycobacterium tuberculosis
TGKPHGWIHDELRRRCGG

SEQ ID NO: 1461645 - protein, 17 aa, Mycobacterium tuberculosis
TGRRWFDEHGISFTRHY

SEQ ID NO: 1461646 - protein, 20 aa, Mycobacterium tuberculosis
TGVAFAFGPGVTVEGMLFDI

SEQ ID NO: 1461647 - protein, 20 aa, Mycobacterium tuberculosis
TISRRVREALAMAESDPSHP

SEQ ID NO: 1461648 - protein, 30 aa, Mycobacterium tuberculosis; identical to SEQ ID NO: 207105

SEQ ID NO: 1461649 - protein, 25 aa, Mycobacterium tuberculosis
TKNSEVSTVWTWPDKPGVAGCAAMD

SEQ ID NO: 1461650 - protein, 17 aa, Mycobacterium tuberculosis
TKRSETFTTADDNQPSV

SEQ ID NO: 1461651 - protein, 22 aa, Mycobacterium tuberculosis
TKRSLNHWYRMFGPAFETSLGL

SEQ ID NO: 1461652 - protein, 23 aa, Mycobacterium tuberculosis
TLDALVSLVLDWHRPVKIFVETK

SEQ ID NO: 1461653 - protein, 18 aa, Mycobacterium tuberculosis
TLQGAGWTTAAPHGAAGT

SEQ ID NO: 1461654 - protein, 20 aa, Mycobacterium tuberculosis
TLSTLTWRVVTNATKLPGLR

SEQ ID NO: 1461655 - protein, 25 aa, Mycobacterium tuberculosis
TLVRMAQPWSLRYPLVDGQGNFGSP

SEQ ID NO: 1461656 - protein, 18 aa, Mycobacterium tuberculosis
TMRGLKTLVLRMQRHSEN

SEQ ID NO: 1461657 - protein, 19 aa, Mycobacterium tuberculosis
TMVVTGLHLLGGARADATR

SEQ ID NO: 1461658 - protein, 18 aa, Mycobacterium tuberculosis
TNMPGVFPQIGGFANTPP

SEQ ID NO: 1461659 - protein, 34 aa, Mycobacterium tuberculosis; identical to SEQ ID NO: 207202

SEQ ID NO: 1461660 - protein, 17 aa, Mycobacterium tuberculosis
TPLRLGASLLIRAARPV

SEQ ID NO: 1461661 - protein, 20 aa, Mycobacterium tuberculosis
TPLVGRLLMYEALDATYHQI

SEQ ID NO: 1461662 - protein, 23 aa, Mycobacterium tuberculosis
TQIPANLLGQMALGSMTGGALGA

SEQ ID NO: 1461663 - protein, 29 aa, Mycobacterium tuberculosis
TRVEFWAFDLLYLDGRALLGTRYQDRRKL

SEQ ID NO: 1461664 - protein, 19 aa, Mycobacterium tuberculosis
TRWWTEIARVLRAGGSYFA

SEQ ID NO: 1461665 - protein, 26 aa, Mycobacterium tuberculosis
TSCDAFEHFPPPILKPVILAAKSATL

SEQ ID NO: 1461666 - protein, 17 aa, Mycobacterium tuberculosis
TSPELATLMAHVKLGLK

SEQ ID NO: 1461667 - protein, 24 aa, Mycobacterium tuberculosis
TSVRMPLTLNIPAGIPLEPGIYEW

SEQ ID NO: 1461668 - protein, 18 aa, Mycobacterium tuberculosis
TTTVARLLALVAEQAELA

SEQ ID NO: 1461669 - protein, 25 aa, Mycobacterium tuberculosis
TTVLKAINWFGQFSTRIADKEADYE

SEQ ID NO: 1461670 - protein, 23 aa, Mycobacterium tuberculosis
TTWPAHLRPALTTAGFATELRNL

SEQ ID NO: 1461671 - protein, 24 aa, Mycobacterium tuberculosis
TVAEPGALIGFLGPRVYELLYGDP

SEQ ID NO: 1461672 - protein, 27 aa, Mycobacterium tuberculosis
TVDAAWRPDTVWRYRLGSGESSERVYH

SEQ ID NO: 1461673 - protein, 20 aa, Mycobacterium tuberculosis
TVFVCPSVYEPLGIVNLEAM

SEQ ID NO: 1461674 - protein, 24 aa, Mycobacterium tuberculosis
TVPDNMGMLFRKHLVMFGPREVLL

SEQ ID NO: 1461675 - protein, 26 aa, Mycobacterium tuberculosis
TVPPGRLGWGWARFAFTSWKTLGWVD

SEQ ID NO: 1461676 - protein, 25 aa, Mycobacterium tuberculosis
TVVFPDAPVKIFLTASAETRARRRN

SEQ ID NO: 1461677 - protein, 19 aa, Mycobacterium tuberculosis
TWCALAETYGDDWHRWPKS

SEQ ID NO: 1461678 - protein, 19 aa, Mycobacterium tuberculosis
TWPELIPLLQSGRLDVDGI

SEQ ID NO: 1461679 - protein, 24 aa, Mycobacterium tuberculosis
TWRSATCRVLAAATGARTANAGPV

SEQ ID NO: 1461680 - protein, 30 aa, Mycobacterium tuberculosis; identical to SEQ ID NO: 207425

SEQ ID NO: 1461681 - protein, 17 aa, Mycobacterium tuberculosis
VAAMPGLLQRLSSAASV

SEQ ID NO: 1461682 - protein, 32 aa, Mycobacterium tuberculosis; identical to SEQ ID NO: 207454

SEQ ID NO: 1461683 - protein, 17 aa, Mycobacterium tuberculosis
VAARILAEFPDYLTEEQ

SEQ ID NO: 1461684 - protein, 18 aa, Mycobacterium tuberculosis
VAAVPLMLEHSGGGSVIN

SEQ ID NO: 1461685 - protein, 36 aa, Mycobacterium tuberculosis; identical to SEQ ID NO: 207467

SEQ ID NO: 1461686 - protein, 24 aa, Mycobacterium tuberculosis
VAGHSMGGITIAAWSDRYRHKVRR

SEQ ID NO: 1461687 - protein, 20 aa, Mycobacterium tuberculosis
VAGVPADMGGSFIGPTQDAV

SEQ ID NO: 1461688 - protein, 19 aa, Mycobacterium tuberculosis
VANALYWLQEFHIDGLRVD

SEQ ID NO: 1461689 - protein, 17 aa, Mycobacterium tuberculosis
VAPRAAAVVGTRAATAY

SEQ ID NO: 1461690 - protein, 17 aa, Mycobacterium tuberculosis
VARAVEEIVRFNPATEI

SEQ ID NO: 1461691 - protein, 23 aa, Mycobacterium tuberculosis
VAREDSEFAVLRRQIAVGGQVLQ

SEQ ID NO: 1461692 - protein, 25 aa, Mycobacterium tuberculosis
VARQEPRLNWAVGVHADGTTVLVTD

SEQ ID NO: 1461693 - protein, 24 aa, Mycobacterium tuberculosis
VARRRPPAGDGWRKAVTKMTFGRV

SEQ ID NO: 1461694 - protein, 22 aa, Mycobacterium tuberculosis
VARSLLDYRYRRLPAARRAAHR

SEQ ID NO: 1461695 - protein, 23 aa, Mycobacterium tuberculosis
VARVRRAVVRVGEGFKVTTPKSD

SEQ ID NO: 1461696 - protein, 18 aa, Mycobacterium tuberculosis
VATRFCAFDSGGLADAVA

SEQ ID NO: 1461697 - protein, 23 aa, Mycobacterium tuberculosis
VDAEGFPVFSGRKDAVVKISGKR

SEQ ID NO: 1461698 - protein, 17 aa, Mycobacterium tuberculosis
VDAELALRVRGWPSMTR

SEQ ID NO: 1461699 - protein, 24 aa, Mycobacterium tuberculosis
VDAKPAQVALAWLISLPGVVAIPG

SEQ ID NO: 1461700 - protein, 23 aa, Mycobacterium tuberculosis
VDEGGRRVGARIVVVTHLATDAA

SEQ ID NO: 1461701 - protein, 28 aa, Mycobacterium tuberculosis
VDGRSHAWVQAWTGGWWHYDPTNDNEIT

SEQ ID NO: 1461702 - protein, 17 aa, Mycobacterium tuberculosis
VDGTSWITGADQPGRHV

SEQ ID NO: 1461703 - protein, 28 aa, Mycobacterium tuberculosis
VDPARLVLDPGLGFAKTAQHNWAILHAL

SEQ ID NO: 1461704 - protein, 24 aa, Mycobacterium tuberculosis
VDPDRPLPEYGLDSLGALELRTRI

SEQ ID NO: 1461705 - protein, 17 aa, Mycobacterium tuberculosis
VDPLRGLSRPDFDHDGE

SEQ ID NO: 1461706 - protein, 22 aa, Mycobacterium tuberculosis
VDPRAQILSAWIAKEELRTLLS

SEQ ID NO: 1461707 - protein, 25 aa, Mycobacterium tuberculosis
VDRTLRVAWSLADLAGRTSPGIDEV

SEQ ID NO: 1461708 - protein, 24 aa, Mycobacterium tuberculosis
VDTEIPSPVAGVLVSISADEDATV

SEQ ID NO: 1461709 - protein, 17 aa, Mycobacterium tuberculosis
VDTGAFITGNYSNGLFL

SEQ ID NO: 1461710 - protein, 17 aa, Mycobacterium tuberculosis
VDTGAFITGSYSNGFLV

SEQ ID NO: 1461711 - protein, 24 aa, Mycobacterium tuberculosis
VDVAPRVAQIFGVQAVPTVVALAA

SEQ ID NO: 1461712 - protein, 33 aa, Mycobacterium tuberculosis; identical to SEQ ID NO: 207648

SEQ ID NO: 1461713 - protein, 17 aa, Mycobacterium tuberculosis
VEIGRRLARECPVEADL

SEQ ID NO: 1461714 - protein, 21 aa, Mycobacterium tuberculosis
VELLRQAWLTATRARNALVLV

SEQ ID NO: 1461715 - protein, 33 aa, Mycobacterium tuberculosis; identical to SEQ ID NO: 207700

SEQ ID NO: 1461716 - protein, 20 aa, Mycobacterium tuberculosis
VEVASFAVLRDWGVLPDFVM

SEQ ID NO: 1461717 - protein, 22 aa, Mycobacterium tuberculosis
VFPEATMCRLGVPLRQVAEPVD

SEQ ID NO: 1461718 - protein, 19 aa, Mycobacterium tuberculosis
VFRECRPENVIAIDAVPSF

SEQ ID NO: 1461719 - protein, 17 aa, Mycobacterium tuberculosis
VFVDHGLLRAGERAQVQ

SEQ ID NO: 1461720 - protein, 25 aa, Mycobacterium tuberculosis
VGAERAVWVGHDWGAVVVWNAPLLH

SEQ ID NO: 1461721 - protein, 24 aa, Mycobacterium tuberculosis
VGARQRLMCRLPKRPDPHAWLGDA

SEQ ID NO: 1461722 - protein, 21 aa, Mycobacterium tuberculosis
VGDAFPLSSLTQIYASDGESN

SEQ ID NO: 1461723 - protein, 23 aa, Mycobacterium tuberculosis
VGDPGLVVAVWDRRLHTGAHAAG

SEQ ID NO: 1461724 - protein, 17 aa, Mycobacterium tuberculosis
VGGELAVIGDAKDAGEA

SEQ ID NO: 1461725 - protein, 24 aa, Mycobacterium tuberculosis
VGGLTLGGGVGWTTRRFGLSCDNL

SEQ ID NO: 1461726 - protein, 25 aa, Mycobacterium tuberculosis
VGHRIRAAIHFDDLQWERRYRRVAA

SEQ ID NO: 1461727 - protein, 18 aa, Mycobacterium tuberculosis
VGIREFVDDGAIDPDHAS

SEQ ID NO: 1461728 - protein, 17 aa, Mycobacterium tuberculosis
VGLARSFLEEVVTVELG

SEQ ID NO: 1461729 - protein, 18 aa, Mycobacterium tuberculosis
VGSGHSFTDIACTDGVMI

SEQ ID NO: 1461730 - protein, 19 aa, Mycobacterium tuberculosis
VHGPLALAVGRRLRDRYGI

SEQ ID NO: 1461731 - protein, 23 aa, Mycobacterium tuberculosis
VHGRSGPIPVRRTHEMTGITESF

SEQ ID NO: 1461732 - protein, 18 aa, Mycobacterium tuberculosis
VHPDVWELAGHVSPNPGG

SEQ ID NO: 1461733 - protein, 19 aa, Mycobacterium tuberculosis
VIAALRAGNLVLMVQPPRG

SEQ ID NO: 1461734 - protein, 25 aa, Mycobacterium tuberculosis
VIAENRAELMILIATNLLGQNTPAI

SEQ ID NO: 1461735 - protein, 22 aa, Mycobacterium tuberculosis
VIDELRELANVLGVARDAEVLG

SEQ ID NO: 1461736 - protein, 21 aa, Mycobacterium tuberculosis
VIDEYRLVYRADSLVNWCPGL

SEQ ID NO: 1461737 - protein, 21 aa, Mycobacterium tuberculosis
VIDNIRYFAELCGVDRQAADE

SEQ ID NO: 1461738 - protein, 24 aa, Mycobacterium tuberculosis
VIPLLDIPPAPGFGNSTTGPSSGF

SEQ ID NO: 1461739 - protein, 18 aa, Mycobacterium tuberculosis
VKEYARKHPHSMGEWSMA

SEQ ID NO: 1461740 - protein, 18 aa, Mycobacterium tuberculosis
VKPPTWWHSLPTDRPIIY

SEQ ID NO: 1461741 - protein, 17 aa, Mycobacterium tuberculosis
VKQTVAFVKSRDLVLDT

SEQ ID NO: 1461742 - protein, 24 aa, Mycobacterium tuberculosis
VLNARFALNAANARWGSLYDALYG

SEQ ID NO: 1461743 - protein, 18 aa, Mycobacterium tuberculosis
VMFDRIMDLPAEIRNRYD

SEQ ID NO: 1461744 - protein, 18 aa, Mycobacterium tuberculosis
VMNKDRLEMLGAQNDPRS

SEQ ID NO: 1461745 - protein, 28 aa, Mycobacterium tuberculosis
VNAETGTVWWPECSKEAYADGIAGAVDA

SEQ ID NO: 1461746 - protein, 24 aa, Mycobacterium tuberculosis
VNDYYDRSGLWPYLEKLGFYLVGY

SEQ ID NO: 1461747 - protein, 19 aa, Mycobacterium tuberculosis
VNGSWNWSSGCDHASWTFV

SEQ ID NO: 1461748 - protein, 17 aa, Mycobacterium tuberculosis
VNSARMYTGPGAGSLLA

SEQ ID NO: 1461749 - protein, 26 aa, Mycobacterium tuberculosis
VPALPRLGPTDALPRCRQTVHRGAVI

SEQ ID NO: 1461750 - protein, 18 aa, Mycobacterium tuberculosis
VPAYMPFFDVLHVTGRQR

SEQ ID NO: 1461751 - protein, 19 aa, Mycobacterium tuberculosis
VPGGHVFRPDMFRLDLDGI

SEQ ID NO: 1461752 - protein, 17 aa, Mycobacterium tuberculosis
VPHVSFVHGSRGVEYLR

SEQ ID NO: 1461753 - protein, 17 aa, Mycobacterium tuberculosis
VPIVPVVVWGAQRIWTK

SEQ ID NO: 1461754 - protein, 23 aa, Mycobacterium tuberculosis
VPRPELFTLSAQRLLTMARAVVD

SEQ ID NO: 1461755 - protein, 20 aa, Mycobacterium tuberculosis
VQFSCKGANVAPPLTWSSPA

SEQ ID NO: 1461756 - protein, 22 aa, Mycobacterium tuberculosis
VQRRWRCFSQIGVPGDDWPAYT

SEQ ID NO: 1461757 - protein, 24 aa, Mycobacterium tuberculosis
VQTPQPYWYWALDRESIGGSVSAA

SEQ ID NO: 1461758 - protein, 20 aa, Mycobacterium tuberculosis
VQVIRCFLHQLPHHVDLPTR

SEQ ID NO: 1461759 - protein, 19 aa, Mycobacterium tuberculosis
VRFGDCLEGDLVRRDFTTN

SEQ ID NO: 1461760 - protein, 17 aa, Mycobacterium tuberculosis
VRGLRMGTGTSERDERD

SEQ ID NO: 1461761 - protein, 18 aa, Mycobacterium tuberculosis
VRRHLPNVALFHYADYQA

SEQ ID NO: 1461762 - protein, 19 aa, Mycobacterium tuberculosis
VRRQFYWHRFFSHQPDLNY

SEQ ID NO: 1461763 - protein, 22 aa, Mycobacterium tuberculosis
VRRRPYTVVLFDEIEKAHPDVF

SEQ ID NO: 1461764 - protein, 20 aa, Mycobacterium tuberculosis
VRRRVTWAFHDRRGRKIDPQ

SEQ ID NO: 1461765 - protein, 18 aa, Mycobacterium tuberculosis
VRRYSRHLIIPDIGVNGQ

SEQ ID NO: 1461766 - protein, 24 aa, Mycobacterium tuberculosis
VRSREVAAEFAARFANLIGARTQD

SEQ ID NO: 1461767 - protein, 18 aa, Mycobacterium tuberculosis
VRVAHVLSVNLARVRANP

SEQ ID NO: 1461768 - protein, 21 aa, Mycobacterium tuberculosis
VSAALAALFGAHAREYQAAAA

SEQ ID NO: 1461769 - protein, 24 aa, Mycobacterium tuberculosis
VSDLPRLGKSLVGYVTPAAGGDGP

SEQ ID NO: 1461770 - protein, 22 aa, Mycobacterium tuberculosis
VSGLRLRLPVIATALGTYDTAS

SEQ ID NO: 1461771 - protein, 20 aa, Mycobacterium tuberculosis
VSLAELWKSVAVHPDAVIGH

SEQ ID NO: 1461772 - protein, 25 aa, Mycobacterium tuberculosis
VSVTMPGKFAALRFADERTARADLV

SEQ ID NO: 1461773 - protein, 18 aa, Mycobacterium tuberculosis
VTATRARLMAPLSGQGGM

SEQ ID NO: 1461774 - protein, 25 aa, Mycobacterium tuberculosis
VTEAITGLDLVEWQLRVGAGEKLGF

SEQ ID NO: 1461775 - protein, 18 aa, Mycobacterium tuberculosis
VTGIARRLPGRSVGRRIE

SEQ ID NO: 1461776 - protein, 18 aa, Mycobacterium tuberculosis
VTTLPAVISRWLSSVLPG

SEQ ID NO: 1461777 - protein, 25 aa, Mycobacterium tuberculosis
VTTMAACIGGVFRECRPENVIAIDA

SEQ ID NO: 1461778 - protein, 17 aa, Mycobacterium tuberculosis
VVADRWFPSLSVEPTVR

SEQ ID NO: 1461779 - protein, 21 aa, Mycobacterium tuberculosis
VVAEVRADLLASVADAVAAGV

SEQ ID NO: 1461780 - protein, 19 aa, Mycobacterium tuberculosis
VVANRCELSAIPAVTDALR

SEQ ID NO: 1461781 - protein, 21 aa, Mycobacterium tuberculosis
VVEGVKLVDGRAFSVQYHPEA

SEQ ID NO: 1461782 - protein, 17 aa, Mycobacterium tuberculosis
VVHRWRNVGVLDMGWEK

SEQ ID NO: 1461783 - protein, 18 aa, Mycobacterium tuberculosis
VVTDHVWHRGQQVGLVDV

SEQ ID NO: 1461784 - protein, 28 aa, Mycobacterium tuberculosis
VVTFAKPYAEWRGMFAGNGMLLPASMTA

SEQ ID NO: 1461785 - protein, 25 aa, Mycobacterium tuberculosis
VWRTFGQERLDAMASVATVPVINAL

SEQ ID NO: 1461786 - protein, 23 aa, Mycobacterium tuberculosis
VYECAVPVIAAVNGFCVGGGIGL

SEQ ID NO: 1461787 - protein, 21 aa, Mycobacterium tuberculosis
VYFVERLVDCLAFELKMDPAE

SEQ ID NO: 1461788 - protein, 18 aa, Mycobacterium tuberculosis
WAARRDRPGVWLIRDPAQ

SEQ ID NO: 1461789 - protein, 19 aa, Mycobacterium tuberculosis
WAEVRPGPDAQLYRDYHDN

SEQ ID NO: 1461790 - protein, 18 aa, Mycobacterium tuberculosis
WEGFTDAYRDLAFPGGIR

SEQ ID NO: 1461791 - protein, 19 aa, Mycobacterium tuberculosis
WELLEDAFVVPETLRGQPI

SEQ ID NO: 1461792 - protein, 17 aa, Mycobacterium tuberculosis
WELYLAYSEAGFRSGYL

SEQ ID NO: 1461793 - protein, 18 aa, Mycobacterium tuberculosis
WFSYVCPGAGHAPHHVFK

SEQ ID NO: 1461794 - protein, 17 aa, Mycobacterium tuberculosis
WIGEASFVLPADLPLGY

SEQ ID NO: 1461795 - protein, 18 aa, Mycobacterium tuberculosis
WLDPMIALSFAAAASSRV

SEQ ID NO: 1461796 - protein, 22 aa, Mycobacterium tuberculosis
WLEMPIQAGVGITRMDLLERGR

SEQ ID NO: 1461797 - protein, 21 aa, Mycobacterium tuberculosis
WLGDGNFLLLGYQRCRVADGM

SEQ ID NO: 1461798 - protein, 17 aa, Mycobacterium tuberculosis
WLPFLPTSDPPAHTRMR

SEQ ID NO: 1461799 - protein, 20 aa, Mycobacterium tuberculosis
WLRNSTRGALAMDPRRMAMM

SEQ ID NO: 1461800 - protein, 17 aa, Mycobacterium tuberculosis
WMWFVFPQLRGLGSSPL

SEQ ID NO: 1461801 - protein, 23 aa, Mycobacterium tuberculosis
WNCDKGRWAFTYATQPDVITTPL

SEQ ID NO: 1461802 - protein, 19 aa, Mycobacterium tuberculosis
WNFTVPFVCGATNLGEALR

SEQ ID NO: 1461803 - protein, 17 aa, Mycobacterium tuberculosis
WPDPADWLAAVRASPLL

SEQ ID NO: 1461804 - protein, 24 aa, Mycobacterium tuberculosis
WPDREYRPDLDILIAGCGTNQAAI

SEQ ID NO: 1461805 - protein, 17 aa, Mycobacterium tuberculosis
WPPEAQLYVALDDDGER

SEQ ID NO: 1461806 - protein, 20 aa, Mycobacterium tuberculosis
WPTDDAFRRRVFELVDIAFA

SEQ ID NO: 1461807 - protein, 17 aa, Mycobacterium tuberculosis
WPTYPLMYRVSAAHEEG

SEQ ID NO: 1461808 - protein, 26 aa, Mycobacterium tuberculosis
WPVAGRMMGRLGWYVESMLSPRLHRR

SEQ ID NO: 1461809 - protein, 19 aa, Mycobacterium tuberculosis
WQGASAMALNAKMDDWLDA

SEQ ID NO: 1461810 - protein, 19 aa, Mycobacterium tuberculosis
WRAAGELRKGDRVAQPRRF

SEQ ID NO: 1461811 - protein, 31 aa, Mycobacterium tuberculosis; identical to SEQ ID NO: 208595

SEQ ID NO: 1461812 - protein, 20 aa, Mycobacterium tuberculosis
WREWSLRCAALATHPAALDT

SEQ ID NO: 1461813 - protein, 17 aa, Mycobacterium tuberculosis
WRLPGDDVTALRGTAEN

SEQ ID NO: 1461814 - protein, 17 aa, Mycobacterium tuberculosis
WRRFKAAQDSFFTARNA

SEQ ID NO: 1461815 - protein, 25 aa, Mycobacterium tuberculosis
WSARELRGRILGVRRETEDSATLFI

SEQ ID NO: 1461816 - protein, 19 aa, Mycobacterium tuberculosis
WTLDTAVAYAKVREQFGKP

SEQ ID NO: 1461817 - protein, 24 aa, Mycobacterium tuberculosis
WTSGAADPRCKILIVMGRTNPDAA

SEQ ID NO: 1461818 - protein, 24 aa, Mycobacterium tuberculosis
WVDNLRHTVRFAAAVQAALEDGYR

SEQ ID NO: 1461819 - protein, 17 aa, Mycobacterium tuberculosis
WVNLVALAVNEENASGG

SEQ ID NO: 1461820 - protein, 20 aa, Mycobacterium tuberculosis
WYPLTACLPLAPDHTNPDTP

SEQ ID NO: 1461821 - protein, 17 aa, Mycobacterium tuberculosis
YADVRVHTVMNKDRLEM

SEQ ID NO: 1461822 - protein, 30 aa, Mycobacterium tuberculosis; identical to SEQ ID NO: 208716

SEQ ID NO: 1461823 - protein, 24 aa, Mycobacterium tuberculosis
YDAPVAEYWPEFGANGKSEVTVSD

SEQ ID NO: 1461824 - protein, 30 aa, Mycobacterium tuberculosis; identical to SEQ ID NO: 208728

SEQ ID NO: 1461825 - protein, 20 aa, Mycobacterium tuberculosis
YDPDKGFGFLSQEGGEDVYV

SEQ ID NO: 1461826 - protein, 18 aa, Mycobacterium tuberculosis
YEGLTANEALYDWNYQRQ

SEQ ID NO: 1461827 - protein, 22 aa, Mycobacterium tuberculosis
YFYRPFRDLVIRAAERADAPLR

SEQ ID NO: 1461828 - protein, 24 aa, Mycobacterium tuberculosis
YGDTKLGLFPFRRNLSFYAVDLGL

SEQ ID NO: 1461829 - protein, 29 aa, Mycobacterium tuberculosis
YGSVLSGLAALHWRGPAAESMAVTAAPYI

SEQ ID NO: 1461830 - protein, 24 aa, Mycobacterium tuberculosis
YGVPFPNNACRVVADSGDDCPDWV

SEQ ID NO: 1461831 - protein, 17 aa, Mycobacterium tuberculosis
YGYDYVTGCVSVPIGGD

SEQ ID NO: 1461832 - protein, 18 aa, Mycobacterium tuberculosis
YHRRAGLTAERFVADPFN

SEQ ID NO: 1461833 - protein, 19 aa, Mycobacterium tuberculosis
YIGEICRYLLNQPAKPTDR

SEQ ID NO: 1461834 - protein, 17 aa, Mycobacterium tuberculosis
YIGSKPSPFAWIPFGGG

SEQ ID NO: 1461835 - protein, 22 aa, Mycobacterium tuberculosis
YKMVFGHRGINIPVVDHATGRV

SEQ ID NO: 1461836 - protein, 28 aa, Mycobacterium tuberculosis
YLALLDALRWLGLDWDEGPEVGGPYGPY

SEQ ID NO: 1461837 - protein, 17 aa, Mycobacterium tuberculosis
YLGRWRVDQWFSTGQIS

SEQ ID NO: 1461838 - protein, 24 aa, Mycobacterium tuberculosis
YLHGAYPGARCFLVNNGDITEDLP

SEQ ID NO: 1461839 - protein, 19 aa, Mycobacterium tuberculosis
YLLAVGDLLIGWRLLVLAG

SEQ ID NO: 1461840 - protein, 17 aa, Mycobacterium tuberculosis
YLSEASMALLYPDSDNA

SEQ ID NO: 1461841 - protein, 18 aa, Mycobacterium tuberculosis
YNRKALDPAQVVDALLEQ

SEQ ID NO: 1461842 - protein, 20 aa, Mycobacterium tuberculosis
YPGRRYYGGCEFVDGVEQLA

SEQ ID NO: 1461843 - protein, 17 aa, Mycobacterium tuberculosis
YPMVYDMPARAKDAFGA

SEQ ID NO: 1461844 - protein, 17 aa, Mycobacterium tuberculosis
YPSLSVALGEEITPQTT

SEQ ID NO: 1461845 - protein, 20 aa, Mycobacterium tuberculosis
YPYLPSHPQYDLAKRQMSGG

SEQ ID NO: 1461846 - protein, 25 aa, Mycobacterium tuberculosis
YQPLWEPKIPLGRLGRPEELAGLYL

SEQ ID NO: 1461847 - protein, 18 aa, Mycobacterium tuberculosis
YRAGMAMGTTLQVPPQMW

SEQ ID NO: 1461848 - protein, 17 aa, Mycobacterium tuberculosis
YRITPLALWNARAAGHD

SEQ ID NO: 1461849 - protein, 17 aa, Mycobacterium tuberculosis
YRMDSGATIAVRITVDR

SEQ ID NO: 1461850 - protein, 18 aa, Mycobacterium tuberculosis
YRPTPSANSIAWLLWHSA

SEQ ID NO: 1461851 - protein, 23 aa, Mycobacterium tuberculosis
YSGLLEHLASWGIVAAAPDSERG

SEQ ID NO: 1461852 - protein, 19 aa, Mycobacterium tuberculosis
YTIPISALTRGGRVDRLVQ

SEQ ID NO: 1461853 - protein, 26 aa, Mycobacterium tuberculosis
YVEILPTPFLPAGVFDLWGLEADDSR

SEQ ID NO: 1461854 - protein, 21 aa, Mycobacterium tuberculosis
YVQRMGKLLGGQLWESAGSPE

SEQ ID NO: 1461855 - protein, 19 aa, Mycobacterium tuberculosis
YWELPAMMLQFLRTGSGAT

SEQ ID NO: 1461856 - protein, 19 aa, Mycobacterium tuberculosis
AAADAARIGSAINTANTAA

SEQ ID NO: 1461857 - protein, 26 aa, Mycobacterium tuberculosis
AAAGKRCPPTAFISGRLPAPPAADVT

SEQ ID NO: 1461858 - protein, 17 aa, Mycobacterium tuberculosis
AADVAAMLGYHGEASAV

SEQ ID NO: 1461859 - protein, 23 aa, Mycobacterium tuberculosis
AAEGFPSLSCIVLNGGFQLHPAI

SEQ ID NO: 1461860 - protein, 17 aa, Mycobacterium tuberculosis
AAELLRYHTVEQVTVVV

SEQ ID NO: 1461861 - protein, 18 aa, Mycobacterium tuberculosis
AAICDAARHWALRVETCQ

SEQ ID NO: 1461862 - protein, 30 aa, Mycobacterium tuberculosis; identical to SEQ ID NO: 195825

SEQ ID NO: 1461863 - protein, 17 aa, Mycobacterium tuberculosis
AALRNAGKFRRMSQMTW

SEQ ID NO: 1461864 - protein, 24 aa, Mycobacterium tuberculosis
AANFRDIMITLGMFTHDALLGGEG

SEQ ID NO: 1461865 - protein, 26 aa, Mycobacterium tuberculosis
AAPRKIPPGTGWRKFVYSVSFHKINP

SEQ ID NO: 1461866 - protein, 18 aa, Mycobacterium tuberculosis
AARFPGPFIYTVHPSKIV

SEQ ID NO: 1461867 - protein, 18 aa, Mycobacterium tuberculosis
AARGRTGVLVGGRVTWED

SEQ ID NO: 1461868 - protein, 24 aa, Mycobacterium tuberculosis
AATEAHYAEMWAQDAAAMYGYAGS

SEQ ID NO: 1461869 - protein, 40 aa, Mycobacterium tuberculosis; identical to SEQ ID NO: 195905

SEQ ID NO: 1461870 - protein, 19 aa, Mycobacterium tuberculosis
AAVDSGYYPGQFQVGQTGK

SEQ ID NO: 1461871 - protein, 18 aa, Mycobacterium tuberculosis
AAVMAAVFAENGAIDVFS

SEQ ID NO: 1461872 - protein, 17 aa, Mycobacterium tuberculosis
AAVRLQIDQPGRLDALN

SEQ ID NO: 1461873 - protein, 19 aa, Mycobacterium tuberculosis
AAVSSFGLGGTNAHVIIEQ

SEQ ID NO: 1461874 - protein, 25 aa, Mycobacterium tuberculosis
AAYLARAGLRVRLLERLAQTGGAAV

SEQ ID NO: 1461875 - protein, 18 aa, Mycobacterium tuberculosis
ADAARALDNFATRWRHGG

SEQ ID NO: 1461876 - protein, 30 aa, Mycobacterium tuberculosis; identical to SEQ ID NO: 195979

SEQ ID NO: 1461877 - protein, 21 aa, Mycobacterium tuberculosis
ADGRAAMLLHVSHAVTDGVGG

SEQ ID NO: 1461878 - protein, 17 aa, Mycobacterium tuberculosis
ADIDGVLRWADEARARL

SEQ ID NO: 1461879 - protein, 21 aa, Mycobacterium tuberculosis
ADPRVSAILDRPLQAVEHERT

SEQ ID NO: 1461880 - protein, 26 aa, Mycobacterium tuberculosis
ADRVAIWSPNTWHWVVACLAIHHAGA

SEQ ID NO: 1461881 - protein, 18 aa, Mycobacterium tuberculosis
ADTHPSGGCSRHLAECPA

SEQ ID NO: 1461882 - protein, 19 aa, Mycobacterium tuberculosis
ADVYLCGPVAMVDAARTWL

SEQ ID NO: 1461883 - protein, 20 aa, Mycobacterium tuberculosis
AEEKFGFLLEAFMFGAPPHG

SEQ ID NO: 1461884 - protein, 18 aa, Mycobacterium tuberculosis
AEGARPGWVGSSAGALSG

SEQ ID NO: 1461885 - protein, 25 aa, Mycobacterium tuberculosis
AELAAAGLHRIRWWTDEAGDFGLSL

SEQ ID NO: 1461886 - protein, 29 aa, Mycobacterium tuberculosis
AELVELFKTEALHRLPVKSWDVRHAREAY

SEQ ID NO: 1461887 - protein, 22 aa, Mycobacterium tuberculosis
AENMARLLIVTRERYHVFRHQQ

SEQ ID NO: 1461888 - protein, 24 aa, Mycobacterium tuberculosis
AEPEDFVGALIYLLSDASSFYTGQ

SEQ ID NO: 1461889 - protein, 17 aa, Mycobacterium tuberculosis
AEPGQVLGLTFTRKAAG

SEQ ID NO: 1461890 - protein, 26 aa, Mycobacterium tuberculosis
AERYGLRHRIRFGATVVSARFDDGRW

SEQ ID NO: 1461891 - protein, 23 aa, Mycobacterium tuberculosis
AESFAAACLPYLSWLTQASADCA

SEQ ID NO: 1461892 - protein, 29 aa, Mycobacterium tuberculosis
AETLLVVLCGVGFYIGFVGSYQRMATITD

SEQ ID NO: 1461893 - protein, 19 aa, Mycobacterium tuberculosis
AFANFGFPESHALSFASLV

SEQ ID NO: 1461894 - protein, 32 aa, Mycobacterium tuberculosis; identical to SEQ ID NO: 196237

SEQ ID NO: 1461895 - protein, 17 aa, Mycobacterium tuberculosis
AFGASRFTGIDFSDEAV

SEQ ID NO: 1461896 - protein, 24 aa, Mycobacterium tuberculosis
AGALWERLTRAVGMDARDAVWQHP

SEQ ID NO: 1461897 - protein, 20 aa, Mycobacterium tuberculosis
AGAVQRLKVGSAKRFTNITR

SEQ ID NO: 1461898 - protein, 24 aa, Mycobacterium tuberculosis
AGGGARGLAHFGVYQELTEAGVVI

SEQ ID NO: 1461899 - protein, 18 aa, Mycobacterium tuberculosis
AGGVGGFGVHPALLDAVL

SEQ ID NO: 1461900 - protein, 19 aa, Mycobacterium tuberculosis
AGITCAVLIPQGKIAMGKL

SEQ ID NO: 1461901 - protein, 19 aa, Mycobacterium tuberculosis
AGPRRAAVSSFGLSGTNAH

SEQ ID NO: 1461902 - protein, 17 aa, Mycobacterium tuberculosis
AGYLLPYLVPGLSVLDV

SEQ ID NO: 1461903 - protein, 17 aa, Mycobacterium tuberculosis
AHLPRAVRWHRYSLDNG

SEQ ID NO: 1461904 - protein, 19 aa, Mycobacterium tuberculosis
AHLTGNVAMGAFTIPQIDI

SEQ ID NO: 1461905 - protein, 25 aa, Mycobacterium tuberculosis
AHPQGRISLAIAHRPGERNGVADLC

SEQ ID NO: 1461906 - protein, 29 aa, Mycobacterium tuberculosis
AISRANAEALVPITALLPAGADDVSAAIA

SEQ ID NO: 1461907 - protein, 19 aa, Mycobacterium tuberculosis
AKADARRKVRDGGEREMRQ

SEQ ID NO: 1461908 - protein, 20 aa, Mycobacterium tuberculosis
AKAVAGAFEAARAAMVDPVV

SEQ ID NO: 1461909 - protein, 27 aa, Mycobacterium tuberculosis
AKDCIQVLGGIGCTWEHDAHLYLRRAH

SEQ ID NO: 1461910 - protein, 19 aa, Mycobacterium tuberculosis
AKPGKTLCSIWDLTDWQGT

SEQ ID NO: 1461911 - protein, 18 aa, Mycobacterium tuberculosis
AKVDGAWNLHELTRHLDV

SEQ ID NO: 1461912 - protein, 23 aa, Mycobacterium tuberculosis
ALAEPADLIARVRAQQSMLGADL

SEQ ID NO: 1461913 - protein, 29 aa, Mycobacterium tuberculosis
ALGEIRAIWRINELLNWQVASAGEDINMA

SEQ ID NO: 1461914 - protein, 19 aa, Mycobacterium tuberculosis
ALGNARRALVESLCYAGQR

SEQ ID NO: 1461915 - protein, 22 aa, Mycobacterium tuberculosis
ALKNPEFDATLVTRAFSGRYAR

SEQ ID NO: 1461916 - protein, 19 aa, Mycobacterium tuberculosis
ALLALYRWRGPLINAGVGG

SEQ ID NO: 1461917 - protein, 26 aa, Mycobacterium tuberculosis
AMAARLKGYRLICVMPENTSVERRQL

SEQ ID NO: 1461918 - protein, 28 aa, Mycobacterium tuberculosis
AMDPRQRLALELTWELLEDAFVVPETLR

SEQ ID NO: 1461919 - protein, 19 aa, Mycobacterium tuberculosis
ANAQWGNNVAILAGDYLLA

SEQ ID NO: 1461920 - protein, 20 aa, Mycobacterium tuberculosis
ANEALYDWNYQRQLLSIRLA

SEQ ID NO: 1461921 - protein, 18 aa, Mycobacterium tuberculosis
ANKIFIEKAVDLGVQALA

SEQ ID NO: 1461922 - protein, 33 aa, Mycobacterium tuberculosis; identical to SEQ ID NO: 196738

SEQ ID NO: 1461923 - protein, 23 aa, Mycobacterium tuberculosis
ANMAPDLFAGILAQVPFVDPLTT

SEQ ID NO: 1461924 - protein, 17 aa, Mycobacterium tuberculosis
ANTLVRTPHGWRADNTD

SEQ ID NO: 1461925 - protein, 17 aa, Mycobacterium tuberculosis
APATGWCTSLRLPRDHY

SEQ ID NO: 1461926 - protein, 19 aa, Mycobacterium tuberculosis
APDGIRMLVEAARRIDEAR

SEQ ID NO: 1461927 - protein, 20 aa, Mycobacterium tuberculosis
APGGVAYACSFRITEAVYFV

SEQ ID NO: 1461928 - protein, 20 aa, Mycobacterium tuberculosis
APGLGGRGGLLLGLPGANGT

SEQ ID NO: 1461929 - protein, 19 aa, Mycobacterium tuberculosis
APMGRAIPYHIGRHSHPKA

SEQ ID NO: 1461930 - protein, 18 aa, Mycobacterium tuberculosis
APMIGGLGYVLAPGPAAY

SEQ ID NO: 1461931 - protein, 26 aa, Mycobacterium tuberculosis
AQLRSRSWWSGFDVVLLVDDWHMIVG

SEQ ID NO: 1461932 - protein, 19 aa, Mycobacterium tuberculosis
AQVSLAQMEYMLPRLRGWG

SEQ ID NO: 1461933 - protein, 22 aa, Mycobacterium tuberculosis
ARARDGGIPLTARMVFEHPVLC

SEQ ID NO: 1461934 - protein, 20 aa, Mycobacterium tuberculosis
ARGVARIGLANYFAGAFLLP

SEQ ID NO: 1461935 - protein, 20 aa, Mycobacterium tuberculosis
ARKFDCEAWIPTQGAYRELT

SEQ ID NO: 1461936 - protein, 19 aa, Mycobacterium tuberculosis
ARPGNPLQRTDPAADAAKA

SEQ ID NO: 1461937 - protein, 17 aa, Mycobacterium tuberculosis
ARPPTFVLFTTGFLEAG

SEQ ID NO: 1461938 - protein, 28 aa, Mycobacterium tuberculosis
ARRDGVACYPARFQLVLAANPCPCAPAD

SEQ ID NO: 1461939 - protein, 22 aa, Mycobacterium tuberculosis
ARRFLPGATILKASVGPMDNNA

SEQ ID NO: 1461940 - protein, 17 aa, Mycobacterium tuberculosis
ARSVAGCSFPIERLRQV

SEQ ID NO: 1461941 - protein, 19 aa, Mycobacterium tuberculosis
ARTCSAGVFKRHRQIDRPC

SEQ ID NO: 1461942 - protein, 29 aa, Mycobacterium tuberculosis
ARTPRCGLCPLDWCAWRHAGYPPSDGPPR

SEQ ID NO: 1461943 - protein, 25 aa, Mycobacterium tuberculosis
ARVSESPWALMHFMVRLPEVGVAGE

SEQ ID NO: 1461944 - protein, 18 aa, Mycobacterium tuberculosis
ARYDYLVNMCDEMGVVTP

SEQ ID NO: 1461945 - protein, 27 aa, Mycobacterium tuberculosis
ARYTWPRFVCALPKEFFAAVRAELAKR

SEQ ID NO: 1461946 - protein, 20 aa, Mycobacterium tuberculosis
ARYTYSSAWFDAISAPPKLG

SEQ ID NO: 1461947 - protein, 26 aa, Mycobacterium tuberculosis
ASARASQTWRYPAFFHAMLDAGVYPP

SEQ ID NO: 1461948 - protein, 18 aa, Mycobacterium tuberculosis
ATAVAWLAGKVESFGVRL

SEQ ID NO: 1461949 - protein, 32 aa, Mycobacterium tuberculosis; identical to SEQ ID NO: 197152

SEQ ID NO: 1461950 - protein, 23 aa, Mycobacterium tuberculosis
ATFFVRGLRDWDQCAGGIVGQPE

SEQ ID NO: 1461951 - protein, 22 aa, Mycobacterium tuberculosis
ATFGHLWQWVGTNIGRYHSYPR

SEQ ID NO: 1461952 - protein, 28 aa, Mycobacterium tuberculosis
ATKYTVGFKFMSRIVPYPGTPLYQAYSD

SEQ ID NO: 1461953 - protein, 19 aa, Mycobacterium tuberculosis
ATMLPFSWQGVSLHAAGAS

SEQ ID NO: 1461954 - protein, 18 aa, Mycobacterium tuberculosis
ATMPDPIITLARTFMVRP

SEQ ID NO: 1461955 - protein, 19 aa, Mycobacterium tuberculosis
ATSTGVCATCYGRSMATGK

SEQ ID NO: 1461956 - protein, 26 aa, Mycobacterium tuberculosis
AVIYFLRKVIWFLPDFTVEGYHDRLR

SEQ ID NO: 1461957 - protein, 25 aa, Mycobacterium tuberculosis
AVRGPKLFQGLAFVVSRRRLLGRFV

SEQ ID NO: 1461958 - protein, 22 aa, Mycobacterium tuberculosis
AVVGMAGRFPGAKDVSAFWSNL

SEQ ID NO: 1461959 - protein, 24 aa, Mycobacterium tuberculosis
AVVMAPMYLGLRVWSRATIGLAYA

SEQ ID NO: 1461960 - protein, 34 aa, Mycobacterium tuberculosis; identical to SEQ ID NO: 197336

SEQ ID NO: 1461961 - protein, 19 aa, Mycobacterium tuberculosis
AYAARAGITCAVLIPQGKI

SEQ ID NO: 1461962 - protein, 21 aa, Mycobacterium tuberculosis
AYEPFPGMALADTFQISEAGD

SEQ ID NO: 1461963 - protein, 18 aa, Mycobacterium tuberculosis
AYGGTFLQFSDYMRPAVR

SEQ ID NO: 1461964 - protein, 23 aa, Mycobacterium tuberculosis
AYGWSSLRSRPALRDQAAGALHG

SEQ ID NO: 1461965 - protein, 19 aa, Mycobacterium tuberculosis
CADGRYVAVGAIEPQFYAA

SEQ ID NO: 1461966 - protein, 19 aa, Mycobacterium tuberculosis
CAPFELSRDAPLRITVVRT

SEQ ID NO: 1461967 - protein, 25 aa, Mycobacterium tuberculosis
CDGPRFRWVNGMRVSFENGFPDSTL

SEQ ID NO: 1461968 - protein, 32 aa, Mycobacterium tuberculosis; identical to SEQ ID NO: 197405

SEQ ID NO: 1461969 - protein, 17 aa, Mycobacterium tuberculosis
CGAGGGASYIARNLGPA

SEQ ID NO: 1461970 - protein, 26 aa, Mycobacterium tuberculosis
CGALSEWRATLIVRESACLDVADRRA

SEQ ID NO: 1461971 - protein, 18 aa, Mycobacterium tuberculosis
CRAAFQALELMVVVDVAM

SEQ ID NO: 1461972 - protein, 32 aa, Mycobacterium tuberculosis; identical to SEQ ID NO: 197481

SEQ ID NO: 1461973 - protein, 17 aa, Mycobacterium tuberculosis
CRPGWVHTADGRILSGG

SEQ ID NO: 1461974 - protein, 19 aa, Mycobacterium tuberculosis
CSWRRWWPDLRLQVTEDRA

SEQ ID NO: 1461975 - protein, 17 aa, Mycobacterium tuberculosis
CTVGRTLKSGTTVNLEV

SEQ ID NO: 1461976 - protein, 21 aa, Mycobacterium tuberculosis
CYSGLELRDDRLVLSPQWPEA

SEQ ID NO: 1461977 - protein, 17 aa, Mycobacterium tuberculosis
DAAGIEWAATSALSASL

SEQ ID NO: 1461978 - protein, 20 aa, Mycobacterium tuberculosis
DAEVAALGRFASAYTESLEN

SEQ ID NO: 1461979 - protein, 22 aa, Mycobacterium tuberculosis
DAGPPTMAARCARNLAEGLLLT

SEQ ID NO: 1461980 - protein, 21 aa, Mycobacterium tuberculosis
DAMAGAELMLGMRRFAPSSST

SEQ ID NO: 1461981 - protein, 24 aa, Mycobacterium tuberculosis
DAPVIRMLLRVCREQGLELAASLR

SEQ ID NO: 1461982 - protein, 43 aa, Mycobacterium tuberculosis; identical to SEQ ID NO: 197632

SEQ ID NO: 1461983 - protein, 26 aa, Mycobacterium tuberculosis
DDGTRIPVSIVHRADIEFPAPALIYG

SEQ ID NO: 1461984 - protein, 25 aa, Mycobacterium tuberculosis
DDLVEAIGVDAARYSLIRSSVDTAI

SEQ ID NO: 1461985 - protein, 19 aa, Mycobacterium tuberculosis
DDVPGFGLVMFGAIREAST

SEQ ID NO: 1461986 - protein, 20 aa, Mycobacterium tuberculosis
DELCDRVAFVVDGRIVALDS

SEQ ID NO: 1461987 - protein, 17 aa, Mycobacterium tuberculosis
DEMRAIVQIAARRPTTG

SEQ ID NO: 1461988 - protein, 22 aa, Mycobacterium tuberculosis
DEQLLLLPLTSLRGLRHTLKKL

SEQ ID NO: 1461989 - protein, 21 aa, Mycobacterium tuberculosis
DEYFRRAAAAGARQVVILAAG

SEQ ID NO: 1461990 - protein, 23 aa, Mycobacterium tuberculosis
DGDARLLLIVAELPLPMQNVNEE

SEQ ID NO: 1461991 - protein, 19 aa, Mycobacterium tuberculosis
DGGAFYGPRGRYEVAGGGV

SEQ ID NO: 1461992 - protein, 25 aa, Mycobacterium tuberculosis
DGIPEVWPFAPAKHRAMLANLHPEE

SEQ ID NO: 1461993 - protein, 18 aa, Mycobacterium tuberculosis
DGRMHGVQVWSGPTDAEP

SEQ ID NO: 1461994 - protein, 22 aa, Mycobacterium tuberculosis
DGYFSRPGLARVAAGKVSPSAE

SEQ ID NO: 1461995 - protein, 17 aa, Mycobacterium tuberculosis
DHRGSYLQMHFALAQPP

SEQ ID NO: 1461996 - protein, 18 aa, Mycobacterium tuberculosis
DIGEAVGIVAAQSIGEPG

SEQ ID NO: 1461997 - protein, 18 aa, Mycobacterium tuberculosis
DKLSVGLGRLAAEDPTLR

SEQ ID NO: 1461998 - protein, 22 aa, Mycobacterium tuberculosis
DKRTEMRAPLSASGDAVPAELL

SEQ ID NO: 1461999 - protein, 17 aa, Mycobacterium tuberculosis
DLAAWPATLDRVLAIGG

SEQ ID NO: 1462000 - protein, 24 aa, Mycobacterium tuberculosis
DLASRACVVINHIMPGEPNVAVKD

SEQ ID NO: 1462001 - protein, 23 aa, Mycobacterium tuberculosis
DLDGRLPFDLRRAVLSNGSVILE

SEQ ID NO: 1462002 - protein, 17 aa, Mycobacterium tuberculosis
DLTAISARSEWAPEFAI

SEQ ID NO: 1462003 - protein, 28 aa, Mycobacterium tuberculosis
DLVSQGRFRFGVGVGWLREEVANHGVDP

SEQ ID NO: 1462004 - protein, 18 aa, Mycobacterium tuberculosis
DNHIFDWETGDAAATEAV

SEQ ID NO: 1462005 - protein, 24 aa, Mycobacterium tuberculosis
DPAVARLPCVWVVDVDSVQHEPSA

SEQ ID NO: 1462006 - protein, 18 aa, Mycobacterium tuberculosis
DPQHRLFLQCAWHALEDA

SEQ ID NO: 1462007 - protein, 17 aa, Mycobacterium tuberculosis
DRIPVVLDVNALLGPIN

SEQ ID NO: 1462008 - protein, 27 aa, Mycobacterium tuberculosis
DSGDDCPDWVAGELWVSGRGIARGYRG

SEQ ID NO: 1462009 - protein, 19 aa, Mycobacterium tuberculosis
DSMVWRFAADTNDLGVPIT

SEQ ID NO: 1462010 - protein, 21 aa, Mycobacterium tuberculosis
DSRLRELVIMRIGWLTDCDYE

SEQ ID NO: 1462011 - protein, 19 aa, Mycobacterium tuberculosis
DTILGLSLAHGGHLTHGMR

SEQ ID NO: 1462012 - protein, 24 aa, Mycobacterium tuberculosis
DTRTDVSLVLRMHHGGDFVIEPLP

SEQ ID NO: 1462013 - protein, 18 aa, Mycobacterium tuberculosis
DTTISWSSVEEALGCLSH

SEQ ID NO: 1462014 - protein, 22 aa, Mycobacterium tuberculosis
DVADYLAGSGWQVTTSTGKELF

SEQ ID NO: 1462015 - protein, 25 aa, Mycobacterium tuberculosis
DVMGGMPCIRGLRIPVATVVAMVAD

SEQ ID NO: 1462016 - protein, 17 aa, Mycobacterium tuberculosis
DVSFPLGVLTSVTGVSG

SEQ ID NO: 1462017 - protein, 28 aa, Mycobacterium tuberculosis
DVSKRALAGLPYRAAEIGLLVLATSTGF

SEQ ID NO: 1462018 - protein, 27 aa, Mycobacterium tuberculosis
DWAARARWANPAAWRLPGDDVTALRGT

SEQ ID NO: 1462019 - protein, 17 aa, Mycobacterium tuberculosis
EALEMKDLLVVGDIPGF

SEQ ID NO: 1462020 - protein, 19 aa, Mycobacterium tuberculosis
EALGLARLGATVVVNDVAS

SEQ ID NO: 1462021 - protein, 22 aa, Mycobacterium tuberculosis
EARRVWEGRGPVVVLANSGSPT

SEQ ID NO: 1462022 - protein, 19 aa, Mycobacterium tuberculosis
EATGALLLIGDPAAGDPLL

SEQ ID NO: 1462023 - protein, 19 aa, Mycobacterium tuberculosis
EAVARLGRHQFPLVCTDTV

SEQ ID NO: 1462024 - protein, 26 aa, Mycobacterium tuberculosis
EAVLPSAFFFEIAQWADGDGEPVAMQ

SEQ ID NO: 1462025 - protein, 23 aa, Mycobacterium tuberculosis
ECPDLRVDDAFMLPATEVDQQYR

SEQ ID NO: 1462026 - protein, 20 aa, Mycobacterium tuberculosis
EGAVCTAMLDLYQNEGIIAE

SEQ ID NO: 1462027 - protein, 19 aa, Mycobacterium tuberculosis
EGFLAEPWWCRMVVMSAER

SEQ ID NO: 1462028 - protein, 24 aa, Mycobacterium tuberculosis
EGIGRPRVEPSFLPGVVDRMVAVP

SEQ ID NO: 1462029 - protein, 18 aa, Mycobacterium tuberculosis
EGLYAVVVDREMSALLDG

SEQ ID NO: 1462030 - protein, 26 aa, Mycobacterium tuberculosis
EGPMAARLGLAGWPRAAEESIVARDA

SEQ ID NO: 1462031 - protein, 21 aa, Mycobacterium tuberculosis
EIARRAGVGAGTVYRHFPTKE

SEQ ID NO: 1462032 - protein, 28 aa, Mycobacterium tuberculosis
EICEDPRFSIARLSLLDRGMVFVVAHVR

SEQ ID NO: 1462033 - protein, 20 aa, Mycobacterium tuberculosis
EILHAAAVEAARVAGAGRGS

SEQ ID NO: 1462034 - protein, 24 aa, Mycobacterium tuberculosis
EILRIQALCARYCLTIDTQDGEGW

SEQ ID NO: 1462035 - protein, 20 aa, Mycobacterium tuberculosis
EINSALIFAGAGPEPMAAAA

SEQ ID NO: 1462036 - protein, 18 aa, Mycobacterium tuberculosis
EKACAWDPATGSRRRYPW

SEQ ID NO: 1462037 - protein, 19 aa, Mycobacterium tuberculosis
EKIGALAITEPGGGSDVGH

SEQ ID NO: 1462038 - protein, 18 aa, Mycobacterium tuberculosis
EKLRTKWVPERAKMLREL

SEQ ID NO: 1462039 - protein, 17 aa, Mycobacterium tuberculosis
ELIECGGGRRWASAEAR

SEQ ID NO: 1462040 - protein, 18 aa, Mycobacterium tuberculosis
ELLQLPVDVAYEGLLTDD

SEQ ID NO: 1462041 - protein, 22 aa, Mycobacterium tuberculosis
ELREKIGAVAMGRVLTLIIAPD

SEQ ID NO: 1462042 - protein, 24 aa, Mycobacterium tuberculosis
ELSRAVFSKGIFPAVDPLASSSTI

SEQ ID NO: 1462043 - protein, 32 aa, Mycobacterium tuberculosis; identical to SEQ ID NO: 198678

SEQ ID NO: 1462044 - protein, 25 aa, Mycobacterium tuberculosis
EPPTLLWPIGVPFSDGLNTLSEFKV

SEQ ID NO: 1462045 - protein, 18 aa, Mycobacterium tuberculosis
EPVLPFTVVAARLADAAD

SEQ ID NO: 1462046 - protein, 19 aa, Mycobacterium tuberculosis
EQMVIDVHNVMTFGGNMIT

SEQ ID NO: 1462047 - protein, 18 aa, Mycobacterium tuberculosis
EQTFLLRLLGGELRQGAK

SEQ ID NO: 1462048 - protein, 20 aa, Mycobacterium tuberculosis
ERCNYVKEAPGWRVSTDTDE

SEQ ID NO: 1462049 - protein, 24 aa, Mycobacterium tuberculosis
ERDRPRISLGPLPVAEHLRDCTAG

SEQ ID NO: 1462050 - protein, 20 aa, Mycobacterium tuberculosis
ERIGWWYSIRTLSGRVRELR

SEQ ID NO: 1462051 - protein, 22 aa, Mycobacterium tuberculosis
ERKGALRGLRLSYFGDGANNMA

SEQ ID NO: 1462052 - protein, 18 aa, Mycobacterium tuberculosis
ERLADILTRYAADTRDAS

SEQ ID NO: 1462053 - protein, 26 aa, Mycobacterium tuberculosis
ERLREERARLQAHLERLQAEYDQLSV

SEQ ID NO: 1462054 - protein, 25 aa, Mycobacterium tuberculosis
ERPYREFPLDWMLGRLGLAGFRILE

SEQ ID NO: 1462055 - protein, 28 aa, Mycobacterium tuberculosis
ERYLTALMPMVWRACEREDFVVEVQAMR

SEQ ID NO: 1462056 - protein, 18 aa, Mycobacterium tuberculosis
ESAVGYSRAVRIGPLVVV

SEQ ID NO: 1462057 - protein, 25 aa, Mycobacterium tuberculosis
ESKTVIGLNMLRLWDDRRTLEPWIA

SEQ ID NO: 1462058 - protein, 28 aa, Mycobacterium tuberculosis
ESRALEDWCHQLAWPIRPAVSADPPSTA

SEQ ID NO: 1462059 - protein, 18 aa, Mycobacterium tuberculosis
ESRIVWSGGSYVRRPLSV

SEQ ID NO: 1462060 - protein, 23 aa, Mycobacterium tuberculosis
ETAWKVAKQYFKLTGKPGKHKVI

SEQ ID NO: 1462061 - protein, 21 aa, Mycobacterium tuberculosis
ETPSQFFPFTGLNSLTYDVSV

SEQ ID NO: 1462062 - protein, 27 aa, Mycobacterium tuberculosis
EVARYLFRRVVSWGRSSNVFLRNGARL

SEQ ID NO: 1462063 - protein, 19 aa, Mycobacterium tuberculosis
EVFCDTPLQDCERRDPKGL

SEQ ID NO: 1462064 - protein, 18 aa, Mycobacterium tuberculosis
EVHSALLSSGPGPGPLLV

SEQ ID NO: 1462065 - protein, 21 aa, Mycobacterium tuberculosis
EVLARGTAWLDTGTFDSLLDA

SEQ ID NO: 1462066 - protein, 20 aa, Mycobacterium tuberculosis
EVRLGLGAVRYLGAELAEKL

SEQ ID NO: 1462067 - protein, 23 aa, Mycobacterium tuberculosis
EVSALTAAQFAAHAQMYQTVSAQ

SEQ ID NO: 1462068 - protein, 19 aa, Mycobacterium tuberculosis
EVYDYLRLLYARAGTPHCP

SEQ ID NO: 1462069 - protein, 27 aa, Mycobacterium tuberculosis
EYADGKRSGLWPGLRETFKSGSSQPPL

SEQ ID NO: 1462070 - protein, 29 aa, Mycobacterium tuberculosis
EYPSAVAKARFVRVSPRKARRVIDLVRGR

SEQ ID NO: 1462071 - protein, 20 aa, Mycobacterium tuberculosis
FAASWQRLRTAPATVPLARC

SEQ ID NO: 1462072 - protein, 24 aa, Mycobacterium tuberculosis
FADDRIADVLGRLRGGYQVEGREV

SEQ ID NO: 1462073 - protein, 20 aa, Mycobacterium tuberculosis
FADHLARVGLYPDAPKLPAV

SEQ ID NO: 1462074 - protein, 18 aa, Mycobacterium tuberculosis
FAELSVRAISLRAGVARS

SEQ ID NO: 1462075 - protein, 18 aa, Mycobacterium tuberculosis
FANELFASNAYRDYLEVH

SEQ ID NO: 1462076 - protein, 24 aa, Mycobacterium tuberculosis
FATELRNLLARCAERGLDPLELQQ

SEQ ID NO: 1462077 - protein, 25 aa, Mycobacterium tuberculosis
FDCSDPAKLAGWWAEQFDGTTRELL

SEQ ID NO: 1462078 - protein, 17 aa, Mycobacterium tuberculosis
FDHVGALAATVMGMPPT

SEQ ID NO: 1462079 - protein, 26 aa, Mycobacterium tuberculosis
FDTACSSGLMAVHLACRSLHDGEADL

SEQ ID NO: 1462080 - protein, 18 aa, Mycobacterium tuberculosis
FEASRQLAALSIFANSGG

SEQ ID NO: 1462081 - protein, 18 aa, Mycobacterium tuberculosis
FEPTLDYVVVKAPRFAFE

SEQ ID NO: 1462082 - protein, 23 aa, Mycobacterium tuberculosis
FEQAADAVMHWGMQRNAGLRVRA

SEQ ID NO: 1462083 - protein, 19 aa, Mycobacterium tuberculosis
FGLARRLSAAGADVIMAIR

SEQ ID NO: 1462084 - protein, 18 aa, Mycobacterium tuberculosis
FGLGCVAGAAGVARLHDY

SEQ ID NO: 1462085 - protein, 25 aa, Mycobacterium tuberculosis
FGLIPEFIGRLPVVASVTNLDKESL

SEQ ID NO: 1462086 - protein, 22 aa, Mycobacterium tuberculosis
FGSGNGRAGLPGSGNVGNGNLG

SEQ ID NO: 1462087 - protein, 18 aa, Mycobacterium tuberculosis
FHFPRIYLDYIGHGDSDK

SEQ ID NO: 1462088 - protein, 17 aa, Mycobacterium tuberculosis
FHVKGDPSAAVTIADIA

SEQ ID NO: 1462089 - protein, 22 aa, Mycobacterium tuberculosis
FIEIRRAAGLSVELTVVESAMA

SEQ ID NO: 1462090 - protein, 24 aa, Mycobacterium tuberculosis
FIEISAHPALLFAIGQNCEGAANL

SEQ ID NO: 1462091 - protein, 33 aa, Mycobacterium tuberculosis; identical to SEQ ID NO: 199187

SEQ ID NO: 1462092 - protein, 33 aa, Mycobacterium tuberculosis; identical to SEQ ID NO: 199188

SEQ ID NO: 1462093 - protein, 18 aa, Mycobacterium tuberculosis
FMAARTAFFDEYFLATAD

SEQ ID NO: 1462094 - protein, 17 aa, Mycobacterium tuberculosis
FNPPGIECERYDLRSNI

SEQ ID NO: 1462095 - protein, 19 aa, Mycobacterium tuberculosis
FNQFCYLQLSGKRSRRGQP

SEQ ID NO: 1462096 - protein, 25 aa, Mycobacterium tuberculosis
FPGEISGGMRKRAGLARALVLDPQI

SEQ ID NO: 1462097 - protein, 23 aa, Mycobacterium tuberculosis
FRAELTIPLILLGGITNRTTMDL

SEQ ID NO: 1462098 - protein, 21 aa, Mycobacterium tuberculosis
FRELSIPYLPVRWSTDNPDSI

SEQ ID NO: 1462099 - protein, 18 aa, Mycobacterium tuberculosis
FRGLSLRPFMIGRPASDP

SEQ ID NO: 1462100 - protein, 22 aa, Mycobacterium tuberculosis
FRIPYDPHLATGLAVDFSSLKR

SEQ ID NO: 1462101 - protein, 22 aa, Mycobacterium tuberculosis
FRSRFGENFFYILYFQEPGIAD

SEQ ID NO: 1462102 - protein, 17 aa, Mycobacterium tuberculosis
FSLCMDNGMPILVFNLL

SEQ ID NO: 1462103 - protein, 17 aa, Mycobacterium tuberculosis
FSRISDVLLPFLVTRQL

SEQ ID NO: 1462104 - protein, 25 aa, Mycobacterium tuberculosis
FSRWNVGKDLSFVPLRPERVVEVRY

SEQ ID NO: 1462105 - protein, 17 aa, Mycobacterium tuberculosis
FTLLEALIRRPGIVHTR

SEQ ID NO: 1462106 - protein, 24 aa, Mycobacterium tuberculosis
FVIGASNRFAHAAALAIAEAPARA

SEQ ID NO: 1462107 - protein, 17 aa, Mycobacterium tuberculosis
FVPLRPERVVEVRYDHM

SEQ ID NO: 1462108 - protein, 22 aa, Mycobacterium tuberculosis
FVRGEGAGVVVLKRLTDAVRDG

SEQ ID NO: 1462109 - protein, 18 aa, Mycobacterium tuberculosis
GAAKHARKVAAWGADAMI

SEQ ID NO: 1462110 - protein, 19 aa, Mycobacterium tuberculosis
GAFEAARAAMVDPVVVAAN

SEQ ID NO: 1462111 - protein, 19 aa, Mycobacterium tuberculosis
GAGCCDLAFAAPEAARTLK

SEQ ID NO: 1462112 - protein, 26 aa, Mycobacterium tuberculosis
GAGSAPMLAAAVAWDGLAAELGSAAS

SEQ ID NO: 1462113 - protein, 18 aa, Mycobacterium tuberculosis
GAIPVMCLPGHRAAELGH

SEQ ID NO: 1462114 - protein, 17 aa, Mycobacterium tuberculosis
GALCAGWTPVPLPEPLG

SEQ ID NO: 1462115 - protein, 17 aa, Mycobacterium tuberculosis
GAPDAWEVQGRGELALA

SEQ ID NO: 1462116 - protein, 20 aa, Mycobacterium tuberculosis
GARGLRAIMEEVLLPVMYDI

SEQ ID NO: 1462117 - protein, 18 aa, Mycobacterium tuberculosis
GATALDFQAKYAAAQQEL

SEQ ID NO: 1462118 - protein, 18 aa, Mycobacterium tuberculosis
GATGNCWAVHTNCPVPGP

SEQ ID NO: 1462119 - protein, 22 aa, Mycobacterium tuberculosis
GATKRFGLTVTLAERERQLAIA

SEQ ID NO: 1462120 - protein, 22 aa, Mycobacterium tuberculosis
GDGNVHMAIACKDPEKKKKLMT

SEQ ID NO: 1462121 - protein, 19 aa, Mycobacterium tuberculosis
GDISVCLHDPCLPVDLTVR

SEQ ID NO: 1462122 - protein, 17 aa, Mycobacterium tuberculosis
GDLGELPGDLAWQPPLW

SEQ ID NO: 1462123 - protein, 18 aa, Mycobacterium tuberculosis
GDVWRFVDTAGLRRKVGQ

SEQ ID NO: 1462124 - protein, 17 aa, Mycobacterium tuberculosis
GEAIPAQAIAQVCELTW

SEQ ID NO: 1462125 - protein, 25 aa, Mycobacterium tuberculosis
GEEGIKRPFAIQELTLPLALDGEDV

SEQ ID NO: 1462126 - protein, 18 aa, Mycobacterium tuberculosis
GEHIRVFPLSNWTEFDIW

SEQ ID NO: 1462127 - protein, 22 aa, Mycobacterium tuberculosis
GEPPMRRAVAFAKDIKTSKQVA

SEQ ID NO: 1462128 - protein, 22 aa, Mycobacterium tuberculosis
GEPRRFGVGAAEFHHRAATRAR

SEQ ID NO: 1462129 - protein, 27 aa, Mycobacterium tuberculosis
GEPTRAAICRFATWWVVLERHGNLVRL

SEQ ID NO: 1462130 - protein, 25 aa, Mycobacterium tuberculosis
GESDWNALNLFTGWVDVGLTDKGQA

SEQ ID NO: 1462131 - protein, 18 aa, Mycobacterium tuberculosis
GFIETRYYVSMNVADKPG

SEQ ID NO: 1462132 - protein, 24 aa, Mycobacterium tuberculosis
GFPESYNRRALMRFVTSVKSGSDY

SEQ ID NO: 1462133 - protein, 20 aa, Mycobacterium tuberculosis
GFQVLCEAGLLPGALTRNVG

SEQ ID NO: 1462134 - protein, 24 aa, Mycobacterium tuberculosis
GFVPDVAGFDAEFFGITPREAAAM

SEQ ID NO: 1462135 - protein, 20 aa, Mycobacterium tuberculosis
GGAIEACARKLFVHPNTVRY

SEQ ID NO: 1462136 - protein, 19 aa, Mycobacterium tuberculosis
GGDVPVTVCQWGEAAAKDL

SEQ ID NO: 1462137 - protein, 17 aa, Mycobacterium tuberculosis
GGIDEYLQLAARVSAPA

SEQ ID NO: 1462138 - protein, 23 aa, Mycobacterium tuberculosis
GGISRKADKWVPLLENRTPVVPA

SEQ ID NO: 1462139 - protein, 19 aa, Mycobacterium tuberculosis
GGNTSGLWNLASAASGVSG

SEQ ID NO: 1462140 - protein, 23 aa, Mycobacterium tuberculosis
GGQTLRPAPVGAYPAGASACGAE

SEQ ID NO: 1462141 - protein, 19 aa, Mycobacterium tuberculosis
GGSCGRKVLGEGWGDVLVG

SEQ ID NO: 1462142 - protein, 17 aa, Mycobacterium tuberculosis
GGTRRCVGAAFANMEMD

SEQ ID NO: 1462143 - protein, 23 aa, Mycobacterium tuberculosis
GGVATRFPGISFPSLGVTATGAT

SEQ ID NO: 1462144 - protein, 27 aa, Mycobacterium tuberculosis
GHDPRRFATDLLERFRDLIVLQSVPDA

SEQ ID NO: 1462145 - protein, 19 aa, Mycobacterium tuberculosis
GHLDWYADGMFPPMHIDAE

SEQ ID NO: 1462146 - protein, 33 aa, Mycobacterium tuberculosis; identical to SEQ ID NO: 199915

SEQ ID NO: 1462147 - protein, 26 aa, Mycobacterium tuberculosis
GHRNGGVVLLMWAGILAYLDRYGYDY

SEQ ID NO: 1462148 - protein, 19 aa, Mycobacterium tuberculosis
GHTKRALVRAGFLAGDALR

SEQ ID NO: 1462149 - protein, 19 aa, Mycobacterium tuberculosis
GITARGAWEAVKRHFREIG

SEQ ID NO: 1462150 - protein, 22 aa, Mycobacterium tuberculosis
GKAFTANILMYGRVVVVADPQL

SEQ ID NO: 1462151 - protein, 23 aa, Mycobacterium tuberculosis
GKLADLVLWEPAFFGVRPHVVLK

SEQ ID NO: 1462152 - protein, 23 aa, Mycobacterium tuberculosis
GKNNPGLVVLLTFGTGIGSAVIH

SEQ ID NO: 1462153 - protein, 21 aa, Mycobacterium tuberculosis
GKSATTAWLIERLQRPTLVMA

SEQ ID NO: 1462154 - protein, 20 aa, Mycobacterium tuberculosis
GLAAWPRVPRHIEWKHGVCD

SEQ ID NO: 1462155 - protein, 19 aa, Mycobacterium tuberculosis
GLDNLTFVINCNLQRLDGP

SEQ ID NO: 1462156 - protein, 18 aa, Mycobacterium tuberculosis
GLLGSRWLAHYTATSAFL

SEQ ID NO: 1462157 - protein, 26 aa, Mycobacterium tuberculosis
GLNAVIRAVVRTCHARYGSSVVGFQN

SEQ ID NO: 1462158 - protein, 19 aa, Mycobacterium tuberculosis
GLPGGRCAVYVKVHHALAD

SEQ ID NO: 1462159 - protein, 19 aa, Mycobacterium tuberculosis
GLPYFPITPLFPLAGPVGL

SEQ ID NO: 1462160 - protein, 21 aa, Mycobacterium tuberculosis
GLRAGMPTLILWDVADQPIWA

SEQ ID NO: 1462161 - protein, 17 aa, Mycobacterium tuberculosis
GLRGVEKGYVLGPQAED

SEQ ID NO: 1462162 - protein, 25 aa, Mycobacterium tuberculosis
GLSLPRRLQIEFSQVIQKIAEGTAG

SEQ ID NO: 1462163 - protein, 19 aa, Mycobacterium tuberculosis
GLVRGRTGILLVDTGTTLG

SEQ ID NO: 1462164 - protein, 20 aa, Mycobacterium tuberculosis
GMAATDCALRAMLRPGDHVV

SEQ ID NO: 1462165 - protein, 24 aa, Mycobacterium tuberculosis
GMAAVQLARLWGLEVFATASRGKW

SEQ ID NO: 1462166 - protein, 17 aa, Mycobacterium tuberculosis
GMFPDKYPISVMAREVG

SEQ ID NO: 1462167 - protein, 31 aa, Mycobacterium tuberculosis; identical to SEQ ID NO: 209471

SEQ ID NO: 1462168 - protein, 26 aa, Mycobacterium tuberculosis
GNSLITSWRALGWIGPEAAEAAAAAP

SEQ ID NO: 1462169 - protein, 18 aa, Mycobacterium tuberculosis
GPEFHRLSFGEAVERGLL

SEQ ID NO: 1462170 - protein, 32 aa, Mycobacterium tuberculosis; identical to SEQ ID NO: 200180

SEQ ID NO: 1462171 - protein, 21 aa, Mycobacterium tuberculosis
GPRRKGVRYFGPYSHAWAIRE

SEQ ID NO: 1462172 - protein, 27 aa, Mycobacterium tuberculosis
GQEVWTSQMIVAPAFVDAAAKDLATIG

SEQ ID NO: 1462173 - protein, 19 aa, Mycobacterium tuberculosis
GQGESPCALGSVKTNIGHL

SEQ ID NO: 1462174 - protein, 22 aa, Mycobacterium tuberculosis
GQLTRWTRFSAQPVATMDPTRR

SEQ ID NO: 1462175 - protein, 22 aa, Mycobacterium tuberculosis
GQRRFWFMWDDLVRGAIGAIVL

SEQ ID NO: 1462176 - protein, 17 aa, Mycobacterium tuberculosis
GQSIPAIAAELYVAPST

SEQ ID NO: 1462177 - protein, 17 aa, Mycobacterium tuberculosis
GQSRGAGGFGGVGQAGG

SEQ ID NO: 1462178 - protein, 25 aa, Mycobacterium tuberculosis
GRAYLDFGEPLPLRKRLQEMRADKS

SEQ ID NO: 1462179 - protein, 19 aa, Mycobacterium tuberculosis
GRLPDPLPCEAYCHSLTDP

SEQ ID NO: 1462180 - protein, 17 aa, Mycobacterium tuberculosis
GRLPEDWFDGDPTVIVD

SEQ ID NO: 1462181 - protein, 23 aa, Mycobacterium tuberculosis
GRPGRGCPGRRDRDLGGLRRGFR

SEQ ID NO: 1462182 - protein, 20 aa, Mycobacterium tuberculosis
GRSGRARWVVGTAPGRAIPF

SEQ ID NO: 1462183 - protein, 20 aa, Mycobacterium tuberculosis
GRYVRARPALDVVDVGYSLV

SEQ ID NO: 1462184 - protein, 17 aa, Mycobacterium tuberculosis
GSRSHFWAPVSTASADG

SEQ ID NO: 1462185 - protein, 21 aa, Mycobacterium tuberculosis
GSSRPEAIEAYDIHRLTADLV

SEQ ID NO: 1462186 - protein, 19 aa, Mycobacterium tuberculosis
GSVEYLVDAVFNYPTFSEA

SEQ ID NO: 1462187 - protein, 18 aa, Mycobacterium tuberculosis
GTGKAAFVARARELAAAY

SEQ ID NO: 1462188 - protein, 25 aa, Mycobacterium tuberculosis
GTPHCAAVGRIAYLLGLRGPAVAVD

SEQ ID NO: 1462189 - protein, 17 aa, Mycobacterium tuberculosis
GTPITWRDIASQIHAIS

SEQ ID NO: 1462190 - protein, 20 aa, Mycobacterium tuberculosis
GTQACRVLRAEGLQVSLVNS

SEQ ID NO: 1462191 - protein, 23 aa, Mycobacterium tuberculosis
GTVAQRRLPLLIASGADVHVIAP

SEQ ID NO: 1462192 - protein, 18 aa, Mycobacterium tuberculosis
GTVIWTLPGNQTYVTTPG

SEQ ID NO: 1462193 - protein, 19 aa, Mycobacterium tuberculosis
GTYSLPLIGSWHGTDGGYL

SEQ ID NO: 1462194 - protein, 17 aa, Mycobacterium tuberculosis
GVEGALVTLDWLGAHGF

SEQ ID NO: 1462195 - protein, 25 aa, Mycobacterium tuberculosis
GVFGDAVALLPSWETLPHERLSPGV

SEQ ID NO: 1462196 - protein, 17 aa, Mycobacterium tuberculosis
GVGTLVMTHYVPAIGPG

SEQ ID NO: 1462197 - protein, 24 aa, Mycobacterium tuberculosis
GVHLGYKCSIRKPWWSTPSLWMPD

SEQ ID NO: 1462198 - protein, 21 aa, Mycobacterium tuberculosis
GVTLMEFHLMYAALVGGHAPL

SEQ ID NO: 1462199 - protein, 25 aa, Mycobacterium tuberculosis
GWEDKRLGIIIAGFDRRRIPLVAEI

SEQ ID NO: 1462200 - protein, 21 aa, Mycobacterium tuberculosis
GWIHLPCLPSVAALDHNLGVP

SEQ ID NO: 1462201 - protein, 25 aa, Mycobacterium tuberculosis
GWKVDAAKGVPDWAARLPDELLEAQ

SEQ ID NO: 1462202 - protein, 34 aa, Mycobacterium tuberculosis; identical to SEQ ID NO: 211021

SEQ ID NO: 1462203 - protein, 19 aa, Mycobacterium tuberculosis
GYIGTALRLLERKIAQLPP

SEQ ID NO: 1462204 - protein, 17 aa, Mycobacterium tuberculosis
HAALPGMVKRGAGAVLN

SEQ ID NO: 1462205 - protein, 21 aa, Mycobacterium tuberculosis
HATAIMWAREQFGLELIWGIE

SEQ ID NO: 1462206 - protein, 17 aa, Mycobacterium tuberculosis
HDTTIRFTHELRMTLRE

SEQ ID NO: 1462207 - protein, 29 aa, Mycobacterium tuberculosis
HDYFWRWDTDWFWCSRSFGAQNPRLRRWW

SEQ ID NO: 1462208 - protein, 23 aa, Mycobacterium tuberculosis
HGGDACALGAVKTNIGHLEAAAG

SEQ ID NO: 1462209 - protein, 17 aa, Mycobacterium tuberculosis
HGGILLITHYTRILRYI

SEQ ID NO: 1462210 - protein, 42 aa, Mycobacterium tuberculosis; identical to SEQ ID NO: 200740

SEQ ID NO: 1462211 - protein, 22 aa, Mycobacterium tuberculosis
HGRVRTGGLLLRTRVPGNRFAD

SEQ ID NO: 1462212 - protein, 22 aa, Mycobacterium tuberculosis
HHWPQGRLSKAYAAYSTPFWRA

SEQ ID NO: 1462213 - protein, 17 aa, Mycobacterium tuberculosis
HILEVQRLIRFMPKVVI

SEQ ID NO: 1462214 - protein, 18 aa, Mycobacterium tuberculosis
HKTFCIPHGGGGPGVGPV

SEQ ID NO: 1462215 - protein, 17 aa, Mycobacterium tuberculosis
HLAATFYLLAESFDEDP

SEQ ID NO: 1462216 - protein, 17 aa, Mycobacterium tuberculosis
HLSRLVPQHLMRRLFFT

SEQ ID NO: 1462217 - protein, 23 aa, Mycobacterium tuberculosis
HPIEVNAGPVLKVHPNLRYATDG

SEQ ID NO: 1462218 - protein, 25 aa, Mycobacterium tuberculosis
HRDLRLLAADMVFDLPVIGEAARKA

SEQ ID NO: 1462219 - protein, 17 aa, Mycobacterium tuberculosis
HRELPLRADYVGKNVPT

SEQ ID NO: 1462220 - protein, 17 aa, Mycobacterium tuberculosis
HRGRLNVLANIVGKPYS

SEQ ID NO: 1462221 - protein, 23 aa, Mycobacterium tuberculosis
HRRAFRDKIKWRTGSEGRINHLK

SEQ ID NO: 1462222 - protein, 25 aa, Mycobacterium tuberculosis
HSARWDHTVPLLGRRIAVIGTGSTG

SEQ ID NO: 1462223 - protein, 32 aa, Mycobacterium tuberculosis; identical to SEQ ID NO: 200848

SEQ ID NO: 1462224 - protein, 26 aa, Mycobacterium tuberculosis
HTGPAMSAFNAWVLLKGLETLAIRVQ

SEQ ID NO: 1462225 - protein, 17 aa, Mycobacterium tuberculosis
HVRHAVGGEIAMLPETM

SEQ ID NO: 1462226 - protein, 24 aa, Mycobacterium tuberculosis
IAALSRLGAVAVVMRPDTDLSASV

SEQ ID NO: 1462227 - protein, 22 aa, Mycobacterium tuberculosis
IACAVLRRPDHRDTYDAMFDLW

SEQ ID NO: 1462228 - protein, 18 aa, Mycobacterium tuberculosis
IAGPRGVGVLAVRPELME

SEQ ID NO: 1462229 - protein, 18 aa, Mycobacterium tuberculosis
IAHTLGLHGPAMTFDTAC

SEQ ID NO: 1462230 - protein, 17 aa, Mycobacterium tuberculosis
IAIDLSVTTPFIPINEQ

SEQ ID NO: 1462231 - protein, 17 aa, Mycobacterium tuberculosis
IALAACSGMASDQPLAR

SEQ ID NO: 1462232 - protein, 23 aa, Mycobacterium tuberculosis
IALSLPLGAGRLTREWLPDDPPG

SEQ ID NO: 1462233 - protein, 26 aa, Mycobacterium tuberculosis
IAQMGRDGWLALGWPKEYGGQGRSAM

SEQ ID NO: 1462234 - protein, 17 aa, Mycobacterium tuberculosis
ICAPILGGYPAVLTSPV

SEQ ID NO: 1462235 - protein, 30 aa, Mycobacterium tuberculosis; identical to SEQ ID NO: 201010

SEQ ID NO: 1462236 - protein, 18 aa, Mycobacterium tuberculosis
ICVSYRITGDIDLARLRD

SEQ ID NO: 1462237 - protein, 18 aa, Mycobacterium tuberculosis
IDGVGLGLLLQHKRIRRT

SEQ ID NO: 1462238 - protein, 17 aa, Mycobacterium tuberculosis
IDGVLRWADEARARLAQ

SEQ ID NO: 1462239 - protein, 18 aa, Mycobacterium tuberculosis
IDIAPTVLAAIGLPEPTH

SEQ ID NO: 1462240 - protein, 25 aa, Mycobacterium tuberculosis
IDIPPMDFTLGLPVLGPITGQLGPI

SEQ ID NO: 1462241 - protein, 25 aa, Mycobacterium tuberculosis
IDLVRRYAPKLALIVTSHQHFDHWQ

SEQ ID NO: 1462242 - protein, 31 aa, Mycobacterium tuberculosis; identical to SEQ ID NO: 201038

SEQ ID NO: 1462243 - protein, 25 aa, Mycobacterium tuberculosis
IDRDWSPKVFGSWNLHRATLGQPLD

SEQ ID NO: 1462244 - protein, 21 aa, Mycobacterium tuberculosis
IDTVLRAKVDAAWNLHQATSD

SEQ ID NO: 1462245 - protein, 17 aa, Mycobacterium tuberculosis
IDVHNVMTFGGNMITVT

SEQ ID NO: 1462246 - protein, 25 aa, Mycobacterium tuberculosis
IEKLDYLVDLGIDFVELMPVNSFAG

SEQ ID NO: 1462247 - protein, 19 aa, Mycobacterium tuberculosis
IERGLWLTALLQATLSTVR

SEQ ID NO: 1462248 - protein, 23 aa, Mycobacterium tuberculosis
IESIASMAAFAWLNSHGEGGSVV

SEQ ID NO: 1462249 - protein, 18 aa, Mycobacterium tuberculosis
IEYEIKDPGLAGVTITDA

SEQ ID NO: 1462250 - protein, 20 aa, Mycobacterium tuberculosis
IGIADARRVLVALRAVGGHR

SEQ ID NO: 1462251 - protein, 19 aa, Mycobacterium tuberculosis
IGNTGNWNIGIGITGNGQI

SEQ ID NO: 1462252 - protein, 23 aa, Mycobacterium tuberculosis
IGWLTDCDYEWTQHWRVASGLGV

SEQ ID NO: 1462253 - protein, 17 aa, Mycobacterium tuberculosis
IHRAMALPGGIEGALGV

SEQ ID NO: 1462254 - protein, 25 aa, Mycobacterium tuberculosis
IKIPLIDIPAAPGFGNSTTTPSSGF

SEQ ID NO: 1462255 - protein, 20 aa, Mycobacterium tuberculosis
IKSQDLLTANGFQPFEDEEV

SEQ ID NO: 1462256 - protein, 23 aa, Mycobacterium tuberculosis
ILAHAAVVYGYFPAVSEGNDIVV

SEQ ID NO: 1462257 - protein, 24 aa, Mycobacterium tuberculosis
ILCACCTTSCPVFWHEGSYFGPAA

SEQ ID NO: 1462258 - protein, 19 aa, Mycobacterium tuberculosis
ILDRGEKLMGFGHRVYRAE

SEQ ID NO: 1462259 - protein, 21 aa, Mycobacterium tuberculosis
INRHIKRGGKVWINIFPDRPL

SEQ ID NO: 1462260 - protein, 19 aa, Mycobacterium tuberculosis
IPDMAQWGIFLRNHDELTL

SEQ ID NO: 1462261 - protein, 18 aa, Mycobacterium tuberculosis
IPLALRLIEEGFALYGDQ

SEQ ID NO: 1462262 - protein, 17 aa, Mycobacterium tuberculosis
IPPLVAVAQQLGVCGAE

SEQ ID NO: 1462263 - protein, 24 aa, Mycobacterium tuberculosis
IPSWMARMGFQMMDPLKTAKARVD

SEQ ID NO: 1462264 - protein, 27 aa, Mycobacterium tuberculosis
IQPFINWLTNLPFLQAMFSGFDPWLPS

SEQ ID NO: 1462265 - protein, 19 aa, Mycobacterium tuberculosis
IRQLARMGAKTIVAMARKP

SEQ ID NO: 1462266 - protein, 24 aa, Mycobacterium tuberculosis
IRTGRANPGMFSRITIDYYGAATP

SEQ ID NO: 1462267 - protein, 22 aa, Mycobacterium tuberculosis
IRWMGSGPLTGLAEIQLPDLQP

SEQ ID NO: 1462268 - protein, 25 aa, Mycobacterium tuberculosis
ISDVIRLARHANHYLAIFDRGKALA

SEQ ID NO: 1462269 - protein, 17 aa, Mycobacterium tuberculosis
ISHAFNLRGPSIAVQTA

SEQ ID NO: 1462270 - protein, 17 aa, Mycobacterium tuberculosis
ITARPPSGFGISARAVT

SEQ ID NO: 1462271 - protein, 17 aa, Mycobacterium tuberculosis
ITPLALWNARAAGHDAE

SEQ ID NO: 1462272 - protein, 17 aa, Mycobacterium tuberculosis
IVPYPGTPLYQAYSDAG

SEQ ID NO: 1462273 - protein, 27 aa, Mycobacterium tuberculosis
IYAELTRLCRYPLLVVDEVGYIPFEPE

SEQ ID NO: 1462274 - protein, 23 aa, Mycobacterium tuberculosis
IYSRTRGGEFCRHATAKVEQSPR

SEQ ID NO: 1462275 - protein, 18 aa, Mycobacterium tuberculosis
IYTKRMQKALNFEGDDVP

SEQ ID NO: 1462276 - protein, 22 aa, Mycobacterium tuberculosis
KESRGVHALRARGALIRIGHDA

SEQ ID NO: 1462277 - protein, 23 aa, Mycobacterium tuberculosis
KGIALQFKRRYPEMFTAYEKACK

SEQ ID NO: 1462278 - protein, 20 aa, Mycobacterium tuberculosis
KGLPVRAGWIHLPCLPSVAA

SEQ ID NO: 1462279 - protein, 32 aa, Mycobacterium tuberculosis; identical to SEQ ID NO: 201634

SEQ ID NO: 1462280 - protein, 18 aa, Mycobacterium tuberculosis
KHAFDVCYYPCLDTTRGR

SEQ ID NO: 1462281 - protein, 20 aa, Mycobacterium tuberculosis
KHTQVFRMWLDAVGISEDLH

SEQ ID NO: 1462282 - protein, 23 aa, Mycobacterium tuberculosis
KIGWACGPAELIAGVRAAKQYLS

SEQ ID NO: 1462283 - protein, 20 aa, Mycobacterium tuberculosis
KLECRACRKYAPISEMTAAA

SEQ ID NO: 1462284 - protein, 25 aa, Mycobacterium tuberculosis
KLRALKRLKVVAAFQQSGNSPMGMV

SEQ ID NO: 1462285 - protein, 24 aa, Mycobacterium tuberculosis
KPDGLPLFRECLAPGTSISHRVVV

SEQ ID NO: 1462286 - protein, 22 aa, Mycobacterium tuberculosis
KPRPGRIVFVGSGPGDPGLLTT

SEQ ID NO: 1462287 - protein, 19 aa, Mycobacterium tuberculosis
KPVPVGVVGDVYYGGGPAV

SEQ ID NO: 1462288 - protein, 24 aa, Mycobacterium tuberculosis
KQIGPRIVPIIPDEARTFGMDSWF

SEQ ID NO: 1462289 - protein, 18 aa, Mycobacterium tuberculosis
KQLRARSSVPVIMVTARD

SEQ ID NO: 1462290 - protein, 25 aa, Mycobacterium tuberculosis
KQPQRVLGLHFFNPVPVLPLVELVR

SEQ ID NO: 1462291 - protein, 25 aa, Mycobacterium tuberculosis
KRDSEWMGRVHRFLGLQVGVILATM

SEQ ID NO: 1462292 - protein, 19 aa, Mycobacterium tuberculosis
KRNGWLSGLHATELLGAVQ

SEQ ID NO: 1462293 - protein, 20 aa, Mycobacterium tuberculosis
KTGMDVCLWLLRNDVCPDKL

SEQ ID NO: 1462294 - protein, 19 aa, Mycobacterium tuberculosis
KVDGGWLLNGQKIWSSRAP

SEQ ID NO: 1462295 - protein, 17 aa, Mycobacterium tuberculosis
KVGPFALQDFSLFQVLR

SEQ ID NO: 1462296 - protein, 23 aa, Mycobacterium tuberculosis
KVKWTGSRVDLVFGSNSELRALV

SEQ ID NO: 1462297 - protein, 19 aa, Mycobacterium tuberculosis
LAAGGYRLAISELTGAYWA

SEQ ID NO: 1462298 - protein, 23 aa, Mycobacterium tuberculosis
LAAPSLDIGIPWRQYLRVQQGIR

SEQ ID NO: 1462299 - protein, 19 aa, Mycobacterium tuberculosis
LAERKDLFTKLLAAETGQP

SEQ ID NO: 1462300 - protein, 19 aa, Mycobacterium tuberculosis
LAESFSEVHPLPGRDLMPV

SEQ ID NO: 1462301 - protein, 18 aa, Mycobacterium tuberculosis
LAGDAWHGPASLAMTRAA

SEQ ID NO: 1462302 - protein, 20 aa, Mycobacterium tuberculosis
LAGIRSALSASYAAAAGPTT

SEQ ID NO: 1462303 - protein, 17 aa, Mycobacterium tuberculosis
LAHVAGLHHRSVKIADL

SEQ ID NO: 1462304 - protein, 24 aa, Mycobacterium tuberculosis
LAKAAELRYGRIPEVEKKLDAALP

SEQ ID NO: 1462305 - protein, 25 aa, Mycobacterium tuberculosis
LALAHEVRMRWCGPEVEVEGIISLK

SEQ ID NO: 1462306 - protein, 21 aa, Mycobacterium tuberculosis
LANAIGYPIAASVALVTPAAG

SEQ ID NO: 1462307 - protein, 27 aa, Mycobacterium tuberculosis
LARGDLALRMGLPVLAVVAFAQSFGDG

SEQ ID NO: 1462308 - protein, 17 aa, Mycobacterium tuberculosis
LASQAWQGPAAAAMAAA

SEQ ID NO: 1462309 - protein, 18 aa, Mycobacterium tuberculosis
LATTRWLVAILENHQRPD

SEQ ID NO: 1462310 - protein, 19 aa, Mycobacterium tuberculosis
LCASRVPMSIAAIAGKLGV

SEQ ID NO: 1462311 - protein, 19 aa, Mycobacterium tuberculosis
LDALVAHLPADRWADPTPA

SEQ ID NO: 1462312 - protein, 23 aa, Mycobacterium tuberculosis
LDERALFLGQWGLRGQRGGEGPS

SEQ ID NO: 1462313 - protein, 28 aa, Mycobacterium tuberculosis
LDFPELVIVCGHVGYPWTEEMVAVARKH

SEQ ID NO: 1462314 - protein, 19 aa, Mycobacterium tuberculosis
LDKLTKWSMPLIRPNGRML

SEQ ID NO: 1462315 - protein, 21 aa, Mycobacterium tuberculosis
LDMVVGGAVLKHSRDFNLMRE

SEQ ID NO: 1462316 - protein, 17 aa, Mycobacterium tuberculosis
LDRCARLLADIAGGEVS

SEQ ID NO: 1462317 - protein, 24 aa, Mycobacterium tuberculosis
LDRRSRAAGWGIISNAAHPGLTKT

SEQ ID NO: 1462318 - protein, 27 aa, Mycobacterium tuberculosis
LDVVRRARFAAAFTFQYSKRPGTPAAQ

SEQ ID NO: 1462319 - protein, 17 aa, Mycobacterium tuberculosis
LEAFANFGFPESHALSF

SEQ ID NO: 1462320 - protein, 24 aa, Mycobacterium tuberculosis
LEIDNLRAAFAFSRENGDTGHALL

SEQ ID NO: 1462321 - protein, 35 aa, Mycobacterium tuberculosis; identical to SEQ ID NO: 202233

SEQ ID NO: 1462322 - protein, 17 aa, Mycobacterium tuberculosis
LEVSCGAGGGASYIARN

SEQ ID NO: 1462323 - protein, 24 aa, Mycobacterium tuberculosis
LFKHLHRAGLRRVFIGVETGSYEQ

SEQ ID NO: 1462324 - protein, 27 aa, Mycobacterium tuberculosis
LFTGDCLFPGGVGKTWQPADFTQLLDD

SEQ ID NO: 1462325 - protein, 19 aa, Mycobacterium tuberculosis
LGDGVGRLARCVVEQAGRG

SEQ ID NO: 1462326 - protein, 22 aa, Mycobacterium tuberculosis
LGDLRSFMFVQMFSRALTEDEL

SEQ ID NO: 1462327 - protein, 19 aa, Mycobacterium tuberculosis
LGLVRLHIATVLGNITPEA

SEQ ID NO: 1462328 - protein, 19 aa, Mycobacterium tuberculosis
LGYQRCRVADGMVYGEGSS

SEQ ID NO: 1462329 - protein, 23 aa, Mycobacterium tuberculosis
LHHPRIPPIAGLDDFRGTVFHSA

SEQ ID NO: 1462330 - protein, 28 aa, Mycobacterium tuberculosis
LIEESIYGWKEFELELMRDGHDNVVVVC

SEQ ID NO: 1462331 - protein, 25 aa, Mycobacterium tuberculosis
LKCAIADGCGDVPALKSCTAAGTSC

SEQ ID NO: 1462332 - protein, 19 aa, Mycobacterium tuberculosis
LKEVREMQALLAKYGAGHR

SEQ ID NO: 1462333 - protein, 24 aa, Mycobacterium tuberculosis
LLAARCPIDGFGVGTQLVVAQDAP

SEQ ID NO: 1462334 - protein, 25 aa, Mycobacterium tuberculosis
LLADRPVVVAARLDRAALAGAELPA

SEQ ID NO: 1462335 - protein, 22 aa, Mycobacterium tuberculosis
LLARIGDAFLALPNGFTAHPRV

SEQ ID NO: 1462336 - protein, 17 aa, Mycobacterium tuberculosis
LLASSGFAARLAGRSAD

SEQ ID NO: 1462337 - protein, 21 aa, Mycobacterium tuberculosis
LLCAGITLYSPLRHWNAGANT

SEQ ID NO: 1462338 - protein, 17 aa, Mycobacterium tuberculosis
LLDACFQSVAAHPAVQG

SEQ ID NO: 1462339 - protein, 20 aa, Mycobacterium tuberculosis
LLDLLWRNRRGELEMSVVMV

SEQ ID NO: 1462340 - protein, 17 aa, Mycobacterium tuberculosis
LLDRLAAGEAFGRAAEP

SEQ ID NO: 1462341 - protein, 20 aa, Mycobacterium tuberculosis
LLGPLGDLFTIMTIPAQEAQ

SEQ ID NO: 1462342 - protein, 19 aa, Mycobacterium tuberculosis
LLHRADAAVLPSHYEPFGL

SEQ ID NO: 1462343 - protein, 20 aa, Mycobacterium tuberculosis
LLPVPARKVGRLILVDELAS

SEQ ID NO: 1462344 - protein, 24 aa, Mycobacterium tuberculosis
LLRIGHEVEEVIPLGPVDGPVTVG

SEQ ID NO: 1462345 - protein, 17 aa, Mycobacterium tuberculosis
LLRLWRPPLRPGEWRTL

SEQ ID NO: 1462346 - protein, 19 aa, Mycobacterium tuberculosis
LLVASALARQGPLLVVTAT

SEQ ID NO: 1462347 - protein, 18 aa, Mycobacterium tuberculosis
LMQNICFLYHLVGGGTGV

SEQ ID NO: 1462348 - protein, 23 aa, Mycobacterium tuberculosis
LMVEAVAPYVAWMRATAIQAEQA

SEQ ID NO: 1462349 - protein, 20 aa, Mycobacterium tuberculosis
LNGGSLIGLEWAEIVRGQIA

SEQ ID NO: 1462350 - protein, 18 aa, Mycobacterium tuberculosis
LNHPEAIAVIADHILEGA

SEQ ID NO: 1462351 - protein, 18 aa, Mycobacterium tuberculosis
LNLSFAIAVRKRAKADAQ

SEQ ID NO: 1462352 - protein, 21 aa, Mycobacterium tuberculosis
LNLSIRDGWWDEWYDGENGWE

SEQ ID NO: 1462353 - protein, 18 aa, Mycobacterium tuberculosis
LNRLRALTHDDFRNAWFV

SEQ ID NO: 1462354 - protein, 17 aa, Mycobacterium tuberculosis
LPFGGGVRRCLGFGFAL

SEQ ID NO: 1462355 - protein, 27 aa, Mycobacterium tuberculosis
LPFYHDMGLVIGICAPILGGYPAVLTS

SEQ ID NO: 1462356 - protein, 17 aa, Mycobacterium tuberculosis
LPLHLALNLTVPDSSIP

SEQ ID NO: 1462357 - protein, 19 aa, Mycobacterium tuberculosis
LPLYCASLRTAEPRLLERL

SEQ ID NO: 1462358 - protein, 26 aa, Mycobacterium tuberculosis
LPSYPHPRLMPDFWEFPTVSMGLGPL

SEQ ID NO: 1462359 - protein, 19 aa, Mycobacterium tuberculosis
LQFGSNHLGHFALTAHLLP

SEQ ID NO: 1462360 - protein, 34 aa, Mycobacterium tuberculosis; identical to SEQ ID NO: 202801

SEQ ID NO: 1462361 - protein, 19 aa, Mycobacterium tuberculosis
LQRRGFLEVETPVLQTLAG

SEQ ID NO: 1462362 - protein, 25 aa, Mycobacterium tuberculosis
LQYWRGRGLPGKRRLMTWRGGYHGD

SEQ ID NO: 1462363 - protein, 19 aa, Mycobacterium tuberculosis
LRAELTVACDGRWSIARHE

SEQ ID NO: 1462364 - protein, 23 aa, Mycobacterium tuberculosis
LRAHVPDAGGMIIASDRTTARAY

SEQ ID NO: 1462365 - protein, 17 aa, Mycobacterium tuberculosis
LRAQGFNDLLIRLATAL

SEQ ID NO: 1462366 - protein, 18 aa, Mycobacterium tuberculosis
LRARRDRLAAGLTEIGFA

SEQ ID NO: 1462367 - protein, 19 aa, Mycobacterium tuberculosis
LRGSRVVLRVPRRGDKRAL

SEQ ID NO: 1462368 - protein, 20 aa, Mycobacterium tuberculosis
LRLHPNMVRQGGRRSAADPF

SEQ ID NO: 1462369 - protein, 21 aa, Mycobacterium tuberculosis
LRLVAAGVNPIALGVGIGKAA

SEQ ID NO: 1462370 - protein, 19 aa, Mycobacterium tuberculosis
LRPIESIRVGDFVTGHDGR

SEQ ID NO: 1462371 - protein, 17 aa, Mycobacterium tuberculosis
LRPPPPQRYPLSEAQAA

SEQ ID NO: 1462372 - protein, 30 aa, Mycobacterium tuberculosis; identical to SEQ ID NO: 202926

SEQ ID NO: 1462373 - protein, 17 aa, Mycobacterium tuberculosis
LRRDEWLHRRFGDIVRL

SEQ ID NO: 1462374 - protein, 19 aa, Mycobacterium tuberculosis
LRRQLKPLGRQAEAAQRAA

SEQ ID NO: 1462375 - protein, 20 aa, Mycobacterium tuberculosis
LRRSGRISGAKAWLGTALAL

SEQ ID NO: 1462376 - protein, 17 aa, Mycobacterium tuberculosis
LRTWLFRIADDEHVLVA

SEQ ID NO: 1462377 - protein, 17 aa, Mycobacterium tuberculosis
LRVDEVLFATGRAPRTD

SEQ ID NO: 1462378 - protein, 17 aa, Mycobacterium tuberculosis
LSAAGADVIMAIRNRAK

SEQ ID NO: 1462379 - protein, 39 aa, Mycobacterium tuberculosis; identical to SEQ ID NO: 202983

SEQ ID NO: 1462380 - protein, 25 aa, Mycobacterium tuberculosis
LSALGPKLPELWGGSADLAGSNNTT

SEQ ID NO: 1462381 - protein, 25 aa, Mycobacterium tuberculosis
LSHGRVSVGVGFGWNTDELVDHGVP

SEQ ID NO: 1462382 - protein, 24 aa, Mycobacterium tuberculosis
LSTEHWMGPASLSMAAAVQPYLVW

SEQ ID NO: 1462383 - protein, 17 aa, Mycobacterium tuberculosis
LTDHGFRAFAGHSLDVR

SEQ ID NO: 1462384 - protein, 22 aa, Mycobacterium tuberculosis
LTGSGLLGFGGLNSGTGNIGLF

SEQ ID NO: 1462385 - protein, 32 aa, Mycobacterium tuberculosis; identical to SEQ ID NO: 203126

SEQ ID NO: 1462386 - protein, 17 aa, Mycobacterium tuberculosis
LTVACDGRWSIARHEAG

SEQ ID NO: 1462387 - protein, 24 aa, Mycobacterium tuberculosis
LVAALQRRGHLAAVDLDRIFDAAR

SEQ ID NO: 1462388 - protein, 18 aa, Mycobacterium tuberculosis
LVDSLGFTLSGLQPGFTD

SEQ ID NO: 1462389 - protein, 20 aa, Mycobacterium tuberculosis
LVFPVKRLADLGFRVLATEG

SEQ ID NO: 1462390 - protein, 31 aa, Mycobacterium tuberculosis; identical to SEQ ID NO: 203193

SEQ ID NO: 1462391 - protein, 25 aa, Mycobacterium tuberculosis
LVRNMPRPLVAVAAILAPLMQDAEL

SEQ ID NO: 1462392 - protein, 17 aa, Mycobacterium tuberculosis
LVRREYMTAIGPVDLLC

SEQ ID NO: 1462393 - protein, 18 aa, Mycobacterium tuberculosis
LWARAGTLATALSAEPAI

SEQ ID NO: 1462394 - protein, 23 aa, Mycobacterium tuberculosis
LYDSYIRAFRWATDRIGDNGVVG

SEQ ID NO: 1462395 - protein, 20 aa, Mycobacterium tuberculosis
MAAAASPYVAWMSVTAGQAQ

SEQ ID NO: 1462396 - protein, 18 aa, Mycobacterium tuberculosis
MCRRCPVIEACRSHALEV

SEQ ID NO: 1462397 - protein, 21 aa, Mycobacterium tuberculosis
MGFVDARGFDSLPIEERRRDA

SEQ ID NO: 1462398 - protein, 20 aa, Mycobacterium tuberculosis
MLDLGFLPDIERILRQIPAD

SEQ ID NO: 1462399 - protein, 20 aa, Mycobacterium tuberculosis
MLLEVAWEALEHAGIPPDSL

SEQ ID NO: 1462400 - protein, 20 aa, Mycobacterium tuberculosis
MLLLWIRGVRFMYSVDPYLP

SEQ ID NO: 1462401 - protein, 21 aa, Mycobacterium tuberculosis
MMMPFLEHFVMRSRYVDNPGL

SEQ ID NO: 1462402 - protein, 28 aa, Mycobacterium tuberculosis
MNNGVFYRGVGQGSLQFAITSPDLTLPS

SEQ ID NO: 1462403 - protein, 19 aa, Mycobacterium tuberculosis
MSDEEWDAVIAVHLRGHFL

SEQ ID NO: 1462404 - protein, 20 aa, Mycobacterium tuberculosis
MSGGMPAAAFGGRAEVMQRL

SEQ ID NO: 1462405 - protein, 18 aa, Mycobacterium tuberculosis
MTSAGGLLEQAAAVEEAS

SEQ ID NO: 1462406 - protein, 18 aa, Mycobacterium tuberculosis
NADAFSWSQTFESLVPVD

SEQ ID NO: 1462407 - protein, 23 aa, Mycobacterium tuberculosis
NATLRYLMFSVFSVSPGALGDQR

SEQ ID NO: 1462408 - protein, 24 aa, Mycobacterium tuberculosis
NAVLALASVEAFFGAGAQRQLDGD

SEQ ID NO: 1462409 - protein, 20 aa, Mycobacterium tuberculosis
NEIHAARCGIELAPDTNQQV

SEQ ID NO: 1462410 - protein, 20 aa, Mycobacterium tuberculosis
NFGDCLSYALAIDRREPLLW

SEQ ID NO: 1462411 - protein, 19 aa, Mycobacterium tuberculosis
NFTDGWLRTGDLGSLSAAG

SEQ ID NO: 1462412 - protein, 23 aa, Mycobacterium tuberculosis
NIGHLEAAAGIAGFIKATLAVQR

SEQ ID NO: 1462413 - protein, 17 aa, Mycobacterium tuberculosis
NKIGALSVPPSWVKTTA

SEQ ID NO: 1462414 - protein, 19 aa, Mycobacterium tuberculosis
NLIRARWARELAKGRQVGH

SEQ ID NO: 1462415 - protein, 22 aa, Mycobacterium tuberculosis
NRAVELACTVGRTLKSGTTVNL

SEQ ID NO: 1462416 - protein, 18 aa, Mycobacterium tuberculosis
NRLAHRLAGCGAGPGECV

SEQ ID NO: 1462417 - protein, 23 aa, Mycobacterium tuberculosis
NRPQRFQVTASRFGRSVDVAAAR

SEQ ID NO: 1462418 - protein, 18 aa, Mycobacterium tuberculosis
NSGTGNWGIANTGDTNTG

SEQ ID NO: 1462419 - protein, 19 aa, Mycobacterium tuberculosis
NSGTGNWGIGNPGTDNTGI

SEQ ID NO: 1462420 - protein, 18 aa, Mycobacterium tuberculosis
NSGTGNWGIGNSGDYNTG

SEQ ID NO: 1462421 - protein, 24 aa, Mycobacterium tuberculosis
NSIGGFRNAMTFVLTGLDIDAKAD

SEQ ID NO: 1462422 - protein, 25 aa, Mycobacterium tuberculosis
NSLVTWGAGVPAAMGTSTAGQVSIS

SEQ ID NO: 1462423 - protein, 20 aa, Mycobacterium tuberculosis
NSTPLPAARIGPGTNNAPSA

SEQ ID NO: 1462424 - protein, 26 aa, Mycobacterium tuberculosis
NTPVVWRGPMLHRALQQFLADVYWGD

SEQ ID NO: 1462425 - protein, 18 aa, Mycobacterium tuberculosis
NTVPRGGVLGTQRLLDEL

SEQ ID NO: 1462426 - protein, 25 aa, Mycobacterium tuberculosis
NVAVSRAQYAAVIVRSELLTQYLPA

SEQ ID NO: 1462427 - protein, 25 aa, Mycobacterium tuberculosis
PADRHPHCAWTVIIDESYPEAEGIP

SEQ ID NO: 1462428 - protein, 18 aa, Mycobacterium tuberculosis
PAGPIPGFIVKRASEHVL

SEQ ID NO: 1462429 - protein, 24 aa, Mycobacterium tuberculosis
PAHLWWIRSQLRSMLVEDVRARLR

SEQ ID NO: 1462430 - protein, 20 aa, Mycobacterium tuberculosis
PAMHTEMWLHPATVDNVATL

SEQ ID NO: 1462431 - protein, 21 aa, Mycobacterium tuberculosis
PARARTPLPVPTPRGERPDDG

SEQ ID NO: 1462432 - protein, 25 aa, Mycobacterium tuberculosis
PARKRRMFDLLVRMGYKEIEVGFPS

SEQ ID NO: 1462433 - protein, 18 aa, Mycobacterium tuberculosis
PASARLLVASALARQGPL

SEQ ID NO: 1462434 - protein, 18 aa, Mycobacterium tuberculosis
PAVIARYPAPPGAPTVLL

SEQ ID NO: 1462435 - protein, 30 aa, Mycobacterium tuberculosis
PAVPSYRGSCWIPFSLEIEGDAAGFVAEVG

SEQ ID NO: 1462436 - protein, 19 aa, Mycobacterium tuberculosis
PDHPKFHGPKGIGYAELPA

SEQ ID NO: 1462437 - protein, 17 aa, Mycobacterium tuberculosis
PDLPPSHHYLAAYRWLD

SEQ ID NO: 1462438 - protein, 18 aa, Mycobacterium tuberculosis
PDTFAGLVALRLPTDEEL

SEQ ID NO: 1462439 - protein, 18 aa, Mycobacterium tuberculosis
PEDLGWHTICAVMTTEFL

SEQ ID NO: 1462440 - protein, 30 aa, Mycobacterium tuberculosis
PGDLATIWRGGCIIRAKFLNHIKEAFDASP

SEQ ID NO: 1462441 - protein, 31 aa, Mycobacterium tuberculosis; identical to SEQ ID NO: 204027

SEQ ID NO: 1462442 - protein, 26 aa, Mycobacterium tuberculosis
PGPWKESLRLLAHEVMPRLNARLATK

SEQ ID NO: 1462443 - protein, 23 aa, Mycobacterium tuberculosis
PGRVKTRLAAAIGDKVAADIAAA

SEQ ID NO: 1462444 - protein, 18 aa, Mycobacterium tuberculosis
PGSVACCLVGVTAVADGI

SEQ ID NO: 1462445 - protein, 24 aa, Mycobacterium tuberculosis
PGVEFKDLTPLFADRRGLAAVTEA

SEQ ID NO: 1462446 - protein, 17 aa, Mycobacterium tuberculosis
PHARIKASHFIQEDSGT

SEQ ID NO: 1462447 - protein, 18 aa, Mycobacterium tuberculosis
PHLIRQLARMGAKTIVAM

SEQ ID NO: 1462448 - protein, 19 aa, Mycobacterium tuberculosis
PHMERRFSADGTSWDPTEL

SEQ ID NO: 1462449 - protein, 18 aa, Mycobacterium tuberculosis
PHRSAVLTASLTSPRGKR

SEQ ID NO: 1462450 - protein, 17 aa, Mycobacterium tuberculosis
PILSDRVLAIIDSAYIR

SEQ ID NO: 1462451 - protein, 20 aa, Mycobacterium tuberculosis
PIQSIYGWRGASATNLPRFT

SEQ ID NO: 1462452 - protein, 22 aa, Mycobacterium tuberculosis
PKGIWAPECAYAPGMEVDYATA

SEQ ID NO: 1462453 - protein, 19 aa, Mycobacterium tuberculosis
PLACPGLLGAMTVGATAVF

SEQ ID NO: 1462454 - protein, 18 aa, Mycobacterium tuberculosis
PLGFDIRTSAGPLNIPII

SEQ ID NO: 1462455 - protein, 24 aa, Mycobacterium tuberculosis
PLMRGYLRLGARACGEPAHDPDFG

SEQ ID NO: 1462456 - protein, 17 aa, Mycobacterium tuberculosis
PLRFKREGAGHFNRGTQ

SEQ ID NO: 1462457 - protein, 18 aa, Mycobacterium tuberculosis
PLVQGMRVGLAAEVKRTH

SEQ ID NO: 1462458 - protein, 18 aa, Mycobacterium tuberculosis
PLYHDMGLMVGLFIPLFV

SEQ ID NO: 1462459 - protein, 19 aa, Mycobacterium tuberculosis
PNPMRQLRITVGLIADLKV

SEQ ID NO: 1462460 - protein, 17 aa, Mycobacterium tuberculosis
PPCDDWSPPPIRMGVDV

SEQ ID NO: 1462461 - protein, 20 aa, Mycobacterium tuberculosis
PPGAPGMPGMPGMPGAPGAP

SEQ ID NO: 1462462 - protein, 32 aa, Mycobacterium tuberculosis; identical to SEQ ID NO: 204244

SEQ ID NO: 1462463 - protein, 18 aa, Mycobacterium tuberculosis
PPLYVGGGPANFPRIARL

SEQ ID NO: 1462464 - protein, 25 aa, Mycobacterium tuberculosis
PPRWLPGPRELRAWTLAAGSPEADR

SEQ ID NO: 1462465 - protein, 17 aa, Mycobacterium tuberculosis
PQIIPFQLVDNASGHVL

SEQ ID NO: 1462466 - protein, 22 aa, Mycobacterium tuberculosis
PQLPSTALMDVLLRRPPRTRSG

SEQ ID NO: 1462467 - protein, 20 aa, Mycobacterium tuberculosis
PREWSDWVTRTAMPPLRIPD

SEQ ID NO: 1462468 - protein, 26 aa, Mycobacterium tuberculosis
PRLTALMCTADILALSAMDYLRAHGI

SEQ ID NO: 1462469 - protein, 20 aa, Mycobacterium tuberculosis
PRTALWLLLAKGGGDTEVSA

SEQ ID NO: 1462470 - protein, 18 aa, Mycobacterium tuberculosis
PRVHLFFGARYACELYDL

SEQ ID NO: 1462471 - protein, 21 aa, Mycobacterium tuberculosis
PSLTEFSVWVVFMMESGSRRA

SEQ ID NO: 1462472 - protein, 18 aa, Mycobacterium tuberculosis
PSVPHVLIEPGVRTGIPL

SEQ ID NO: 1462473 - protein, 19 aa, Mycobacterium tuberculosis
PTACILCECNCGIVVQVDD

SEQ ID NO: 1462474 - protein, 27 aa, Mycobacterium tuberculosis
PTANPCGVCESCVSLAPNAPGSIDVVE

SEQ ID NO: 1462475 - protein, 20 aa, Mycobacterium tuberculosis
PTGCGKTYLAQTLAKMLNVP

SEQ ID NO: 1462476 - protein, 17 aa, Mycobacterium tuberculosis
PTLILHRVGSTYIPVGH

SEQ ID NO: 1462477 - protein, 19 aa, Mycobacterium tuberculosis
PTMTTPFIVEMLKRERDIQ

SEQ ID NO: 1462478 - protein, 18 aa, Mycobacterium tuberculosis
PTRGCSAPTDRFRAAVRA

SEQ ID NO: 1462479 - protein, 24 aa, Mycobacterium tuberculosis
PVVSFRLAGDRGYTEFDVSHELRT

SEQ ID NO: 1462480 - protein, 19 aa, Mycobacterium tuberculosis
PWGAFDMSLGKAMYAGFTL

SEQ ID NO: 1462481 - protein, 20 aa, Mycobacterium tuberculosis
QAAQFGWQGASAMALNAKMD

SEQ ID NO: 1462482 - protein, 24 aa, Mycobacterium tuberculosis
QALNDCPLRWLAERHGGTNTRELP

SEQ ID NO: 1462483 - protein, 21 aa, Mycobacterium tuberculosis
QARSGEFSWRQSAEALRSVLE

SEQ ID NO: 1462484 - protein, 23 aa, Mycobacterium tuberculosis
QAVAARHGFAQDVANVGFAGDAG

SEQ ID NO: 1462485 - protein, 17 aa, Mycobacterium tuberculosis
QDLCAKTRVFILAESLG

SEQ ID NO: 1462486 - protein, 35 aa, Mycobacterium tuberculosis; identical to SEQ ID NO: 83529

SEQ ID NO: 1462487 - protein, 17 aa, Mycobacterium tuberculosis
QGPFPMETVYLWEDGPN

SEQ ID NO: 1462488 - protein, 22 aa, Mycobacterium tuberculosis
QGRLDLGLGAGWFRRESQAYGI

SEQ ID NO: 1462489 - protein, 24 aa, Mycobacterium tuberculosis
QPSPGGPFDWRLPDLVGASLDSLL

SEQ ID NO: 1462490 - protein, 25 aa, Mycobacterium tuberculosis
QRFADWLVRVVEAFADRPDQPLREV

SEQ ID NO: 1462491 - protein, 19 aa, Mycobacterium tuberculosis
QRHASLLPLLHNYREPAKP

SEQ ID NO: 1462492 - protein, 19 aa, Mycobacterium tuberculosis
QRLAAAGLTCLGWPEEHGG

SEQ ID NO: 1462493 - protein, 21 aa, Mycobacterium tuberculosis
QRLSGPLQRLRAMAGGDVPVT

SEQ ID NO: 1462494 - protein, 32 aa, Mycobacterium tuberculosis; identical to SEQ ID NO: 204851

SEQ ID NO: 1462495 - protein, 23 aa, Mycobacterium tuberculosis
QTRRWNPKMKRFIFTDRNGIYII

SEQ ID NO: 1462496 - protein, 25 aa, Mycobacterium tuberculosis
QYREGMARAWGPVRVAIAAEQAHGA

SEQ ID NO: 1462497 - protein, 28 aa, Mycobacterium tuberculosis
RAAFAAATRGGWRAGGVRDGRIGTLVPG

SEQ ID NO: 1462498 - protein, 21 aa, Mycobacterium tuberculosis
RAAGIARRTLFRYYASKNAIP

SEQ ID NO: 1462499 - protein, 17 aa, Mycobacterium tuberculosis
RAAGTGARRVAVVRLPR

SEQ ID NO: 1462500 - protein, 21 aa, Mycobacterium tuberculosis
RAAVVGAGLMGRRIAGVLASA

SEQ ID NO: 1462501 - protein, 21 aa, Mycobacterium tuberculosis
RADVLPLPGGLTVHLPQPPNY

SEQ ID NO: 1462502 - protein, 23 aa, Mycobacterium tuberculosis
RAEMEMKVLLWAVQRLIGGLSTI

SEQ ID NO: 1462503 - protein, 24 aa, Mycobacterium tuberculosis
RAEPWGVWGGEIFDQGSIVSHKRP

SEQ ID NO: 1462504 - protein, 17 aa, Mycobacterium tuberculosis
RAFIEISAHPALLFAIG

SEQ ID NO: 1462505 - protein, 20 aa, Mycobacterium tuberculosis
RAKANGINLWRVDADHVSVA

SEQ ID NO: 1462506 - protein, 25 aa, Mycobacterium tuberculosis
RARRFPKGLAAFIGLRDQRCRMPYC

SEQ ID NO: 1462507 - protein, 23 aa, Mycobacterium tuberculosis
RASGLPAAVINWGPWSEVGVAQA

SEQ ID NO: 1462508 - protein, 25 aa, Mycobacterium tuberculosis
RASLAKILAGFGYRVQESAFEAMLT

SEQ ID NO: 1462509 - protein, 24 aa, Mycobacterium tuberculosis
RATMKVSWRLYAYVSKDADRAQRR

SEQ ID NO: 1462510 - protein, 19 aa, Mycobacterium tuberculosis
RAVCDGRRLVTLDGPEIGA

SEQ ID NO: 1462511 - protein, 18 aa, Mycobacterium tuberculosis
RAVDAGAAGHIFNLGHGV

SEQ ID NO: 1462512 - protein, 26 aa, Mycobacterium tuberculosis
RAVQAWRGFSRWLMRAYDVLVDEDQI

SEQ ID NO: 1462513 - protein, 19 aa, Mycobacterium tuberculosis
RAVRWHRYSLDNGDMHRTC

SEQ ID NO: 1462514 - protein, 20 aa, Mycobacterium tuberculosis
RAYTPWYLVRYWRLLRFKLA

SEQ ID NO: 1462515 - protein, 26 aa, Mycobacterium tuberculosis
RDASVRCARLYRAAVHAGAKGLTVRL

SEQ ID NO: 1462516 - protein, 18 aa, Mycobacterium tuberculosis
RDEVPVLLVRGQVSDIVR

SEQ ID NO: 1462517 - protein, 19 aa, Mycobacterium tuberculosis
RDGLLRLLVDVQYTRNDMS

SEQ ID NO: 1462518 - protein, 19 aa, Mycobacterium tuberculosis
RDGPHVRLWAKLEDRNPTG

SEQ ID NO: 1462519 - protein, 22 aa, Mycobacterium tuberculosis
REHPRPVAAGLYGDLTATLSAL

SEQ ID NO: 1462520 - protein, 19 aa, Mycobacterium tuberculosis
RELTGGRRSFILVPGIDVP

SEQ ID NO: 1462521 - protein, 17 aa, Mycobacterium tuberculosis
REPIPGMGHAIELRVYR

SEQ ID NO: 1462522 - protein, 18 aa, Mycobacterium tuberculosis
RERGRVGAALVTEIYSVG

SEQ ID NO: 1462523 - protein, 25 aa, Mycobacterium tuberculosis
RFAFTSWKTLGWVDANVWRHVVPKG

SEQ ID NO: 1462524 - protein, 18 aa, Mycobacterium tuberculosis
RFGDAFIPMDETLAHAAV

SEQ ID NO: 1462525 - protein, 17 aa, Mycobacterium tuberculosis
RFRSHPDLEVLTHGLTL

SEQ ID NO: 1462526 - protein, 29 aa, Mycobacterium tuberculosis
RFSFNVKGGRCEACTGDGTIKIEMNFLPD

SEQ ID NO: 1462527 - protein, 20 aa, Mycobacterium tuberculosis
RGGIILCNDPAIAKKINSAV

SEQ ID NO: 1462528 - protein, 26 aa, Mycobacterium tuberculosis
RGSLLKELRSILAPECAARAREISTR

SEQ ID NO: 1462529 - protein, 17 aa, Mycobacterium tuberculosis
RGTGARGLRAIMEEVLL

SEQ ID NO: 1462530 - protein, 23 aa, Mycobacterium tuberculosis
RHARIPVSVMPNAGLPVLGAKGA

SEQ ID NO: 1462531 - protein, 18 aa, Mycobacterium tuberculosis
RHELLSGLVPQISIILGK

SEQ ID NO: 1462532 - protein, 26 aa, Mycobacterium tuberculosis
RHRDGPRPTLCVIHGFMGSSYLLNGL

SEQ ID NO: 1462533 - protein, 18 aa, Mycobacterium tuberculosis
RHTPEIAQGLRAVTDRDV

SEQ ID NO: 1462534 - protein, 19 aa, Mycobacterium tuberculosis
RIDGRFAGLRRWDGNTRAE

SEQ ID NO: 1462535 - protein, 21 aa, Mycobacterium tuberculosis
RISDVLLPFLVTRQLICGAGK

SEQ ID NO: 1462536 - protein, 18 aa, Mycobacterium tuberculosis
RKAFNWTVTALKADIKAW

SEQ ID NO: 1462537 - protein, 19 aa, Mycobacterium tuberculosis
RKLDTMAANLARLTDLTTE

SEQ ID NO: 1462538 - protein, 20 aa, Mycobacterium tuberculosis
RKNLMLFAGRAHPELAEQVA

SEQ ID NO: 1462539 - protein, 26 aa, Mycobacterium tuberculosis
RLAAALPDYPFAYLITVDDGHRVHTV

SEQ ID NO: 1462540 - protein, 26 aa, Mycobacterium tuberculosis
RLAEAIRRFGPIFAQYYGQSEAPMVI

SEQ ID NO: 1462541 - protein, 26 aa, Mycobacterium tuberculosis
RLAQRQGIEILGPVGVAARTAATVGD

SEQ ID NO: 1462542 - protein, 19 aa, Mycobacterium tuberculosis
RLDAIAAELDRAVPDQDQL

SEQ ID NO: 1462543 - protein, 21 aa, Mycobacterium tuberculosis
RLGGPGSWLLAVPPYHIAGLA

SEQ ID NO: 1462544 - protein, 19 aa, Mycobacterium tuberculosis
RLIAFGRERMRFVHAHHQL

SEQ ID NO: 1462545 - protein, 21 aa, Mycobacterium tuberculosis
RLLDCCQETDGAVAIVVTSAA

SEQ ID NO: 1462546 - protein, 19 aa, Mycobacterium tuberculosis
RLRKPTVLVIDQIPDREGE

SEQ ID NO: 1462547 - protein, 24 aa, Mycobacterium tuberculosis
RLRRRGPVHVVDWHNVAGLTPSAL

SEQ ID NO: 1462548 - protein, 19 aa, Mycobacterium tuberculosis
RLTCVFVDHGLLRAGERAQ

SEQ ID NO: 1462549 - protein, 22 aa, Mycobacterium tuberculosis
RLTGNFWLPEKIPLSNDLASWQ

SEQ ID NO: 1462550 - protein, 18 aa, Mycobacterium tuberculosis
RMNSMAFDVMVPLKEALA

SEQ ID NO: 1462551 - protein, 32 aa, Mycobacterium tuberculosis; identical to SEQ ID NO: 205630

SEQ ID NO: 1462552 - protein, 19 aa, Mycobacterium tuberculosis
RNPGSPAERLRALRRACAA

SEQ ID NO: 1462553 - protein, 23 aa, Mycobacterium tuberculosis
RNRRGELEMSVVMVIANHPDLAA

SEQ ID NO: 1462554 - protein, 21 aa, Mycobacterium tuberculosis
RNYITGLSCHGAIVVGGSSGA

SEQ ID NO: 1462555 - protein, 17 aa, Mycobacterium tuberculosis
RPDNLLAVANAAIGAAI

SEQ ID NO: 1462556 - protein, 19 aa, Mycobacterium tuberculosis
RPEVARRWLAALSADQIGI

SEQ ID NO: 1462557 - protein, 24 aa, Mycobacterium tuberculosis
RPGDIAIVSMHWGSNWGYATAPGD

SEQ ID NO: 1462558 - protein, 18 aa, Mycobacterium tuberculosis
RPHVSLAVAERIAPEVDE

SEQ ID NO: 1462559 - protein, 19 aa, Mycobacterium tuberculosis
RPHVVLKGGAIAWAAMGDA

SEQ ID NO: 1462560 - protein, 23 aa, Mycobacterium tuberculosis
RPIPGPLKWDLTRGVATDTPESL

SEQ ID NO: 1462561 - protein, 17 aa, Mycobacterium tuberculosis
RPRMATLNPCSMSFGAG

SEQ ID NO: 1462562 - protein, 24 aa, Mycobacterium tuberculosis
RPVMVKAQVKIGGRGKAGGVKYAA

SEQ ID NO: 1462563 - protein, 21 aa, Mycobacterium tuberculosis
RQFVMATLFHKTRSWSNLLKV

SEQ ID NO: 1462564 - protein, 19 aa, Mycobacterium tuberculosis
RQHLAQAWRKHIGPPRQLP

SEQ ID NO: 1462565 - protein, 23 aa, Mycobacterium tuberculosis
RQQRGRFLCIADFIRSRELAAER

SEQ ID NO: 1462566 - protein, 24 aa, Mycobacterium tuberculosis
RRAARRARCGVARRVPLIRDETGS

SEQ ID NO: 1462567 - protein, 22 aa, Mycobacterium tuberculosis
RREALPRVQLWPIGPDGNYGEP

SEQ ID NO: 1462568 - protein, 18 aa, Mycobacterium tuberculosis
RRGIMFADVPWRGNRINR

SEQ ID NO: 1462569 - protein, 21 aa, Mycobacterium tuberculosis
RRLAEKLWNLRVLADEKSASD

SEQ ID NO: 1462570 - protein, 20 aa, Mycobacterium tuberculosis
RRLRHACALIADNLTQPLTL

SEQ ID NO: 1462571 - protein, 28 aa, Mycobacterium tuberculosis
RRPHRSLTSLGQWSWRTETEVDLDYHVR

SEQ ID NO: 1462572 - protein, 25 aa, Mycobacterium tuberculosis
RRTSAVKAFTAWAVRRGLLAGDPAA

SEQ ID NO: 1462573 - protein, 21 aa, Mycobacterium tuberculosis
RRYRCYTDRLTRLSCGYSATS

SEQ ID NO: 1462574 - protein, 24 aa, Mycobacterium tuberculosis
RSGLAALCAAVLVSSGCARFNDAQ

SEQ ID NO: 1462575 - protein, 17 aa, Mycobacterium tuberculosis
RSGMAWCIQAFGRQEML

SEQ ID NO: 1462576 - protein, 27 aa, Mycobacterium tuberculosis
RSGYPLELLVRAAAAGWRVVELDVSYG

SEQ ID NO: 1462577 - protein, 18 aa, Mycobacterium tuberculosis
RSTPSWSPASPTRASVVG

SEQ ID NO: 1462578 - protein, 19 aa, Mycobacterium tuberculosis
RTADGYASNWLCDHAQVGM

SEQ ID NO: 1462579 - protein, 19 aa, Mycobacterium tuberculosis
RTAQELREFFASRPDETGA

SEQ ID NO: 1462580 - protein, 19 aa, Mycobacterium tuberculosis
RTATDWAYAAGWMAVRALP

SEQ ID NO: 1462581 - protein, 31 aa, Mycobacterium tuberculosis; identical to SEQ ID NO: 206014

SEQ ID NO: 1462582 - protein, 26 aa, Mycobacterium tuberculosis
RTGHMPVRRLDLIWISARNAARRELD

SEQ ID NO: 1462583 - protein, 24 aa, Mycobacterium tuberculosis
RTHTRFGPVQADGRYLLRTDAGEE

SEQ ID NO: 1462584 - protein, 27 aa, Mycobacterium tuberculosis
RTVFIELLAWQFASPVRWIETQDLLFI

SEQ ID NO: 1462585 - protein, 17 aa, Mycobacterium tuberculosis
RVHPAPMETCGAVADLD

SEQ ID NO: 1462586 - protein, 24 aa, Mycobacterium tuberculosis
RVHVPEIPAHVTVEVPVNIPITAS

SEQ ID NO: 1462587 - protein, 19 aa, Mycobacterium tuberculosis
RVICRRSALMTRIAGAGAM

SEQ ID NO: 1462588 - protein, 18 aa, Mycobacterium tuberculosis
RVLRVSWCTVLRSSGGEL

SEQ ID NO: 1462589 - protein, 23 aa, Mycobacterium tuberculosis
RVRTRLIELFELFDPADPEVVAG

SEQ ID NO: 1462590 - protein, 20 aa, Mycobacterium tuberculosis
RVVDRPAWIRSAAESMRAMT

SEQ ID NO: 1462591 - protein, 20 aa, Mycobacterium tuberculosis
RWVVEHGFRGLSLRPFMIGR

SEQ ID NO: 1462592 - protein, 21 aa, Mycobacterium tuberculosis
RYGGVTICQWTRYFPAGDPVA

SEQ ID NO: 1462593 - protein, 19 aa, Mycobacterium tuberculosis
SAAAARAAGAAAQAKAVAS

SEQ ID NO: 1462594 - protein, 19 aa, Mycobacterium tuberculosis
SAAPNFAFDLAVAKTSEED

SEQ ID NO: 1462595 - protein, 18 aa, Mycobacterium tuberculosis
SAESRTLARLGLANYFAA

SEQ ID NO: 1462596 - protein, 17 aa, Mycobacterium tuberculosis
SAGLPAVGINWGPWADV

SEQ ID NO: 1462597 - protein, 24 aa, Mycobacterium tuberculosis
SALLFPALCTPTGDPPRPDPARAD

SEQ ID NO: 1462598 - protein, 17 aa, Mycobacterium tuberculosis
SARELAHDTTIRFTHEL

SEQ ID NO: 1462599 - protein, 20 aa, Mycobacterium tuberculosis
SARNETEWQRLMVALSAFDL

SEQ ID NO: 1462600 - protein, 18 aa, Mycobacterium tuberculosis
SDELDRLVADAAHYPPSQ

SEQ ID NO: 1462601 - protein, 23 aa, Mycobacterium tuberculosis
SDGFWDEVFRELSIPYLPVRWST

SEQ ID NO: 1462602 - protein, 19 aa, Mycobacterium tuberculosis
SDLPVTLVRSITWDQGIEM

SEQ ID NO: 1462603 - protein, 19 aa, Mycobacterium tuberculosis
SDPRKVLAAVGVGDVDNAE

SEQ ID NO: 1462604 - protein, 27 aa, Mycobacterium tuberculosis
SEFPWCGQAAEVLRSHFGASLPVRVCT

SEQ ID NO: 1462605 - protein, 17 aa, Mycobacterium tuberculosis
SGARRGGAVSGIGGHNA

SEQ ID NO: 1462606 - protein, 20 aa, Mycobacterium tuberculosis
SGASRAAVRLQIDQPGRLDA

SEQ ID NO: 1462607 - protein, 18 aa, Mycobacterium tuberculosis
SGGVWGRERGYCLMIGGD

SEQ ID NO: 1462608 - protein, 24 aa, Mycobacterium tuberculosis
SGMLGGLSVPLSWGVAVPPDDYDH

SEQ ID NO: 1462609 - protein, 21 aa, Mycobacterium tuberculosis
SGNYLPRFGPYLSSASNPWGD

SEQ ID NO: 1462610 - protein, 20 aa, Mycobacterium tuberculosis
SGRESIEIPAIRRSVDPRRQ

SEQ ID NO: 1462611 - protein, 18 aa, Mycobacterium tuberculosis
SGTWAVAVDRGGQLRWYG

SEQ ID NO: 1462612 - protein, 17 aa, Mycobacterium tuberculosis
SGWRVVEAVDEPSAITT

SEQ ID NO: 1462613 - protein, 19 aa, Mycobacterium tuberculosis
SIADAARWASTDRIVEPSA

SEQ ID NO: 1462614 - protein, 17 aa, Mycobacterium tuberculosis
SKGGDPRSPGWYHNLKA

SEQ ID NO: 1462615 - protein, 20 aa, Mycobacterium tuberculosis
SKNAIPWGDFSTHLAQLQGL

SEQ ID NO: 1462616 - protein, 19 aa, Mycobacterium tuberculosis
SLARLLAPVLPKLDTVHTV

SEQ ID NO: 1462617 - protein, 29 aa, Mycobacterium tuberculosis
SLDARIAGRLGLRADVRRVPLFGLGCVAG

SEQ ID NO: 1462618 - protein, 21 aa, Mycobacterium tuberculosis
SLPTDRPIIYATLGSSGGKNL

SEQ ID NO: 1462619 - protein, 28 aa, Mycobacterium tuberculosis
SMNNGLLWRADRQGLLAANYTITIERPA

SEQ ID NO: 1462620 - protein, 19 aa, Mycobacterium tuberculosis
SNKAFGRWGEVFGGDDVVA

SEQ ID NO: 1462621 - protein, 18 aa, Mycobacterium tuberculosis
SPTVTALLQLAAYADALV

SEQ ID NO: 1462622 - protein, 23 aa, Mycobacterium tuberculosis
SQLRSRFGFLAIHGGGLEQVTDL

SEQ ID NO: 1462623 - protein, 21 aa, Mycobacterium tuberculosis
SQMTWRSMIRDGLTMRHGKEL

SEQ ID NO: 1462624 - protein, 19 aa, Mycobacterium tuberculosis
SQQRLAFFADIHMIAVLTE

SEQ ID NO: 1462625 - protein, 19 aa, Mycobacterium tuberculosis
SRGAGGFGGVGQAGGKGWD

SEQ ID NO: 1462626 - protein, 22 aa, Mycobacterium tuberculosis
SRGRLAMAMAAIRARRSLDSAA

SEQ ID NO: 1462627 - protein, 22 aa, Mycobacterium tuberculosis
SRISFADGRVIVWSEELGESQY

SEQ ID NO: 1462628 - protein, 19 aa, Mycobacterium tuberculosis
SRRWLLNLVITRGTPPRLE

SEQ ID NO: 1462629 - protein, 22 aa, Mycobacterium tuberculosis
SRSTPWPGGELPDWYRRCYDPV

SEQ ID NO: 1462630 - protein, 19 aa, Mycobacterium tuberculosis
SRTLARLGLANYFAAATVL

SEQ ID NO: 1462631 - protein, 20 aa, Mycobacterium tuberculosis
SSRAPRIVFRTDRRTAVRVG

SEQ ID NO: 1462632 - protein, 17 aa, Mycobacterium tuberculosis
SSRRGRVLGTETAGHDR

SEQ ID NO: 1462633 - protein, 20 aa, Mycobacterium tuberculosis
SSSLVAIHLACQSLRLRETD

SEQ ID NO: 1462634 - protein, 24 aa, Mycobacterium tuberculosis
STPGCTKQACDFRDNLGDFTTAGL

SEQ ID NO: 1462635 - protein, 18 aa, Mycobacterium tuberculosis
STVVHGWDLAVATGQAGE

SEQ ID NO: 1462636 - protein, 24 aa, Mycobacterium tuberculosis
SVAGCGVCPGCETHDPVMCFSGPM

SEQ ID NO: 1462637 - protein, 19 aa, Mycobacterium tuberculosis
SVLPALGEEGIYIVTWADL

SEQ ID NO: 1462638 - protein, 21 aa, Mycobacterium tuberculosis
SVSMTAQWWLDAREPKKEVVA

SEQ ID NO: 1462639 - protein, 17 aa, Mycobacterium tuberculosis
SVTSDLASQAWQGPAAA

SEQ ID NO: 1462640 - protein, 24 aa, Mycobacterium tuberculosis
SYARQRPGLLAAWLDGDLGELPGD

SEQ ID NO: 1462641 - protein, 34 aa, Mycobacterium tuberculosis; identical to SEQ ID NO: 206803

SEQ ID NO: 1462642 - protein, 29 aa, Mycobacterium tuberculosis
SYSNGILWRGDYQGLIGYSDTLSIPAIPL

SEQ ID NO: 1462643 - protein, 24 aa, Mycobacterium tuberculosis
TAARRCPEATFLPSNPAAYNAASE

SEQ ID NO: 1462644 - protein, 21 aa, Mycobacterium tuberculosis
TAEGPRRAAVSSFGLGGTNAH

SEQ ID NO: 1462645 - protein, 28 aa, Mycobacterium tuberculosis
TAELLADCARLLLQIPAVLGLAFDGGWW

SEQ ID NO: 1462646 - protein, 24 aa, Mycobacterium tuberculosis
TAKMTARYSQWVRSRPLLLAGKSV

SEQ ID NO: 1462647 - protein, 17 aa, Mycobacterium tuberculosis
TAQRIVLTRNPRWWGAR

SEQ ID NO: 1462648 - protein, 25 aa, Mycobacterium tuberculosis
TDAGRRIRDAFVVGDGYAELMTADY

SEQ ID NO: 1462649 - protein, 24 aa, Mycobacterium tuberculosis
TDVPTGVVVPYFWSDQYDVKIQCL

SEQ ID NO: 1462650 - protein, 22 aa, Mycobacterium tuberculosis
TEDLKLLGVHIFGTSATEMVHI

SEQ ID NO: 1462651 - protein, 17 aa, Mycobacterium tuberculosis
TELTGITGARTWCGHGV

SEQ ID NO: 1462652 - protein, 18 aa, Mycobacterium tuberculosis
TELVCSNAAIVLGHSGTE

SEQ ID NO: 1462653 - protein, 19 aa, Mycobacterium tuberculosis
TGFDFPFAAMGAIHTENHI

SEQ ID NO: 1462654 - protein, 17 aa, Mycobacterium tuberculosis
TILYLYATMFKLKKSLD

SEQ ID NO: 1462655 - protein, 19 aa, Mycobacterium tuberculosis
TLILWDVADQPIWAGAVQR

SEQ ID NO: 1462656 - protein, 24 aa, Mycobacterium tuberculosis
TLNLTDVHIGWVFTRTVRNNARTH

SEQ ID NO: 1462657 - protein, 24 aa, Mycobacterium tuberculosis
TMKHLRAGYWRQVRAQLTVTPVML

SEQ ID NO: 1462658 - protein, 24 aa, Mycobacterium tuberculosis
TMPVPEPMVKMLLNNVLEHLAENL

SEQ ID NO: 1462659 - protein, 17 aa, Mycobacterium tuberculosis
TNLGLAIDLQGKDGKRS

SEQ ID NO: 1462660 - protein, 19 aa, Mycobacterium tuberculosis
TNTLCAVMGGDAIFDRLKE

SEQ ID NO: 1462661 - protein, 17 aa, Mycobacterium tuberculosis
TPAEVLELAVALRRENP

SEQ ID NO: 1462662 - protein, 29 aa, Mycobacterium tuberculosis
TPDRVDVVLRSKVDAAWHLHELTRDLDVS

SEQ ID NO: 1462663 - protein, 19 aa, Mycobacterium tuberculosis
TPGATPWVTWGEFVETRML

SEQ ID NO: 1462664 - protein, 24 aa, Mycobacterium tuberculosis
TQCANRFDVVQAFTDDALTTCERC

SEQ ID NO: 1462665 - protein, 19 aa, Mycobacterium tuberculosis
TRADGSIGLAPTAKEVTAL

SEQ ID NO: 1462666 - protein, 22 aa, Mycobacterium tuberculosis
TRLWEHWGKPEIVWYPGGHTGF

SEQ ID NO: 1462667 - protein, 26 aa, Mycobacterium tuberculosis
TRRLLPRVPRCIPLAARLAPGTIGCP

SEQ ID NO: 1462668 - protein, 20 aa, Mycobacterium tuberculosis
TRRTGLCQFEDAFTQLSGAT

SEQ ID NO: 1462669 - protein, 20 aa, Mycobacterium tuberculosis
TRTGVMMGLSSWDYTIVNIE

SEQ ID NO: 1462670 - protein, 18 aa, Mycobacterium tuberculosis
TSEFLTHPAFTQYRTETS

SEQ ID NO: 1462671 - protein, 26 aa, Mycobacterium tuberculosis
TSLTVATIVRRHWPTPSLARVDAEYE

SEQ ID NO: 1462672 - protein, 21 aa, Mycobacterium tuberculosis
TSLYVYARETVGYALMIGGRV

SEQ ID NO: 1462673 - protein, 25 aa, Mycobacterium tuberculosis
TVHAPRLSPAPALLALPAAESAWRL

SEQ ID NO: 1462674 - protein, 22 aa, Mycobacterium tuberculosis
TWIKEFDPRFNVRYRDDKSYPV

SEQ ID NO: 1462675 - protein, 17 aa, Mycobacterium tuberculosis
TWLPMPPEWAALTAEKQ

SEQ ID NO: 1462676 - protein, 22 aa, Mycobacterium tuberculosis
TYFLCADPRPLGYDDSTEFCAA

SEQ ID NO: 1462677 - protein, 19 aa, Mycobacterium tuberculosis
VAAKDIWVRPTERAHAEVI

SEQ ID NO: 1462678 - protein, 20 aa, Mycobacterium tuberculosis
VAAPGRAMTSAGLIDIAPHQ

SEQ ID NO: 1462679 - protein, 24 aa, Mycobacterium tuberculosis
VAASLRCPWCVDAHTTMLYAAGQT

SEQ ID NO: 1462680 - protein, 17 aa, Mycobacterium tuberculosis
VACGTAYHSGLLAKYAI

SEQ ID NO: 1462681 - protein, 19 aa, Mycobacterium tuberculosis
VADAGWKYLSTGAYAGSLD

SEQ ID NO: 1462682 - protein, 23 aa, Mycobacterium tuberculosis
VAERLAPGAHRWWQAGHRSSEPG

SEQ ID NO: 1462683 - protein, 22 aa, Mycobacterium tuberculosis
VAEYISALALLAKREQWAEFAR

SEQ ID NO: 1462684 - protein, 23 aa, Mycobacterium tuberculosis
VAGDTLSALALRFYGDAELNWLI

SEQ ID NO: 1462685 - protein, 17 aa, Mycobacterium tuberculosis
VALDFPELVIVCGHVGY

SEQ ID NO: 1462686 - protein, 24 aa, Mycobacterium tuberculosis
VALDRLGYDEAWFGEHHSGGYELI

SEQ ID NO: 1462687 - protein, 17 aa, Mycobacterium tuberculosis
VAMVVDMHGRRSRDIVD

SEQ ID NO: 1462688 - protein, 17 aa, Mycobacterium tuberculosis
VARGEYKSAANLFTEDG

SEQ ID NO: 1462689 - protein, 21 aa, Mycobacterium tuberculosis
VARRLAGLFASYARQRPGLLA

SEQ ID NO: 1462690 - protein, 20 aa, Mycobacterium tuberculosis
VAVVCLHSYLYPGHEREIGT

SEQ ID NO: 1462691 - protein, 17 aa, Mycobacterium tuberculosis
VCTNTLCAVMGGDAIFD

SEQ ID NO: 1462692 - protein, 32 aa, Mycobacterium tuberculosis; identical to SEQ ID NO: 207586

SEQ ID NO: 1462693 - protein, 23 aa, Mycobacterium tuberculosis
VDASLRLLVRGGRFLEMGKTDIR

SEQ ID NO: 1462694 - protein, 26 aa, Mycobacterium tuberculosis
VDDPDFDLGRHVWRIALPRPGNEDQL

SEQ ID NO: 1462695 - protein, 20 aa, Mycobacterium tuberculosis
VDEFERWVVEHGFRGLSLRP

SEQ ID NO: 1462696 - protein, 36 aa, Mycobacterium tuberculosis
VDELQEWPVVAGRPRRAGVSSFGFGGTNAHVIVEEA

SEQ ID NO: 1462697 - protein, 24 aa, Mycobacterium tuberculosis
VDHPRLGWRQAPVGPVLADALGLP

SEQ ID NO: 1462698 - protein, 18 aa, Mycobacterium tuberculosis
VDTGAFISGSYSNGFLWS

SEQ ID NO: 1462699 - protein, 29 aa, Mycobacterium tuberculosis
VEASHCYPHFRRFLAEVVRVLRPGGYFPY

SEQ ID NO: 1462700 - protein, 20 aa, Mycobacterium tuberculosis
VELRNRLKTATGLTLPPTLI

SEQ ID NO: 1462701 - protein, 21 aa, Mycobacterium tuberculosis
VELRRPGGPGVIMGRNVVRKD

SEQ ID NO: 1462702 - protein, 21 aa, Mycobacterium tuberculosis
VEMRNRLKSATGLSLSPTLIF

SEQ ID NO: 1462703 - protein, 21 aa, Mycobacterium tuberculosis
VEPAILRPSFRNWDHPYRRQI

SEQ ID NO: 1462704 - protein, 22 aa, Mycobacterium tuberculosis
VETCWRKAIQMDYETDTDTELV

SEQ ID NO: 1462705 - protein, 18 aa, Mycobacterium tuberculosis
VFEGTSFGGALMTTTDVE

SEQ ID NO: 1462706 - protein, 18 aa, Mycobacterium tuberculosis
VFIRAPWVERVGDGVQVL

SEQ ID NO: 1462707 - protein, 18 aa, Mycobacterium tuberculosis
VFRAWKLHDELGLNIVMP

SEQ ID NO: 1462708 - protein, 37 aa, Mycobacterium tuberculosis; identical to SEQ ID NO: 207719

SEQ ID NO: 1462709 - protein, 18 aa, Mycobacterium tuberculosis
VGCVDRIVTELAVIDVCA

SEQ ID NO: 1462710 - protein, 17 aa, Mycobacterium tuberculosis
VGDPIQSIYGWRGASAT

SEQ ID NO: 1462711 - protein, 25 aa, Mycobacterium tuberculosis
VGEAWRYLKELRLERGPLSTEEATT

SEQ ID NO: 1462712 - protein, 24 aa, Mycobacterium tuberculosis
VGIAFLRAPCRVVYVIDEPDVRGF

SEQ ID NO: 1462713 - protein, 17 aa, Mycobacterium tuberculosis
VGMSGLLVKSTVVMKEN

SEQ ID NO: 1462714 - protein, 17 aa, Mycobacterium tuberculosis
VGVLDMLAAFYNDTPDE

SEQ ID NO: 1462715 - protein, 17 aa, Mycobacterium tuberculosis
VHHCHREQWPVAGRMMG

SEQ ID NO: 1462716 - protein, 17 aa, Mycobacterium tuberculosis
VHNVMTFGGNMITVTEA

SEQ ID NO: 1462717 - protein, 25 aa, Mycobacterium tuberculosis
VIDLLLKRAASLGIQIRYETGATEL

SEQ ID NO: 1462718 - protein, 21 aa, Mycobacterium tuberculosis
VISGLQMLLHQAFAQVEQFTG

SEQ ID NO: 1462719 - protein, 24 aa, Mycobacterium tuberculosis
VKEKNDWTYPKWAKQVTRVLIAIE

SEQ ID NO: 1462720 - protein, 23 aa, Mycobacterium tuberculosis
VKFDGGTLPPMFVDLINAPTRRQ

SEQ ID NO: 1462721 - protein, 18 aa, Mycobacterium tuberculosis
VKPFRPFQLNSRLLALAD

SEQ ID NO: 1462722 - protein, 25 aa, Mycobacterium tuberculosis
VLAAYPGHIARMFGLVYGGESRDHA

SEQ ID NO: 1462723 - protein, 27 aa, Mycobacterium tuberculosis
VLLKVRLRQGLPLARLGAAERERAEAV

SEQ ID NO: 1462724 - protein, 18 aa, Mycobacterium tuberculosis
VLRRRRGAWVGWPGVNDD

SEQ ID NO: 1462725 - protein, 30 aa, Mycobacterium tuberculosis; identical to SEQ ID NO: 207957

SEQ ID NO: 1462726 - protein, 18 aa, Mycobacterium tuberculosis
VLVDCRRLQDSFAAVDFF

SEQ ID NO: 1462727 - protein, 19 aa, Mycobacterium tuberculosis
VMTGFRVSRSGWYGIDPVP

SEQ ID NO: 1462728 - protein, 27 aa, Mycobacterium tuberculosis
VNSGRMYCGPGSAPMVAAASAWNGLAA

SEQ ID NO: 1462729 - protein, 29 aa, Mycobacterium tuberculosis
VPIYPGYVCAIVASLLLDKPVKWMEDRSE

SEQ ID NO: 1462730 - protein, 25 aa, Mycobacterium tuberculosis
VPLPSKWRIAFGEPICTADYASTDA

SEQ ID NO: 1462731 - protein, 21 aa, Mycobacterium tuberculosis
VPSCAEGGVLGAICATIASIQ

SEQ ID NO: 1462732 - protein, 18 aa, Mycobacterium tuberculosis
VPSRRLNPVRAISAERAA

SEQ ID NO: 1462733 - protein, 17 aa, Mycobacterium tuberculosis
VQSLIRWDPVGHAEAEL

SEQ ID NO: 1462734 - protein, 31 aa, Mycobacterium tuberculosis; identical to SEQ ID NO: 208111

SEQ ID NO: 1462735 - protein, 17 aa, Mycobacterium tuberculosis
VRDCCAPGSRFAQATRA

SEQ ID NO: 1462736 - protein, 19 aa, Mycobacterium tuberculosis
VREFACQRWQWHDLEVSRT

SEQ ID NO: 1462737 - protein, 21 aa, Mycobacterium tuberculosis
VRLKGGDPFVFARGYEEVLAC

SEQ ID NO: 1462738 - protein, 30 aa, Mycobacterium tuberculosis; identical to SEQ ID NO: 208150

SEQ ID NO: 1462739 - protein, 18 aa, Mycobacterium tuberculosis
VRQFLNLDVPLFVESAFH

SEQ ID NO: 1462740 - protein, 23 aa, Mycobacterium tuberculosis
VRSYKLRGAYNLLVQLSDEELAA

SEQ ID NO: 1462741 - protein, 24 aa, Mycobacterium tuberculosis
VRVLRPGGYFPYADLRPNNEIAAW

SEQ ID NO: 1462742 - protein, 20 aa, Mycobacterium tuberculosis
VSAGIAALFGARAQAYQAIS

SEQ ID NO: 1462743 - protein, 19 aa, Mycobacterium tuberculosis
VSAKGEFLGGAIAPGVQVS

SEQ ID NO: 1462744 - protein, 17 aa, Mycobacterium tuberculosis
VSARAAAIHDQFVATLA

SEQ ID NO: 1462745 - protein, 18 aa, Mycobacterium tuberculosis
VSARSDANIAVMTRDLNR

SEQ ID NO: 1462746 - protein, 18 aa, Mycobacterium tuberculosis
VSPMPLAFVEYDLDTGDP

SEQ ID NO: 1462747 - protein, 19 aa, Mycobacterium tuberculosis
VSRALRLTGRRVMLVPTMG

SEQ ID NO: 1462748 - protein, 17 aa, Mycobacterium tuberculosis
VTDAHLLTLARRRGVRL

SEQ ID NO: 1462749 - protein, 41 aa, Mycobacterium tuberculosis; identical to SEQ ID NO: 208256

SEQ ID NO: 1462750 - protein, 21 aa, Mycobacterium tuberculosis
VTPELRATIEAVWAKLAAPGM

SEQ ID NO: 1462751 - protein, 23 aa, Mycobacterium tuberculosis
VVAAAPYAGWLAAAAARAGGAAV

SEQ ID NO: 1462752 - protein, 24 aa, Mycobacterium tuberculosis
VVDDAARLTAVWIADWADDTVHLS

SEQ ID NO: 1462753 - protein, 24 aa, Mycobacterium tuberculosis
VVDGRGRLTGLITVKDFVKTEQHP

SEQ ID NO: 1462754 - protein, 20 aa, Mycobacterium tuberculosis
VVIDGRICRPGWVHTADGRI

SEQ ID NO: 1462755 - protein, 25 aa, Mycobacterium tuberculosis
VVVACSAISHASRRRAQRRLPDTPV

SEQ ID NO: 1462756 - protein, 24 aa, Mycobacterium tuberculosis
VWAGEIDPSLRLRPSRGTHLVFDA

SEQ ID NO: 1462757 - protein, 21 aa, Mycobacterium tuberculosis
VYRLGRGRYGPGYIPRSTEYR

SEQ ID NO: 1462758 - protein, 21 aa, Mycobacterium tuberculosis
VYRLTVEGVLPMPQSTHYPLA

SEQ ID NO: 1462759 - protein, 18 aa, Mycobacterium tuberculosis
WAATRWVAEHGRQVGADL

SEQ ID NO: 1462760 - protein, 17 aa, Mycobacterium tuberculosis
WDLAVKIGGHLKDPVDS

SEQ ID NO: 1462761 - protein, 17 aa, Mycobacterium tuberculosis
WDLTRGVATDTPESLTN

SEQ ID NO: 1462762 - protein, 24 aa, Mycobacterium tuberculosis
WDVRHAREAYRFLSQARHVGKVVL

SEQ ID NO: 1462763 - protein, 19 aa, Mycobacterium tuberculosis
WELGEGWAKHVTVEVALGT

SEQ ID NO: 1462764 - protein, 22 aa, Mycobacterium tuberculosis
WEQVADWDFVCEQLAAAEPWWQ

SEQ ID NO: 1462765 - protein, 24 aa, Mycobacterium tuberculosis
WESELDPDLLWLADHVIDDLVVLP

SEQ ID NO: 1462766 - protein, 17 aa, Mycobacterium tuberculosis
WFPSLKIYNRNGQLYTA

SEQ ID NO: 1462767 - protein, 17 aa, Mycobacterium tuberculosis
WGPPNFCAAAARMQDVR

SEQ ID NO: 1462768 - protein, 17 aa, Mycobacterium tuberculosis
WIQRAAMDRRTTMKRVA

SEQ ID NO: 1462769 - protein, 17 aa, Mycobacterium tuberculosis
WKNTGQILADEGHHVVA

SEQ ID NO: 1462770 - protein, 23 aa, Mycobacterium tuberculosis
WLTATRARNALVLVRGKPTDQLP

SEQ ID NO: 1462771 - protein, 24 aa, Mycobacterium tuberculosis
WNRIDYRPLDGFVYAITPFNFTSI

SEQ ID NO: 1462772 - protein, 32 aa, Mycobacterium tuberculosis; identical to SEQ ID NO: 208544

SEQ ID NO: 1462773 - protein, 20 aa, Mycobacterium tuberculosis
WPARQLVDDRWVWLPTLLAG

SEQ ID NO: 1462774 - protein, 21 aa, Mycobacterium tuberculosis
WPATLDRVLAIGGPDASYVPG

SEQ ID NO: 1462775 - protein, 20 aa, Mycobacterium tuberculosis
WPDRQLPGEGVTRGAIQVPP

SEQ ID NO: 1462776 - protein, 25 aa, Mycobacterium tuberculosis
WPTGPLPKVRVAAALPPPADYLTRI

SEQ ID NO: 1462777 - protein, 23 aa, Mycobacterium tuberculosis
WQSDHQGQWGAHYAITVPQIPLL

SEQ ID NO: 1462778 - protein, 26 aa, Mycobacterium tuberculosis
WQTAHVMKARRGALEGDPSGSQAADN

SEQ ID NO: 1462779 - protein, 20 aa, Mycobacterium tuberculosis
WRAPSKLAYIDAGLIDLIRV

SEQ ID NO: 1462780 - protein, 20 aa, Mycobacterium tuberculosis
WRFGLDRILTGVAMSEDSQA

SEQ ID NO: 1462781 - protein, 18 aa, Mycobacterium tuberculosis
WRNIRRLIDAGARVALST

SEQ ID NO: 1462782 - protein, 20 aa, Mycobacterium tuberculosis
WSLMAQGVYAPAIPRRKSQN

SEQ ID NO: 1462783 - protein, 30 aa, Mycobacterium tuberculosis; identical to SEQ ID NO: 208650

SEQ ID NO: 1462784 - protein, 24 aa, Mycobacterium tuberculosis
WVARVGTVVMSWRLRTRHRLPVHD

SEQ ID NO: 1462785 - protein, 17 aa, Mycobacterium tuberculosis
WWLVRLLGSITPTERTT

SEQ ID NO: 1462786 - protein, 18 aa, Mycobacterium tuberculosis
WYSDFLDFVGRERIFASL

SEQ ID NO: 1462787 - protein, 24 aa, Mycobacterium tuberculosis
YADPLGALRRSGALDARLQDTAPE

SEQ ID NO: 1462788 - protein, 18 aa, Mycobacterium tuberculosis
YAVNNSFGFGGHNVALAF

SEQ ID NO: 1462789 - protein, 27 aa, Mycobacterium tuberculosis
YDDIPANVMPIDWYLHVRHAVGGEIAM

SEQ ID NO: 1462790 - protein, 27 aa, Mycobacterium tuberculosis
YEKACKRGEVTIGKMFVVDTGQLDGPK

SEQ ID NO: 1462791 - protein, 26 aa, Mycobacterium tuberculosis
YEPMCKRLVMSGGFYRAIQRDDVELV

SEQ ID NO: 1462792 - protein, 19 aa, Mycobacterium tuberculosis
YERLGIPTIATVPWTTDRL

SEQ ID NO: 1462793 - protein, 23 aa, Mycobacterium tuberculosis
YERWKETAFQYGWLLATADSDRY

SEQ ID NO: 1462794 - protein, 18 aa, Mycobacterium tuberculosis
YGDYRYAVNNSFGFGGHN

SEQ ID NO: 1462795 - protein, 19 aa, Mycobacterium tuberculosis
YKFRPWRDVKVLADGASIR

SEQ ID NO: 1462796 - protein, 25 aa, Mycobacterium tuberculosis
YLLGSRSALGWIIDRYRVTTDKASG

SEQ ID NO: 1462797 - protein, 20 aa, Mycobacterium tuberculosis
YLQRWRRRRALWVGVTLGGA

SEQ ID NO: 1462798 - protein, 24 aa, Mycobacterium tuberculosis
YPDLVPRLRFGDIVRVGSADEHLQ

SEQ ID NO: 1462799 - protein, 18 aa, Mycobacterium tuberculosis
YPKIKQWLSQVLGNFPVY

SEQ ID NO: 1462800 - protein, 23 aa, Mycobacterium tuberculosis
YRLDSGEQLKVWRAMEDADEVPV

SEQ ID NO: 1462801 - protein, 20 aa, Mycobacterium tuberculosis
YRNNWKRLGFTDDEVSRPGS

SEQ ID NO: 1462802 - protein, 17 aa, Mycobacterium tuberculosis
YRPHRSAVLTASLTSPR

SEQ ID NO: 1462803 - protein, 17 aa, Mycobacterium tuberculosis
YRSGARHVPRLQRRTLP

SEQ ID NO: 1462804 - protein, 18 aa, Mycobacterium tuberculosis
YSTIKILSGMQFARNYIT

SEQ ID NO: 1462805 - protein, 20 aa, Mycobacterium tuberculosis
YSTILPKCRAVVHHGGAGTT

SEQ ID NO: 1462806 - protein, 23 aa, Mycobacterium tuberculosis
YTGELAGGFAFVPGHETVGTIAA

SEQ ID NO: 1462807 - protein, 23 aa, Mycobacterium tuberculosis
YTIKRLPGKLVRFMKTDTGQRKV

SEQ ID NO: 1462808 - protein, 22 aa, Mycobacterium tuberculosis
YTLRLPLDVLVVASANPEDYTN

SEQ ID NO: 1462809 - protein, 17 aa, Mycobacterium tuberculosis
YTSEWKIRNLVKKYSDF

SEQ ID NO: 1462810 - protein, 23 aa, Mycobacterium tuberculosis
YVAAHTPYLAWLVQASANSAAMA

SEQ ID NO: 1462811 - protein, 26 aa, Mycobacterium tuberculosis
YVGFDIPNDFVVGYGLDYDERYRDLS

SEQ ID NO: 1462812 - protein, 18 aa, Mycobacterium tuberculosis
YWLQEFHIDGLRVDAVAS

SEQ ID NO: 1462813 - protein, 18 aa, Mycobacterium tuberculosis
AAADPAAVWATHFPSTDA

SEQ ID NO: 1462814 - protein, 26 aa, Mycobacterium tuberculosis
AAAELGERCAFGLQLIAPRLPPFDVP

SEQ ID NO: 1462815 - protein, 19 aa, Mycobacterium tuberculosis
AAAVLRFAATEVIPRLAGT

SEQ ID NO: 1462816 - protein, 19 aa, Mycobacterium tuberculosis
AAAWRRIRSQVRDWTDLEP

SEQ ID NO: 1462817 - protein, 18 aa, Mycobacterium tuberculosis
AADCALFVIAANEGVDEP

SEQ ID NO: 1462818 - protein, 25 aa, Mycobacterium tuberculosis
AADFRGWCGEAGFRSFEVIPLAGGS

SEQ ID NO: 1462819 - protein, 17 aa, Mycobacterium tuberculosis
AAFFSSSTSFGIIRGGH

SEQ ID NO: 1462820 - protein, 27 aa, Mycobacterium tuberculosis
AAGDARPPFWQNLAELGWLGLHIDERH

SEQ ID NO: 1462821 - protein, 29 aa, Mycobacterium tuberculosis
AAGHSFVIFLREGFPINILNPVQAVPEVC

SEQ ID NO: 1462822 - protein, 18 aa, Mycobacterium tuberculosis
AALDHPLLVERPEPKRAG

SEQ ID NO: 1462823 - protein, 23 aa, Mycobacterium tuberculosis
AALLPTHCWFEGRGWGFQVYPAL

SEQ ID NO: 1462824 - protein, 18 aa, Mycobacterium tuberculosis
AANALPLQKAQGVVSELA

SEQ ID NO: 1462825 - protein, 25 aa, Mycobacterium tuberculosis
AAPDRKRLTLAHELGHLVLHSTNPT

SEQ ID NO: 1462826 - protein, 31 aa, Mycobacterium tuberculosis; identical to SEQ ID NO: 195874

SEQ ID NO: 1462827 - protein, 21 aa, Mycobacterium tuberculosis
AARTRYFDAFFRDATSAGIRQ

SEQ ID NO: 1462828 - protein, 17 aa, Mycobacterium tuberculosis
AATRAGFEAGFEADPVL

SEQ ID NO: 1462829 - protein, 18 aa, Mycobacterium tuberculosis
AAVLFDIDGVLVLSWRAI

SEQ ID NO: 1462830 - protein, 24 aa, Mycobacterium tuberculosis
AAWFPSAEHLASWVRLCPGNHESA

SEQ ID NO: 1462831 - protein, 19 aa, Mycobacterium tuberculosis
AAYEKAYHAEPFIYLMPEG

SEQ ID NO: 1462832 - protein, 28 aa, Mycobacterium tuberculosis
ACGAIELGIKWLSLYAFSTENWKRSPEE

SEQ ID NO: 1462833 - protein, 26 aa, Mycobacterium tuberculosis
ACPASAYSRMCLTTFFTSLTQRFPQL

SEQ ID NO: 1462834 - protein, 19 aa, Mycobacterium tuberculosis
ADAVARMAEFGRHVEELVA

SEQ ID NO: 1462835 - protein, 24 aa, Mycobacterium tuberculosis
ADDVPRGISFLLNRNRLNVAVSRA

SEQ ID NO: 1462836 - protein, 24 aa, Mycobacterium tuberculosis
ADFKRPAPHWWFDDATLYGPDGLA

SEQ ID NO: 1462837 - protein, 20 aa, Mycobacterium tuberculosis
ADGGFQLGRLAAILRDKRIP

SEQ ID NO: 1462838 - protein, 17 aa, Mycobacterium tuberculosis
ADMIRLIIRDEAVHGYY

SEQ ID NO: 1462839 - protein, 17 aa, Mycobacterium tuberculosis
ADPDLIIGRYIPNLVPR

SEQ ID NO: 1462840 - protein, 25 aa, Mycobacterium tuberculosis
ADPERTAELATRFGVESSIARLQKA

SEQ ID NO: 1462841 - protein, 19 aa, Mycobacterium tuberculosis
ADPQRAGLVRSHFGARRKA

SEQ ID NO: 1462842 - protein, 26 aa, Mycobacterium tuberculosis
ADRAASYRAAGYWSGRTLDTVLSDAA

SEQ ID NO: 1462843 - protein, 23 aa, Mycobacterium tuberculosis
ADRRYSAAITRLAPETDVRIVTY

SEQ ID NO: 1462844 - protein, 23 aa, Mycobacterium tuberculosis
ADTPGLPKMGSFEVMNRTIDIAQ

SEQ ID NO: 1462845 - protein, 25 aa, Mycobacterium tuberculosis
ADVHIAIELACPLVYGAAVSLEPRD

SEQ ID NO: 1462846 - protein, 30 aa, Mycobacterium tuberculosis; identical to SEQ ID NO: 196083

SEQ ID NO: 1462847 - protein, 18 aa, Mycobacterium tuberculosis
AEELRYSVIREVLPTRRA

SEQ ID NO: 1462848 - protein, 17 aa, Mycobacterium tuberculosis
AEIGRIPVDSIYSPVLK

SEQ ID NO: 1462849 - protein, 21 aa, Mycobacterium tuberculosis
AELFWALRGGGGGNFGVTTSM

SEQ ID NO: 1462850 - protein, 18 aa, Mycobacterium tuberculosis
AELGRMYVHHGVVVVEQK

SEQ ID NO: 1462851 - protein, 24 aa, Mycobacterium tuberculosis
AELVTEHAWRIGVVAQSHATVENL

SEQ ID NO: 1462852 - protein, 20 aa, Mycobacterium tuberculosis
AESCTAGLLAARLTDRPGSS

SEQ ID NO: 1462853 - protein, 21 aa, Mycobacterium tuberculosis
AETARLEGFYESVRRRAGEVT

SEQ ID NO: 1462854 - protein, 25 aa, Mycobacterium tuberculosis
AEVLGNWTGIPVFKLTEAETTRLLR

SEQ ID NO: 1462855 - protein, 18 aa, Mycobacterium tuberculosis
AFETSWLDPFTEFRFPRI

SEQ ID NO: 1462856 - protein, 24 aa, Mycobacterium tuberculosis
AFRVLRPGGELIFTDPMQADDVPD

SEQ ID NO: 1462857 - protein, 19 aa, Mycobacterium tuberculosis
AFSIVWDGQKLHGLNASGR

SEQ ID NO: 1462858 - protein, 23 aa, Mycobacterium tuberculosis
AFYLQYFGCRPYFAERVGGFTMR

SEQ ID NO: 1462859 - protein, 18 aa, Mycobacterium tuberculosis
AGAIAFSSVLSYPVVAEQ

SEQ ID NO: 1462860 - protein, 22 aa, Mycobacterium tuberculosis
AGDTWAAIGVALGITRQAAFQR

SEQ ID NO: 1462861 - protein, 22 aa, Mycobacterium tuberculosis
AGDVRLLLPMPADWSYAEAAAI

SEQ ID NO: 1462862 - protein, 20 aa, Mycobacterium tuberculosis
AGGEILRLLLGHPAYADGRL

SEQ ID NO: 1462863 - protein, 24 aa, Mycobacterium tuberculosis
AGGHSLLPMMKLRIANPEYLVDIN

SEQ ID NO: 1462864 - protein, 17 aa, Mycobacterium tuberculosis
AGGRWGSLDAQWDEIKA

SEQ ID NO: 1462865 - protein, 19 aa, Mycobacterium tuberculosis
AGIELPRRIFAHGFLHNRG

SEQ ID NO: 1462866 - protein, 27 aa, Mycobacterium tuberculosis
AGLKTSRDAWCYNFSRGALEANIGRTI

SEQ ID NO: 1462867 - protein, 19 aa, Mycobacterium tuberculosis
AGQFCLANTIAVAPAATNL

SEQ ID NO: 1462868 - protein, 22 aa, Mycobacterium tuberculosis
AGQRFVIDVTVWIDLAEAANSD

SEQ ID NO: 1462869 - protein, 25 aa, Mycobacterium tuberculosis
AGSGPMLAAAAAWDGLAAELGLAAE

SEQ ID NO: 1462870 - protein, 17 aa, Mycobacterium tuberculosis
AGVRLLGCYHPSQQNMF

SEQ ID NO: 1462871 - protein, 22 aa, Mycobacterium tuberculosis
AGVVRLRFGLTDGQPRTLDEIG

SEQ ID NO: 1462872 - protein, 19 aa, Mycobacterium tuberculosis
AHAGIPVTVVPGVTSAIAV

SEQ ID NO: 1462873 - protein, 21 aa, Mycobacterium tuberculosis
AHAWGGPPIGAMVFRDPSVMN

SEQ ID NO: 1462874 - protein, 19 aa, Mycobacterium tuberculosis
AHCALWRALIGLDSMERIS

SEQ ID NO: 1462875 - protein, 18 aa, Mycobacterium tuberculosis
AHFADGWNTFNLTLQGDV

SEQ ID NO: 1462876 - protein, 18 aa, Mycobacterium tuberculosis
AHGKGHFNIEDWDAILAA

SEQ ID NO: 1462877 - protein, 24 aa, Mycobacterium tuberculosis
AHKLVPRKEFRGVAQARLTEVGLW

SEQ ID NO: 1462878 - protein, 27 aa, Mycobacterium tuberculosis
AHRERLGLPGLRDWLRRQAKAGAGPPE

SEQ ID NO: 1462879 - protein, 24 aa, Mycobacterium tuberculosis
AHRRRAQGLTVVFCTYQSLPTVAK

SEQ ID NO: 1462880 - protein, 17 aa, Mycobacterium tuberculosis
AKALRDFASQYGVPMEQ

SEQ ID NO: 1462881 - protein, 17 aa, Mycobacterium tuberculosis
AKFTPAREALDNPNFRL

SEQ ID NO: 1462882 - protein, 25 aa, Mycobacterium tuberculosis
AKTAASRNKHGWVTVGDVGYLDDDG

SEQ ID NO: 1462883 - protein, 25 aa, Mycobacterium tuberculosis
AKTRAEAMAALDIWRDRYPGAAALL

SEQ ID NO: 1462884 - protein, 24 aa, Mycobacterium tuberculosis
AKVLSRYVDAIVWRTFGQERLDAM

SEQ ID NO: 1462885 - protein, 18 aa, Mycobacterium tuberculosis
AKVMRIGTMIKQLLEEVR

SEQ ID NO: 1462886 - protein, 19 aa, Mycobacterium tuberculosis
ALARAGFHTLKLQTFLTAG

SEQ ID NO: 1462887 - protein, 18 aa, Mycobacterium tuberculosis
ALEEVRGAAAAAIADGAR

SEQ ID NO: 1462888 - protein, 17 aa, Mycobacterium tuberculosis
ALIGTKCRGDRAPEGLR

SEQ ID NO: 1462889 - protein, 17 aa, Mycobacterium tuberculosis
ALLDVAGVTVTRFVRFE

SEQ ID NO: 1462890 - protein, 26 aa, Mycobacterium tuberculosis
ALLLRGSPCAIGWVAGWLSAEFPARV

SEQ ID NO: 1462891 - protein, 17 aa, Mycobacterium tuberculosis
ALSGYSCPPDVRIRANI

SEQ ID NO: 1462892 - protein, 18 aa, Mycobacterium tuberculosis
AMEKFDYTKGFKFSTYAT

SEQ ID NO: 1462893 - protein, 23 aa, Mycobacterium tuberculosis
AMFDLWFPAALGARAVITTEDES

SEQ ID NO: 1462894 - protein, 20 aa, Mycobacterium tuberculosis
AMGFSAALDGCFKIHQLNHA

SEQ ID NO: 1462895 - protein, 25 aa, Mycobacterium tuberculosis
AMNLAVVLRATWAVARVLTDRGLAG

SEQ ID NO: 1462896 - protein, 18 aa, Mycobacterium tuberculosis
AMVSGGWNQAPSALLGGG

SEQ ID NO: 1462897 - protein, 24 aa, Mycobacterium tuberculosis
ANYRRNKVGIVFQAFNLVPSLTAV

SEQ ID NO: 1462898 - protein, 27 aa, Mycobacterium tuberculosis
ANYYARVCVDLLKPRKAQPLLPGIGKT

SEQ ID NO: 1462899 - protein, 18 aa, Mycobacterium tuberculosis
APDIKLLQPVPAGDPSKG

SEQ ID NO: 1462900 - protein, 26 aa, Mycobacterium tuberculosis
APDSLCGVRVFFPDPWPKARHHKRRL

SEQ ID NO: 1462901 - protein, 18 aa, Mycobacterium tuberculosis
APITLRGGQLVAFDSSSG

SEQ ID NO: 1462902 - protein, 18 aa, Mycobacterium tuberculosis
APPGIPVDIGPGATVAHL

SEQ ID NO: 1462903 - protein, 18 aa, Mycobacterium tuberculosis
APTLSGFWHWAVANLPAN

SEQ ID NO: 1462904 - protein, 19 aa, Mycobacterium tuberculosis
APVLDRLIAFTGRQPTAGH

SEQ ID NO: 1462905 - protein, 22 aa, Mycobacterium tuberculosis
AQAAAIHEMFVNTLVASSGSYA

SEQ ID NO: 1462906 - protein, 24 aa, Mycobacterium tuberculosis
AQAALFHDRFVQILQEGAAAYAMA

SEQ ID NO: 1462907 - protein, 17 aa, Mycobacterium tuberculosis
AQARLESARPYAFEITR

SEQ ID NO: 1462908 - protein, 17 aa, Mycobacterium tuberculosis
AQLPSGWMVTAAKFEVE

SEQ ID NO: 1462909 - protein, 19 aa, Mycobacterium tuberculosis
AQRPAVFIFNHRNQVDPVI

SEQ ID NO: 1462910 - protein, 27 aa, Mycobacterium tuberculosis
AQSPKETWLRLLLINAGFPRPSTQIPL

SEQ ID NO: 1462911 - protein, 23 aa, Mycobacterium tuberculosis
ARADLAAARRVCRRLTTSAPALA

SEQ ID NO: 1462912 - protein, 23 aa, Mycobacterium tuberculosis
ARAGSRAAPLLRLPDVRALLDAQ

SEQ ID NO: 1462913 - protein, 27 aa, Mycobacterium tuberculosis
ARAQAGALPALFSGLARRPRRRQIDDT

SEQ ID NO: 1462914 - protein, 18 aa, Mycobacterium tuberculosis
ARCAQFSTLLGVPMESMI

SEQ ID NO: 1462915 - protein, 21 aa, Mycobacterium tuberculosis
ARDAGAMAYLVKPFSISDLIP

SEQ ID NO: 1462916 - protein, 19 aa, Mycobacterium tuberculosis
AREAAWRVLDQRPFDVQVM

SEQ ID NO: 1462917 - protein, 21 aa, Mycobacterium tuberculosis
ARGKLTPRERIELLVDPDSPF

SEQ ID NO: 1462918 - protein, 20 aa, Mycobacterium tuberculosis
ARLLRQLGVEAARVRMLRSF

SEQ ID NO: 1462919 - protein, 20 aa, Mycobacterium tuberculosis
ARLPSIALRAARSALQSGAP

SEQ ID NO: 1462920 - protein, 17 aa, Mycobacterium tuberculosis
ARLRAAGAVIIGKLAMT

SEQ ID NO: 1462921 - protein, 17 aa, Mycobacterium tuberculosis
ASAVHYGLACRELEAAD

SEQ ID NO: 1462922 - protein, 25 aa, Mycobacterium tuberculosis
ASGDPRGGMKQVLGASRLRRDRVQA

SEQ ID NO: 1462923 - protein, 19 aa, Mycobacterium tuberculosis
ASVGSPWLADTWRDRFEQM

SEQ ID NO: 1462924 - protein, 26 aa, Mycobacterium tuberculosis
ATADCELDWWLGFSSAASLLGSPGQA

SEQ ID NO: 1462925 - protein, 26 aa, Mycobacterium tuberculosis
ATARAYRAAAEFVPRIGALIDTVHRH

SEQ ID NO: 1462926 - protein, 21 aa, Mycobacterium tuberculosis
ATDVAARWPVPGPRDDKYTQG

SEQ ID NO: 1462927 - protein, 19 aa, Mycobacterium tuberculosis
ATKAVGWSPTDWVDNTLAT

SEQ ID NO: 1462928 - protein, 18 aa, Mycobacterium tuberculosis
ATLRCRRLGAVLHAAADV

SEQ ID NO: 1462929 - protein, 18 aa, Mycobacterium tuberculosis
ATPLQAIAAMDAMDYDVH

SEQ ID NO: 1462930 - protein, 27 aa, Mycobacterium tuberculosis
ATQRAFLRYGKGRHRAALNFGDCMTYA

SEQ ID NO: 1462931 - protein, 18 aa, Mycobacterium tuberculosis
ATRGYRYGPAFRGLTAMW

SEQ ID NO: 1462932 - protein, 25 aa, Mycobacterium tuberculosis
AVARGDASAGWCVSIAITSALLVAY

SEQ ID NO: 1462933 - protein, 17 aa, Mycobacterium tuberculosis
AVIPGKCQLTVVPGATH

SEQ ID NO: 1462934 - protein, 25 aa, Mycobacterium tuberculosis
AVLRALRLETEWPARQLVDDRWVWL

SEQ ID NO: 1462935 - protein, 19 aa, Mycobacterium tuberculosis
AVLRRCGRCGRKASWYDRG

SEQ ID NO: 1462936 - protein, 25 aa, Mycobacterium tuberculosis
AVLSRAQLLELVWGYDFAADTNVVD

SEQ ID NO: 1462937 - protein, 24 aa, Mycobacterium tuberculosis
AVTAGLAGSSWLGAASTAMTGAAA

SEQ ID NO: 1462938 - protein, 18 aa, Mycobacterium tuberculosis
AVTVPELGTFLAECPPIA

SEQ ID NO: 1462939 - protein, 18 aa, Mycobacterium tuberculosis
AVVQPMLVAANRADLVSL

SEQ ID NO: 1462940 - protein, 19 aa, Mycobacterium tuberculosis
AYACSFRITEAVYFVERLV

SEQ ID NO: 1462941 - protein, 18 aa, Mycobacterium tuberculosis
CAERLPGAVLAIGNAPTA

SEQ ID NO: 1462942 - protein, 19 aa, Mycobacterium tuberculosis
CARHAPTDPVHWGAVRRAR

SEQ ID NO: 1462943 - protein, 20 aa, Mycobacterium tuberculosis
CCARSRILVQRSVYDRFMEL

SEQ ID NO: 1462944 - protein, 17 aa, Mycobacterium tuberculosis
CGHLASRYGVPMRVITF

SEQ ID NO: 1462945 - protein, 23 aa, Mycobacterium tuberculosis
CGIKASMGMGAIRVQPLAPREKC

SEQ ID NO: 1462946 - protein, 20 aa, Mycobacterium tuberculosis
CKLPEAIAAVSHERIALLVG

SEQ ID NO: 1462947 - protein, 19 aa, Mycobacterium tuberculosis
CPYCGSPYSFLPQLNPGDI

SEQ ID NO: 1462948 - protein, 17 aa, Mycobacterium tuberculosis
CTTRAYVMDSWLRPVPD

SEQ ID NO: 1462949 - protein, 18 aa, Mycobacterium tuberculosis
CWRTFLTCDANLAVTLPP

SEQ ID NO: 1462950 - protein, 26 aa, Mycobacterium tuberculosis
DADCAQLRAAASVLMEALRMERSQVA

SEQ ID NO: 1462951 - protein, 17 aa, Mycobacterium tuberculosis
DAEYLFDQFVELMAGEG

SEQ ID NO: 1462952 - protein, 22 aa, Mycobacterium tuberculosis
DAFGDKVLPLYLPSGDGLIGLL

SEQ ID NO: 1462953 - protein, 31 aa, Mycobacterium tuberculosis; identical to SEQ ID NO: 87302

SEQ ID NO: 1462954 - protein, 26 aa, Mycobacterium tuberculosis
DASGVRLAIVASSWHGKICDALLDGA

SEQ ID NO: 1462955 - protein, 22 aa, Mycobacterium tuberculosis
DAWEDFLFWLAADRKTARRITR

SEQ ID NO: 1462956 - protein, 27 aa, Mycobacterium tuberculosis
DCQVAAMALRIGVAVAHRDRDYEAIRT

SEQ ID NO: 1462957 - protein, 17 aa, Mycobacterium tuberculosis
DCRAAGVQWALVASPAV

SEQ ID NO: 1462958 - protein, 25 aa, Mycobacterium tuberculosis
DDPDGYRLSVDYAVRITSRGLYVHS

SEQ ID NO: 1462959 - protein, 20 aa, Mycobacterium tuberculosis
DDTLPMLTGIRVEILGETVV

SEQ ID NO: 1462960 - protein, 27 aa, Mycobacterium tuberculosis
DEANIAPWLRAAHRYGAKVKWAEVDIE

SEQ ID NO: 1462961 - protein, 21 aa, Mycobacterium tuberculosis
DELAAELWLAAASFESVCSGL

SEQ ID NO: 1462962 - protein, 24 aa, Mycobacterium tuberculosis
DELAEALAGFIAEFGLSLVGGCCG

SEQ ID NO: 1462963 - protein, 17 aa, Mycobacterium tuberculosis
DEVRRLPEELARVDALL

SEQ ID NO: 1462964 - protein, 21 aa, Mycobacterium tuberculosis
DGGLPAWRSAGGSIETGQVSP

SEQ ID NO: 1462965 - protein, 17 aa, Mycobacterium tuberculosis
DGGRDEQLLLLPLTSLR

SEQ ID NO: 1462966 - protein, 19 aa, Mycobacterium tuberculosis
DGMTYVGLVPFRMSSTKLG

SEQ ID NO: 1462967 - protein, 22 aa, Mycobacterium tuberculosis
DGNEVWVLPGGLTRVALVEGSR

SEQ ID NO: 1462968 - protein, 18 aa, Mycobacterium tuberculosis
DGQYLKAARRLYMTATPR

SEQ ID NO: 1462969 - protein, 23 aa, Mycobacterium tuberculosis
DHRAACIRTELVTGRSAADIYRV

SEQ ID NO: 1462970 - protein, 18 aa, Mycobacterium tuberculosis
DILFLEWTANSAVSRVDD

SEQ ID NO: 1462971 - protein, 17 aa, Mycobacterium tuberculosis
DINTGWFNTGIMNTGTR

SEQ ID NO: 1462972 - protein, 25 aa, Mycobacterium tuberculosis
DIPGFADSLLRGWQAKKRTSTRISN

SEQ ID NO: 1462973 - protein, 22 aa, Mycobacterium tuberculosis
DKAKAMGAIALFGESYPDEVRV

SEQ ID NO: 1462974 - protein, 19 aa, Mycobacterium tuberculosis
DLCDAESKVAAARSPIKAD

SEQ ID NO: 1462975 - protein, 24 aa, Mycobacterium tuberculosis
DLDKPKLVFFFDEAHLLFTDASKA

SEQ ID NO: 1462976 - protein, 18 aa, Mycobacterium tuberculosis
DLLELAYPLMSWPRRGVF

SEQ ID NO: 1462977 - protein, 22 aa, Mycobacterium tuberculosis
DLLKCSFCGKSQKQVKKLIAGP

SEQ ID NO: 1462978 - protein, 21 aa, Mycobacterium tuberculosis
DLLPELQAAGVHYTIAVEAAD

SEQ ID NO: 1462979 - protein, 23 aa, Mycobacterium tuberculosis
DLPGRLRAVGFTDIHVDVAGARL

SEQ ID NO: 1462980 - protein, 20 aa, Mycobacterium tuberculosis
DLRAGTLTRRAHWRSPAGKQ

SEQ ID NO: 1462981 - protein, 27 aa, Mycobacterium tuberculosis
DLVTPAFASGLMRDGMGTMTLNLGLAN

SEQ ID NO: 1462982 - protein, 18 aa, Mycobacterium tuberculosis
DMFRLDLDGIVARLRPAS

SEQ ID NO: 1462983 - protein, 17 aa, Mycobacterium tuberculosis
DPATGSRRRYPWGTEEP

SEQ ID NO: 1462984 - protein, 17 aa, Mycobacterium tuberculosis
DPDRCVRGQYLGYTEVA

SEQ ID NO: 1462985 - protein, 18 aa, Mycobacterium tuberculosis
DPLEPGGRLPIDREPRAI

SEQ ID NO: 1462986 - protein, 24 aa, Mycobacterium tuberculosis
DPQQRLLLEVSWEALERTGIDPTK

SEQ ID NO: 1462987 - protein, 25 aa, Mycobacterium tuberculosis
DPTASRAVSWWSVHEYVAPTLAAAV

SEQ ID NO: 1462988 - protein, 26 aa, Mycobacterium tuberculosis
DRALELGCGTGFFLLNLIQAGVARRG

SEQ ID NO: 1462989 - protein, 18 aa, Mycobacterium tuberculosis
DRCGVVLVGPHGVGKTLL

SEQ ID NO: 1462990 - protein, 22 aa, Mycobacterium tuberculosis
DREVLTAWGAYGEKQMYGKTVQ

SEQ ID NO: 1462991 - protein, 21 aa, Mycobacterium tuberculosis
DRGPSQWLLRMLATQTQRAEL

SEQ ID NO: 1462992 - protein, 27 aa, Mycobacterium tuberculosis
DRICIPVPFYHCFGMVMGNLAATSHGA

SEQ ID NO: 1462993 - protein, 17 aa, Mycobacterium tuberculosis
DRLRLEGYRRLAAASSD

SEQ ID NO: 1462994 - protein, 29 aa, Mycobacterium tuberculosis
DRRATRLVAEWPPRLNIPDPDPLRLIYFA

SEQ ID NO: 1462995 - protein, 24 aa, Mycobacterium tuberculosis
DRRFTRTRLRTEVLPLLEDVLGGG

SEQ ID NO: 1462996 - protein, 25 aa, Mycobacterium tuberculosis
DSATLFIKPGWGFSFDYQPGQYIGI

SEQ ID NO: 1462997 - protein, 18 aa, Mycobacterium tuberculosis
DSFLRAAELLGVTPDAAA

SEQ ID NO: 1462998 - protein, 20 aa, Mycobacterium tuberculosis
DSHLLLLWGAANRDPAQFEA

SEQ ID NO: 1462999 - protein, 18 aa, Mycobacterium tuberculosis
DSPDRLWEALLRGDDLVT

SEQ ID NO: 1463000 - protein, 19 aa, Mycobacterium tuberculosis
DSPELLWKALLRGDDLITE

SEQ ID NO: 1463001 - protein, 20 aa, Mycobacterium tuberculosis
DSPISLAFLTFLPRFDCQDR

SEQ ID NO: 1463002 - protein, 25 aa, Mycobacterium tuberculosis
DTEITRLVPFIEWLRGAYPDQLISV

SEQ ID NO: 1463003 - protein, 29 aa, Mycobacterium tuberculosis
DTPCDLLIAVGVSFGGLVTRSFSPRWRGL

SEQ ID NO: 1463004 - protein, 26 aa, Mycobacterium tuberculosis
DTSASVTCGIGFADLSSFTALTQALT

SEQ ID NO: 1463005 - protein, 19 aa, Mycobacterium tuberculosis
DTYGFPIELTLEMAAETGL

SEQ ID NO: 1463006 - protein, 18 aa, Mycobacterium tuberculosis
DTYGFTGIDTSQCTGDTV

SEQ ID NO: 1463007 - protein, 24 aa, Mycobacterium tuberculosis
DVAADVWSVTSWGELNRDGVAIET

SEQ ID NO: 1463008 - protein, 29 aa, Mycobacterium tuberculosis
DVAQLCERAELAAHWLSHGRWTDGWDPHR

SEQ ID NO: 1463009 - protein, 18 aa, Mycobacterium tuberculosis
DVDTPWRKLPAKARKAIL

SEQ ID NO: 1463010 - protein, 19 aa, Mycobacterium tuberculosis
DVGNVRFAGAPVVAHSAVQ

SEQ ID NO: 1463011 - protein, 26 aa, Mycobacterium tuberculosis
DVIGLRIAGGAIVWATPDHKVLTEYG

SEQ ID NO: 1463012 - protein, 21 aa, Mycobacterium tuberculosis
DVKGLRLTLTQAAWRVAEDSL

SEQ ID NO: 1463013 - protein, 19 aa, Mycobacterium tuberculosis
DVVNKVWFLDAVRGQVDVY

SEQ ID NO: 1463014 - protein, 26 aa, Mycobacterium tuberculosis
EAAYPGRFLLGIGVGHAEMISEYRKP

SEQ ID NO: 1463015 - protein, 28 aa, Mycobacterium tuberculosis
EACPAALVDRWAPGRVMLNAYGPTETTI

SEQ ID NO: 1463016 - protein, 24 aa, Mycobacterium tuberculosis
EAGLHLVGVFTFPGHSYAPGKPGE

SEQ ID NO: 1463017 - protein, 18 aa, Mycobacterium tuberculosis
EAGLPRRGTPDAIVVVRD

SEQ ID NO: 1463018 - protein, 25 aa, Mycobacterium tuberculosis
EAIDAEIPLLVVITEGIPVQDTAYA

SEQ ID NO: 1463019 - protein, 20 aa, Mycobacterium tuberculosis
EAIVDRIDYIVSLGETVMSP

SEQ ID NO: 1463020 - protein, 20 aa, Mycobacterium tuberculosis
EALRAKQCWTEPRAWETLQR

SEQ ID NO: 1463021 - protein, 23 aa, Mycobacterium tuberculosis
EATRPLVICDLGMPRDVDPAVAR

SEQ ID NO: 1463022 - protein, 17 aa, Mycobacterium tuberculosis
ECVPVLMAALGKITGYD

SEQ ID NO: 1463023 - protein, 27 aa, Mycobacterium tuberculosis
EEFISWEPFTRMAFRFNECSTRAVGAF

SEQ ID NO: 1463024 - protein, 19 aa, Mycobacterium tuberculosis
EERYRICSTVHTKIAVVKS

SEQ ID NO: 1463025 - protein, 19 aa, Mycobacterium tuberculosis
EFFRISPREATAMDPQQRV

SEQ ID NO: 1463026 - protein, 22 aa, Mycobacterium tuberculosis
EFGRLPEPLAMLSPDEGLLTAG

SEQ ID NO: 1463027 - protein, 27 aa, Mycobacterium tuberculosis
EGALVTLDWLGAHGFGRLLQHTVVVLN

SEQ ID NO: 1463028 - protein, 17 aa, Mycobacterium tuberculosis
EGFDVRGGALAPGTVRQ

SEQ ID NO: 1463029 - protein, 27 aa, Mycobacterium tuberculosis
EGGLMPGFGGAPWVGGHWGLGGEGHSG

SEQ ID NO: 1463030 - protein, 21 aa, Mycobacterium tuberculosis
EGVTLRFGSKVPGTAMEVRDV

SEQ ID NO: 1463031 - protein, 19 aa, Mycobacterium tuberculosis
EHALALLLAASRQIPAADA

SEQ ID NO: 1463032 - protein, 22 aa, Mycobacterium tuberculosis
EIEALGYGAVWVGGSPPAALSW

SEQ ID NO: 1463033 - protein, 19 aa, Mycobacterium tuberculosis
EIVDPRPLTLLPEPNPGDL

SEQ ID NO: 1463034 - protein, 25 aa, Mycobacterium tuberculosis
ELPGDLAWQPPLWRALVTTVGADPP

SEQ ID NO: 1463035 - protein, 18 aa, Mycobacterium tuberculosis
ELSEICGHIASLPATAVG

SEQ ID NO: 1463036 - protein, 24 aa, Mycobacterium tuberculosis
ELTAEQRGTVALMHGEREFPSFQA

SEQ ID NO: 1463037 - protein, 17 aa, Mycobacterium tuberculosis
ELVWAPAAFRYVMMVLR

SEQ ID NO: 1463038 - protein, 20 aa, Mycobacterium tuberculosis
EPGAPVVILAHGFPELAYSW

SEQ ID NO: 1463039 - protein, 27 aa, Mycobacterium tuberculosis
EPKVPRAARVAVRWLRAVALDRIGDVE

SEQ ID NO: 1463040 - protein, 20 aa, Mycobacterium tuberculosis
EQANINWGKAGRMRWKGKRP

SEQ ID NO: 1463041 - protein, 23 aa, Mycobacterium tuberculosis
EQNAWWWDVLKFGRSSAYAEFFD

SEQ ID NO: 1463042 - protein, 18 aa, Mycobacterium tuberculosis
ERALGYRLDGVHIAAVVW

SEQ ID NO: 1463043 - protein, 45 aa, Mycobacterium tuberculosis; identical to SEQ ID NO: 198761

SEQ ID NO: 1463044 - protein, 19 aa, Mycobacterium tuberculosis
ERYMKLLAPRWQMMSDPQL

SEQ ID NO: 1463045 - protein, 20 aa, Mycobacterium tuberculosis
ESDQRSAAVIARNIEALGLS

SEQ ID NO: 1463046 - protein, 19 aa, Mycobacterium tuberculosis
ESEIRPELRRLDLGKLLEL

SEQ ID NO: 1463047 - protein, 17 aa, Mycobacterium tuberculosis
ESIKATLTFRDPKELRF

SEQ ID NO: 1463048 - protein, 19 aa, Mycobacterium tuberculosis
ESLASRWLADRIAADSTVI

SEQ ID NO: 1463049 - protein, 20 aa, Mycobacterium tuberculosis
ESLTEVWRTDGYCHCMFTAL

SEQ ID NO: 1463050 - protein, 26 aa, Mycobacterium tuberculosis
ETFLRAIGAIPRFSARSSARTWLLAI

SEQ ID NO: 1463051 - protein, 17 aa, Mycobacterium tuberculosis
ETMKLPRTILMYPMTLA

SEQ ID NO: 1463052 - protein, 25 aa, Mycobacterium tuberculosis
ETTFSVGLANLGFWNLGSANIGNYN

SEQ ID NO: 1463053 - protein, 20 aa, Mycobacterium tuberculosis
ETTPGGGVTIVIPGHENVTL

SEQ ID NO: 1463054 - protein, 26 aa, Mycobacterium tuberculosis
ETYLRLMFLKFRYRLGYESLCREVTD

SEQ ID NO: 1463055 - protein, 20 aa, Mycobacterium tuberculosis
EVGWRDPFRLAVGPFPCLPA

SEQ ID NO: 1463056 - protein, 18 aa, Mycobacterium tuberculosis
EVRAVPAAAQASVLVLPV

SEQ ID NO: 1463057 - protein, 24 aa, Mycobacterium tuberculosis
EVRRARKSIAQFKLREGMPVGVRV

SEQ ID NO: 1463058 - protein, 25 aa, Mycobacterium tuberculosis
EVRYFIDRLAGWYVITSSDRMSREG

SEQ ID NO: 1463059 - protein, 27 aa, Mycobacterium tuberculosis
EWDAVIAVHLRGHFLLTRNAAAYWRDK

SEQ ID NO: 1463060 - protein, 27 aa, Mycobacterium tuberculosis
EYLSGRWAQAYGFPLMPIDGILVGTAA

SEQ ID NO: 1463061 - protein, 19 aa, Mycobacterium tuberculosis
FAASHLRDGAVLLDVSRID

SEQ ID NO: 1463062 - protein, 25 aa, Mycobacterium tuberculosis
FAEFLEVRGSLLPDDERLLAEQWLL

SEQ ID NO: 1463063 - protein, 23 aa, Mycobacterium tuberculosis
FARECLADGVAVLVEERVDLRRE

SEQ ID NO: 1463064 - protein, 20 aa, Mycobacterium tuberculosis
FASGRVAYAMGLQGPAITVD

SEQ ID NO: 1463065 - protein, 19 aa, Mycobacterium tuberculosis
FASLRRWTGGSIPETDIPI

SEQ ID NO: 1463066 - protein, 21 aa, Mycobacterium tuberculosis
FDDMARLGAQVTIFRLGSDPG

SEQ ID NO: 1463067 - protein, 37 aa, Mycobacterium tuberculosis
FDGDGMIHVVGFRDGKAFYRNRFIRTDGFLAENEAGG

SEQ ID NO: 1463068 - protein, 25 aa, Mycobacterium tuberculosis
FEDLVIRLLEAMGYGRAGAVERTSA

SEQ ID NO: 1463069 - protein, 24 aa, Mycobacterium tuberculosis
FEHRCPGCGEPVIWQLVDEDAPLR

SEQ ID NO: 1463070 - protein, 26 aa, Mycobacterium tuberculosis
FEVEGGIIRVAEGWAHGPQVDKGVKW

SEQ ID NO: 1463071 - protein, 30 aa, Mycobacterium tuberculosis; identical to SEQ ID NO: 199098

SEQ ID NO: 1463072 - protein, 17 aa, Mycobacterium tuberculosis
FGAGYAKAMEKMLEVNQ

SEQ ID NO: 1463073 - protein, 17 aa, Mycobacterium tuberculosis
FGASLPVRVCTICTDPW

SEQ ID NO: 1463074 - protein, 41 aa, Mycobacterium tuberculosis; identical to SEQ ID NO: 210784

SEQ ID NO: 1463075 - protein, 18 aa, Mycobacterium tuberculosis
FGHSGWQPGDAWMAETTL

SEQ ID NO: 1463076 - protein, 26 aa, Mycobacterium tuberculosis
FGISGEVTFDYGIAYDRSRKVAEGRV

SEQ ID NO: 1463077 - protein, 30 aa, Mycobacterium tuberculosis
FGNLMLYSRLRLATAASWSIRYVVERRAIG

SEQ ID NO: 1463078 - protein, 17 aa, Mycobacterium tuberculosis
FGPSPAINLNIGKPDGS

SEQ ID NO: 1463079 - protein, 22 aa, Mycobacterium tuberculosis
FIGGNFSNGAFWQSDHQGQWGA

SEQ ID NO: 1463080 - protein, 17 aa, Mycobacterium tuberculosis
FKNARAASVTRTGAGVL

SEQ ID NO: 1463081 - protein, 24 aa, Mycobacterium tuberculosis
FLARLCKTAIWIDHGVIRLAGGIE

SEQ ID NO: 1463082 - protein, 19 aa, Mycobacterium tuberculosis
FNRPLRPLAPVAHLDFDEP

SEQ ID NO: 1463083 - protein, 20 aa, Mycobacterium tuberculosis
FPLRRGLVWRRRASELRTEA

SEQ ID NO: 1463084 - protein, 18 aa, Mycobacterium tuberculosis
FRDMVHPLIARPLPAETG

SEQ ID NO: 1463085 - protein, 20 aa, Mycobacterium tuberculosis
FRFGPEPDRSQTFACEASSH

SEQ ID NO: 1463086 - protein, 17 aa, Mycobacterium tuberculosis
FRLGEKVDDPLAMYLFD

SEQ ID NO: 1463087 - protein, 17 aa, Mycobacterium tuberculosis
FRRRRHPAVAGAWSPGV

SEQ ID NO: 1463088 - protein, 19 aa, Mycobacterium tuberculosis
FSAKFASAVSKNPFVGEPI

SEQ ID NO: 1463089 - protein, 17 aa, Mycobacterium tuberculosis
FSCYVHPEIEFFLLKPG

SEQ ID NO: 1463090 - protein, 17 aa, Mycobacterium tuberculosis
FSREKVISGVRRACQGR

SEQ ID NO: 1463091 - protein, 18 aa, Mycobacterium tuberculosis
FSTLLSNAGTIFWNGPMG

SEQ ID NO: 1463092 - protein, 18 aa, Mycobacterium tuberculosis
FTAAEALEYGFVDHIITR

SEQ ID NO: 1463093 - protein, 20 aa, Mycobacterium tuberculosis
FTSSKVMCWVALDRGAKLAE

SEQ ID NO: 1463094 - protein, 17 aa, Mycobacterium tuberculosis
FTVADAYQGRGIGSFLI

SEQ ID NO: 1463095 - protein, 19 aa, Mycobacterium tuberculosis
FVAALRAIWLAWQDGTKLC

SEQ ID NO: 1463096 - protein, 26 aa, Mycobacterium tuberculosis
FVALCRAAGVPARIAFQTIDAPDKEF

SEQ ID NO: 1463097 - protein, 20 aa, Mycobacterium tuberculosis
GACDSTLLIAERVQSYADVW

SEQ ID NO: 1463098 - protein, 27 aa, Mycobacterium tuberculosis
GAGISRPTFYFYFPSKEAVLLTLLDRV

SEQ ID NO: 1463099 - protein, 18 aa, Mycobacterium tuberculosis
GALAGAMRPPAPPAAPPG

SEQ ID NO: 1463100 - protein, 29 aa, Mycobacterium tuberculosis
GALESRTITFLKIDPAPGIGNSTTNPSSG

SEQ ID NO: 1463101 - protein, 17 aa, Mycobacterium tuberculosis
GAREHALLLALGKDPQV

SEQ ID NO: 1463102 - protein, 21 aa, Mycobacterium tuberculosis
GARSGGTLVGYAGISRLGRTP

SEQ ID NO: 1463103 - protein, 29 aa, Mycobacterium tuberculosis
GAVTEPMLFEWTDRDTLLYAIGVGAGTGD

SEQ ID NO: 1463104 - protein, 18 aa, Mycobacterium tuberculosis
GCRVHPLGEMRYLPVASR

SEQ ID NO: 1463105 - protein, 20 aa, Mycobacterium tuberculosis
GDAAGAWRTAAVELARALVR

SEQ ID NO: 1463106 - protein, 20 aa, Mycobacterium tuberculosis
GDLLLLRQGQLLAHTTPHRL

SEQ ID NO: 1463107 - protein, 20 aa, Mycobacterium tuberculosis
GDMRVSLFLSDAAQADAQSG

SEQ ID NO: 1463108 - protein, 18 aa, Mycobacterium tuberculosis
GDTTRSWYVIDATDVVLG

SEQ ID NO: 1463109 - protein, 21 aa, Mycobacterium tuberculosis
GDVMAAARIAGIAAAKRTGDL

SEQ ID NO: 1463110 - protein, 19 aa, Mycobacterium tuberculosis
GEHPMFKAMAAGLSSLAGR

SEQ ID NO: 1463111 - protein, 23 aa, Mycobacterium tuberculosis
GEIEWAKASLIGPEEYVTAVAAA

SEQ ID NO: 1463112 - protein, 29 aa, Mycobacterium tuberculosis
GEISRGVLFPKHRTDLLGCAVSVQRMLAG

SEQ ID NO: 1463113 - protein, 18 aa, Mycobacterium tuberculosis
GERLDAKALVAFTQSGDT

SEQ ID NO: 1463114 - protein, 20 aa, Mycobacterium tuberculosis
GFFYIKGRSSEMIICGGVNI

SEQ ID NO: 1463115 - protein, 24 aa, Mycobacterium tuberculosis
GFTSEVRGVFTYRVNKAGLITNMR

SEQ ID NO: 1463116 - protein, 22 aa, Mycobacterium tuberculosis
GGGAGLRAAIAIAETNPHLDVA

SEQ ID NO: 1463117 - protein, 25 aa, Mycobacterium tuberculosis
GGGGNFGVTTSMTFARFPTADCDVV

SEQ ID NO: 1463118 - protein, 20 aa, Mycobacterium tuberculosis
GGLQLLIIISAGRTIANDIS

SEQ ID NO: 1463119 - protein, 19 aa, Mycobacterium tuberculosis
GGSGTPIPSARYVELANAL

SEQ ID NO: 1463120 - protein, 18 aa, Mycobacterium tuberculosis
GGVTIVIPGHENVTLPHE

SEQ ID NO: 1463121 - protein, 20 aa, Mycobacterium tuberculosis
GIGRRLLRELLDFARGGVVY

SEQ ID NO: 1463122 - protein, 26 aa, Mycobacterium tuberculosis
GITGDHQMGFGGFNSGSGNIGFGNSG

SEQ ID NO: 1463123 - protein, 18 aa, Mycobacterium tuberculosis
GITGLDFDNGTVFLNKPV

SEQ ID NO: 1463124 - protein, 24 aa, Mycobacterium tuberculosis
GKDRPELASALGAAGQVFTTGVPV

SEQ ID NO: 1463125 - protein, 24 aa, Mycobacterium tuberculosis
GKNTFHGLLLLRHVADLVMTGWPV

SEQ ID NO: 1463126 - protein, 23 aa, Mycobacterium tuberculosis
GKPVVRRRILLPEHKDFGRIAPD

SEQ ID NO: 1463127 - protein, 24 aa, Mycobacterium tuberculosis
GKTARRIAALVVQRAIFLNDRNTA

SEQ ID NO: 1463128 - protein, 20 aa, Mycobacterium tuberculosis
GKTLAAFLWALDSLAGSEPM

SEQ ID NO: 1463129 - protein, 18 aa, Mycobacterium tuberculosis
GLCRGMDSSMFFHPDGER

SEQ ID NO: 1463130 - protein, 27 aa, Mycobacterium tuberculosis
GLDSRAYRLPWPDGTTVFELDRPQVLD

SEQ ID NO: 1463131 - protein, 18 aa, Mycobacterium tuberculosis
GLRSYRGDMINGFAPDAA

SEQ ID NO: 1463132 - protein, 26 aa, Mycobacterium tuberculosis
GLRVWSRATIGLAYASALIIADRHDE

SEQ ID NO: 1463133 - protein, 18 aa, Mycobacterium tuberculosis
GNIGFGLTGNNQVGIGGL

SEQ ID NO: 1463134 - protein, 23 aa, Mycobacterium tuberculosis
GNPSRLAALYGLQLAHESQCCQM

SEQ ID NO: 1463135 - protein, 18 aa, Mycobacterium tuberculosis
GNQTMTWRDYAAQVRRVA

SEQ ID NO: 1463136 - protein, 24 aa, Mycobacterium tuberculosis
GPADLPARLSLFGHTRLACTDVQL

SEQ ID NO: 1463137 - protein, 25 aa, Mycobacterium tuberculosis
GPAMLPGFNSGFANIGSFNAGIANS

SEQ ID NO: 1463138 - protein, 20 aa, Mycobacterium tuberculosis
GPEVGRYVPDPAPTKRQLLS

SEQ ID NO: 1463139 - protein, 29 aa, Mycobacterium tuberculosis
GPISIPIIDLRPAPGFFNATTGPSSGFLN

SEQ ID NO: 1463140 - protein, 23 aa, Mycobacterium tuberculosis
GQAGGKGWDGGPIGNGQVGEQHG

SEQ ID NO: 1463141 - protein, 17 aa, Mycobacterium tuberculosis
GQFFPRWTYEKTEPRDG

SEQ ID NO: 1463142 - protein, 19 aa, Mycobacterium tuberculosis
GQGGLLRGIPLARAGRRTG

SEQ ID NO: 1463143 - protein, 25 aa, Mycobacterium tuberculosis
GQPRVNPLYFLRDGGRVIVAASKGG

SEQ ID NO: 1463144 - protein, 18 aa, Mycobacterium tuberculosis
GQVFTTGVPVQWSAVFAG

SEQ ID NO: 1463145 - protein, 18 aa, Mycobacterium tuberculosis
GRADGVCAGIAFRNPQSL

SEQ ID NO: 1463146 - protein, 22 aa, Mycobacterium tuberculosis
GRELKKLVPITTFLRRSPYLAA

SEQ ID NO: 1463147 - protein, 18 aa, Mycobacterium tuberculosis
GRFALKIGDGRARCTPTD

SEQ ID NO: 1463148 - protein, 19 aa, Mycobacterium tuberculosis
GRGGFPGMHLGSVSRAVVN

SEQ ID NO: 1463149 - protein, 20 aa, Mycobacterium tuberculosis
GRQRWCVRLVQGGGFAGPLF

SEQ ID NO: 1463150 - protein, 20 aa, Mycobacterium tuberculosis
GRSEFAYGSFVRTVSLPVGA

SEQ ID NO: 1463151 - protein, 17 aa, Mycobacterium tuberculosis
GRVLKCPQPPPQAESTG

SEQ ID NO: 1463152 - protein, 24 aa, Mycobacterium tuberculosis
GSLYHAGVKLDWMVATTLLTGRRT

SEQ ID NO: 1463153 - protein, 26 aa, Mycobacterium tuberculosis
GSSIPAIPIGLVLNGDIGPITIQPIP

SEQ ID NO: 1463154 - protein, 18 aa, Mycobacterium tuberculosis
GSTLIRLFGHDNVTVLPH

SEQ ID NO: 1463155 - protein, 26 aa, Mycobacterium tuberculosis
GTGKTFTALKIAERIAADNGGSARIL

SEQ ID NO: 1463156 - protein, 25 aa, Mycobacterium tuberculosis
GTGQAGGNGGWLWGNGGNGGSGAPG

SEQ ID NO: 1463157 - protein, 23 aa, Mycobacterium tuberculosis
GTLSTFFGVPLVLTYATLGAPFA

SEQ ID NO: 1463158 - protein, 17 aa, Mycobacterium tuberculosis
GTMPIEVESSVARVAGA

SEQ ID NO: 1463159 - protein, 22 aa, Mycobacterium tuberculosis
GTSTLRLAPALGASRTVAVVST

SEQ ID NO: 1463160 - protein, 18 aa, Mycobacterium tuberculosis
GTVSGLYVCEMVTARALI

SEQ ID NO: 1463161 - protein, 18 aa, Mycobacterium tuberculosis
GVALSLVYREGRLTRAST

SEQ ID NO: 1463162 - protein, 25 aa, Mycobacterium tuberculosis
GVDRMQFCSEFEWIAPSGRGLLTHY

SEQ ID NO: 1463163 - protein, 34 aa, Mycobacterium tuberculosis
GVEARRFWRHEYLLNALIGRFAKPYVALMDGIVM

SEQ ID NO: 1463164 - protein, 17 aa, Mycobacterium tuberculosis
GVEKWRDGQFVAFEGSY

SEQ ID NO: 1463165 - protein, 19 aa, Mycobacterium tuberculosis
GVFGRRNRYVAHWDDTGQA

SEQ ID NO: 1463166 - protein, 19 aa, Mycobacterium tuberculosis
GVGSAENFSVVEALADSLG

SEQ ID NO: 1463167 - protein, 18 aa, Mycobacterium tuberculosis
GVPGEAWARHGVEHPMGA

SEQ ID NO: 1463168 - protein, 20 aa, Mycobacterium tuberculosis
GVWLRPFRNLVYAMPPYICT

SEQ ID NO: 1463169 - protein, 26 aa, Mycobacterium tuberculosis
GYIPILGAPWLADLVRRSPWGEMFAS

SEQ ID NO: 1463170 - protein, 24 aa, Mycobacterium tuberculosis
HAGLLPVPARKAGRLILVDDQPAD

SEQ ID NO: 1463171 - protein, 23 aa, Mycobacterium tuberculosis
HAKARGANILARIMGASITSDGF

SEQ ID NO: 1463172 - protein, 18 aa, Mycobacterium tuberculosis
HDALRGWASSLTTTAELG

SEQ ID NO: 1463173 - protein, 17 aa, Mycobacterium tuberculosis
HELTVLAALLGPADAPV

SEQ ID NO: 1463174 - protein, 20 aa, Mycobacterium tuberculosis
HFFRSVLRWLQVGYPEGVPG

SEQ ID NO: 1463175 - protein, 21 aa, Mycobacterium tuberculosis
HFGQSGGFIWVDPKADLALVV

SEQ ID NO: 1463176 - protein, 36 aa, Mycobacterium tuberculosis
HGARLRPGATVSLPCAPFLHLFVAYGRLTLEGGGEL

SEQ ID NO: 1463177 - protein, 18 aa, Mycobacterium tuberculosis
HGHSAWREDGNYSPQLNS

SEQ ID NO: 1463178 - protein, 20 aa, Mycobacterium tuberculosis
HGQLPNMRAIVGFAAETGDA

SEQ ID NO: 1463179 - protein, 21 aa, Mycobacterium tuberculosis
HGVAFCMGKASSFVALCRAAG

SEQ ID NO: 1463180 - protein, 18 aa, Mycobacterium tuberculosis
HHRNEVTEIIPLDGFLDG

SEQ ID NO: 1463181 - protein, 27 aa, Mycobacterium tuberculosis
HIVIDGWSLPLFVSELLALYRAGGHVA

SEQ ID NO: 1463182 - protein, 25 aa, Mycobacterium tuberculosis
HIVRHYRPIVVVLFLSAEIAAFENA

SEQ ID NO: 1463183 - protein, 19 aa, Mycobacterium tuberculosis
HLIDAARPFIFDTGLAPAA

SEQ ID NO: 1463184 - protein, 31 aa, Mycobacterium tuberculosis
HLRASKPLVRLRVPFTLSRNEIDDVERGSKD

SEQ ID NO: 1463185 - protein, 25 aa, Mycobacterium tuberculosis
HLSSKEWPGMLAFYRNLAMALVGDH

SEQ ID NO: 1463186 - protein, 19 aa, Mycobacterium tuberculosis
HNLAALGMEADLCRADVLH

SEQ ID NO: 1463187 - protein, 18 aa, Mycobacterium tuberculosis
HNSQPWRWVAESGSEHTT

SEQ ID NO: 1463188 - protein, 17 aa, Mycobacterium tuberculosis
HNTWRFGLDRILTGVAM

SEQ ID NO: 1463189 - protein, 24 aa, Mycobacterium tuberculosis
HRDPGIPVVIGRNVSGPVSGPNED

SEQ ID NO: 1463190 - protein, 17 aa, Mycobacterium tuberculosis
HRETTRIGRTLAAEVQL

SEQ ID NO: 1463191 - protein, 29 aa, Mycobacterium tuberculosis
HTRRLRFGLAAPLPRAGTQMRAFAQAVEA

SEQ ID NO: 1463192 - protein, 20 aa, Mycobacterium tuberculosis
HVQEIGWAEHWQCDSCSASH

SEQ ID NO: 1463193 - protein, 25 aa, Mycobacterium tuberculosis
IAAFSAVKPSLAWAETYPGTLSYYL

SEQ ID NO: 1463194 - protein, 25 aa, Mycobacterium tuberculosis
IAANRARLTSLVTHNVFGQNTASIA

SEQ ID NO: 1463195 - protein, 18 aa, Mycobacterium tuberculosis
IAGITYRQLDYWARTSLV

SEQ ID NO: 1463196 - protein, 28 aa, Mycobacterium tuberculosis
IANGIDAPALWPGLPIRPVKGEVLRLRW

SEQ ID NO: 1463197 - protein, 25 aa, Mycobacterium tuberculosis
IANSDFYAVCGWDAVNEAIGRPEDF

SEQ ID NO: 1463198 - protein, 28 aa, Mycobacterium tuberculosis
IAQCVKAEMLAASSWRVAVNAGADSTGR

SEQ ID NO: 1463199 - protein, 20 aa, Mycobacterium tuberculosis
IDAPVLRRAQTRFANAPIRW

SEQ ID NO: 1463200 - protein, 26 aa, Mycobacterium tuberculosis
IDEIKPARLYARFPAGFAGMPALLDI

SEQ ID NO: 1463201 - protein, 21 aa, Mycobacterium tuberculosis
IDGVLVLSWRAIPGAAETVRQ

SEQ ID NO: 1463202 - protein, 22 aa, Mycobacterium tuberculosis
IECLRSIFTGARVEYSGRHVNS

SEQ ID NO: 1463203 - protein, 18 aa, Mycobacterium tuberculosis
IEEAMRLAAEMGEQDPGA

SEQ ID NO: 1463204 - protein, 19 aa, Mycobacterium tuberculosis
IGAILPLLAGVADPSNFGA

SEQ ID NO: 1463205 - protein, 33 aa, Mycobacterium tuberculosis; identical to SEQ ID NO: 201184

SEQ ID NO: 1463206 - protein, 17 aa, Mycobacterium tuberculosis
IISCGAVLDHLRIAMTA

SEQ ID NO: 1463207 - protein, 17 aa, Mycobacterium tuberculosis
INGCKTWISNARRSGLF

SEQ ID NO: 1463208 - protein, 21 aa, Mycobacterium tuberculosis
INIPINITSAPGFGNSTTTPS

SEQ ID NO: 1463209 - protein, 19 aa, Mycobacterium tuberculosis
IPARPVIIGPITFLLLSKA

SEQ ID NO: 1463210 - protein, 17 aa, Mycobacterium tuberculosis
IPGAGLAVERIGERAHD

SEQ ID NO: 1463211 - protein, 20 aa, Mycobacterium tuberculosis
IPQFPIRITTTGGIGPIVIP

SEQ ID NO: 1463212 - protein, 24 aa, Mycobacterium tuberculosis
IQAIKGVEIGDGFQTARRRGSRAH

SEQ ID NO: 1463213 - protein, 21 aa, Mycobacterium tuberculosis
IRALHEVGVELSVFGTQGRKG

SEQ ID NO: 1463214 - protein, 19 aa, Mycobacterium tuberculosis
IRDVTELWCQGYSEPGAGS

SEQ ID NO: 1463215 - protein, 17 aa, Mycobacterium tuberculosis
IRLEGKSVLISDSERLA

SEQ ID NO: 1463216 - protein, 24 aa, Mycobacterium tuberculosis
IRSACARAGGALLVVEREDPVPVP

SEQ ID NO: 1463217 - protein, 23 aa, Mycobacterium tuberculosis
ISALRWGGSAPRVIFLHGGGQNA

SEQ ID NO: 1463218 - protein, 18 aa, Mycobacterium tuberculosis
ISDVRQGKRFELEVDDTV

SEQ ID NO: 1463219 - protein, 17 aa, Mycobacterium tuberculosis
ISVWWGWQDHFREIVNV

SEQ ID NO: 1463220 - protein, 20 aa, Mycobacterium tuberculosis
ITALWEEWPPSGARASIHSY

SEQ ID NO: 1463221 - protein, 17 aa, Mycobacterium tuberculosis
ITETLTWSEVFRRTRIV

SEQ ID NO: 1463222 - protein, 17 aa, Mycobacterium tuberculosis
ITSAPGFGNSTTTPSSG

SEQ ID NO: 1463223 - protein, 17 aa, Mycobacterium tuberculosis
IVDRPLYRFPVFGFFAL

SEQ ID NO: 1463224 - protein, 18 aa, Mycobacterium tuberculosis
IVGALGRLGHLGISDVRQ

SEQ ID NO: 1463225 - protein, 23 aa, Mycobacterium tuberculosis
IVRRPAIAAVRAEYERVLRQRTA

SEQ ID NO: 1463226 - protein, 20 aa, Mycobacterium tuberculosis
IWPIAAARFVDNVVAVDSAA

SEQ ID NO: 1463227 - protein, 21 aa, Mycobacterium tuberculosis
KAGQLWDAAGIEWAATSALSA

SEQ ID NO: 1463228 - protein, 19 aa, Mycobacterium tuberculosis
KATRPEVRGGLGGFAGLFT

SEQ ID NO: 1463229 - protein, 21 aa, Mycobacterium tuberculosis
KCYRIRRAPGHSASFRITGAA

SEQ ID NO: 1463230 - protein, 19 aa, Mycobacterium tuberculosis
KDAEGGSVFGRLVNTSSEA

SEQ ID NO: 1463231 - protein, 24 aa, Mycobacterium tuberculosis
KDMWGRVVPELAALNLLKESDLGV

SEQ ID NO: 1463232 - protein, 20 aa, Mycobacterium tuberculosis
KDSPEVIAYLEAENDYTERT

SEQ ID NO: 1463233 - protein, 23 aa, Mycobacterium tuberculosis
KFIVTEIFPGGRLPSIPMVQECA

SEQ ID NO: 1463234 - protein, 23 aa, Mycobacterium tuberculosis
KLAGLPRLTWRADAWHRQRAALA

SEQ ID NO: 1463235 - protein, 18 aa, Mycobacterium tuberculosis
KLLFKKGIHLLDCGTSGG

SEQ ID NO: 1463236 - protein, 20 aa, Mycobacterium tuberculosis
KLQHKMVYRHSGYPGGLHKR

SEQ ID NO: 1463237 - protein, 23 aa, Mycobacterium tuberculosis
KLRDRPRLGVSVLAEGHDAACMS

SEQ ID NO: 1463238 - protein, 17 aa, Mycobacterium tuberculosis
KPIPHRTVLPLEFARLA

SEQ ID NO: 1463239 - protein, 25 aa, Mycobacterium tuberculosis
KPLQNLAGLPAWLASGAPAAAMTAA

SEQ ID NO: 1463240 - protein, 25 aa, Mycobacterium tuberculosis
KPPAARCPLCPGPTGLSSEVPAPDY

SEQ ID NO: 1463241 - protein, 19 aa, Mycobacterium tuberculosis
KQGFLGMAVPEEYGGGGNA

SEQ ID NO: 1463242 - protein, 19 aa, Mycobacterium tuberculosis
KRPTSGWGALTPTELEVAL

SEQ ID NO: 1463243 - protein, 19 aa, Mycobacterium tuberculosis
KRWVDNMVNELAARPPDDP

SEQ ID NO: 1463244 - protein, 31 aa, Mycobacterium tuberculosis; identical to SEQ ID NO: 201768

SEQ ID NO: 1463245 - protein, 20 aa, Mycobacterium tuberculosis
KTSISAPIVESWRAQRGAQC

SEQ ID NO: 1463246 - protein, 26 aa, Mycobacterium tuberculosis
KVIAQLRFPGYFLVVHDITRFCRDND

SEQ ID NO: 1463247 - protein, 17 aa, Mycobacterium tuberculosis
KVPGVLTARIVPGATAL

SEQ ID NO: 1463248 - protein, 21 aa, Mycobacterium tuberculosis
KVPSWISDIANIFNIGAGNWA

SEQ ID NO: 1463249 - protein, 23 aa, Mycobacterium tuberculosis
KWAVRWKPALNALAITFADRMPA

SEQ ID NO: 1463250 - protein, 18 aa, Mycobacterium tuberculosis
KYGMTLCALGIAEEMRAD

SEQ ID NO: 1463251 - protein, 25 aa, Mycobacterium tuberculosis
KYTGLKLGGVYGFYPRFTGPQRSTV

SEQ ID NO: 1463252 - protein, 23 aa, Mycobacterium tuberculosis
LAAMPGNVFLPATTTRLPRDSVV

SEQ ID NO: 1463253 - protein, 17 aa, Mycobacterium tuberculosis
LACAKLGAIAVMADGNL

SEQ ID NO: 1463254 - protein, 19 aa, Mycobacterium tuberculosis
LADSLGPVRVVVNCAGTGN

SEQ ID NO: 1463255 - protein, 24 aa, Mycobacterium tuberculosis
LADYRGRRVIVYFYPAASTPGCTK

SEQ ID NO: 1463256 - protein, 18 aa, Mycobacterium tuberculosis
LAKLEGDAAFFWAPGGNT

SEQ ID NO: 1463257 - protein, 24 aa, Mycobacterium tuberculosis
LAPHLVKPLPFLFPLTKRWWERPY

SEQ ID NO: 1463258 - protein, 23 aa, Mycobacterium tuberculosis
LAQLRPQPILQLPDTNSGWRLVA

SEQ ID NO: 1463259 - protein, 24 aa, Mycobacterium tuberculosis
LAQTRISGVLIDLRPYRPPDAARR

SEQ ID NO: 1463260 - protein, 18 aa, Mycobacterium tuberculosis
LARAAGLAIGDRGGVLTD

SEQ ID NO: 1463261 - protein, 17 aa, Mycobacterium tuberculosis
LATAVLPAMVARRRGDL

SEQ ID NO: 1463262 - protein, 20 aa, Mycobacterium tuberculosis
LATFRDAQGLTFPLLSDPDR

SEQ ID NO: 1463263 - protein, 18 aa, Mycobacterium tuberculosis
LATGLAVDFSSLKRRTRN

SEQ ID NO: 1463264 - protein, 18 aa, Mycobacterium tuberculosis
LAVSHAFHSLLMEPMLAE

SEQ ID NO: 1463265 - protein, 19 aa, Mycobacterium tuberculosis
LCELKDIIDRSAAAGDPCG

SEQ ID NO: 1463266 - protein, 17 aa, Mycobacterium tuberculosis
LDLGDDCVFDYEAQLLA

SEQ ID NO: 1463267 - protein, 18 aa, Mycobacterium tuberculosis
LDLQEQFGLSYLFVSHDL

SEQ ID NO: 1463268 - protein, 18 aa, Mycobacterium tuberculosis
LDLYSCAVYAGQLIIEHH

SEQ ID NO: 1463269 - protein, 20 aa, Mycobacterium tuberculosis
LDPGDLYDVLAINAASASTQ

SEQ ID NO: 1463270 - protein, 17 aa, Mycobacterium tuberculosis
LDPLDYVDYRWGTEEFA

SEQ ID NO: 1463271 - protein, 31 aa, Mycobacterium tuberculosis; identical to SEQ ID NO: 202151

SEQ ID NO: 1463272 - protein, 17 aa, Mycobacterium tuberculosis
LDTEDAWVAALRNSLRA

SEQ ID NO: 1463273 - protein, 25 aa, Mycobacterium tuberculosis
LEDGTTWRVEIERAHMEEDTGKLTH

SEQ ID NO: 1463274 - protein, 23 aa, Mycobacterium tuberculosis
LELLPFRRNLAFYGLDLGLMSVS

SEQ ID NO: 1463275 - protein, 23 aa, Mycobacterium tuberculosis
LEPEFVAQGGFSLRDVIAGGKEL

SEQ ID NO: 1463276 - protein, 17 aa, Mycobacterium tuberculosis
LFAEERIVVLGAAAEAG

SEQ ID NO: 1463277 - protein, 17 aa, Mycobacterium tuberculosis
LFDEVWSWSTKALKLGA

SEQ ID NO: 1463278 - protein, 19 aa, Mycobacterium tuberculosis
LFQSHMWDGSAVPIDENLA

SEQ ID NO: 1463279 - protein, 21 aa, Mycobacterium tuberculosis
LFTATPRTGMWRLNHDGRVSF

SEQ ID NO: 1463280 - protein, 19 aa, Mycobacterium tuberculosis
LGAELGAPVIQGSTRTSER

SEQ ID NO: 1463281 - protein, 29 aa, Mycobacterium tuberculosis
LGGTSLRRSYTLLRPGGRLVGYGISNMQH

SEQ ID NO: 1463282 - protein, 19 aa, Mycobacterium tuberculosis
LGIVPLLLLDMWEHAFYLQ

SEQ ID NO: 1463283 - protein, 18 aa, Mycobacterium tuberculosis
LGPHEFLSFIEGRAAMFA

SEQ ID NO: 1463284 - protein, 24 aa, Mycobacterium tuberculosis
LGSLDDFRGTLCVPGDPDYPRVRA

SEQ ID NO: 1463285 - protein, 19 aa, Mycobacterium tuberculosis
LHAPTRLALLTGLAPHQVT

SEQ ID NO: 1463286 - protein, 17 aa, Mycobacterium tuberculosis
LHLALKAFRPGRLPFPV

SEQ ID NO: 1463287 - protein, 33 aa, Mycobacterium tuberculosis; identical to SEQ ID NO: 81998

SEQ ID NO: 1463288 - protein, 24 aa, Mycobacterium tuberculosis
LISRGGWCTVTVRYDRASVRNDEL

SEQ ID NO: 1463289 - protein, 25 aa, Mycobacterium tuberculosis
LIYPREALWRPPVLTMSAVEGRGLA

SEQ ID NO: 1463290 - protein, 18 aa, Mycobacterium tuberculosis
LKLAGLLEELGHRVEHVD

SEQ ID NO: 1463291 - protein, 19 aa, Mycobacterium tuberculosis
LLAGERPYREFPLDWMLGR

SEQ ID NO: 1463292 - protein, 17 aa, Mycobacterium tuberculosis
LLDKPVKWMEDRSENLT

SEQ ID NO: 1463293 - protein, 18 aa, Mycobacterium tuberculosis
LLDRGMVFVVAHVRGGGE

SEQ ID NO: 1463294 - protein, 29 aa, Mycobacterium tuberculosis
LLEALPERERTVLVLRFFDSMTQTQIAER

SEQ ID NO: 1463295 - protein, 28 aa, Mycobacterium tuberculosis
LLGKKCYSLRIASAMAHDEGWLAEHMLI

SEQ ID NO: 1463296 - protein, 18 aa, Mycobacterium tuberculosis
LLKATAAAVLAERGLDAS

SEQ ID NO: 1463297 - protein, 18 aa, Mycobacterium tuberculosis
LLLVRAAHATELPYVWGN

SEQ ID NO: 1463298 - protein, 21 aa, Mycobacterium tuberculosis
LLPHWRERRFGHVVNVSSAGV

SEQ ID NO: 1463299 - protein, 24 aa, Mycobacterium tuberculosis
LLQPGVLSLAWGSVVRQLAAGLGI

SEQ ID NO: 1463300 - protein, 21 aa, Mycobacterium tuberculosis
LLTRADLVICGGGHGMVAKTL

SEQ ID NO: 1463301 - protein, 17 aa, Mycobacterium tuberculosis
LMEAVARDKAGHSAFTK

SEQ ID NO: 1463302 - protein, 17 aa, Mycobacterium tuberculosis
LMHRTRASALMMAAGME

SEQ ID NO: 1463303 - protein, 17 aa, Mycobacterium tuberculosis
LMISAALAEGWAVSVPD

SEQ ID NO: 1463304 - protein, 18 aa, Mycobacterium tuberculosis
LMPVNSFAGTRGWGYDGV

SEQ ID NO: 1463305 - protein, 23 aa, Mycobacterium tuberculosis
LMQPRARGRITLVSSDPQIPVRI

SEQ ID NO: 1463306 - protein, 22 aa, Mycobacterium tuberculosis
LMRRAGGLVFARKVRAEHRPGR

SEQ ID NO: 1463307 - protein, 17 aa, Mycobacterium tuberculosis
LNASGRSPSAWTPEYFG

SEQ ID NO: 1463308 - protein, 29 aa, Mycobacterium tuberculosis
LNIPVNIPIHLDFGTLAVNGFQIPAITLR

SEQ ID NO: 1463309 - protein, 21 aa, Mycobacterium tuberculosis
LPDHPAFHWYAERIGEQRAVL

SEQ ID NO: 1463310 - protein, 17 aa, Mycobacterium tuberculosis
LPEAQLDRFAIRLELRY

SEQ ID NO: 1463311 - protein, 24 aa, Mycobacterium tuberculosis
LPEETLRWLYEMMVVTRELDTEFV

SEQ ID NO: 1463312 - protein, 20 aa, Mycobacterium tuberculosis
LPEHAIVQFVKAICSPMALA

SEQ ID NO: 1463313 - protein, 17 aa, Mycobacterium tuberculosis
LPGEVADKFHATFDALL

SEQ ID NO: 1463314 - protein, 41 aa, Mycobacterium tuberculosis
LPHAQVRFVWLRGRRATSHWLTLPALKAFGAIPVADERIVH

SEQ ID NO: 1463315 - protein, 23 aa, Mycobacterium tuberculosis
LPPEINSALMFAGPGSGPLIAAA

SEQ ID NO: 1463316 - protein, 17 aa, Mycobacterium tuberculosis
LPPKTSHLIVRMYNALL

SEQ ID NO: 1463317 - protein, 26 aa, Mycobacterium tuberculosis
LPPLSGGMVGFFAYDMVRRLERLPER

SEQ ID NO: 1463318 - protein, 18 aa, Mycobacterium tuberculosis
LPQAVPHSGAVVLNADDP

SEQ ID NO: 1463319 - protein, 19 aa, Mycobacterium tuberculosis
LPRSRRIPASRVVEIAPTV

SEQ ID NO: 1463320 - protein, 17 aa, Mycobacterium tuberculosis
LPTAIEEIVRWTSPSPS

SEQ ID NO: 1463321 - protein, 21 aa, Mycobacterium tuberculosis
LPVRVGRDVPGFIGNRLQHAL

SEQ ID NO: 1463322 - protein, 18 aa, Mycobacterium tuberculosis
LQGLRLVFERNLEVQRGR

SEQ ID NO: 1463323 - protein, 17 aa, Mycobacterium tuberculosis
LQIHGAIAFTWEHDLHL

SEQ ID NO: 1463324 - protein, 23 aa, Mycobacterium tuberculosis
LQPEIPYYSATSFDPREEPYCDA

SEQ ID NO: 1463325 - protein, 25 aa, Mycobacterium tuberculosis
LQTVAALLRLQARRTSNAEGREALI

SEQ ID NO: 1463326 - protein, 21 aa, Mycobacterium tuberculosis
LRASNRIAIERGTHFKGFERS

SEQ ID NO: 1463327 - protein, 17 aa, Mycobacterium tuberculosis
LRDQRCRTPYCDAPIRH

SEQ ID NO: 1463328 - protein, 25 aa, Mycobacterium tuberculosis
LRFAATEVIPRLAGTATEIEQVLRA

SEQ ID NO: 1463329 - protein, 32 aa, Mycobacterium tuberculosis
LRHGLRFLTACQRRYGSVFTLHVAGFGHMVYL

SEQ ID NO: 1463330 - protein, 24 aa, Mycobacterium tuberculosis
LRLNRARPTPWRVPDVDSLPELVA

SEQ ID NO: 1463331 - protein, 23 aa, Mycobacterium tuberculosis
LRRVIRSAKLLGIDAAIVGDLMA

SEQ ID NO: 1463332 - protein, 20 aa, Mycobacterium tuberculosis
LRTAVRRAKVLAGLDEDTEV

SEQ ID NO: 1463333 - protein, 21 aa, Mycobacterium tuberculosis
LSAQCPVAIVRPHRVPIGRDA

SEQ ID NO: 1463334 - protein, 21 aa, Mycobacterium tuberculosis
LSDDEFGFFVVMLAVAGNETT

SEQ ID NO: 1463335 - protein, 17 aa, Mycobacterium tuberculosis
LSDLLMRQDETFLRELV

SEQ ID NO: 1463336 - protein, 21 aa, Mycobacterium tuberculosis
LSFSLPRNGIVGVIGPNGVGK

SEQ ID NO: 1463337 - protein, 22 aa, Mycobacterium tuberculosis
LSPANIAFALGYPMDIGSYVAF

SEQ ID NO: 1463338 - protein, 20 aa, Mycobacterium tuberculosis
LSTTDVGAWVTHPGGPKIIN

SEQ ID NO: 1463339 - protein, 17 aa, Mycobacterium tuberculosis
LSVITWPAKYGGRDAPL

SEQ ID NO: 1463340 - protein, 19 aa, Mycobacterium tuberculosis
LTAYPAQIHDWYGSEDGLD

SEQ ID NO: 1463341 - protein, 18 aa, Mycobacterium tuberculosis
LTHDDFRNAWFVDASGRK

SEQ ID NO: 1463342 - protein, 19 aa, Mycobacterium tuberculosis
LTIVEGFALLSVPSSFVQN

SEQ ID NO: 1463343 - protein, 22 aa, Mycobacterium tuberculosis
LTVAEWSHLLAGHGLVVEHVVT

SEQ ID NO: 1463344 - protein, 17 aa, Mycobacterium tuberculosis
LTVRLADALARTGDCTA

SEQ ID NO: 1463345 - protein, 17 aa, Mycobacterium tuberculosis
LVDCLAFELKMDPAELR

SEQ ID NO: 1463346 - protein, 17 aa, Mycobacterium tuberculosis
LVEMIARIVEAYGKYSS

SEQ ID NO: 1463347 - protein, 25 aa, Mycobacterium tuberculosis
LVGLQRLSPRWDDGRDGPHVRLWAK

SEQ ID NO: 1463348 - protein, 18 aa, Mycobacterium tuberculosis
LVGRARRHAAAALRSGIT

SEQ ID NO: 1463349 - protein, 26 aa, Mycobacterium tuberculosis
LVHLLECGLLRGWLIPPADIKAARDV

SEQ ID NO: 1463350 - protein, 19 aa, Mycobacterium tuberculosis
LVIPKRIRERLGLRGNDQV

SEQ ID NO: 1463351 - protein, 17 aa, Mycobacterium tuberculosis
LVVIAGLQDGLWPNTVP

SEQ ID NO: 1463352 - protein, 18 aa, Mycobacterium tuberculosis
LWMLMSPTMIARGVKGTN

SEQ ID NO: 1463353 - protein, 17 aa, Mycobacterium tuberculosis
LYHREWWDRYVDVNQRF

SEQ ID NO: 1463354 - protein, 17 aa, Mycobacterium tuberculosis
LYPANCRLLDPAEALLN

SEQ ID NO: 1463355 - protein, 17 aa, Mycobacterium tuberculosis
MAGEPYAVAFGGQGSAW

SEQ ID NO: 1463356 - protein, 18 aa, Mycobacterium tuberculosis
MASESWLGPSSAGMAAAA

SEQ ID NO: 1463357 - protein, 20 aa, Mycobacterium tuberculosis
MDQPYPVAMAKLGQAIATEQ

SEQ ID NO: 1463358 - protein, 17 aa, Mycobacterium tuberculosis
MEIAEAAGLEERYVREW

SEQ ID NO: 1463359 - protein, 17 aa, Mycobacterium tuberculosis
MGGMIAQIFAARFAQRT

SEQ ID NO: 1463360 - protein, 35 aa, Mycobacterium tuberculosis; identical to SEQ ID NO: 82626

SEQ ID NO: 1463361 - protein, 19 aa, Mycobacterium tuberculosis
MGVQVIAGRGELIDSTPGL

SEQ ID NO: 1463362 - protein, 25 aa, Mycobacterium tuberculosis
MIGKPGAGVCPVRGHSNVQGDRTMG

SEQ ID NO: 1463363 - protein, 17 aa, Mycobacterium tuberculosis
MLARADSVGVFQVESRA

SEQ ID NO: 1463364 - protein, 20 aa, Mycobacterium tuberculosis
MPPLDHRAPGPVLALLCDPR

SEQ ID NO: 1463365 - protein, 22 aa, Mycobacterium tuberculosis
MQVCQKSQCPFSTADSENLQIP

SEQ ID NO: 1463366 - protein, 25 aa, Mycobacterium tuberculosis
MRDRGRLPGLSKRLGVLTRTNSESI

SEQ ID NO: 1463367 - protein, 22 aa, Mycobacterium tuberculosis
MRWKGKRPSVRGVVMNPVDHPH

SEQ ID NO: 1463368 - protein, 17 aa, Mycobacterium tuberculosis
MSALSRMSRGEHRSITL

SEQ ID NO: 1463369 - protein, 26 aa, Mycobacterium tuberculosis
MTLGSYRWLRPSGRRTAKEIAAEFST

SEQ ID NO: 1463370 - protein, 19 aa, Mycobacterium tuberculosis
MVAATMWDRYRQAVAGRIA

SEQ ID NO: 1463371 - protein, 19 aa, Mycobacterium tuberculosis
MVLRSMGIPCRYVSGYLHP

SEQ ID NO: 1463372 - protein, 21 aa, Mycobacterium tuberculosis
NEPKHPAARPKHVALQQLTGA

SEQ ID NO: 1463373 - protein, 18 aa, Mycobacterium tuberculosis
NIPIEIAGTPGFGNSTTT

SEQ ID NO: 1463374 - protein, 24 aa, Mycobacterium tuberculosis
NIPIIDIPAAPGFGNSTQMPSSGF

SEQ ID NO: 1463375 - protein, 23 aa, Mycobacterium tuberculosis
NIVELYISYLRKKIDNGREPMIH

SEQ ID NO: 1463376 - protein, 25 aa, Mycobacterium tuberculosis
NLDPAVVLAGWPAVERAARAVVDDG

SEQ ID NO: 1463377 - protein, 18 aa, Mycobacterium tuberculosis
NLLLDLQEQFGLSYLFVS

SEQ ID NO: 1463378 - protein, 23 aa, Mycobacterium tuberculosis
NPSVHRFDLFVPVFRNHLVELSA

SEQ ID NO: 1463379 - protein, 18 aa, Mycobacterium tuberculosis
NQLYVRWAGQDEWAAVPL

SEQ ID NO: 1463380 - protein, 21 aa, Mycobacterium tuberculosis
NRNQGAFGFSEPCTDCRGSGS

SEQ ID NO: 1463381 - protein, 22 aa, Mycobacterium tuberculosis
NRPGYLRFDFNWQGPLTDDQRT

SEQ ID NO: 1463382 - protein, 21 aa, Mycobacterium tuberculosis
NRQEIKQALLALQRVSERDTD

SEQ ID NO: 1463383 - protein, 17 aa, Mycobacterium tuberculosis
NSNFCYFDDAGFNYKQL

SEQ ID NO: 1463384 - protein, 27 aa, Mycobacterium tuberculosis
NTGHAAELFGWLGPHPDTMVSSAATIV

SEQ ID NO: 1463385 - protein, 24 aa, Mycobacterium tuberculosis
NTLSRFCNRFAPYNFREDMIRPSY

SEQ ID NO: 1463386 - protein, 19 aa, Mycobacterium tuberculosis
PAELLEAGFDNVEEIGRGG

SEQ ID NO: 1463387 - protein, 25 aa, Mycobacterium tuberculosis
PAFALPLRLPAGLAAGPAAVVTALT

SEQ ID NO: 1463388 - protein, 24 aa, Mycobacterium tuberculosis
PAPTKRQLLSAAFIDHLRHLGRIP

SEQ ID NO: 1463389 - protein, 19 aa, Mycobacterium tuberculosis
PAQRVCAVDGAIHVMTTVL

SEQ ID NO: 1463390 - protein, 27 aa, Mycobacterium tuberculosis
PDALVGPCWPAVFAAIGSAVTDTGEPV

SEQ ID NO: 1463391 - protein, 32 aa, Mycobacterium tuberculosis; identical to SEQ ID NO: 203840

SEQ ID NO: 1463392 - protein, 20 aa, Mycobacterium tuberculosis
PDDMSEEFCRWEERIRLDQD

SEQ ID NO: 1463393 - protein, 20 aa, Mycobacterium tuberculosis
PDNILCLDVRRGIEQTRAHE

SEQ ID NO: 1463394 - protein, 21 aa, Mycobacterium tuberculosis
PDNTCDLGRFVAEKTAGVHAA

SEQ ID NO: 1463395 - protein, 25 aa, Mycobacterium tuberculosis
PEFATYAPGLWRYWAEHLDPDRARR

SEQ ID NO: 1463396 - protein, 24 aa, Mycobacterium tuberculosis
PEFINRLDDVLIFEGLNPEELVRI

SEQ ID NO: 1463397 - protein, 18 aa, Mycobacterium tuberculosis
PEHPDHVMYVWVDALTNY

SEQ ID NO: 1463398 - protein, 33 aa, Mycobacterium tuberculosis
PELISRWAAYWPPAGAEALFRWLSERDGQNKVL

SEQ ID NO: 1463399 - protein, 20 aa, Mycobacterium tuberculosis
PELMSELLWSRIGAQCDATI

SEQ ID NO: 1463400 - protein, 20 aa, Mycobacterium tuberculosis
PELYDPEILTARYSVGAVDA

SEQ ID NO: 1463401 - protein, 17 aa, Mycobacterium tuberculosis
PEPLRTFVARLEAALPP

SEQ ID NO: 1463402 - protein, 22 aa, Mycobacterium tuberculosis
PETIAYGLIPRAHRGIVAVNEL

SEQ ID NO: 1463403 - protein, 17 aa, Mycobacterium tuberculosis
PEVRGGLGGFAGLFTLR

SEQ ID NO: 1463404 - protein, 19 aa, Mycobacterium tuberculosis
PFQPEELMPEYSIGTMTFA

SEQ ID NO: 1463405 - protein, 19 aa, Mycobacterium tuberculosis
PGCDHEIRSGTAHVVVWPT

SEQ ID NO: 1463406 - protein, 27 aa, Mycobacterium tuberculosis
PGDIDRFGRRFGCVVMDGFGSTEGGVA

SEQ ID NO: 1463407 - protein, 21 aa, Mycobacterium tuberculosis
PGDQPGKWSLMAQGVYAPAIP

SEQ ID NO: 1463408 - protein, 22 aa, Mycobacterium tuberculosis
PGERIRVVRRVHLRYEGTDTAI

SEQ ID NO: 1463409 - protein, 21 aa, Mycobacterium tuberculosis
PHPIQGIGAGFVPPVLDQDLV

SEQ ID NO: 1463410 - protein, 20 aa, Mycobacterium tuberculosis
PHYNPWDQRLCLVPNGDLFR

SEQ ID NO: 1463411 - protein, 19 aa, Mycobacterium tuberculosis
PKSWDPAAMESAIYQKWLD

SEQ ID NO: 1463412 - protein, 22 aa, Mycobacterium tuberculosis
PLDCVIGAPVLFGRANVVFTRL

SEQ ID NO: 1463413 - protein, 18 aa, Mycobacterium tuberculosis
PLGDTLSGSGWVIDTPGI

SEQ ID NO: 1463414 - protein, 18 aa, Mycobacterium tuberculosis
PLVSRAHRDKVAGYVPDD

SEQ ID NO: 1463415 - protein, 22 aa, Mycobacterium tuberculosis
PMGAREFQTFLVAKQREIVAVV

SEQ ID NO: 1463416 - protein, 31 aa, Mycobacterium tuberculosis; identical to SEQ ID NO: 204212

SEQ ID NO: 1463417 - protein, 26 aa, Mycobacterium tuberculosis
PPEFADRVADAWIKAQAYRLQTFGTV

SEQ ID NO: 1463418 - protein, 23 aa, Mycobacterium tuberculosis
PPGSLAAKWLVTRVPVAGLAEKC

SEQ ID NO: 1463419 - protein, 21 aa, Mycobacterium tuberculosis
PPTGPHWRLLSAVKELDPSWA

SEQ ID NO: 1463420 - protein, 37 aa, Mycobacterium tuberculosis
PQIATTRFLLDVNISGGLPAFTLFAGGLTIPTNAIPL

SEQ ID NO: 1463421 - protein, 17 aa, Mycobacterium tuberculosis
PQLDRIGGDQGKYLAIM

SEQ ID NO: 1463422 - protein, 22 aa, Mycobacterium tuberculosis
PRDLRLRVLSWGAAPAPDALLR

SEQ ID NO: 1463423 - protein, 21 aa, Mycobacterium tuberculosis
PREEPYCDAYYWVDNLRHTVR

SEQ ID NO: 1463424 - protein, 20 aa, Mycobacterium tuberculosis
PRHPGYRLHPVVLDAALQSV

SEQ ID NO: 1463425 - protein, 19 aa, Mycobacterium tuberculosis
PRKARRVIDLVRGRSVSDA

SEQ ID NO: 1463426 - protein, 28 aa, Mycobacterium tuberculosis
PRLLMVGDAFSPRYGDRVVRLLESKIFG

SEQ ID NO: 1463427 - protein, 18 aa, Mycobacterium tuberculosis
PRPWQLGTEMLRVTKPGG

SEQ ID NO: 1463428 - protein, 18 aa, Mycobacterium tuberculosis
PRVTLPYTDESWKTICEV

SEQ ID NO: 1463429 - protein, 22 aa, Mycobacterium tuberculosis
PSDAGFHVGERVSAFGVLGGYA

SEQ ID NO: 1463430 - protein, 18 aa, Mycobacterium tuberculosis
PSGTSWAQLGLASLAGGA

SEQ ID NO: 1463431 - protein, 20 aa, Mycobacterium tuberculosis
PSTQIPLLGVYGHPKYFLDM

SEQ ID NO: 1463432 - protein, 17 aa, Mycobacterium tuberculosis
PTAQFSVVLPRRDGVEY

SEQ ID NO: 1463433 - protein, 34 aa, Mycobacterium tuberculosis; identical to SEQ ID NO: 211539

SEQ ID NO: 1463434 - protein, 17 aa, Mycobacterium tuberculosis
PTLEALRAHVARTLDVT

SEQ ID NO: 1463435 - protein, 25 aa, Mycobacterium tuberculosis
PVFPGETLSTVIWRTEPGRAVFRTE

SEQ ID NO: 1463436 - protein, 20 aa, Mycobacterium tuberculosis
PVLARELLPERALMGDASAI

SEQ ID NO: 1463437 - protein, 23 aa, Mycobacterium tuberculosis
PVLECLRAGVPATALYVALGTEA

SEQ ID NO: 1463438 - protein, 19 aa, Mycobacterium tuberculosis
PVRAHLIDAARPFIFDTGL

SEQ ID NO: 1463439 - protein, 19 aa, Mycobacterium tuberculosis
PVSARWKFLAENTKGKPAV

SEQ ID NO: 1463440 - protein, 21 aa, Mycobacterium tuberculosis
QALDRWISWAQRCRIPVFVEL

SEQ ID NO: 1463441 - protein, 24 aa, Mycobacterium tuberculosis
QALLYVVVLHRFLRWRQRDYAPAR

SEQ ID NO: 1463442 - protein, 21 aa, Mycobacterium tuberculosis
QARVGSYLRYGAYPYAIAVRE

SEQ ID NO: 1463443 - protein, 21 aa, Mycobacterium tuberculosis
QEIMTELEIAPTRRLRGLGDR

SEQ ID NO: 1463444 - protein, 20 aa, Mycobacterium tuberculosis
QELREAIAAFSAVKPSLAWA

SEQ ID NO: 1463445 - protein, 17 aa, Mycobacterium tuberculosis
QELRELLDVSARSVNDF

SEQ ID NO: 1463446 - protein, 25 aa, Mycobacterium tuberculosis
QEPGREWSALCIGRSKTRNHIARRL

SEQ ID NO: 1463447 - protein, 18 aa, Mycobacterium tuberculosis
QEWIEGVPMAEIIRHGTT

SEQ ID NO: 1463448 - protein, 26 aa, Mycobacterium tuberculosis
QGLRVITTRSRLMARLSGQGAMALLE

SEQ ID NO: 1463449 - protein, 20 aa, Mycobacterium tuberculosis
QHPELWPNTVEEILRLDSPV

SEQ ID NO: 1463450 - protein, 21 aa, Mycobacterium tuberculosis
QIMTVFVAKGLQFPIVYLPFA

SEQ ID NO: 1463451 - protein, 25 aa, Mycobacterium tuberculosis
QLFSMPIHQVMVMPGSVMTIPGMRL

SEQ ID NO: 1463452 - protein, 24 aa, Mycobacterium tuberculosis
QLIWREYRPGWTRYGDGSVAQVKS

SEQ ID NO: 1463453 - protein, 18 aa, Mycobacterium tuberculosis
QLTLPFGAPHTMLNVAVG

SEQ ID NO: 1463454 - protein, 25 aa, Mycobacterium tuberculosis
QPDRLRRWMAVAARIELRTGGAYRW

SEQ ID NO: 1463455 - protein, 22 aa, Mycobacterium tuberculosis
QQQRLCIARAIAVQPDVLLMDE

SEQ ID NO: 1463456 - protein, 24 aa, Mycobacterium tuberculosis
QQRRFEWLLSVLRLADRLIPHRAW

SEQ ID NO: 1463457 - protein, 29 aa, Mycobacterium tuberculosis
QRAGGVLRRSIKFPTFMAGIDAVRRVAER

SEQ ID NO: 1463458 - protein, 17 aa, Mycobacterium tuberculosis
QRAVLCASTGNTSASAA

SEQ ID NO: 1463459 - protein, 19 aa, Mycobacterium tuberculosis
QRNGFDCPGCAWPEEPGGR

SEQ ID NO: 1463460 - protein, 26 aa, Mycobacterium tuberculosis
QSGRFEFRAGPIFTNLLLADEINRTP

SEQ ID NO: 1463461 - protein, 24 aa, Mycobacterium tuberculosis
QSRTIRLPVHLVEQVNKLARIKRE

SEQ ID NO: 1463462 - protein, 23 aa, Mycobacterium tuberculosis
QTAGRGRHGRGWAATARAQIILS

SEQ ID NO: 1463463 - protein, 30 aa, Mycobacterium tuberculosis; identical to SEQ ID NO: 204884

SEQ ID NO: 1463464 - protein, 23 aa, Mycobacterium tuberculosis
QVEKEAFALLALQHPVAGELREI

SEQ ID NO: 1463465 - protein, 31 aa, Mycobacterium tuberculosis; identical to SEQ ID NO: 204904

SEQ ID NO: 1463466 - protein, 18 aa, Mycobacterium tuberculosis
QVPRRAAVSSYGFSGTNV

SEQ ID NO: 1463467 - protein, 19 aa, Mycobacterium tuberculosis
QVRGGEGFFNRQEIKQALL

SEQ ID NO: 1463468 - protein, 41 aa, Mycobacterium tuberculosis; identical to SEQ ID NO: 204938

SEQ ID NO: 1463469 - protein, 19 aa, Mycobacterium tuberculosis
RAASPYVGWLNTAAGQAAQ

SEQ ID NO: 1463470 - protein, 17 aa, Mycobacterium tuberculosis
RACLFDLDGVLTDTASL

SEQ ID NO: 1463471 - protein, 17 aa, Mycobacterium tuberculosis
RADRLQYFVSCLVYMPR

SEQ ID NO: 1463472 - protein, 23 aa, Mycobacterium tuberculosis
RAEPTTRWWPLTVNVGGDSGPSG

SEQ ID NO: 1463473 - protein, 42 aa, Mycobacterium tuberculosis; identical to SEQ ID NO: 209963

SEQ ID NO: 1463474 - protein, 17 aa, Mycobacterium tuberculosis
RALVLCDFESMTGALPT

SEQ ID NO: 1463475 - protein, 27 aa, Mycobacterium tuberculosis
RAPLHTDLKEFGRWAADRIAEAIEFEG

SEQ ID NO: 1463476 - protein, 20 aa, Mycobacterium tuberculosis
RARLLPALIDGTLTAGVGLD

SEQ ID NO: 1463477 - protein, 17 aa, Mycobacterium tuberculosis
RAVKVQAPGPVTLVAGL

SEQ ID NO: 1463478 - protein, 19 aa, Mycobacterium tuberculosis
RAVQLAVLVDRGHRELPLR

SEQ ID NO: 1463479 - protein, 24 aa, Mycobacterium tuberculosis
RCGPSRARYLMLRLLERAGEQRVA

SEQ ID NO: 1463480 - protein, 24 aa, Mycobacterium tuberculosis
RDFTLPGERIHVVFRSDESGTTDN

SEQ ID NO: 1463481 - protein, 17 aa, Mycobacterium tuberculosis
RDGTCVLVIAPAPALPD

SEQ ID NO: 1463482 - protein, 20 aa, Mycobacterium tuberculosis
RDVPYDVLASFRYLAQGHHR

SEQ ID NO: 1463483 - protein, 20 aa, Mycobacterium tuberculosis
RELRQITGRVPVEIPRMRGA

SEQ ID NO: 1463484 - protein, 23 aa, Mycobacterium tuberculosis
RELRQLWEDRGCPRMPPRPRDVH

SEQ ID NO: 1463485 - protein, 23 aa, Mycobacterium tuberculosis
RELTARTGGVVGRRVCAVVGSGD

SEQ ID NO: 1463486 - protein, 24 aa, Mycobacterium tuberculosis
REPTGDGLVEWEGIGTVEAWTTPV

SEQ ID NO: 1463487 - protein, 27 aa, Mycobacterium tuberculosis
REPVRSLVWIRGCLHQIPPAELVETLD

SEQ ID NO: 1463488 - protein, 17 aa, Mycobacterium tuberculosis
REQFAYLSYGRVMDTTR

SEQ ID NO: 1463489 - protein, 21 aa, Mycobacterium tuberculosis
RFAECPTFPAPPPREILDAAG

SEQ ID NO: 1463490 - protein, 26 aa, Mycobacterium tuberculosis
RGAEYSVDFVPKVRIEVVVDDSIVDK

SEQ ID NO: 1463491 - protein, 23 aa, Mycobacterium tuberculosis
RGAWLVCRAAGRVLLEQGQGGSV

SEQ ID NO: 1463492 - protein, 19 aa, Mycobacterium tuberculosis
RGGKLSLRVIALVNGTVIG

SEQ ID NO: 1463493 - protein, 17 aa, Mycobacterium tuberculosis
RGIACAYLTNTTTRTRR

SEQ ID NO: 1463494 - protein, 20 aa, Mycobacterium tuberculosis
RGLRGAGFAGRIVSFEPLPG

SEQ ID NO: 1463495 - protein, 17 aa, Mycobacterium tuberculosis
RGTDTKIAWKGDEAVEL

SEQ ID NO: 1463496 - protein, 19 aa, Mycobacterium tuberculosis
RHLGGVLYLFVRGMCGAAT

SEQ ID NO: 1463497 - protein, 22 aa, Mycobacterium tuberculosis
RIDALSRPGSWLASNVPGAGFL

SEQ ID NO: 1463498 - protein, 18 aa, Mycobacterium tuberculosis
RIRIAIAGADASHFAILP

SEQ ID NO: 1463499 - protein, 19 aa, Mycobacterium tuberculosis
RIVPISDYLAALIRDTPHG

SEQ ID NO: 1463500 - protein, 25 aa, Mycobacterium tuberculosis
RKADELGCRSLALVAFGTGVGGFPL

SEQ ID NO: 1463501 - protein, 24 aa, Mycobacterium tuberculosis
RKANLYRAALMLSLKDAISRDKRR

SEQ ID NO: 1463502 - protein, 41 aa, Mycobacterium tuberculosis; identical to SEQ ID NO: 211654

SEQ ID NO: 1463503 - protein, 25 aa, Mycobacterium tuberculosis
RKLDRKATLAFAFSHRSYLDGMLLP

SEQ ID NO: 1463504 - protein, 17 aa, Mycobacterium tuberculosis
RKLKINTILSVGEHSVR

SEQ ID NO: 1463505 - protein, 19 aa, Mycobacterium tuberculosis
RLAEIRKALGHARQADVAA

SEQ ID NO: 1463506 - protein, 25 aa, Mycobacterium tuberculosis
RLAKELDFRPRKSLGQNFVHDANTV

SEQ ID NO: 1463507 - protein, 19 aa, Mycobacterium tuberculosis
RLCTACFDGKYPIELPRET

SEQ ID NO: 1463508 - protein, 25 aa, Mycobacterium tuberculosis
RLDSKRSAVDLALRRLVGEPLGRDE

SEQ ID NO: 1463509 - protein, 20 aa, Mycobacterium tuberculosis
RLEDIWSTFTKLAPKQLIVD

SEQ ID NO: 1463510 - protein, 17 aa, Mycobacterium tuberculosis
RLLCDVGVNAAILDAAL

SEQ ID NO: 1463511 - protein, 20 aa, Mycobacterium tuberculosis
RLLGRFVRRYGKAFTANILM

SEQ ID NO: 1463512 - protein, 19 aa, Mycobacterium tuberculosis
RLLPREKRAALSAVYALGR

SEQ ID NO: 1463513 - protein, 22 aa, Mycobacterium tuberculosis
RLRSDPSIEFVDRFAEQLAGVR

SEQ ID NO: 1463514 - protein, 24 aa, Mycobacterium tuberculosis
RNAESDSGWVLHARGVLGAKAVAP

SEQ ID NO: 1463515 - protein, 34 aa, Mycobacterium tuberculosis
RNEEDPRWRFGVPPANNANYAWIQHILYKLAPGG

SEQ ID NO: 1463516 - protein, 19 aa, Mycobacterium tuberculosis
RPACGVCVLAKDCPSFGLG

SEQ ID NO: 1463517 - protein, 19 aa, Mycobacterium tuberculosis
RPEEAIGLPETFVRDVYGK

SEQ ID NO: 1463518 - protein, 17 aa, Mycobacterium tuberculosis
RPGETVLAASLTRTPGG

SEQ ID NO: 1463519 - protein, 17 aa, Mycobacterium tuberculosis
RPLAAPVVRKLAKELAV

SEQ ID NO: 1463520 - protein, 20 aa, Mycobacterium tuberculosis
RPLYRFPVFGFFALSIGAAA

SEQ ID NO: 1463521 - protein, 19 aa, Mycobacterium tuberculosis
RPRVFCMDEPLSNLDAKLR

SEQ ID NO: 1463522 - protein, 19 aa, Mycobacterium tuberculosis
RPYYNAIVWQDTRTDRIAS

SEQ ID NO: 1463523 - protein, 17 aa, Mycobacterium tuberculosis
RQDIDWITFAQNPSGPR

SEQ ID NO: 1463524 - protein, 17 aa, Mycobacterium tuberculosis
RRADARLLAGQRRLASA

SEQ ID NO: 1463525 - protein, 18 aa, Mycobacterium tuberculosis
RRAGYMYGTVLARGLRGH

SEQ ID NO: 1463526 - protein, 20 aa, Mycobacterium tuberculosis
RRCNEADAGVPARRRGRGVA

SEQ ID NO: 1463527 - protein, 29 aa, Mycobacterium tuberculosis
RRELSALVARSPFGQGAAWPVVQTVQRDG

SEQ ID NO: 1463528 - protein, 22 aa, Mycobacterium tuberculosis
RRFNFPDGETHTWAYWRAPLQA

SEQ ID NO: 1463529 - protein, 19 aa, Mycobacterium tuberculosis
RRGRPEWIAAGQFAQRYEQ

SEQ ID NO: 1463530 - protein, 18 aa, Mycobacterium tuberculosis
RRHFSALRPIGGGRFTVI

SEQ ID NO: 1463531 - protein, 21 aa, Mycobacterium tuberculosis
RRKPFSVVLFDEIEKAHQEIY

SEQ ID NO: 1463532 - protein, 21 aa, Mycobacterium tuberculosis
RRLGADAGVPVIFLHHLGAVL

SEQ ID NO: 1463533 - protein, 18 aa, Mycobacterium tuberculosis
RRLVTSCEHFHRQAVGIV

SEQ ID NO: 1463534 - protein, 19 aa, Mycobacterium tuberculosis
RRRYYRVSGADAYTMRRDS

SEQ ID NO: 1463535 - protein, 17 aa, Mycobacterium tuberculosis
RRSDGRFALYSVSDTPE

SEQ ID NO: 1463536 - protein, 18 aa, Mycobacterium tuberculosis
RRVGEGFVGLRVVPWLWG

SEQ ID NO: 1463537 - protein, 26 aa, Mycobacterium tuberculosis
RRWPSKAELVLAAFIEGIRQVAVPPN

SEQ ID NO: 1463538 - protein, 20 aa, Mycobacterium tuberculosis
RSADLADLFMLIFTSGTSGD

SEQ ID NO: 1463539 - protein, 20 aa, Mycobacterium tuberculosis
RSREIEVLEFVPAADVDPMM

SEQ ID NO: 1463540 - protein, 24 aa, Mycobacterium tuberculosis
RTCAATGCELHLVEPLGFDLSEPK

SEQ ID NO: 1463541 - protein, 23 aa, Mycobacterium tuberculosis
RTLPAHELATALNLMNERTLFAS

SEQ ID NO: 1463542 - protein, 24 aa, Mycobacterium tuberculosis
RTSNDLLLVPSIVEPSNFLENISR

SEQ ID NO: 1463543 - protein, 20 aa, Mycobacterium tuberculosis
RTVGRQALDMYFNLANYRNN

SEQ ID NO: 1463544 - protein, 17 aa, Mycobacterium tuberculosis
RTVLPGHGPDLLDLEAI

SEQ ID NO: 1463545 - protein, 20 aa, Mycobacterium tuberculosis
RVDVVLRRVDAHYADPLDLR

SEQ ID NO: 1463546 - protein, 18 aa, Mycobacterium tuberculosis
RVLAFFVSACSAPGHIRY

SEQ ID NO: 1463547 - protein, 27 aa, Mycobacterium tuberculosis
RVLSRDGVFPLAAFRKIVDINLVGTFN

SEQ ID NO: 1463548 - protein, 20 aa, Mycobacterium tuberculosis
RVRESDVYTPTLFLTARDSV

SEQ ID NO: 1463549 - protein, 29 aa, Mycobacterium tuberculosis
RWYPGEPLPRWQIALYWRTDGRPLWTNDA

SEQ ID NO: 1463550 - protein, 27 aa, Mycobacterium tuberculosis
RYAATRLRELCKMDGAVVLSTDGSRIV

SEQ ID NO: 1463551 - protein, 20 aa, Mycobacterium tuberculosis
RYEVHFACDPRFNKLLGPLP

SEQ ID NO: 1463552 - protein, 24 aa, Mycobacterium tuberculosis
RYWDRVLFDAGLSVITWPAKYGGR

SEQ ID NO: 1463553 - protein, 25 aa, Mycobacterium tuberculosis
SAELALRLAEHGLRDERLADILTRY

SEQ ID NO: 1463554 - protein, 18 aa, Mycobacterium tuberculosis
SAGRAVIVTGDFNARYSD

SEQ ID NO: 1463555 - protein, 26 aa, Mycobacterium tuberculosis
SALNRSCRRWFGMTPRQYRAYGGVSG

SEQ ID NO: 1463556 - protein, 25 aa, Mycobacterium tuberculosis
SARGRLGLLELRGFEMPPHLHMAMV

SEQ ID NO: 1463557 - protein, 21 aa, Mycobacterium tuberculosis
SARPYAFEITRMLTTLAAEAA

SEQ ID NO: 1463558 - protein, 25 aa, Mycobacterium tuberculosis
SATDHPDLFWALRGGGGGNFGVTTS

SEQ ID NO: 1463559 - protein, 17 aa, Mycobacterium tuberculosis
SCRCSRAVHIQGISPPL

SEQ ID NO: 1463560 - protein, 23 aa, Mycobacterium tuberculosis
SDAFAGAPIRVGAFLAEDHALRL

SEQ ID NO: 1463561 - protein, 25 aa, Mycobacterium tuberculosis
SDLAARLKAVWAPQGLIHRGQGRWY

SEQ ID NO: 1463562 - protein, 26 aa, Mycobacterium tuberculosis
SEGVDVPALDAVLFLNPRNSIVDVVQ

SEQ ID NO: 1463563 - protein, 18 aa, Mycobacterium tuberculosis
SESLRLAREREANLIPGG

SEQ ID NO: 1463564 - protein, 18 aa, Mycobacterium tuberculosis
SFAHVVRAVHRCLLAGRF

SEQ ID NO: 1463565 - protein, 31 aa, Mycobacterium tuberculosis
SGAIAVQWCRSWPGCTAVAFERDERRRRNIG

SEQ ID NO: 1463566 - protein, 20 aa, Mycobacterium tuberculosis
SGGRPAALYRFTDSQLRVTD

SEQ ID NO: 1463567 - protein, 17 aa, Mycobacterium tuberculosis
SGLAPALIAVAGFDPLR

SEQ ID NO: 1463568 - protein, 17 aa, Mycobacterium tuberculosis
SGMALPFADDSVDICLS

SEQ ID NO: 1463569 - protein, 22 aa, Mycobacterium tuberculosis
SGPLFMAAAAWEGLAADLRASA

SEQ ID NO: 1463570 - protein, 22 aa, Mycobacterium tuberculosis
SGPYRFVYRKRFHKRCETELTV

SEQ ID NO: 1463571 - protein, 33 aa, Mycobacterium tuberculosis; identical to SEQ ID NO: 206423

SEQ ID NO: 1463572 - protein, 17 aa, Mycobacterium tuberculosis
SISVPLDLYSCAVYAGQ

SEQ ID NO: 1463573 - protein, 22 aa, Mycobacterium tuberculosis
SIVAVTGGLLWPTRQNDARMED

SEQ ID NO: 1463574 - protein, 17 aa, Mycobacterium tuberculosis
SKDLPFAQKRFCGAEGT

SEQ ID NO: 1463575 - protein, 18 aa, Mycobacterium tuberculosis
SKPSPFAWIPFGGGTRRC

SEQ ID NO: 1463576 - protein, 19 aa, Mycobacterium tuberculosis
SLGGSCCWSCPDHPDYSER

SEQ ID NO: 1463577 - protein, 18 aa, Mycobacterium tuberculosis
SLPLTVTEWDEWGNPLND

SEQ ID NO: 1463578 - protein, 24 aa, Mycobacterium tuberculosis
SLSESIPIRIPVDIPASVIDGISM

SEQ ID NO: 1463579 - protein, 18 aa, Mycobacterium tuberculosis
SLSRGFRGADRLYGYAHR

SEQ ID NO: 1463580 - protein, 20 aa, Mycobacterium tuberculosis
SLTAPAPFVYGLGAVGPALT

SEQ ID NO: 1463581 - protein, 17 aa, Mycobacterium tuberculosis
SMDSAWRGGLPPESGFT

SEQ ID NO: 1463582 - protein, 22 aa, Mycobacterium tuberculosis
SMPAMIRAGGKMYGADGKLKDT

SEQ ID NO: 1463583 - protein, 18 aa, Mycobacterium tuberculosis
SNIRWGFDPTHRRRYGLD

SEQ ID NO: 1463584 - protein, 19 aa, Mycobacterium tuberculosis
SPAALRLLATDAIVVLVSA

SEQ ID NO: 1463585 - protein, 21 aa, Mycobacterium tuberculosis
SPARGSRHLGFAKALVYEMPH

SEQ ID NO: 1463586 - protein, 25 aa, Mycobacterium tuberculosis
SPGSTMTLPLISMRFEGEDWILGST

SEQ ID NO: 1463587 - protein, 28 aa, Mycobacterium tuberculosis
SPLLRRPDLLVSLLTYWQRHPSLSYLFA

SEQ ID NO: 1463588 - protein, 17 aa, Mycobacterium tuberculosis
SQVRPAYEDPLSRLAAA

SEQ ID NO: 1463589 - protein, 23 aa, Mycobacterium tuberculosis
SRGKWDTLRAMGFDDDHIGDSRT

SEQ ID NO: 1463590 - protein, 19 aa, Mycobacterium tuberculosis
SRRLLQMVGRDLGLDIKRY

SEQ ID NO: 1463591 - protein, 24 aa, Mycobacterium tuberculosis
SRRRAEELLARVNLAERMNHRPGD

SEQ ID NO: 1463592 - protein, 17 aa, Mycobacterium tuberculosis
SSALARAEVMRALLDKG

SEQ ID NO: 1463593 - protein, 18 aa, Mycobacterium tuberculosis
SSIMPGKVNPVLPEAVTQ

SEQ ID NO: 1463594 - protein, 17 aa, Mycobacterium tuberculosis
SSLTAMVAAMERIIDTG

SEQ ID NO: 1463595 - protein, 19 aa, Mycobacterium tuberculosis
SSLVALHMAVGSLRSGECD

SEQ ID NO: 1463596 - protein, 17 aa, Mycobacterium tuberculosis
STPLQLLAQRIEFDDPL

SEQ ID NO: 1463597 - protein, 25 aa, Mycobacterium tuberculosis
SVAEALRAGGFKHRAKVEICWVASD

SEQ ID NO: 1463598 - protein, 24 aa, Mycobacterium tuberculosis
SVDERLHHLFARMPDARVHLYGKA

SEQ ID NO: 1463599 - protein, 20 aa, Mycobacterium tuberculosis
SVFELQARAILGLAVDTLMI

SEQ ID NO: 1463600 - protein, 18 aa, Mycobacterium tuberculosis
SVFRADFLSELDAPAQAG

SEQ ID NO: 1463601 - protein, 19 aa, Mycobacterium tuberculosis
SVGLLSVGAYRPERVVTND

SEQ ID NO: 1463602 - protein, 22 aa, Mycobacterium tuberculosis
SVHVRGSVVLDRLSRKSQSAGS

SEQ ID NO: 1463603 - protein, 24 aa, Mycobacterium tuberculosis
SVSDALDILRWAPQAASGPVAKVI

SEQ ID NO: 1463604 - protein, 25 aa, Mycobacterium tuberculosis
SVSSSLVRRAGCPVAVIHSDDAVIP

SEQ ID NO: 1463605 - protein, 17 aa, Mycobacterium tuberculosis
SVTSGLVGGAWQGASSS

SEQ ID NO: 1463606 - protein, 23 aa, Mycobacterium tuberculosis
SVYWRLMALDQRFGIADRFENSR

SEQ ID NO: 1463607 - protein, 21 aa, Mycobacterium tuberculosis
SWLRRWVRDGYAWVQPRLSPV

SEQ ID NO: 1463608 - protein, 22 aa, Mycobacterium tuberculosis
SWQAREWLPFVGIERADTDRPH

SEQ ID NO: 1463609 - protein, 22 aa, Mycobacterium tuberculosis
TAALARRNSDVFQRMQEALNIS

SEQ ID NO: 1463610 - protein, 23 aa, Mycobacterium tuberculosis
TAAQAAAMIAEFEAVKTAVVQPM

SEQ ID NO: 1463611 - protein, 19 aa, Mycobacterium tuberculosis
TADSLSFVLDDAVLTADTV

SEQ ID NO: 1463612 - protein, 17 aa, Mycobacterium tuberculosis
TAGHATAIMWAREQFGL

SEQ ID NO: 1463613 - protein, 21 aa, Mycobacterium tuberculosis
TEARLTPLAMEMLREIDEETV

SEQ ID NO: 1463614 - protein, 22 aa, Mycobacterium tuberculosis
TEFLPGSLIDRAEFEAENRRVV

SEQ ID NO: 1463615 - protein, 25 aa, Mycobacterium tuberculosis
TEIDNLRAAFAWSRENGHITEALQL

SEQ ID NO: 1463616 - protein, 17 aa, Mycobacterium tuberculosis
TEMGPLVSRAHRDKVAG

SEQ ID NO: 1463617 - protein, 22 aa, Mycobacterium tuberculosis
TEPDAFKWIQRAAMDRRTTMKR

SEQ ID NO: 1463618 - protein, 25 aa, Mycobacterium tuberculosis
TEPVAVVGIGCRFPGGVDGPDGLWD

SEQ ID NO: 1463619 - protein, 24 aa, Mycobacterium tuberculosis
TEVRLRLLDTLDLFGIALGMAAFR

SEQ ID NO: 1463620 - protein, 20 aa, Mycobacterium tuberculosis
TFAGGLWLRTVDEVGECYPD

SEQ ID NO: 1463621 - protein, 17 aa, Mycobacterium tuberculosis
TFDTRLMRLEDEMKEGR

SEQ ID NO: 1463622 - protein, 21 aa, Mycobacterium tuberculosis
TFGMDSWFPSLKIYNRNGQLY

SEQ ID NO: 1463623 - protein, 18 aa, Mycobacterium tuberculosis
TFGYKFRPWRDVKVLADG

SEQ ID NO: 1463624 - protein, 18 aa, Mycobacterium tuberculosis
TFLAMSICDPHGGMHSLW

SEQ ID NO: 1463625 - protein, 30 aa, Mycobacterium tuberculosis
TGRTHLQFRRFAACPICHLHLRSFANRHQE

SEQ ID NO: 1463626 - protein, 25 aa, Mycobacterium tuberculosis
TILLECTMAGMATCTLTHLIESSDS

SEQ ID NO: 1463627 - protein, 18 aa, Mycobacterium tuberculosis
TITGCCLITARALVARTR

SEQ ID NO: 1463628 - protein, 29 aa, Mycobacterium tuberculosis
TKLPWSDWLPRQRWYAGRNRELATVKPGV

SEQ ID NO: 1463629 - protein, 17 aa, Mycobacterium tuberculosis
TLAELRVGVLAAATTDI

SEQ ID NO: 1463630 - protein, 17 aa, Mycobacterium tuberculosis
TLAVNGFQIPAITLRAL

SEQ ID NO: 1463631 - protein, 24 aa, Mycobacterium tuberculosis
TLGLVEVLCIRRRIRTGDQPLALV

SEQ ID NO: 1463632 - protein, 20 aa, Mycobacterium tuberculosis
TNALGGPGIELFRRLVEEYE

SEQ ID NO: 1463633 - protein, 23 aa, Mycobacterium tuberculosis
TNEGLRSRFTRNIDFPSYTSHEL

SEQ ID NO: 1463634 - protein, 28 aa, Mycobacterium tuberculosis
TPDRVDVVLRSKVDAAWHLHELTRDLDV

SEQ ID NO: 1463635 - protein, 23 aa, Mycobacterium tuberculosis
TPGCGHWPGAVIRLEAPVIPHMG

SEQ ID NO: 1463636 - protein, 18 aa, Mycobacterium tuberculosis
TPPIYFGFGSTPVQTPVQ

SEQ ID NO: 1463637 - protein, 18 aa, Mycobacterium tuberculosis
TPSRGVWQFIAPTFAAYH

SEQ ID NO: 1463638 - protein, 18 aa, Mycobacterium tuberculosis
TRKSRRLRTDLVGGDQAF

SEQ ID NO: 1463639 - protein, 25 aa, Mycobacterium tuberculosis
TRRGRPTVWSVWGVGGAILLGDALH

SEQ ID NO: 1463640 - protein, 22 aa, Mycobacterium tuberculosis
TRSGGHCWFLGGVADSVEELVD

SEQ ID NO: 1463641 - protein, 17 aa, Mycobacterium tuberculosis
TSGEMYLGPGAGPMLAA

SEQ ID NO: 1463642 - protein, 19 aa, Mycobacterium tuberculosis
TSGSRGFHVYARIAPCWSF

SEQ ID NO: 1463643 - protein, 19 aa, Mycobacterium tuberculosis
TSIAARFTKPVFPGETLST

SEQ ID NO: 1463644 - protein, 22 aa, Mycobacterium tuberculosis
TSILQRRVVFRANRAEVQAIAT

SEQ ID NO: 1463645 - protein, 19 aa, Mycobacterium tuberculosis
TSIRTRLTAIESVLGNAIR

SEQ ID NO: 1463646 - protein, 34 aa, Mycobacterium tuberculosis; identical to SEQ ID NO: 207339

SEQ ID NO: 1463647 - protein, 19 aa, Mycobacterium tuberculosis
TSWDLRKFLWAPRLGCYGI

SEQ ID NO: 1463648 - protein, 18 aa, Mycobacterium tuberculosis
TTDGLRIDTGMYLTGMEQ

SEQ ID NO: 1463649 - protein, 26 aa, Mycobacterium tuberculosis
TTSPLRPWPGFVPMVYERYSQPFFGG

SEQ ID NO: 1463650 - protein, 17 aa, Mycobacterium tuberculosis
TVDGDLVGAGWVSGGSD

SEQ ID NO: 1463651 - protein, 26 aa, Mycobacterium tuberculosis
TVKTFKRAGGQVWLMPHNPAFDPIPG

SEQ ID NO: 1463652 - protein, 22 aa, Mycobacterium tuberculosis
TYLYRDGSDFVFMDSQDYEQHP

SEQ ID NO: 1463653 - protein, 25 aa, Mycobacterium tuberculosis
TYVDFDPIYCWPKPVTKPYPPLYVG

SEQ ID NO: 1463654 - protein, 17 aa, Mycobacterium tuberculosis
VAACRPAGVPVIADGGL

SEQ ID NO: 1463655 - protein, 23 aa, Mycobacterium tuberculosis
VAAKLLRRKRFDIVGPPHHVEVE

SEQ ID NO: 1463656 - protein, 17 aa, Mycobacterium tuberculosis
VAARRGPAHSAFTLPEL

SEQ ID NO: 1463657 - protein, 21 aa, Mycobacterium tuberculosis
VAELFPKVVEAYRELVDDGPG

SEQ ID NO: 1463658 - protein, 21 aa, Mycobacterium tuberculosis
VAGCSFPIERLRQVAEHADAT

SEQ ID NO: 1463659 - protein, 20 aa, Mycobacterium tuberculosis
VAGPQFLLSLIVSSAVCGTS

SEQ ID NO: 1463660 - protein, 17 aa, Mycobacterium tuberculosis
VANLLAFQPEERIAQVI

SEQ ID NO: 1463661 - protein, 26 aa, Mycobacterium tuberculosis
VAPECPDWLPPGAKDMWGRVVPELAA

SEQ ID NO: 1463662 - protein, 18 aa, Mycobacterium tuberculosis
VARIKFPTPAACGRTPLV

SEQ ID NO: 1463663 - protein, 27 aa, Mycobacterium tuberculosis
VAVDLRDEWQIALCNNGFDANRPSAWI

SEQ ID NO: 1463664 - protein, 17 aa, Mycobacterium tuberculosis
VAVLAPRSPADCFETAL

SEQ ID NO: 1463665 - protein, 18 aa, Mycobacterium tuberculosis
VCYYPCLDTTRGRSFGAY

SEQ ID NO: 1463666 - protein, 17 aa, Mycobacterium tuberculosis
VDEGAVCTAMLDLYQNE

SEQ ID NO: 1463667 - protein, 18 aa, Mycobacterium tuberculosis
VDLYSCFPSAVQVAAIEL

SEQ ID NO: 1463668 - protein, 18 aa, Mycobacterium tuberculosis
VELFTAEAIWEMPPYTGW

SEQ ID NO: 1463669 - protein, 17 aa, Mycobacterium tuberculosis
VELMARIAQRRVRVAEA

SEQ ID NO: 1463670 - protein, 20 aa, Mycobacterium tuberculosis
VERPEPKRAGVLVVSSDRGL

SEQ ID NO: 1463671 - protein, 25 aa, Mycobacterium tuberculosis
VERRYRAWIRWNAAIMVHRAQRPGV

SEQ ID NO: 1463672 - protein, 19 aa, Mycobacterium tuberculosis
VFDREWPLRVGDIDRAGRL

SEQ ID NO: 1463673 - protein, 17 aa, Mycobacterium tuberculosis
VGALLALAALIHRDRTG

SEQ ID NO: 1463674 - protein, 18 aa, Mycobacterium tuberculosis
VGAVALVAGWAARNLPAD

SEQ ID NO: 1463675 - protein, 19 aa, Mycobacterium tuberculosis
VGDLGVTLLRTIKATLDPA

SEQ ID NO: 1463676 - protein, 23 aa, Mycobacterium tuberculosis
VGRRRWNRRGAMVTDRYQRLCHH

SEQ ID NO: 1463677 - protein, 17 aa, Mycobacterium tuberculosis
VHSALLSAGPGPASLQA

SEQ ID NO: 1463678 - protein, 24 aa, Mycobacterium tuberculosis
VIISDFLGPINWMRPLRAIAARHE

SEQ ID NO: 1463679 - protein, 21 aa, Mycobacterium tuberculosis
VIKMVLAMRHELLPATLHVDV

SEQ ID NO: 1463680 - protein, 17 aa, Mycobacterium tuberculosis
VIRRLQPDFLVTVTAAV

SEQ ID NO: 1463681 - protein, 20 aa, Mycobacterium tuberculosis
VIRRSRRGGRGWVVPAGGAV

SEQ ID NO: 1463682 - protein, 25 aa, Mycobacterium tuberculosis
VKEAVLPFHRFRRADGAAIDSLLGP

SEQ ID NO: 1463683 - protein, 26 aa, Mycobacterium tuberculosis
VLAISINGPRAWDLDLAIDFTFTEPD

SEQ ID NO: 1463684 - protein, 17 aa, Mycobacterium tuberculosis
VLEQLAFDERRLRQVLS

SEQ ID NO: 1463685 - protein, 18 aa, Mycobacterium tuberculosis
VLGVCVGMQILFACGVEF

SEQ ID NO: 1463686 - protein, 25 aa, Mycobacterium tuberculosis
VLIETARLWLSLGHHDRHGVWHLDG

SEQ ID NO: 1463687 - protein, 18 aa, Mycobacterium tuberculosis
VLLDPGLRESVRHGVTTV

SEQ ID NO: 1463688 - protein, 28 aa, Mycobacterium tuberculosis
VLLDRERCILCARCTRFSDQIAGDPFID

SEQ ID NO: 1463689 - protein, 17 aa, Mycobacterium tuberculosis
VLLPGLPYLGLEHRAAW

SEQ ID NO: 1463690 - protein, 20 aa, Mycobacterium tuberculosis
VLRDIEWRIGPGERIGIVGA

SEQ ID NO: 1463691 - protein, 17 aa, Mycobacterium tuberculosis
VLRRLEGHFTLVFANAD

SEQ ID NO: 1463692 - protein, 25 aa, Mycobacterium tuberculosis
VLSEFPADRGWDLAGLYNPDPDAAG

SEQ ID NO: 1463693 - protein, 17 aa, Mycobacterium tuberculosis
VNLWAPLMWTSLVVTAW

SEQ ID NO: 1463694 - protein, 35 aa, Mycobacterium tuberculosis; identical to SEQ ID NO: 208001

SEQ ID NO: 1463695 - protein, 23 aa, Mycobacterium tuberculosis
VPDYLMQVLARFARYLRESRSID

SEQ ID NO: 1463696 - protein, 17 aa, Mycobacterium tuberculosis
VPFRLSIDDGIEAVRQR

SEQ ID NO: 1463697 - protein, 23 aa, Mycobacterium tuberculosis
VPGAYVAGWIKRGPTGFIGTNKS

SEQ ID NO: 1463698 - protein, 18 aa, Mycobacterium tuberculosis
VPIAGFGGAPGFGNSTTL

SEQ ID NO: 1463699 - protein, 23 aa, Mycobacterium tuberculosis
VPLPTEKNVYCVIRSPHKYKDSR

SEQ ID NO: 1463700 - protein, 17 aa, Mycobacterium tuberculosis
VPRLGVLTVTIIQQTPD

SEQ ID NO: 1463701 - protein, 25 aa, Mycobacterium tuberculosis
VPVNPSGGLACFGEAIPAQAIAQVC

SEQ ID NO: 1463702 - protein, 25 aa, Mycobacterium tuberculosis
VPWEPICAPDLLLAQALLRTQQIKL

SEQ ID NO: 1463703 - protein, 18 aa, Mycobacterium tuberculosis
VQDHVASVFRHEDLASAL

SEQ ID NO: 1463704 - protein, 19 aa, Mycobacterium tuberculosis
VQDLGIEVFLVMPFTTDFM

SEQ ID NO: 1463705 - protein, 19 aa, Mycobacterium tuberculosis
VQGSGWAALGWDTLGNKLL

SEQ ID NO: 1463706 - protein, 24 aa, Mycobacterium tuberculosis
VQTGMGRTGAFFAHQHDGITPDVV

SEQ ID NO: 1463707 - protein, 21 aa, Mycobacterium tuberculosis
VQYLRVRFVYQSGREDAVKTF

SEQ ID NO: 1463708 - protein, 19 aa, Mycobacterium tuberculosis
VRGEGAAVVVLKRLDDAVR

SEQ ID NO: 1463709 - protein, 19 aa, Mycobacterium tuberculosis
VRQVCARALSLPSLPCEVA

SEQ ID NO: 1463710 - protein, 40 aa, Mycobacterium tuberculosis; identical to SEQ ID NO: 210324

SEQ ID NO: 1463711 - protein, 18 aa, Mycobacterium tuberculosis
VRVAEGMVLGQWSAVVGH

SEQ ID NO: 1463712 - protein, 17 aa, Mycobacterium tuberculosis
VRVCTICTDPWNLDHET

SEQ ID NO: 1463713 - protein, 17 aa, Mycobacterium tuberculosis
VRYGELISHERILDLRA

SEQ ID NO: 1463714 - protein, 29 aa, Mycobacterium tuberculosis
VSALKALEGDAKWVASVEELMNAVDESIP

SEQ ID NO: 1463715 - protein, 20 aa, Mycobacterium tuberculosis
VSKPRIPLVSNVTGQMAGAG

SEQ ID NO: 1463716 - protein, 17 aa, Mycobacterium tuberculosis
VSRSGWYGIDPVPADLF

SEQ ID NO: 1463717 - protein, 17 aa, Mycobacterium tuberculosis
VTGVPLWTTRAKRWLRR

SEQ ID NO: 1463718 - protein, 19 aa, Mycobacterium tuberculosis
VTNVLLLRGMIGKPGAGVC

SEQ ID NO: 1463719 - protein, 18 aa, Mycobacterium tuberculosis
VVKHPSAWRGWLTTMRSR

SEQ ID NO: 1463720 - protein, 20 aa, Mycobacterium tuberculosis
VVLFCGVVGPGPAHIRTVRL

SEQ ID NO: 1463721 - protein, 23 aa, Mycobacterium tuberculosis
VVPGIYQVRGFDISNISFVEGDT

SEQ ID NO: 1463722 - protein, 23 aa, Mycobacterium tuberculosis
VVQRLELVRRIGLVIDYDVVELG

SEQ ID NO: 1463723 - protein, 25 aa, Mycobacterium tuberculosis
VVSELFLRAAQAYGVKRGQRMLGLS

SEQ ID NO: 1463724 - protein, 17 aa, Mycobacterium tuberculosis
VVSRKCSVPYLYRFELM

SEQ ID NO: 1463725 - protein, 25 aa, Mycobacterium tuberculosis
VVVGLPMRCVFALTAMGFLPQSAET

SEQ ID NO: 1463726 - protein, 20 aa, Mycobacterium tuberculosis
VVVLPDFGERYLSTPLFADV

SEQ ID NO: 1463727 - protein, 18 aa, Mycobacterium tuberculosis
VWFQRGPLDAAIRASIAI

SEQ ID NO: 1463728 - protein, 20 aa, Mycobacterium tuberculosis
VWRDVLLRLANDFRCVAIDA

SEQ ID NO: 1463729 - protein, 24 aa, Mycobacterium tuberculosis
VYSRGDVGTGWVLHAEGALRAGSA

SEQ ID NO: 1463730 - protein, 21 aa, Mycobacterium tuberculosis
WADLRRRVAALAGALSGRGVG

SEQ ID NO: 1463731 - protein, 20 aa, Mycobacterium tuberculosis
WDDPESWTLATYQRHDRYRG

SEQ ID NO: 1463732 - protein, 21 aa, Mycobacterium tuberculosis
WDLLQRSRISAVSVDASTLQA

SEQ ID NO: 1463733 - protein, 17 aa, Mycobacterium tuberculosis
WDYAVAVGSELKAADSL

SEQ ID NO: 1463734 - protein, 18 aa, Mycobacterium tuberculosis
WEALGRWDKPFLAIFGYR

SEQ ID NO: 1463735 - protein, 20 aa, Mycobacterium tuberculosis
WEKMPEQFLAALDREFGITS

SEQ ID NO: 1463736 - protein, 41 aa, Mycobacterium tuberculosis
WIHPDHRKKGYGTAALRKSRSEMAWAFPAVPMVARAPAAQP

SEQ ID NO: 1463737 - protein, 26 aa, Mycobacterium tuberculosis
WKPSELTPLTALACQALLSRAAADVG

SEQ ID NO: 1463738 - protein, 18 aa, Mycobacterium tuberculosis
WLPPAKRLPDGLASYVSV

SEQ ID NO: 1463739 - protein, 17 aa, Mycobacterium tuberculosis
WNAAIMVHRAQRPGVGV

SEQ ID NO: 1463740 - protein, 23 aa, Mycobacterium tuberculosis
WNEGVKGAWVLARYDDGRPSQVR

SEQ ID NO: 1463741 - protein, 17 aa, Mycobacterium tuberculosis
WNWAAHVAGQRTPRKNE

SEQ ID NO: 1463742 - protein, 20 aa, Mycobacterium tuberculosis
WPMAGTPAWCDLDDTDPVKW

SEQ ID NO: 1463743 - protein, 17 aa, Mycobacterium tuberculosis
WQRLRTDVGAVFDTEVY

SEQ ID NO: 1463744 - protein, 19 aa, Mycobacterium tuberculosis
WRRRKPYSWLRQVLPDPQY

SEQ ID NO: 1463745 - protein, 20 aa, Mycobacterium tuberculosis
WSANPFPFLRQIIANQQVYW

SEQ ID NO: 1463746 - protein, 26 aa, Mycobacterium tuberculosis
WSEACDRGGPGLLLRAKHAVFDRLVY

SEQ ID NO: 1463747 - protein, 25 aa, Mycobacterium tuberculosis
WSFAQAAAVPVVFLTAWYGLADLAE

SEQ ID NO: 1463748 - protein, 19 aa, Mycobacterium tuberculosis
WSYAEAAAISAVFTTAYYA

SEQ ID NO: 1463749 - protein, 23 aa, Mycobacterium tuberculosis
WVGGSPPAALSWVEPILQATTTL

SEQ ID NO: 1463750 - protein, 21 aa, Mycobacterium tuberculosis
YAHAAIKRFLTVSTPGSHLIL

SEQ ID NO: 1463751 - protein, 29 aa, Mycobacterium tuberculosis
YAKALRRYRFRAGIAKVDFVLSDEIPWSD

SEQ ID NO: 1463752 - protein, 18 aa, Mycobacterium tuberculosis
YAPLPWLPDNIYREVVSR

SEQ ID NO: 1463753 - protein, 17 aa, Mycobacterium tuberculosis
YATGAARDIVKRARALG

SEQ ID NO: 1463754 - protein, 17 aa, Mycobacterium tuberculosis
YEEIDWDTAIVEIAEGF

SEQ ID NO: 1463755 - protein, 23 aa, Mycobacterium tuberculosis
YEVTALNFMPGWLDMLLEVGGGR

SEQ ID NO: 1463756 - protein, 18 aa, Mycobacterium tuberculosis
YFLDMGWEDIMLAVEYDG

SEQ ID NO: 1463757 - protein, 23 aa, Mycobacterium tuberculosis
YGACPECSGLGIRKEVDPELVVP

SEQ ID NO: 1463758 - protein, 23 aa, Mycobacterium tuberculosis
YGAECATWRNFFLTGAAELRDGN

SEQ ID NO: 1463759 - protein, 18 aa, Mycobacterium tuberculosis
YGVHPVLLDACFQSVAAH

SEQ ID NO: 1463760 - protein, 17 aa, Mycobacterium tuberculosis
YGVKIPDEDLAGLRTVG

SEQ ID NO: 1463761 - protein, 18 aa, Mycobacterium tuberculosis
YHALRASNRIAIERGTHF

SEQ ID NO: 1463762 - protein, 18 aa, Mycobacterium tuberculosis
YHQSLPLAEMLYARGSGL

SEQ ID NO: 1463763 - protein, 18 aa, Mycobacterium tuberculosis
YIAALLWFGEFSGCGIKA

SEQ ID NO: 1463764 - protein, 20 aa, Mycobacterium tuberculosis
YLGEKICAAVVFAGAPITLA

SEQ ID NO: 1463765 - protein, 21 aa, Mycobacterium tuberculosis
YPDAPKLPAVVGYEVAGTVEA

SEQ ID NO: 1463766 - protein, 24 aa, Mycobacterium tuberculosis
YRALKEASYRLGARTLYHQFGAPL

SEQ ID NO: 1463767 - protein, 21 aa, Mycobacterium tuberculosis
YRGRDRLLVLGLARGGVPVGW

SEQ ID NO: 1463768 - protein, 18 aa, Mycobacterium tuberculosis
YRVFTELTPHPLLTHAVD

SEQ ID NO: 1463769 - protein, 19 aa, Mycobacterium tuberculosis
YTQSRWWSERGWQHRQRAG

SEQ ID NO: 1463770 - protein, 22 aa, Mycobacterium tuberculosis
YVHSAPWALPALGLENVSHGCI

SEQ ID NO: 1463771 - protein, 18 aa, Mycobacterium tuberculosis
AAAEAMYEQMWAADVAAM

SEQ ID NO: 1463772 - protein, 21 aa, Mycobacterium tuberculosis
AAGLTRSFMAFLIDAYTEDEA

SEQ ID NO: 1463773 - protein, 17 aa, Mycobacterium tuberculosis
AAGPAGQILAVLEATVD

SEQ ID NO: 1463774 - protein, 19 aa, Mycobacterium tuberculosis
AAHPGRPDVLTAWMDAAVI

SEQ ID NO: 1463775 - protein, 17 aa, Mycobacterium tuberculosis
AAIAVSRRVRTRWINFA

SEQ ID NO: 1463776 - protein, 23 aa, Mycobacterium tuberculosis
AAIEIKSAATLRGRDTRSISRLR

SEQ ID NO: 1463777 - protein, 18 aa, Mycobacterium tuberculosis
AALDYSALYPAGRLVDAP

SEQ ID NO: 1463778 - protein, 24 aa, Mycobacterium tuberculosis
AALQRSDLLIALGTRFDDRVTGKL

SEQ ID NO: 1463779 - protein, 24 aa, Mycobacterium tuberculosis
AANSWLDTFTHWRRAQDLPATSIA

SEQ ID NO: 1463780 - protein, 22 aa, Mycobacterium tuberculosis
AASLKGLVRVLAFEHPDMRTTL

SEQ ID NO: 1463781 - protein, 26 aa, Mycobacterium tuberculosis
AAVGSDFIICYRLSMADYVAEGQSWD

SEQ ID NO: 1463782 - protein, 18 aa, Mycobacterium tuberculosis
AAVSFGFGPLLLAGSDPL

SEQ ID NO: 1463783 - protein, 18 aa, Mycobacterium tuberculosis
ACDLQRPAAVNQLQVVGE

SEQ ID NO: 1463784 - protein, 21 aa, Mycobacterium tuberculosis
ACSSGLTAVHMACRSLHEGES

SEQ ID NO: 1463785 - protein, 22 aa, Mycobacterium tuberculosis
ADHHPRELLVVGIATFDQKRPA

SEQ ID NO: 1463786 - protein, 19 aa, Mycobacterium tuberculosis
ADLYWAARGAGPGFFGVVT

SEQ ID NO: 1463787 - protein, 23 aa, Mycobacterium tuberculosis
ADMLGRAGGLLVDVAIDTVPRGY

SEQ ID NO: 1463788 - protein, 18 aa, Mycobacterium tuberculosis
ADPVSLQTAAGFSAQGVE

SEQ ID NO: 1463789 - protein, 17 aa, Mycobacterium tuberculosis
ADQGKRNVTHGCINLSP

SEQ ID NO: 1463790 - protein, 24 aa, Mycobacterium tuberculosis
ADRGRTGVFSLDARQWFQSFPAVA

SEQ ID NO: 1463791 - protein, 19 aa, Mycobacterium tuberculosis
ADRLYERLLGWLADIQQPR

SEQ ID NO: 1463792 - protein, 18 aa, Mycobacterium tuberculosis
AEAQRIVVLSGDQLDALC

SEQ ID NO: 1463793 - protein, 20 aa, Mycobacterium tuberculosis
AEIEPALVIMLGEYPGRSMI

SEQ ID NO: 1463794 - protein, 25 aa, Mycobacterium tuberculosis
AELAELRLALMHGRLSADDKDAAMA

SEQ ID NO: 1463795 - protein, 17 aa, Mycobacterium tuberculosis
AELLRRAKHSGLSDHQI

SEQ ID NO: 1463796 - protein, 18 aa, Mycobacterium tuberculosis
AERIRRVAERIVATKKQG

SEQ ID NO: 1463797 - protein, 22 aa, Mycobacterium tuberculosis
AERLDDRFQFGVLLTAAPEATP

SEQ ID NO: 1463798 - protein, 19 aa, Mycobacterium tuberculosis
AEVPADRIVNTWPADTLLA

SEQ ID NO: 1463799 - protein, 18 aa, Mycobacterium tuberculosis
AFAAVALASIRELGLNPQ

SEQ ID NO: 1463800 - protein, 23 aa, Mycobacterium tuberculosis
AFTAFPKAHWQKIWSTNPLERIN

SEQ ID NO: 1463801 - protein, 19 aa, Mycobacterium tuberculosis
AFTGRPGMFVRASGMALPF

SEQ ID NO: 1463802 - protein, 17 aa, Mycobacterium tuberculosis
AGARWASRVTGRGAGAM

SEQ ID NO: 1463803 - protein, 21 aa, Mycobacterium tuberculosis
AGLAVRPGYVLSDGFRVPGLP

SEQ ID NO: 1463804 - protein, 22 aa, Mycobacterium tuberculosis
AGLRICARIAQARPLRDLLGSI

SEQ ID NO: 1463805 - protein, 24 aa, Mycobacterium tuberculosis
AGPAYNTGSAWGYTPKGATGVPTR

SEQ ID NO: 1463806 - protein, 25 aa, Mycobacterium tuberculosis
AGRTERFWVGLSVYRPGGTAEPAPT

SEQ ID NO: 1463807 - protein, 23 aa, Mycobacterium tuberculosis
AGTEPRKIFDLLEHAPVDVAVLT

SEQ ID NO: 1463808 - protein, 24 aa, Mycobacterium tuberculosis
AGTVARAFLRQALGVEVLSHVISI

SEQ ID NO: 1463809 - protein, 18 aa, Mycobacterium tuberculosis
AGVKITWTPIEPTLPSID

SEQ ID NO: 1463810 - protein, 25 aa, Mycobacterium tuberculosis
AGYAYFAGRLGDWMRVDGENLGTAP

SEQ ID NO: 1463811 - protein, 23 aa, Mycobacterium tuberculosis
AHAIPGLRQALGLAEDGTDERAT

SEQ ID NO: 1463812 - protein, 24 aa, Mycobacterium tuberculosis
AHDEGWLAEHMLILKLISPENKAY

SEQ ID NO: 1463813 - protein, 21 aa, Mycobacterium tuberculosis
AHMGRRYGRRLTVMADRPNVG

SEQ ID NO: 1463814 - protein, 21 aa, Mycobacterium tuberculosis
AKALRSGGVVVVFPGGDYDAY

SEQ ID NO: 1463815 - protein, 18 aa, Mycobacterium tuberculosis
AKGGAAVFQMMGLCQILR

SEQ ID NO: 1463816 - protein, 21 aa, Mycobacterium tuberculosis
AKPGDLALLIGYGAGLSYAAQ

SEQ ID NO: 1463817 - protein, 18 aa, Mycobacterium tuberculosis
ALAKLRLPSPSGRAGIAV

SEQ ID NO: 1463818 - protein, 27 aa, Mycobacterium tuberculosis
ALALTRFHIFSHSWGGMLAQQYVLDKA

SEQ ID NO: 1463819 - protein, 21 aa, Mycobacterium tuberculosis
ALARRVSPTPVRLADERLTTV

SEQ ID NO: 1463820 - protein, 17 aa, Mycobacterium tuberculosis
ALERLRSQQSFEEVSAR

SEQ ID NO: 1463821 - protein, 35 aa, Mycobacterium tuberculosis
ALHAWSDMGPLDFPRLNWAPIEWRNLEDEQEKMLA

SEQ ID NO: 1463822 - protein, 17 aa, Mycobacterium tuberculosis
ALIGYAQKRRDIVAITA

SEQ ID NO: 1463823 - protein, 18 aa, Mycobacterium tuberculosis
ALLALADAGVRGRVLHAA

SEQ ID NO: 1463824 - protein, 24 aa, Mycobacterium tuberculosis
ALLREFDAKLGRGPAVAVDDELMA

SEQ ID NO: 1463825 - protein, 17 aa, Mycobacterium tuberculosis
ALTPIPFAATVFAIEAI

SEQ ID NO: 1463826 - protein, 28 aa, Mycobacterium tuberculosis
ALYMDRYPLVSAISRPLIVKHLVAAARE

SEQ ID NO: 1463827 - protein, 24 aa, Mycobacterium tuberculosis
ANAQRGLSEAVVRDISAKKNEPDW

SEQ ID NO: 1463828 - protein, 17 aa, Mycobacterium tuberculosis
ANGISAFMVHKDDEGFT

SEQ ID NO: 1463829 - protein, 19 aa, Mycobacterium tuberculosis
ANLLGSVALVGGARLWTRD

SEQ ID NO: 1463830 - protein, 18 aa, Mycobacterium tuberculosis
APGTNWKSNPNAMRTIAA

SEQ ID NO: 1463831 - protein, 18 aa, Mycobacterium tuberculosis
APLRPEERQTTVVDHAEA

SEQ ID NO: 1463832 - protein, 18 aa, Mycobacterium tuberculosis
AQGYSRVRVDGVVHPLTD

SEQ ID NO: 1463833 - protein, 17 aa, Mycobacterium tuberculosis
AQLEPGLFRAIKAEVDR

SEQ ID NO: 1463834 - protein, 23 aa, Mycobacterium tuberculosis
AQLRKAGLVISDRRGMHVFHRVH

SEQ ID NO: 1463835 - protein, 21 aa, Mycobacterium tuberculosis
AQNVRLPWRVDKTDYVLHLID

SEQ ID NO: 1463836 - protein, 26 aa, Mycobacterium tuberculosis
AQQYDAVWRWIDWPERRGRTDTGIDL

SEQ ID NO: 1463837 - protein, 19 aa, Mycobacterium tuberculosis
AQRRTVEGLNRVEAAHDNL

SEQ ID NO: 1463838 - protein, 21 aa, Mycobacterium tuberculosis
ARAAPLVAILWGRDASTLKPM

SEQ ID NO: 1463839 - protein, 17 aa, Mycobacterium tuberculosis
ARAGEMLDLVASYAANP

SEQ ID NO: 1463840 - protein, 17 aa, Mycobacterium tuberculosis
ARALGVTLFDTAEIYGL

SEQ ID NO: 1463841 - protein, 25 aa, Mycobacterium tuberculosis
ARDFAAEAAFVFAMIAVDLSRLAED

SEQ ID NO: 1463842 - protein, 18 aa, Mycobacterium tuberculosis
AREREANLIPGGKSLSGG

SEQ ID NO: 1463843 - protein, 17 aa, Mycobacterium tuberculosis
ARFLVYPAMKALTLDIA

SEQ ID NO: 1463844 - protein, 20 aa, Mycobacterium tuberculosis
ARMLMDAAIFKDTLIMSYEW

SEQ ID NO: 1463845 - protein, 18 aa, Mycobacterium tuberculosis
ARPRYIRIAADLPSTATH

SEQ ID NO: 1463846 - protein, 17 aa, Mycobacterium tuberculosis
ARQPISVIPTGSIALDV

SEQ ID NO: 1463847 - protein, 20 aa, Mycobacterium tuberculosis
ARQRHWVEPNHTVWAQAPGA

SEQ ID NO: 1463848 - protein, 25 aa, Mycobacterium tuberculosis
ARRTLVFPPGMYWRTPDMLSGAPAL

SEQ ID NO: 1463849 - protein, 20 aa, Mycobacterium tuberculosis
ARSADLCRRELLSRRDQLTA

SEQ ID NO: 1463850 - protein, 17 aa, Mycobacterium tuberculosis
ARSAEIERDRRLPDELV

SEQ ID NO: 1463851 - protein, 24 aa, Mycobacterium tuberculosis
ARVICRRSKLMTRIAGAGAMGSVE

SEQ ID NO: 1463852 - protein, 23 aa, Mycobacterium tuberculosis
ASASRWRIVSRYLPVGVAPEQGL

SEQ ID NO: 1463853 - protein, 19 aa, Mycobacterium tuberculosis
ASIARKLGALTVGVVTRPF

SEQ ID NO: 1463854 - protein, 35 aa, Mycobacterium tuberculosis
ASKADTPDGVWSRMKFEGGVHRVQRVPVTESQGRV

SEQ ID NO: 1463855 - protein, 25 aa, Mycobacterium tuberculosis
ASKGWNLPGLMCAQVILSNRRDAHD

SEQ ID NO: 1463856 - protein, 29 aa, Mycobacterium tuberculosis
ASTETRLPFCWRGVSLHAGGAGRVRARFA

SEQ ID NO: 1463857 - protein, 26 aa, Mycobacterium tuberculosis
ATDLAEWLVRQGVPFRSAHEAAGAAV

SEQ ID NO: 1463858 - protein, 19 aa, Mycobacterium tuberculosis
ATDVARPAETVRGWLRRFA

SEQ ID NO: 1463859 - protein, 21 aa, Mycobacterium tuberculosis
ATEDAWRRVFEFFGQHLRAGS

SEQ ID NO: 1463860 - protein, 25 aa, Mycobacterium tuberculosis
ATGQWARTAVGLARDVAEAFARDPE

SEQ ID NO: 1463861 - protein, 24 aa, Mycobacterium tuberculosis
ATGRRFEALSALSAGVKEVRAVIE

SEQ ID NO: 1463862 - protein, 20 aa, Mycobacterium tuberculosis
ATPLRTVVRANLKSIYQHAI

SEQ ID NO: 1463863 - protein, 23 aa, Mycobacterium tuberculosis
AVASRVGAPLGHDYAVISLSDRL

SEQ ID NO: 1463864 - protein, 18 aa, Mycobacterium tuberculosis
AVIEMIHLATLYHDDVMD

SEQ ID NO: 1463865 - protein, 39 aa, Mycobacterium tuberculosis
AVPDHSFFGLLWADVKFEWHALPYLLGFKKACAGFRSLG

SEQ ID NO: 1463866 - protein, 21 aa, Mycobacterium tuberculosis
AVQRLRKERSIGLSEAVNELI

SEQ ID NO: 1463867 - protein, 17 aa, Mycobacterium tuberculosis
AVRRAGAVVVDRHSDTD

SEQ ID NO: 1463868 - protein, 20 aa, Mycobacterium tuberculosis
AVSADWGLDEILLLSTGPAE

SEQ ID NO: 1463869 - protein, 21 aa, Mycobacterium tuberculosis
AVSQLFGRYGQEFQTVSNQLA

SEQ ID NO: 1463870 - protein, 19 aa, Mycobacterium tuberculosis
AVVAAMLGAYARDFQGISA

SEQ ID NO: 1463871 - protein, 17 aa, Mycobacterium tuberculosis
AWETLQRGWNVVGLAVR

SEQ ID NO: 1463872 - protein, 17 aa, Mycobacterium tuberculosis
AYCPSKAGTDLLAKTLA

SEQ ID NO: 1463873 - protein, 24 aa, Mycobacterium tuberculosis
AYKTGRGSIRMRGVVEVEEDSRGR

SEQ ID NO: 1463874 - protein, 23 aa, Mycobacterium tuberculosis
CDPELLTLWISRRVNTEALPGRR

SEQ ID NO: 1463875 - protein, 17 aa, Mycobacterium tuberculosis
CDPRFNKLLGPLPFPHH

SEQ ID NO: 1463876 - protein, 17 aa, Mycobacterium tuberculosis
CGQRLAFENSACLSCGS

SEQ ID NO: 1463877 - protein, 25 aa, Mycobacterium tuberculosis
CHGLQCGFCTPGMLITARALLDRNP

SEQ ID NO: 1463878 - protein, 21 aa, Mycobacterium tuberculosis
CIECPDGTVGEIWVHGDNVAN

SEQ ID NO: 1463879 - protein, 19 aa, Mycobacterium tuberculosis
CPDQFLGAHVRRVTGRKNL

SEQ ID NO: 1463880 - protein, 22 aa, Mycobacterium tuberculosis
CSHGSPFRSGPIRTLADLEDIA

SEQ ID NO: 1463881 - protein, 22 aa, Mycobacterium tuberculosis
CSSGLTAIHLACRSLHDGESDI

SEQ ID NO: 1463882 - protein, 22 aa, Mycobacterium tuberculosis
DAAQWLATHGWQVHSVSNREEM

SEQ ID NO: 1463883 - protein, 28 aa, Mycobacterium tuberculosis
DAMMTDGRWDPGKDFAMVTARETGPTQK

SEQ ID NO: 1463884 - protein, 20 aa, Mycobacterium tuberculosis
DAMTQGWFTGLIPITVPIAG

SEQ ID NO: 1463885 - protein, 21 aa, Mycobacterium tuberculosis
DARISVRSVLHRHYLDVLRPL

SEQ ID NO: 1463886 - protein, 24 aa, Mycobacterium tuberculosis
DAVSDFPADRGWDVDGLFDPDPDA

SEQ ID NO: 1463887 - protein, 20 aa, Mycobacterium tuberculosis
DAYYEHGVQVWDCAAGALIA

SEQ ID NO: 1463888 - protein, 17 aa, Mycobacterium tuberculosis
DCIQVHGGIGFTWEHDT

SEQ ID NO: 1463889 - protein, 21 aa, Mycobacterium tuberculosis
DDAPCCVQIVPVAPLAFSSQI

SEQ ID NO: 1463890 - protein, 18 aa, Mycobacterium tuberculosis
DDILLQGVSICFDQLHEI

SEQ ID NO: 1463891 - protein, 22 aa, Mycobacterium tuberculosis
DDLRAIATLTHRGVEGAIVGKA

SEQ ID NO: 1463892 - protein, 23 aa, Mycobacterium tuberculosis
DEAKTLCRACPRRWLCARDAVES

SEQ ID NO: 1463893 - protein, 21 aa, Mycobacterium tuberculosis
DEEERRMSVMNGREVARESRD

SEQ ID NO: 1463894 - protein, 23 aa, Mycobacterium tuberculosis
DEGFARPGARRSREDFEICATAQ

SEQ ID NO: 1463895 - protein, 24 aa, Mycobacterium tuberculosis
DEMKRQALAWAMSVAGKRANALLA

SEQ ID NO: 1463896 - protein, 24 aa, Mycobacterium tuberculosis
DEPEPHWGPFGGAAPVSAGVGHAA

SEQ ID NO: 1463897 - protein, 26 aa, Mycobacterium tuberculosis
DEQRRWAAEGVQRGWQATMVLTEPDA

SEQ ID NO: 1463898 - protein, 17 aa, Mycobacterium tuberculosis
DEYAEWAKTVSYRAILG

SEQ ID NO: 1463899 - protein, 17 aa, Mycobacterium tuberculosis
DFLAIVARRRRRHPNMH

SEQ ID NO: 1463900 - protein, 17 aa, Mycobacterium tuberculosis
DGAQGCNLVHVYPDTVV

SEQ ID NO: 1463901 - protein, 17 aa, Mycobacterium tuberculosis
DGAVWMRVHERGVGETR

SEQ ID NO: 1463902 - protein, 25 aa, Mycobacterium tuberculosis
DGEPFVLHPGEFVLGSTLELFTLPD

SEQ ID NO: 1463903 - protein, 17 aa, Mycobacterium tuberculosis
DGPRFVFAPLTIESDEM

SEQ ID NO: 1463904 - protein, 17 aa, Mycobacterium tuberculosis
DGSRIVVRGELFTAFVP

SEQ ID NO: 1463905 - protein, 27 aa, Mycobacterium tuberculosis
DGTIVRYRVGELIPVYRSQRALLQRLL

SEQ ID NO: 1463906 - protein, 18 aa, Mycobacterium tuberculosis
DGVLHEFTTVPGVKEDVT

SEQ ID NO: 1463907 - protein, 20 aa, Mycobacterium tuberculosis
DGWVHFDAPAGMLIPDSVAT

SEQ ID NO: 1463908 - protein, 18 aa, Mycobacterium tuberculosis
DHLIGHFVDQARRSGASW

SEQ ID NO: 1463909 - protein, 17 aa, Mycobacterium tuberculosis
DIKPEMVERFEIEVDTK

SEQ ID NO: 1463910 - protein, 17 aa, Mycobacterium tuberculosis
DKRGHRLGPAFAGLVDA

SEQ ID NO: 1463911 - protein, 27 aa, Mycobacterium tuberculosis
DKRLPRIAGPCGMVIFGVTGDLARKKV

SEQ ID NO: 1463912 - protein, 21 aa, Mycobacterium tuberculosis
DKSDVLAGLFAVWHSLDALLD

SEQ ID NO: 1463913 - protein, 24 aa, Mycobacterium tuberculosis
DLARIDVWDGYYCFAAELTSATLE

SEQ ID NO: 1463914 - protein, 21 aa, Mycobacterium tuberculosis
DLASACLYLLEHFDGPTHVNV

SEQ ID NO: 1463915 - protein, 17 aa, Mycobacterium tuberculosis
DLAVTFRFGEEVTAVDV

SEQ ID NO: 1463916 - protein, 19 aa, Mycobacterium tuberculosis
DLIERIQGGWLEFDAAIAT

SEQ ID NO: 1463917 - protein, 19 aa, Mycobacterium tuberculosis
DLLRFVLETGTPKSDRTGT

SEQ ID NO: 1463918 - protein, 28 aa, Mycobacterium tuberculosis
DLMTLDVDRDCFARIAPGLPSSVIRIAE

SEQ ID NO: 1463919 - protein, 18 aa, Mycobacterium tuberculosis
DLRGNPTLREVLQRTRQM

SEQ ID NO: 1463920 - protein, 24 aa, Mycobacterium tuberculosis
DLRTRVQTFLARRQLFDPALLAQA

SEQ ID NO: 1463921 - protein, 25 aa, Mycobacterium tuberculosis
DMTRRLAREEAMLVGGSCGMAVVAA

SEQ ID NO: 1463922 - protein, 24 aa, Mycobacterium tuberculosis
DNAFTADELAAWAGRIHAEVGDAA

SEQ ID NO: 1463923 - protein, 18 aa, Mycobacterium tuberculosis
DPIWPRHGIRIIPGPSSL

SEQ ID NO: 1463924 - protein, 19 aa, Mycobacterium tuberculosis
DPKHSGPCDVLYRDIGDYL

SEQ ID NO: 1463925 - protein, 17 aa, Mycobacterium tuberculosis
DPLVVAWPARIRPDGRV

SEQ ID NO: 1463926 - protein, 25 aa, Mycobacterium tuberculosis
DPRRRCAPLGAGRCLLGSGSALGWI

SEQ ID NO: 1463927 - protein, 20 aa, Mycobacterium tuberculosis
DRDGFVFGEGGALLLIETEE

SEQ ID NO: 1463928 - protein, 17 aa, Mycobacterium tuberculosis
DRGRPCIGDLIERKVRG

SEQ ID NO: 1463929 - protein, 17 aa, Mycobacterium tuberculosis
DRHPGWNRGSARAAHAD

SEQ ID NO: 1463930 - protein, 18 aa, Mycobacterium tuberculosis
DRIFAASANHSVWFHRQV

SEQ ID NO: 1463931 - protein, 26 aa, Mycobacterium tuberculosis
DRLMARIDAKLGFPQRDPHGDPIPGA

SEQ ID NO: 1463932 - protein, 17 aa, Mycobacterium tuberculosis
DRRRGRLVGALIVDDDS

SEQ ID NO: 1463933 - protein, 19 aa, Mycobacterium tuberculosis
DRSTLQTSLLLTVMIDETL

SEQ ID NO: 1463934 - protein, 17 aa, Mycobacterium tuberculosis
DRVGALEVLGRFESRVR

SEQ ID NO: 1463935 - protein, 22 aa, Mycobacterium tuberculosis
DSATEPVHFVQMWVIPDATGIT

SEQ ID NO: 1463936 - protein, 19 aa, Mycobacterium tuberculosis
DSGEGRWTAIAAIDEGVPA

SEQ ID NO: 1463937 - protein, 24 aa, Mycobacterium tuberculosis
DSTKLRAAAVAWRSAGTQFALTEI

SEQ ID NO: 1463938 - protein, 17 aa, Mycobacterium tuberculosis
DTGIAHVRDVVMPALQG

SEQ ID NO: 1463939 - protein, 21 aa, Mycobacterium tuberculosis
DTPLPRVSIFLSILDAHVQRA

SEQ ID NO: 1463940 - protein, 17 aa, Mycobacterium tuberculosis
DTSTPRWAELVAGDGAF

SEQ ID NO: 1463941 - protein, 23 aa, Mycobacterium tuberculosis
DVAETLIEVALRFVKIRETAWRV

SEQ ID NO: 1463942 - protein, 18 aa, Mycobacterium tuberculosis
DVVEAIVAQGVWCGMTIP

SEQ ID NO: 1463943 - protein, 17 aa, Mycobacterium tuberculosis
DYLGTKIEFRLGDVNET

SEQ ID NO: 1463944 - protein, 21 aa, Mycobacterium tuberculosis
DYPARVVAVGVDRECRAAEIA

SEQ ID NO: 1463945 - protein, 22 aa, Mycobacterium tuberculosis
DYSDAGLYLWATRGEPCRDSAA

SEQ ID NO: 1463946 - protein, 22 aa, Mycobacterium tuberculosis
EAIVAQGVWCGMTIPRVYPEMP

SEQ ID NO: 1463947 - protein, 17 aa, Mycobacterium tuberculosis
EALRRCRAGELRVVPGA

SEQ ID NO: 1463948 - protein, 22 aa, Mycobacterium tuberculosis
EAYRISISELDWMTPQTRQRAL

SEQ ID NO: 1463949 - protein, 27 aa, Mycobacterium tuberculosis
ECGIAKGSLRGGLVLGLEDSSSRMSRL

SEQ ID NO: 1463950 - protein, 19 aa, Mycobacterium tuberculosis
EDARFAAMVVLERLRPDQR

SEQ ID NO: 1463951 - protein, 25 aa, Mycobacterium tuberculosis
EDGWVRAQLLHYMRSAPDFYFDEMS

SEQ ID NO: 1463952 - protein, 17 aa, Mycobacterium tuberculosis
EEARDAAAVGFDVTVCI

SEQ ID NO: 1463953 - protein, 22 aa, Mycobacterium tuberculosis
EFDGRIITVPFSFKEIDDDGLI

SEQ ID NO: 1463954 - protein, 22 aa, Mycobacterium tuberculosis
EGELRPQLLDRFGLTVDVQASR

SEQ ID NO: 1463955 - protein, 19 aa, Mycobacterium tuberculosis
EGFVGLRVVPWLWGAPPTD

SEQ ID NO: 1463956 - protein, 19 aa, Mycobacterium tuberculosis
EGRLRRFDCSQMTDGGAGL

SEQ ID NO: 1463957 - protein, 24 aa, Mycobacterium tuberculosis
EIADRAGVSKPVLYQHFSSKLELY

SEQ ID NO: 1463958 - protein, 17 aa, Mycobacterium tuberculosis
EIEALYYLHPLTGEVIR

SEQ ID NO: 1463959 - protein, 20 aa, Mycobacterium tuberculosis
EINSLRMFIGAGTAPMLAAA

SEQ ID NO: 1463960 - protein, 21 aa, Mycobacterium tuberculosis
EIPANRPGRAVSMEKHHLMIG

SEQ ID NO: 1463961 - protein, 18 aa, Mycobacterium tuberculosis
EIRAHALAIGDDLVGRGV

SEQ ID NO: 1463962 - protein, 24 aa, Mycobacterium tuberculosis
EKCREYRITPVFVEVREGQSTRHG

SEQ ID NO: 1463963 - protein, 17 aa, Mycobacterium tuberculosis
EKGRWYLVGHDRDRDAT

SEQ ID NO: 1463964 - protein, 18 aa, Mycobacterium tuberculosis
EKMEKAVAVARDDLSTIR

SEQ ID NO: 1463965 - protein, 17 aa, Mycobacterium tuberculosis
EKNFKWIARSADGWITT

SEQ ID NO: 1463966 - protein, 18 aa, Mycobacterium tuberculosis
ELEKLVCGERVPFAALRT

SEQ ID NO: 1463967 - protein, 19 aa, Mycobacterium tuberculosis
ELKAEKVLQAIGFAPNVEG

SEQ ID NO: 1463968 - protein, 20 aa, Mycobacterium tuberculosis
ELLERSGLVALRNVIDQQFA

SEQ ID NO: 1463969 - protein, 23 aa, Mycobacterium tuberculosis
ELNSLRMFTGAGSAPMLAAAVAW

SEQ ID NO: 1463970 - protein, 19 aa, Mycobacterium tuberculosis
ELNVMGAMQLFAACQKAPS

SEQ ID NO: 1463971 - protein, 20 aa, Mycobacterium tuberculosis
ELRIGLATAEDIRQWSYGEV

SEQ ID NO: 1463972 - protein, 22 aa, Mycobacterium tuberculosis
ELRRLIPPWVTLGSRLAALPKP

SEQ ID NO: 1463973 - protein, 26 aa, Mycobacterium tuberculosis
ENSACLSCGSALGFSLGRMALLVIAD

SEQ ID NO: 1463974 - protein, 31 aa, Mycobacterium tuberculosis
ENVPISPIWLCPLRLRDHAGWPLYPIRPDRS

SEQ ID NO: 1463975 - protein, 27 aa, Mycobacterium tuberculosis
EPGVPGRTDCKWGAYLDNVGDFDPEFF

SEQ ID NO: 1463976 - protein, 24 aa, Mycobacterium tuberculosis
EPITDSWYLTSIRAGLEPWSDGVG

SEQ ID NO: 1463977 - protein, 20 aa, Mycobacterium tuberculosis
EPMLEEFARVAARVQAREPQ

SEQ ID NO: 1463978 - protein, 26 aa, Mycobacterium tuberculosis
EQLELLVGLVCLQAAAVLGRPSAEDV

SEQ ID NO: 1463979 - protein, 22 aa, Mycobacterium tuberculosis
EQMWAADVAAMVGYHSGASAAA

SEQ ID NO: 1463980 - protein, 20 aa, Mycobacterium tuberculosis
EQQWLPRIAAHLGVASPVPV

SEQ ID NO: 1463981 - protein, 23 aa, Mycobacterium tuberculosis
ERARCIAGGLAAAGVGLGDVVGV

SEQ ID NO: 1463982 - protein, 19 aa, Mycobacterium tuberculosis
ERARQAGAVGLVVTTDWTF

SEQ ID NO: 1463983 - protein, 25 aa, Mycobacterium tuberculosis
ERFRRGRDRIPLTGRIAVIVDDGIA

SEQ ID NO: 1463984 - protein, 21 aa, Mycobacterium tuberculosis
ERLRLSGTRIELEELLQLPVD

SEQ ID NO: 1463985 - protein, 20 aa, Mycobacterium tuberculosis
ESDYARMWIQAATTMASYQA

SEQ ID NO: 1463986 - protein, 25 aa, Mycobacterium tuberculosis
ETGLRPDFPRPALLSGAGDAVEFRL

SEQ ID NO: 1463987 - protein, 17 aa, Mycobacterium tuberculosis
ETIEAIAAMGSEVVVEC

SEQ ID NO: 1463988 - protein, 30 aa, Mycobacterium tuberculosis; identical to SEQ ID NO: 198846

SEQ ID NO: 1463989 - protein, 19 aa, Mycobacterium tuberculosis
EVLDALQELTRLAVHQKTG

SEQ ID NO: 1463990 - protein, 18 aa, Mycobacterium tuberculosis
EVLRLVGRRRLWGRGLGA

SEQ ID NO: 1463991 - protein, 20 aa, Mycobacterium tuberculosis
EVRHVPPGDMPGGTAAADAA

SEQ ID NO: 1463992 - protein, 23 aa, Mycobacterium tuberculosis
EVRVPAKALWRAQTQRAVENFPI

SEQ ID NO: 1463993 - protein, 28 aa, Mycobacterium tuberculosis
EVVQRPAGRARSRWFSDYLRTVTQRDVR

SEQ ID NO: 1463994 - protein, 22 aa, Mycobacterium tuberculosis
EYAEMWAQDAAVMYSYEGASAA

SEQ ID NO: 1463995 - protein, 17 aa, Mycobacterium tuberculosis
EYSPESYTGTELEYAKQ

SEQ ID NO: 1463996 - protein, 21 aa, Mycobacterium tuberculosis
FAAKARRLFPSGSPFGLGVLL

SEQ ID NO: 1463997 - protein, 32 aa, Mycobacterium tuberculosis; identical to SEQ ID NO: 79584

SEQ ID NO: 1463998 - protein, 19 aa, Mycobacterium tuberculosis
FADRALVMYAGRVVESAGV

SEQ ID NO: 1463999 - protein, 19 aa, Mycobacterium tuberculosis
FAKQPKFEFNHVINNDDVA

SEQ ID NO: 1464000 - protein, 17 aa, Mycobacterium tuberculosis
FALGYPMDIGSYVAFLS

SEQ ID NO: 1464001 - protein, 25 aa, Mycobacterium tuberculosis
FASLDRWPGTVGEYLNTVFDPSLTF

SEQ ID NO: 1464002 - protein, 17 aa, Mycobacterium tuberculosis
FAVGDRVMGLFPEGTGT

SEQ ID NO: 1464003 - protein, 17 aa, Mycobacterium tuberculosis
FDDAGAIGRRYRRQDEV

SEQ ID NO: 1464004 - protein, 17 aa, Mycobacterium tuberculosis
FDVGFPFAVADEKPDAE

SEQ ID NO: 1464005 - protein, 24 aa, Mycobacterium tuberculosis
FEARFRFVEEMIRLGADARTDGHH

SEQ ID NO: 1464006 - protein, 17 aa, Mycobacterium tuberculosis
FEIPSPRADAFAFVEAV

SEQ ID NO: 1464007 - protein, 17 aa, Mycobacterium tuberculosis
FEQALRIAYGESIENHR

SEQ ID NO: 1464008 - protein, 20 aa, Mycobacterium tuberculosis
FFFLRPKDIAIYVGSGELDF

SEQ ID NO: 1464009 - protein, 17 aa, Mycobacterium tuberculosis
FGGVRDYLRAVVERARK

SEQ ID NO: 1464010 - protein, 25 aa, Mycobacterium tuberculosis
FGHAGGCPHPLVVVAGAATRWVWVK

SEQ ID NO: 1464011 - protein, 25 aa, Mycobacterium tuberculosis
FGLELIWGIEDCRNMSARLERDLLA

SEQ ID NO: 1464012 - protein, 18 aa, Mycobacterium tuberculosis
FGSVRVVEPAEWTRSNRH

SEQ ID NO: 1464013 - protein, 27 aa, Mycobacterium tuberculosis
FICVFGYKAQAAFFKHANIATAEAQIV

SEQ ID NO: 1464014 - protein, 19 aa, Mycobacterium tuberculosis
FKPGTLTSLGFSYDVLHAF

SEQ ID NO: 1464015 - protein, 18 aa, Mycobacterium tuberculosis
FLCLLAGAIQARRVLEIG

SEQ ID NO: 1464016 - protein, 19 aa, Mycobacterium tuberculosis
FLDRGLRDTGRCRVPLILR

SEQ ID NO: 1464017 - protein, 20 aa, Mycobacterium tuberculosis
FLEGLPGLRLIGLDRDPTAL

SEQ ID NO: 1464018 - protein, 17 aa, Mycobacterium tuberculosis
FLEHSRILHFRAIDEFW

SEQ ID NO: 1464019 - protein, 17 aa, Mycobacterium tuberculosis
FLLEGMPVQVAFHNGVP

SEQ ID NO: 1464020 - protein, 20 aa, Mycobacterium tuberculosis
FLLNRNRLNVAVSRAQYAAV

SEQ ID NO: 1464021 - protein, 25 aa, Mycobacterium tuberculosis
FLMSVGDLIIGWLLQRQAAVAVAAL

SEQ ID NO: 1464022 - protein, 18 aa, Mycobacterium tuberculosis
FLRQIIANQQVYWQQIAA

SEQ ID NO: 1464023 - protein, 18 aa, Mycobacterium tuberculosis
FLVYPAMKALTLDIASMV

SEQ ID NO: 1464024 - protein, 17 aa, Mycobacterium tuberculosis
FMRPFRADEWLLYDQSS

SEQ ID NO: 1464025 - protein, 17 aa, Mycobacterium tuberculosis
FPAPQLSSSDGRGPVLV

SEQ ID NO: 1464026 - protein, 27 aa, Mycobacterium tuberculosis
FPEFPLPLGDPSVRCGGDLLSMMLMDE

SEQ ID NO: 1464027 - protein, 21 aa, Mycobacterium tuberculosis
FQMMGLCQILRDGVIPPNRSL

SEQ ID NO: 1464028 - protein, 19 aa, Mycobacterium tuberculosis
FRESAARALLLPRRHPGRR

SEQ ID NO: 1464029 - protein, 17 aa, Mycobacterium tuberculosis
FRGERLVNSMFTLSTMV

SEQ ID NO: 1464030 - protein, 20 aa, Mycobacterium tuberculosis
FRPEFFAAMRELCDEFDALL

SEQ ID NO: 1464031 - protein, 31 aa, Mycobacterium tuberculosis
FRPNPSRLCDWCPHQQRCPAFGGTPPPYPGW

SEQ ID NO: 1464032 - protein, 21 aa, Mycobacterium tuberculosis
FSDHRLILEGIAWRFRTGSPW

SEQ ID NO: 1464033 - protein, 18 aa, Mycobacterium tuberculosis
FSGKILAPAHLPQEQSQR

SEQ ID NO: 1464034 - protein, 18 aa, Mycobacterium tuberculosis
FSGPDFWVTVVGPAQPTA

SEQ ID NO: 1464035 - protein, 23 aa, Mycobacterium tuberculosis
FSMHGELYKAIARQAHVIHESFV

SEQ ID NO: 1464036 - protein, 18 aa, Mycobacterium tuberculosis
FSPGKGLGVIPREGYFQI

SEQ ID NO: 1464037 - protein, 28 aa, Mycobacterium tuberculosis
FTATPLPLALAKLFWTARFNTSQPCEGQ

SEQ ID NO: 1464038 - protein, 17 aa, Mycobacterium tuberculosis
FTPPFDLDGRWIGEASF

SEQ ID NO: 1464039 - protein, 18 aa, Mycobacterium tuberculosis
FVDAMCRKALRLTPEDTG

SEQ ID NO: 1464040 - protein, 18 aa, Mycobacterium tuberculosis
FVLETGTPKSDRTGTGTR

SEQ ID NO: 1464041 - protein, 23 aa, Mycobacterium tuberculosis
FVPRPETEAILAWATAQSLPARP

SEQ ID NO: 1464042 - protein, 23 aa, Mycobacterium tuberculosis
FYEADYWKARLAETPVDVATLES

SEQ ID NO: 1464043 - protein, 18 aa, Mycobacterium tuberculosis
GAEYWLAPSGFTRAPQNS

SEQ ID NO: 1464044 - protein, 27 aa, Mycobacterium tuberculosis
GAGPEPMAAAATAWDGLAMELASAAAS

SEQ ID NO: 1464045 - protein, 18 aa, Mycobacterium tuberculosis
GAGTLGFAGTTHKASPGQ

SEQ ID NO: 1464046 - protein, 19 aa, Mycobacterium tuberculosis
GALKPARLLVSGSAALPVP

SEQ ID NO: 1464047 - protein, 20 aa, Mycobacterium tuberculosis
GAQPQAAKLTEWLKLALDEP

SEQ ID NO: 1464048 - protein, 27 aa, Mycobacterium tuberculosis
GATLPAAAWQRCRTHYAANLMAATPKP

SEQ ID NO: 1464049 - protein, 19 aa, Mycobacterium tuberculosis
GAWEGLTFAEAAERDPELH

SEQ ID NO: 1464050 - protein, 17 aa, Mycobacterium tuberculosis
GCDDVYYCVVDTRAWLR

SEQ ID NO: 1464051 - protein, 20 aa, Mycobacterium tuberculosis
GDDDRLHGMLTDRDIVIKGL

SEQ ID NO: 1464052 - protein, 25 aa, Mycobacterium tuberculosis
GDILTRLTAPVIRGLGIGIVPAATR

SEQ ID NO: 1464053 - protein, 17 aa, Mycobacterium tuberculosis
GDLAKLRASVVNTQALA

SEQ ID NO: 1464054 - protein, 17 aa, Mycobacterium tuberculosis
GDLTPWAQRGVLLLNRV

SEQ ID NO: 1464055 - protein, 20 aa, Mycobacterium tuberculosis
GDNQIGFGPLNAGIANMGLF

SEQ ID NO: 1464056 - protein, 17 aa, Mycobacterium tuberculosis
GDPLALIAPAGSGAGAG

SEQ ID NO: 1464057 - protein, 18 aa, Mycobacterium tuberculosis
GDPSRRTSCLSGLGYPAS

SEQ ID NO: 1464058 - protein, 17 aa, Mycobacterium tuberculosis
GDTFAPVRAVLGGAGTR

SEQ ID NO: 1464059 - protein, 21 aa, Mycobacterium tuberculosis
GDVGAVVGRYAAGGYEVDFTA

SEQ ID NO: 1464060 - protein, 18 aa, Mycobacterium tuberculosis
GEAGSPVWHQLTTRDYRS

SEQ ID NO: 1464061 - protein, 32 aa, Mycobacterium tuberculosis
GEKRSWLRARGLKIFPLVGWAERGGYDAQGHG

SEQ ID NO: 1464062 - protein, 26 aa, Mycobacterium tuberculosis
GELPTWQWESLISKSTRLVAVNSASG

SEQ ID NO: 1464063 - protein, 19 aa, Mycobacterium tuberculosis
GELREIFSAVQIIADTERM

SEQ ID NO: 1464064 - protein, 25 aa, Mycobacterium tuberculosis
GENRLKIARLLALIDMLSDRFIGEP

SEQ ID NO: 1464065 - protein, 21 aa, Mycobacterium tuberculosis
GFDRLRLIQRITDRLPAKAPL

SEQ ID NO: 1464066 - protein, 25 aa, Mycobacterium tuberculosis
GFDSADLSLPWGQDALIAAVASANA

SEQ ID NO: 1464067 - protein, 20 aa, Mycobacterium tuberculosis
GFFRALDYTLPWDVDTVEDS

SEQ ID NO: 1464068 - protein, 24 aa, Mycobacterium tuberculosis
GFRSMLWPRVYADLRTAGVRGEDA

SEQ ID NO: 1464069 - protein, 18 aa, Mycobacterium tuberculosis
GGPPEGWQDSFVSSYATM

SEQ ID NO: 1464070 - protein, 21 aa, Mycobacterium tuberculosis
GGRLIKLPVFGSVAEAMEKTG

SEQ ID NO: 1464071 - protein, 20 aa, Mycobacterium tuberculosis
GGTPLRSRVGHSYIKALMAE

SEQ ID NO: 1464072 - protein, 25 aa, Mycobacterium tuberculosis
GGVVDVVCPLGWPATPARLPFTLGA

SEQ ID NO: 1464073 - protein, 21 aa, Mycobacterium tuberculosis
GHNPIAIIVPCHRVIGASGKL

SEQ ID NO: 1464074 - protein, 17 aa, Mycobacterium tuberculosis
GIHAAWFTDTWGRYNEA

SEQ ID NO: 1464075 - protein, 25 aa, Mycobacterium tuberculosis
GKTVVCAALASAARQAGIDVAVCKP

SEQ ID NO: 1464076 - protein, 27 aa, Mycobacterium tuberculosis
GLDTRAYRLPWPPGTVVYEIDQPAVIK

SEQ ID NO: 1464077 - protein, 18 aa, Mycobacterium tuberculosis
GLFFEWLTDHGFRAFAGH

SEQ ID NO: 1464078 - protein, 29 aa, Mycobacterium tuberculosis
GLLNRLSAFKVPHRFAVVDRLPRTPNGKL

SEQ ID NO: 1464079 - protein, 18 aa, Mycobacterium tuberculosis
GLLPIKIPLIDIPAAPGF

SEQ ID NO: 1464080 - protein, 25 aa, Mycobacterium tuberculosis
GLPRTAFKPSYGIAEATLLVATIDH

SEQ ID NO: 1464081 - protein, 25 aa, Mycobacterium tuberculosis
GLRVRRRAKVWYDRLNAEDPTRKPE

SEQ ID NO: 1464082 - protein, 17 aa, Mycobacterium tuberculosis
GMIAQIFAARFAQRTKT

SEQ ID NO: 1464083 - protein, 20 aa, Mycobacterium tuberculosis
GMYELEFPAPQLSSSDGRGP

SEQ ID NO: 1464084 - protein, 21 aa, Mycobacterium tuberculosis
GPEARYRRWLAALRGSARLVI

SEQ ID NO: 1464085 - protein, 23 aa, Mycobacterium tuberculosis
GPISEADLLWDLASRLEGRMAAI

SEQ ID NO: 1464086 - protein, 18 aa, Mycobacterium tuberculosis
GPPERGSRVRLCPTPGHL

SEQ ID NO: 1464087 - protein, 32 aa, Mycobacterium tuberculosis; identical to SEQ ID NO: 200206

SEQ ID NO: 1464088 - protein, 20 aa, Mycobacterium tuberculosis
GPVVGVWRRAPLQALARLHM

SEQ ID NO: 1464089 - protein, 21 aa, Mycobacterium tuberculosis
GQAFWSFGGLFLVNSPEQRRL

SEQ ID NO: 1464090 - protein, 17 aa, Mycobacterium tuberculosis
GQDLQFTAEVDIRPKIS

SEQ ID NO: 1464091 - protein, 17 aa, Mycobacterium tuberculosis
GQLAEFADFLINVPSRD

SEQ ID NO: 1464092 - protein, 18 aa, Mycobacterium tuberculosis
GQLPVGMLDGLVAADWPP

SEQ ID NO: 1464093 - protein, 23 aa, Mycobacterium tuberculosis
GQPAADALHAWLVDGRRALVTAE

SEQ ID NO: 1464094 - protein, 17 aa, Mycobacterium tuberculosis
GQRPSWAPLPVQYADYS

SEQ ID NO: 1464095 - protein, 18 aa, Mycobacterium tuberculosis
GRARAFALGQLRSLAERN

SEQ ID NO: 1464096 - protein, 32 aa, Mycobacterium tuberculosis; identical to SEQ ID NO: 200279

SEQ ID NO: 1464097 - protein, 22 aa, Mycobacterium tuberculosis
GRCKRARVALPGGDAIGSRPLD

SEQ ID NO: 1464098 - protein, 21 aa, Mycobacterium tuberculosis
GRGDEALQWFLRSAAADIDGV

SEQ ID NO: 1464099 - protein, 20 aa, Mycobacterium tuberculosis
GRGGLTGMLLGSVSNAVLHA

SEQ ID NO: 1464100 - protein, 17 aa, Mycobacterium tuberculosis
GRIAVIGGYAHLGVPAG

SEQ ID NO: 1464101 - protein, 21 aa, Mycobacterium tuberculosis
GRIHKLLRIFANPKLPTIGDY

SEQ ID NO: 1464102 - protein, 22 aa, Mycobacterium tuberculosis
GRILRVRGRGVPKRSGGSGDLL

SEQ ID NO: 1464103 - protein, 19 aa, Mycobacterium tuberculosis
GRPPRAIPDPAPRSSHGPA

SEQ ID NO: 1464104 - protein, 17 aa, Mycobacterium tuberculosis
GRVRGQRGWIVEKPGEP

SEQ ID NO: 1464105 - protein, 25 aa, Mycobacterium tuberculosis
GRVVVMPWDRHIAAGTEISLDLLDP

SEQ ID NO: 1464106 - protein, 25 aa, Mycobacterium tuberculosis
GSAPMCYPRADFLVGDRDILLGVLD

SEQ ID NO: 1464107 - protein, 32 aa, Mycobacterium tuberculosis; identical to SEQ ID NO: 200387

SEQ ID NO: 1464108 - protein, 36 aa, Mycobacterium tuberculosis
GSGGIRGPIGLGFRVPCLVISPYSRGPLMVHDTFDH

SEQ ID NO: 1464109 - protein, 19 aa, Mycobacterium tuberculosis
GSRVRLCPTPGHLHFFAVD

SEQ ID NO: 1464110 - protein, 19 aa, Mycobacterium tuberculosis
GSVMKRAVERYDVNVVGLT

SEQ ID NO: 1464111 - protein, 17 aa, Mycobacterium tuberculosis
GTTRLLDNIAIEIGTFA

SEQ ID NO: 1464112 - protein, 17 aa, Mycobacterium tuberculosis
GVLRQEDLHLAFASGAG

SEQ ID NO: 1464113 - protein, 25 aa, Mycobacterium tuberculosis
GVPIWGDVELAWRLDAAGCYGPPRS

SEQ ID NO: 1464114 - protein, 23 aa, Mycobacterium tuberculosis
GWFWPAAAAHPSLPRGALLQIAV

SEQ ID NO: 1464115 - protein, 18 aa, Mycobacterium tuberculosis
GYHGDTFLAMSICDPHGG

SEQ ID NO: 1464116 - protein, 20 aa, Mycobacterium tuberculosis
HAEPGAWLLISTCDATDLVA

SEQ ID NO: 1464117 - protein, 27 aa, Mycobacterium tuberculosis
HAVAVDLRNDWPTALKNAGFDPARPTA

SEQ ID NO: 1464118 - protein, 24 aa, Mycobacterium tuberculosis
HDETRKSFSIAGTRVVDAIKLSVP

SEQ ID NO: 1464119 - protein, 23 aa, Mycobacterium tuberculosis
HDEVSAAIAALFSAHGQAYQAAS

SEQ ID NO: 1464120 - protein, 21 aa, Mycobacterium tuberculosis
HEDLKRFFDGFPRNAHPMPVL

SEQ ID NO: 1464121 - protein, 20 aa, Mycobacterium tuberculosis
HGAVQGHDALRGWASSLTTT

SEQ ID NO: 1464122 - protein, 17 aa, Mycobacterium tuberculosis
HGHAYVMQAPHDLITNL

SEQ ID NO: 1464123 - protein, 20 aa, Mycobacterium tuberculosis
HGLTGPAIRIRCKSLLNALH

SEQ ID NO: 1464124 - protein, 24 aa, Mycobacterium tuberculosis
HGNSVPRFHITWGTGPALVDIFVR

SEQ ID NO: 1464125 - protein, 22 aa, Mycobacterium tuberculosis
HLRVVFPGVVGLFADLDSPISL

SEQ ID NO: 1464126 - protein, 17 aa, Mycobacterium tuberculosis
HMLTDSGVQAWLGPLPD

SEQ ID NO: 1464127 - protein, 21 aa, Mycobacterium tuberculosis
HPASGAAHLLAQWTGAHNDGP

SEQ ID NO: 1464128 - protein, 19 aa, Mycobacterium tuberculosis
HPLIARAHLLLRFDRGNWI

SEQ ID NO: 1464129 - protein, 19 aa, Mycobacterium tuberculosis
HPPVGVVVFVGGASSRLDD

SEQ ID NO: 1464130 - protein, 25 aa, Mycobacterium tuberculosis
HRADIEFPAPALIYGYGAYEICEDP

SEQ ID NO: 1464131 - protein, 19 aa, Mycobacterium tuberculosis
HRKVKKWLAHGDFDVLHLH

SEQ ID NO: 1464132 - protein, 19 aa, Mycobacterium tuberculosis
HRLDSGTWGVMGIGMGYAI

SEQ ID NO: 1464133 - protein, 17 aa, Mycobacterium tuberculosis
HRSLVCDKPARWLLEHS

SEQ ID NO: 1464134 - protein, 17 aa, Mycobacterium tuberculosis
HSRAALLSAARTDAAAG

SEQ ID NO: 1464135 - protein, 24 aa, Mycobacterium tuberculosis
HSRVLRVGVAEFRRSLDRVMPRDA

SEQ ID NO: 1464136 - protein, 24 aa, Mycobacterium tuberculosis
HTPPPHWRPDVLLVAVGAMSRPCM

SEQ ID NO: 1464137 - protein, 34 aa, Mycobacterium tuberculosis
HVNKLRGRHVPKLRQVIGCVFQDFRLLQQKTVYD

SEQ ID NO: 1464138 - protein, 26 aa, Mycobacterium tuberculosis
HVSGHAYAGELLFLYNGVRPRNVMPV

SEQ ID NO: 1464139 - protein, 20 aa, Mycobacterium tuberculosis
HVVDVPAFRIGRVPVTNGEW

SEQ ID NO: 1464140 - protein, 24 aa, Mycobacterium tuberculosis
HVVRAVHRCLLAGRFATALGADDD

SEQ ID NO: 1464141 - protein, 19 aa, Mycobacterium tuberculosis
IADFVPRVRAGLEALGVGK

SEQ ID NO: 1464142 - protein, 18 aa, Mycobacterium tuberculosis
IADGEFLVLVGPSGCGKS

SEQ ID NO: 1464143 - protein, 17 aa, Mycobacterium tuberculosis
IAEAAGLEERYVREWLG

SEQ ID NO: 1464144 - protein, 17 aa, Mycobacterium tuberculosis
IAEICAALDKLAAGGGV

SEQ ID NO: 1464145 - protein, 17 aa, Mycobacterium tuberculosis
IAIERGTHFKGFERSKY

SEQ ID NO: 1464146 - protein, 18 aa, Mycobacterium tuberculosis
IAMTRWQALVNWSGTDPV

SEQ ID NO: 1464147 - protein, 22 aa, Mycobacterium tuberculosis
IATWQRIAAALKRDPYGRTARQ

SEQ ID NO: 1464148 - protein, 18 aa, Mycobacterium tuberculosis
IAVDICEQIASVPYPLST

SEQ ID NO: 1464149 - protein, 19 aa, Mycobacterium tuberculosis
IAVGLALRGFVPVPEIQFD

SEQ ID NO: 1464150 - protein, 27 aa, Mycobacterium tuberculosis
IDEPLVRRLWVLKVWGDVVDDRRGTRP

SEQ ID NO: 1464151 - protein, 17 aa, Mycobacterium tuberculosis
IDIAWNTNLAYVRTVLQ

SEQ ID NO: 1464152 - protein, 18 aa, Mycobacterium tuberculosis
IDIGKNGQINLGFGNTGS

SEQ ID NO: 1464153 - protein, 20 aa, Mycobacterium tuberculosis
IDKWLPLSWSLNMVNRSMGH

SEQ ID NO: 1464154 - protein, 18 aa, Mycobacterium tuberculosis
IEAFELVVVNLYPFSQTV

SEQ ID NO: 1464155 - protein, 22 aa, Mycobacterium tuberculosis
IEELLRGADMVFVTAGEGGGTG

SEQ ID NO: 1464156 - protein, 18 aa, Mycobacterium tuberculosis
IEMIPIPMLQDGPDVDLI

SEQ ID NO: 1464157 - protein, 26 aa, Mycobacterium tuberculosis
IEVAVCSTGLIGDRLPMDKLLAGVAH

SEQ ID NO: 1464158 - protein, 20 aa, Mycobacterium tuberculosis
IEVIEFCLGIPHLLKGEYTE

SEQ ID NO: 1464159 - protein, 17 aa, Mycobacterium tuberculosis
IFGAYGRQCQVLSAQAS

SEQ ID NO: 1464160 - protein, 23 aa, Mycobacterium tuberculosis
IFRLGSDPGLARFIDQVARRVQG

SEQ ID NO: 1464161 - protein, 21 aa, Mycobacterium tuberculosis
IGDLFGGLFGRGGSARPSRPR

SEQ ID NO: 1464162 - protein, 18 aa, Mycobacterium tuberculosis
IGFEPLQWVRALAAEDPV

SEQ ID NO: 1464163 - protein, 18 aa, Mycobacterium tuberculosis
IGFYSSFMVADKVQLLTR

SEQ ID NO: 1464164 - protein, 25 aa, Mycobacterium tuberculosis
IGPIKINPITLWPAQNFNQTITLAW

SEQ ID NO: 1464165 - protein, 19 aa, Mycobacterium tuberculosis
IGVPDWIVGGLNNVLKPLV

SEQ ID NO: 1464166 - protein, 20 aa, Mycobacterium tuberculosis
IHAALRINGFTVMLNDDVPQ

SEQ ID NO: 1464167 - protein, 17 aa, Mycobacterium tuberculosis
IHRPRYDDWSLPKGKVD

SEQ ID NO: 1464168 - protein, 24 aa, Mycobacterium tuberculosis
IITRASARLAPAFTDTWVATTDND

SEQ ID NO: 1464169 - protein, 17 aa, Mycobacterium tuberculosis
IKGILGEVWEFITNALN

SEQ ID NO: 1464170 - protein, 18 aa, Mycobacterium tuberculosis
IKVEAPGGEAARQITSVL

SEQ ID NO: 1464171 - protein, 23 aa, Mycobacterium tuberculosis
ILCDPWVNPAYFASWFPFPDNSG

SEQ ID NO: 1464172 - protein, 20 aa, Mycobacterium tuberculosis
ILDVRWRLDEPDGHAAYLQG

SEQ ID NO: 1464173 - protein, 17 aa, Mycobacterium tuberculosis
ILRFFPTPACARLTEQN

SEQ ID NO: 1464174 - protein, 21 aa, Mycobacterium tuberculosis
ILRGRTGALIVLGHDENVEAI

SEQ ID NO: 1464175 - protein, 18 aa, Mycobacterium tuberculosis
ILYGYEWELTKSPAGAWQ

SEQ ID NO: 1464176 - protein, 27 aa, Mycobacterium tuberculosis
INMFEFARPVLEACGQRWPKMRISGPA

SEQ ID NO: 1464177 - protein, 18 aa, Mycobacterium tuberculosis
IPDLITWWCERDGVHPDK

SEQ ID NO: 1464178 - protein, 17 aa, Mycobacterium tuberculosis
IPIIHIPATPGFGNSTG

SEQ ID NO: 1464179 - protein, 19 aa, Mycobacterium tuberculosis
IPIPDEFKSRLSTAVNAIA

SEQ ID NO: 1464180 - protein, 17 aa, Mycobacterium tuberculosis
IPSGWRNLASGYQVKTY

SEQ ID NO: 1464181 - protein, 18 aa, Mycobacterium tuberculosis
IPSPAAALQATRLAAAPI

SEQ ID NO: 1464182 - protein, 17 aa, Mycobacterium tuberculosis
IQAGYVKRAPYALPKSG

SEQ ID NO: 1464183 - protein, 17 aa, Mycobacterium tuberculosis
IQREHLLQAIKDVGVDL

SEQ ID NO: 1464184 - protein, 25 aa, Mycobacterium tuberculosis
ISSIPPVPGKFYWMSPTQVRWRPFE

SEQ ID NO: 1464185 - protein, 24 aa, Mycobacterium tuberculosis
ITFDFEPGEFVALLGQSGSGKSTL

SEQ ID NO: 1464186 - protein, 23 aa, Mycobacterium tuberculosis
ITKSGHDYTWFVLNAKIIEKEFA

SEQ ID NO: 1464187 - protein, 23 aa, Mycobacterium tuberculosis
IVERGRMLGGVCVNTGTIPSKTL

SEQ ID NO: 1464188 - protein, 18 aa, Mycobacterium tuberculosis
IVPPPLIAANRARLTSLV

SEQ ID NO: 1464189 - protein, 28 aa, Mycobacterium tuberculosis
IYNPLRFLRAAMKWCRKAQELGTLDEDA

SEQ ID NO: 1464190 - protein, 20 aa, Mycobacterium tuberculosis
KAAADRLCYSYFRSYGLDVT

SEQ ID NO: 1464191 - protein, 24 aa, Mycobacterium tuberculosis
KAGEGDAFISAGVETVSRFAKGNS

SEQ ID NO: 1464192 - protein, 17 aa, Mycobacterium tuberculosis
KAIFGRLVAESDAVFAN

SEQ ID NO: 1464193 - protein, 17 aa, Mycobacterium tuberculosis
KAIGRLARRNFKRSDAQ

SEQ ID NO: 1464194 - protein, 22 aa, Mycobacterium tuberculosis
KANPAVRVRIGGRWRSGTAYLL

SEQ ID NO: 1464195 - protein, 19 aa, Mycobacterium tuberculosis
KASSVMLESFLFYSGFYLP

SEQ ID NO: 1464196 - protein, 18 aa, Mycobacterium tuberculosis
KDLRIAVDGGFLSVTEEG

SEQ ID NO: 1464197 - protein, 19 aa, Mycobacterium tuberculosis
KDSPLARALAKLGVAADDV

SEQ ID NO: 1464198 - protein, 27 aa, Mycobacterium tuberculosis
KDVLQGQCTFSWPPRMELPGYKPNTKP

SEQ ID NO: 1464199 - protein, 18 aa, Mycobacterium tuberculosis
KELWRRMSAAGDIYLDNY

SEQ ID NO: 1464200 - protein, 18 aa, Mycobacterium tuberculosis
KEPLYRLYELRLRQGLAA

SEQ ID NO: 1464201 - protein, 24 aa, Mycobacterium tuberculosis
KEVKGFAGFPIGGRFLRAGNPALT

SEQ ID NO: 1464202 - protein, 22 aa, Mycobacterium tuberculosis
KFLRRFRPYNLMPAAVKPSYGM

SEQ ID NO: 1464203 - protein, 18 aa, Mycobacterium tuberculosis
KGHPVVRQGASYVVTGGL

SEQ ID NO: 1464204 - protein, 17 aa, Mycobacterium tuberculosis
KGQLLSLHLGRLKDRVG

SEQ ID NO: 1464205 - protein, 27 aa, Mycobacterium tuberculosis
KHLVLAGARSPVSFFAYPGMPSDLVPA

SEQ ID NO: 1464206 - protein, 17 aa, Mycobacterium tuberculosis
KLGWLDRVVSPEPVLTT

SEQ ID NO: 1464207 - protein, 23 aa, Mycobacterium tuberculosis
KLSEPVAVVGMGCRYPGGVDSPE

SEQ ID NO: 1464208 - protein, 17 aa, Mycobacterium tuberculosis
KPGVRREALVDRVEVKD

SEQ ID NO: 1464209 - protein, 21 aa, Mycobacterium tuberculosis
KRIVGAKGKAALLRELSDVVP

SEQ ID NO: 1464210 - protein, 23 aa, Mycobacterium tuberculosis
KSTTLRILLGLVKADGGSVRLLG

SEQ ID NO: 1464211 - protein, 18 aa, Mycobacterium tuberculosis
KSVYLCCRAALRHMVLAG

SEQ ID NO: 1464212 - protein, 21 aa, Mycobacterium tuberculosis
KTLTCVLPAYLNALAGNGVHI

SEQ ID NO: 1464213 - protein, 21 aa, Mycobacterium tuberculosis
KVGLGSVRFLMSVGDLIIGWL

SEQ ID NO: 1464214 - protein, 24 aa, Mycobacterium tuberculosis
KVGRIARVLGPRGLMPNPKTGTVT

SEQ ID NO: 1464215 - protein, 24 aa, Mycobacterium tuberculosis
KVISRLLAGPALAFAQAKNAINAA

SEQ ID NO: 1464216 - protein, 17 aa, Mycobacterium tuberculosis
KVLDGYCRHMGGDLSEG

SEQ ID NO: 1464217 - protein, 17 aa, Mycobacterium tuberculosis
KYWVCKRSTAHAAEALE

SEQ ID NO: 1464218 - protein, 18 aa, Mycobacterium tuberculosis
LAAAAAWDGLATELQSTA

SEQ ID NO: 1464219 - protein, 19 aa, Mycobacterium tuberculosis
LADHLLRSLAIIGAAAGAQ

SEQ ID NO: 1464220 - protein, 17 aa, Mycobacterium tuberculosis
LALLEADVSLPVVRAFI

SEQ ID NO: 1464221 - protein, 19 aa, Mycobacterium tuberculosis
LAPGPARCCVVLKRCSAHD

SEQ ID NO: 1464222 - protein, 22 aa, Mycobacterium tuberculosis
LARELACAYDLDFVDPASNSRV

SEQ ID NO: 1464223 - protein, 20 aa, Mycobacterium tuberculosis
LATLLQHWGISPDFLIGHSV

SEQ ID NO: 1464224 - protein, 17 aa, Mycobacterium tuberculosis
LAVGELRCAPAVSDQPV

SEQ ID NO: 1464225 - protein, 21 aa, Mycobacterium tuberculosis
LCMDNGMPILVFNLLTDGNIA

SEQ ID NO: 1464226 - protein, 17 aa, Mycobacterium tuberculosis
LDALILMNFIQTNSAVY

SEQ ID NO: 1464227 - protein, 17 aa, Mycobacterium tuberculosis
LDESSWFISARGILETV

SEQ ID NO: 1464228 - protein, 17 aa, Mycobacterium tuberculosis
LDFFKDPVKGFFRALDY

SEQ ID NO: 1464229 - protein, 29 aa, Mycobacterium tuberculosis
LDGLAAYRRSRGLAALSVAWGLWEQASAM

SEQ ID NO: 1464230 - protein, 20 aa, Mycobacterium tuberculosis
LDKIFYRSGQGVTLQAVSYG

SEQ ID NO: 1464231 - protein, 26 aa, Mycobacterium tuberculosis
LDNQIWQCPVVLLADVRSVGVQGDGR

SEQ ID NO: 1464232 - protein, 17 aa, Mycobacterium tuberculosis
LEFKRVQFTPDLMPGDV

SEQ ID NO: 1464233 - protein, 22 aa, Mycobacterium tuberculosis
LEFRVLRDRLFDTLAAAGGPEV

SEQ ID NO: 1464234 - protein, 19 aa, Mycobacterium tuberculosis
LEILAQLLVLATGTRITYV

SEQ ID NO: 1464235 - protein, 17 aa, Mycobacterium tuberculosis
LEIRCAVTGDLPAARQL

SEQ ID NO: 1464236 - protein, 17 aa, Mycobacterium tuberculosis
LEMTKWFDTNYHYLVPE

SEQ ID NO: 1464237 - protein, 17 aa, Mycobacterium tuberculosis
LENPQWCARVIGEHGDQ

SEQ ID NO: 1464238 - protein, 17 aa, Mycobacterium tuberculosis
LERNPKLGASWEGFVLE

SEQ ID NO: 1464239 - protein, 35 aa, Mycobacterium tuberculosis; identical to SEQ ID NO: 211218

SEQ ID NO: 1464240 - protein, 17 aa, Mycobacterium tuberculosis
LEYALAHDERFGIWGGL

SEQ ID NO: 1464241 - protein, 17 aa, Mycobacterium tuberculosis
LFAAIVVLMQWGDEYLP

SEQ ID NO: 1464242 - protein, 18 aa, Mycobacterium tuberculosis
LFASEVAMEIALNAVRIH

SEQ ID NO: 1464243 - protein, 27 aa, Mycobacterium tuberculosis
LFDRIAGHRRFRFYLNVEIGKHLGHAE

SEQ ID NO: 1464244 - protein, 24 aa, Mycobacterium tuberculosis
LGAHCNIEHGCVVARAETLRGAEI

SEQ ID NO: 1464245 - protein, 18 aa, Mycobacterium tuberculosis
LGALIANGAAMTRVPART

SEQ ID NO: 1464246 - protein, 17 aa, Mycobacterium tuberculosis
LGDRLVLVVGDVVGHGV

SEQ ID NO: 1464247 - protein, 17 aa, Mycobacterium tuberculosis
LGEAKIEADRRLHVADE

SEQ ID NO: 1464248 - protein, 21 aa, Mycobacterium tuberculosis
LGGTLCCALANRLRITKPEAG

SEQ ID NO: 1464249 - protein, 20 aa, Mycobacterium tuberculosis
LGLDHCFGPVMLHRVEATVR

SEQ ID NO: 1464250 - protein, 19 aa, Mycobacterium tuberculosis
LGLDSVRFVLLMKQLGVNR

SEQ ID NO: 1464251 - protein, 18 aa, Mycobacterium tuberculosis
LGQRALRFVTDPDSGRTM

SEQ ID NO: 1464252 - protein, 21 aa, Mycobacterium tuberculosis
LGRDDVCYVSMPLFHSNAVLV

SEQ ID NO: 1464253 - protein, 18 aa, Mycobacterium tuberculosis
LGVLPVLATDVLRRLRMV

SEQ ID NO: 1464254 - protein, 29 aa, Mycobacterium tuberculosis
LGWAGGSELGFRLAFAEGYSHAMTLNNDT

SEQ ID NO: 1464255 - protein, 18 aa, Mycobacterium tuberculosis
LHGMLTDRDIVIKGLAAG

SEQ ID NO: 1464256 - protein, 17 aa, Mycobacterium tuberculosis
LHLDILVDRMRREFKVE

SEQ ID NO: 1464257 - protein, 25 aa, Mycobacterium tuberculosis
LHPNAIAALGIREWDAVSLTGSRTT

SEQ ID NO: 1464258 - protein, 24 aa, Mycobacterium tuberculosis
LHRLGRPVFGPSFEVEVDTDLRIR

SEQ ID NO: 1464259 - protein, 19 aa, Mycobacterium tuberculosis
LIAQLRPPPTFAEVSFATY

SEQ ID NO: 1464260 - protein, 18 aa, Mycobacterium tuberculosis
LIERDAWLRCMHTAVASI

SEQ ID NO: 1464261 - protein, 20 aa, Mycobacterium tuberculosis
LIERLQRPTLVMAPNKTLAA

SEQ ID NO: 1464262 - protein, 23 aa, Mycobacterium tuberculosis
LIPRARAKISIRVAPGGDATAHL

SEQ ID NO: 1464263 - protein, 17 aa, Mycobacterium tuberculosis
LKQAERVKALALAGGAR

SEQ ID NO: 1464264 - protein, 18 aa, Mycobacterium tuberculosis
LKRSYGWNRTELTGITGA

SEQ ID NO: 1464265 - protein, 21 aa, Mycobacterium tuberculosis
LKTATGLTLPPTVIFDHPTPT

SEQ ID NO: 1464266 - protein, 23 aa, Mycobacterium tuberculosis
LLAVRRIAERPGLTVGLEPLLDL

SEQ ID NO: 1464267 - protein, 17 aa, Mycobacterium tuberculosis
LLDVSVLREAGWRPSIA

SEQ ID NO: 1464268 - protein, 21 aa, Mycobacterium tuberculosis
LLERAYRMGLVSAEARTKLYK

SEQ ID NO: 1464269 - protein, 19 aa, Mycobacterium tuberculosis
LLIRKAGAASADMAAELAK

SEQ ID NO: 1464270 - protein, 19 aa, Mycobacterium tuberculosis
LLKALGWTSEQIVERFGFS

SEQ ID NO: 1464271 - protein, 21 aa, Mycobacterium tuberculosis
LLKLRVEVFVVEQACPYPELD

SEQ ID NO: 1464272 - protein, 20 aa, Mycobacterium tuberculosis
LLPDELYTAVGASIGDAWAA

SEQ ID NO: 1464273 - protein, 20 aa, Mycobacterium tuberculosis
LLTSLPFAPGYGVEIGLLID

SEQ ID NO: 1464274 - protein, 19 aa, Mycobacterium tuberculosis
LMAELPAGGVMVVVAASEE

SEQ ID NO: 1464275 - protein, 25 aa, Mycobacterium tuberculosis
LMDRWSRGRVALVGDAGYCCSPLSG

SEQ ID NO: 1464276 - protein, 23 aa, Mycobacterium tuberculosis
LMRNRVDLIVGHGRFIDPHTILV

SEQ ID NO: 1464277 - protein, 23 aa, Mycobacterium tuberculosis
LNPVRRGAALAGDIAKADCQLVL

SEQ ID NO: 1464278 - protein, 17 aa, Mycobacterium tuberculosis
LNQMLVWGFTGQVISAV

SEQ ID NO: 1464279 - protein, 20 aa, Mycobacterium tuberculosis
LNTAVWSGGSFIYVPPGVHV

SEQ ID NO: 1464280 - protein, 25 aa, Mycobacterium tuberculosis
LPDNTPWGGKPVRKLQLPRDAALVT

SEQ ID NO: 1464281 - protein, 20 aa, Mycobacterium tuberculosis
LPIARDLASKLIRVVTIAPG

SEQ ID NO: 1464282 - protein, 17 aa, Mycobacterium tuberculosis
LPMAHEGLRRWGVDAEV

SEQ ID NO: 1464283 - protein, 19 aa, Mycobacterium tuberculosis
LPPSPKPGQKWVNVDPTKN

SEQ ID NO: 1464284 - protein, 18 aa, Mycobacterium tuberculosis
LPSNCFDKPPVVNPGLEP

SEQ ID NO: 1464285 - protein, 18 aa, Mycobacterium tuberculosis
LQALAGRCATLAGELSAA

SEQ ID NO: 1464286 - protein, 20 aa, Mycobacterium tuberculosis
LQMDGSWRVGNRPVRVDHRA

SEQ ID NO: 1464287 - protein, 24 aa, Mycobacterium tuberculosis
LQPFPLPALTCLLRSITLRMTMAP

SEQ ID NO: 1464288 - protein, 17 aa, Mycobacterium tuberculosis
LQRAATWGATPIPSPAA

SEQ ID NO: 1464289 - protein, 18 aa, Mycobacterium tuberculosis
LQRCYSGLELRDDRLVLS

SEQ ID NO: 1464290 - protein, 17 aa, Mycobacterium tuberculosis
LQTRAEIVVVRGDVASP

SEQ ID NO: 1464291 - protein, 20 aa, Mycobacterium tuberculosis
LRAAATRLALRHPMLRVQFL

SEQ ID NO: 1464292 - protein, 18 aa, Mycobacterium tuberculosis
LRAADVLVLADAKRGDIG

SEQ ID NO: 1464293 - protein, 21 aa, Mycobacterium tuberculosis
LRADWPAALQAAGLDSTAPTA

SEQ ID NO: 1464294 - protein, 17 aa, Mycobacterium tuberculosis
LRAGEVPTLGNWFRAAG

SEQ ID NO: 1464295 - protein, 25 aa, Mycobacterium tuberculosis
LRDAYCRHIGVEYAHILDPEQKEWL

SEQ ID NO: 1464296 - protein, 20 aa, Mycobacterium tuberculosis
LRDRFRCVAPDYLGFGLSER

SEQ ID NO: 1464297 - protein, 17 aa, Mycobacterium tuberculosis
LRFPKKQGMRIDFILGS

SEQ ID NO: 1464298 - protein, 18 aa, Mycobacterium tuberculosis
LRLPGQRYLVVDYKTNHL

SEQ ID NO: 1464299 - protein, 17 aa, Mycobacterium tuberculosis
LRNEIQIVVTILSLDPG

SEQ ID NO: 1464300 - protein, 17 aa, Mycobacterium tuberculosis
LRNLAAIKDVAARPTRT

SEQ ID NO: 1464301 - protein, 19 aa, Mycobacterium tuberculosis
LRPPPTFAEVSFATYRPDP

SEQ ID NO: 1464302 - protein, 17 aa, Mycobacterium tuberculosis
LRRALAPPVKRQEQYRL

SEQ ID NO: 1464303 - protein, 19 aa, Mycobacterium tuberculosis
LRSLGATLKASNAAAAVPT

SEQ ID NO: 1464304 - protein, 19 aa, Mycobacterium tuberculosis
LRVADLFDSQGIWLVSSMT

SEQ ID NO: 1464305 - protein, 17 aa, Mycobacterium tuberculosis
LRVGTPRGPNLFENMGF

SEQ ID NO: 1464306 - protein, 21 aa, Mycobacterium tuberculosis
LSADRGFARFRRLRWRHPLDG

SEQ ID NO: 1464307 - protein, 22 aa, Mycobacterium tuberculosis
LSGLDLRPATSRAQCLRMVADY

SEQ ID NO: 1464308 - protein, 23 aa, Mycobacterium tuberculosis
LSGYSRVLLKLGGEMFGGGQVGL

SEQ ID NO: 1464309 - protein, 22 aa, Mycobacterium tuberculosis
LSRELPKSIIIAGAGAIGMEFG

SEQ ID NO: 1464310 - protein, 17 aa, Mycobacterium tuberculosis
LSSAPVWCSDIRAGAGL

SEQ ID NO: 1464311 - protein, 21 aa, Mycobacterium tuberculosis
LSSSQMRSWFNYRFDGPNAVN

SEQ ID NO: 1464312 - protein, 33 aa, Mycobacterium tuberculosis; identical to SEQ ID NO: 209749

SEQ ID NO: 1464313 - protein, 27 aa, Mycobacterium tuberculosis
LTDMIRFGSLYLRDGVSLAGQQVVPAA

SEQ ID NO: 1464314 - protein, 17 aa, Mycobacterium tuberculosis
LTFGIVYTYARPNWWAN

SEQ ID NO: 1464315 - protein, 18 aa, Mycobacterium tuberculosis
LTKAGELGFSCYVHPEIE

SEQ ID NO: 1464316 - protein, 17 aa, Mycobacterium tuberculosis
LTLNLGVGNIGSLNLGS

SEQ ID NO: 1464317 - protein, 18 aa, Mycobacterium tuberculosis
LTPGYLTMGGFIPAQDEH

SEQ ID NO: 1464318 - protein, 18 aa, Mycobacterium tuberculosis
LTSPLAFLQRPARWLHSL

SEQ ID NO: 1464319 - protein, 17 aa, Mycobacterium tuberculosis
LVLDFYRCAMLPASPDW

SEQ ID NO: 1464320 - protein, 17 aa, Mycobacterium tuberculosis
LVTRVPQGWSFAQAAAV

SEQ ID NO: 1464321 - protein, 20 aa, Mycobacterium tuberculosis
LYPPGARCLVHESMAEGLAA

SEQ ID NO: 1464322 - protein, 23 aa, Mycobacterium tuberculosis
LYRLYELRLRQGLAASKSDLPRH

SEQ ID NO: 1464323 - protein, 19 aa, Mycobacterium tuberculosis
LYRNEERNFWAVSRHHDVL

SEQ ID NO: 1464324 - protein, 18 aa, Mycobacterium tuberculosis
MAAVQLARQWGVEVFVTA

SEQ ID NO: 1464325 - protein, 17 aa, Mycobacterium tuberculosis
MAGAPGFEADDVLGTLA

SEQ ID NO: 1464326 - protein, 26 aa, Mycobacterium tuberculosis
MDPQHRMLLEVAWEALEHAGIPPDSL

SEQ ID NO: 1464327 - protein, 20 aa, Mycobacterium tuberculosis
MGKTLAAAKAEALKCAKGFR

SEQ ID NO: 1464328 - protein, 17 aa, Mycobacterium tuberculosis
MIRGLRRTHGWPAAMGI

SEQ ID NO: 1464329 - protein, 17 aa, Mycobacterium tuberculosis
MIVTGGFNVFPREVEDV

SEQ ID NO: 1464330 - protein, 17 aa, Mycobacterium tuberculosis
MLARRLSGWQDRYPDVV

SEQ ID NO: 1464331 - protein, 20 aa, Mycobacterium tuberculosis
MMAAGAAWNGLAAELGTTAA

SEQ ID NO: 1464332 - protein, 22 aa, Mycobacterium tuberculosis
MPDEIEAAIGLAERDQDIKVIV

SEQ ID NO: 1464333 - protein, 19 aa, Mycobacterium tuberculosis
MRALDWFEVQSIRGHLVDG

SEQ ID NO: 1464334 - protein, 27 aa, Mycobacterium tuberculosis
MRRTNACDRRRFGLSLTIHEDACRIIS

SEQ ID NO: 1464335 - protein, 23 aa, Mycobacterium tuberculosis
NADIAMAFERYRIVTGDGSLEEE

SEQ ID NO: 1464336 - protein, 26 aa, Mycobacterium tuberculosis
NAITLFPGGLTFPATSLLNLDVTAGA

SEQ ID NO: 1464337 - protein, 33 aa, Mycobacterium tuberculosis
NAMEAVGGPSTWRMGGAINCGKAQPGQVAAVSH

SEQ ID NO: 1464338 - protein, 28 aa, Mycobacterium tuberculosis
NDQVALFLRHLWSAGGSVRWDPTNGQGR

SEQ ID NO: 1464339 - protein, 24 aa, Mycobacterium tuberculosis
NFGAMLRAECARLNRAGLTTCSEM

SEQ ID NO: 1464340 - protein, 20 aa, Mycobacterium tuberculosis
NHTGGWRVDPLRGLSRPDFD

SEQ ID NO: 1464341 - protein, 17 aa, Mycobacterium tuberculosis
NIPCPVNTLPVPGLTIA

SEQ ID NO: 1464342 - protein, 17 aa, Mycobacterium tuberculosis
NLDMGLGSILGRRPTAL

SEQ ID NO: 1464343 - protein, 18 aa, Mycobacterium tuberculosis
NLKLIKNGHHFRLRDADE

SEQ ID NO: 1464344 - protein, 23 aa, Mycobacterium tuberculosis
NPIARLVWRLCKIDGKPSRYRSE

SEQ ID NO: 1464345 - protein, 17 aa, Mycobacterium tuberculosis
NPLKEVIRGKRLIVVDD

SEQ ID NO: 1464346 - protein, 25 aa, Mycobacterium tuberculosis
NQIKLAVLVATNFFGINTIPIAINE

SEQ ID NO: 1464347 - protein, 23 aa, Mycobacterium tuberculosis
NRLAELWSIMDFLNPGLLGSSER

SEQ ID NO: 1464348 - protein, 23 aa, Mycobacterium tuberculosis
NRLPPVHMFGGINLSFGLMGPLM

SEQ ID NO: 1464349 - protein, 19 aa, Mycobacterium tuberculosis
NTGTLPFAVTSLVSGLANI

SEQ ID NO: 1464350 - protein, 17 aa, Mycobacterium tuberculosis
NTLLPAFVDTPMQQTAM

SEQ ID NO: 1464351 - protein, 17 aa, Mycobacterium tuberculosis
NVADGDAALALLRAELR

SEQ ID NO: 1464352 - protein, 24 aa, Mycobacterium tuberculosis
PAADEVSLLLATQFRTHAATYQTA

SEQ ID NO: 1464353 - protein, 19 aa, Mycobacterium tuberculosis
PAALLRWGVSQFDAEVRPV

SEQ ID NO: 1464354 - protein, 17 aa, Mycobacterium tuberculosis
PARECWQTNRFRPGDDD

SEQ ID NO: 1464355 - protein, 29 aa, Mycobacterium tuberculosis
PASGRPLAMPRLDMVTGLYYLTTEVPGDT

SEQ ID NO: 1464356 - protein, 19 aa, Mycobacterium tuberculosis
PASRYPYSRDGVIAVPAQA

SEQ ID NO: 1464357 - protein, 20 aa, Mycobacterium tuberculosis
PATRAVVIYLEYLGTTIGDL

SEQ ID NO: 1464358 - protein, 29 aa, Mycobacterium tuberculosis
PDGSWGAEFPFCYEDRLLSTLAAMISLTS

SEQ ID NO: 1464359 - protein, 18 aa, Mycobacterium tuberculosis
PDLGGRLRAGRSRNDQVA

SEQ ID NO: 1464360 - protein, 24 aa, Mycobacterium tuberculosis
PDYLVTFASLWASVNVEDWKCWAR

SEQ ID NO: 1464361 - protein, 21 aa, Mycobacterium tuberculosis
PEALADMVAIGQRIARAARAT

SEQ ID NO: 1464362 - protein, 23 aa, Mycobacterium tuberculosis
PEDYWPEQWAHAYVDFAAGEKRS

SEQ ID NO: 1464363 - protein, 18 aa, Mycobacterium tuberculosis
PEFFATIRAAGYTRVSLG

SEQ ID NO: 1464364 - protein, 27 aa, Mycobacterium tuberculosis
PEGKSIASFARRLQVAGVRVAAHTSHR

SEQ ID NO: 1464365 - protein, 17 aa, Mycobacterium tuberculosis
PERLGVLASHHDNAAVD

SEQ ID NO: 1464366 - protein, 21 aa, Mycobacterium tuberculosis
PEVAAEFGAGLVCAHTGGALP

SEQ ID NO: 1464367 - protein, 19 aa, Mycobacterium tuberculosis
PEVIASPTPAAAGRVQAWV

SEQ ID NO: 1464368 - protein, 22 aa, Mycobacterium tuberculosis
PFGGAYRLIDFVLSNLVNARYL

SEQ ID NO: 1464369 - protein, 24 aa, Mycobacterium tuberculosis
PGIPFGAAVGSGFARLNFATTRAI

SEQ ID NO: 1464370 - protein, 19 aa, Mycobacterium tuberculosis
PGLELSTGIALAFPRGPFV

SEQ ID NO: 1464371 - protein, 19 aa, Mycobacterium tuberculosis
PGMGHAIELRVYRFGGSLH

SEQ ID NO: 1464372 - protein, 23 aa, Mycobacterium tuberculosis
PGPPRELQPIWSKAIQTAPVQDA

SEQ ID NO: 1464373 - protein, 19 aa, Mycobacterium tuberculosis
PGPTRLRVADLLRATDQAA

SEQ ID NO: 1464374 - protein, 23 aa, Mycobacterium tuberculosis
PGRAIPFGAFRHLISLPASGADI

SEQ ID NO: 1464375 - protein, 19 aa, Mycobacterium tuberculosis
PGRVWPLLQRNKSALADIG

SEQ ID NO: 1464376 - protein, 23 aa, Mycobacterium tuberculosis
PHHTRLRKIISRGFTPRAVGRLH

SEQ ID NO: 1464377 - protein, 18 aa, Mycobacterium tuberculosis
PIGAHRVLVLAGRIHAYE

SEQ ID NO: 1464378 - protein, 18 aa, Mycobacterium tuberculosis
PKGKWGMVTAEDLQNATP

SEQ ID NO: 1464379 - protein, 18 aa, Mycobacterium tuberculosis
PKHARRCVFWEVDPAILG

SEQ ID NO: 1464380 - protein, 18 aa, Mycobacterium tuberculosis
PKPGQKWVNVDPTKNKSG

SEQ ID NO: 1464381 - protein, 17 aa, Mycobacterium tuberculosis
PLHVAVYRRVIAEFNGG

SEQ ID NO: 1464382 - protein, 21 aa, Mycobacterium tuberculosis
PLRIHCDGATDFARIPGSGID

SEQ ID NO: 1464383 - protein, 21 aa, Mycobacterium tuberculosis
PNRDPITGVHFVFVSNSSPWT

SEQ ID NO: 1464384 - protein, 25 aa, Mycobacterium tuberculosis
PPARYFGPNLSRLSAVRQKYDPSRV

SEQ ID NO: 1464385 - protein, 33 aa, Mycobacterium tuberculosis; identical to SEQ ID NO: 204245

SEQ ID NO: 1464386 - protein, 18 aa, Mycobacterium tuberculosis
PPIYFGFGSMPIGSLADR

SEQ ID NO: 1464387 - protein, 19 aa, Mycobacterium tuberculosis
PPKGPNWAAMPTVRTPAGG

SEQ ID NO: 1464388 - protein, 28 aa, Mycobacterium tuberculosis
PPVITAPEGWAFEYSRFQEAQKREIVEH

SEQ ID NO: 1464389 - protein, 21 aa, Mycobacterium tuberculosis
PQGIDYVCGFYAAIKAGTVAV

SEQ ID NO: 1464390 - protein, 19 aa, Mycobacterium tuberculosis
PRIAAHLGVASPVPVGLGS

SEQ ID NO: 1464391 - protein, 17 aa, Mycobacterium tuberculosis
PRYGEGVYALRNMDEGF

SEQ ID NO: 1464392 - protein, 17 aa, Mycobacterium tuberculosis
PRYLIGRKILTPPARPV

SEQ ID NO: 1464393 - protein, 18 aa, Mycobacterium tuberculosis
PSAVWTTWLPVAETPHTR

SEQ ID NO: 1464394 - protein, 31 aa, Mycobacterium tuberculosis
PTAATDVRAAWDWLAHVCGLAAEHMVIAADS

SEQ ID NO: 1464395 - protein, 23 aa, Mycobacterium tuberculosis
PTFSARLTAVAGRRVATGRDFDS

SEQ ID NO: 1464396 - protein, 23 aa, Mycobacterium tuberculosis
PTGVLHWNRRVQAWLAEETGQPP

SEQ ID NO: 1464397 - protein, 21 aa, Mycobacterium tuberculosis
PVAPRRAGGAVAEVYAEARRE

SEQ ID NO: 1464398 - protein, 22 aa, Mycobacterium tuberculosis
PVCDLGRQIGYLLASQEPALAE

SEQ ID NO: 1464399 - protein, 24 aa, Mycobacterium tuberculosis
PVHAATLLPFIGRLLAARYAELNT

SEQ ID NO: 1464400 - protein, 20 aa, Mycobacterium tuberculosis
PVIDCARPQSNHAFGAEPGV

SEQ ID NO: 1464401 - protein, 21 aa, Mycobacterium tuberculosis
PVIGAPWLVAFAERSRFFEVF

SEQ ID NO: 1464402 - protein, 21 aa, Mycobacterium tuberculosis
PVVDPRARIVILVDDGIATGA

SEQ ID NO: 1464403 - protein, 20 aa, Mycobacterium tuberculosis
PVYNPWDQRLCAVPDADMFK

SEQ ID NO: 1464404 - protein, 27 aa, Mycobacterium tuberculosis
PWPEDYELMGVPFAKRGKRIDECIEIV

SEQ ID NO: 1464405 - protein, 22 aa, Mycobacterium tuberculosis
PYLIRLPVGAGLVFATSDVWPR

SEQ ID NO: 1464406 - protein, 21 aa, Mycobacterium tuberculosis
QAAAIHEMFVNTLQMSSGSYA

SEQ ID NO: 1464407 - protein, 23 aa, Mycobacterium tuberculosis
QAGIDVAVCKPVQTGTARGDDDL

SEQ ID NO: 1464408 - protein, 20 aa, Mycobacterium tuberculosis
QAIRAGDCDLALAGGVCVMG

SEQ ID NO: 1464409 - protein, 18 aa, Mycobacterium tuberculosis
QALPPGSGGPVFGALDGG

SEQ ID NO: 1464410 - protein, 19 aa, Mycobacterium tuberculosis
QANSLLLRRLQAERPGDAV

SEQ ID NO: 1464411 - protein, 20 aa, Mycobacterium tuberculosis
QAQQIEWSKVHLFWGDERYV

SEQ ID NO: 1464412 - protein, 19 aa, Mycobacterium tuberculosis
QCDRRVIAVIGDGALTGGV

SEQ ID NO: 1464413 - protein, 23 aa, Mycobacterium tuberculosis
QDIRAAAELALPHRRRRDPFDDH

SEQ ID NO: 1464414 - protein, 21 aa, Mycobacterium tuberculosis
QEELWLLRGGDPGQPGLLPPA

SEQ ID NO: 1464415 - protein, 18 aa, Mycobacterium tuberculosis
QEPDDVASWGRVDLGAAI

SEQ ID NO: 1464416 - protein, 25 aa, Mycobacterium tuberculosis
QGDLWAAPSGWRGGGHMAPVRTAMR

SEQ ID NO: 1464417 - protein, 32 aa, Mycobacterium tuberculosis
QGLRLADKLTPWRAVDGWRTAAVSAFGMSGTN

SEQ ID NO: 1464418 - protein, 19 aa, Mycobacterium tuberculosis
QHWGDAMMTDGRWDPGKDF

SEQ ID NO: 1464419 - protein, 25 aa, Mycobacterium tuberculosis
QKVQEVKLGLARPVWIDDRDFDITY

SEQ ID NO: 1464420 - protein, 29 aa, Mycobacterium tuberculosis
QLAEIVGAYFPRGWQIACHVHGDGGVDTI

SEQ ID NO: 1464421 - protein, 24 aa, Mycobacterium tuberculosis
QLEELYRRMWVLRLLDMALEQLRI

SEQ ID NO: 1464422 - protein, 24 aa, Mycobacterium tuberculosis
QLRHEFGDAVAIIGRPAYTPAGLA

SEQ ID NO: 1464423 - protein, 18 aa, Mycobacterium tuberculosis
QNAPAIAAAEAMYEQMWA

SEQ ID NO: 1464424 - protein, 19 aa, Mycobacterium tuberculosis
QPAAVGRVVVLSGPSAVGK

SEQ ID NO: 1464425 - protein, 17 aa, Mycobacterium tuberculosis
QPLSDAGPTGWRIRVRL

SEQ ID NO: 1464426 - protein, 19 aa, Mycobacterium tuberculosis
QPQLRMSGYNLAAIAAGLP

SEQ ID NO: 1464427 - protein, 17 aa, Mycobacterium tuberculosis
QQPGFRGERLVNSMFTL

SEQ ID NO: 1464428 - protein, 23 aa, Mycobacterium tuberculosis
QQRAWLNLVQPLTIVEGFALLSV

SEQ ID NO: 1464429 - protein, 21 aa, Mycobacterium tuberculosis
QRFLAEQGYGYIIRDADDLLG

SEQ ID NO: 1464430 - protein, 19 aa, Mycobacterium tuberculosis
QRPARWMHLMASDFHAFSA

SEQ ID NO: 1464431 - protein, 24 aa, Mycobacterium tuberculosis
QRVVCGGISIPGRWDPTPEPEITE

SEQ ID NO: 1464432 - protein, 22 aa, Mycobacterium tuberculosis
QTVWKRHHRWSLDGTCDEVFAH

SEQ ID NO: 1464433 - protein, 19 aa, Mycobacterium tuberculosis
QVRMAVLFHVLVGAQDAGK

SEQ ID NO: 1464434 - protein, 22 aa, Mycobacterium tuberculosis
RAAMPNTVWTTGCDSWYLNKDG

SEQ ID NO: 1464435 - protein, 21 aa, Mycobacterium tuberculosis
RAATHAALWAVDEAVNRDIPL

SEQ ID NO: 1464436 - protein, 19 aa, Mycobacterium tuberculosis
RACTPVWSGVGLHRPAEFN

SEQ ID NO: 1464437 - protein, 19 aa, Mycobacterium tuberculosis
RALIEIRLCNERATPMPIP

SEQ ID NO: 1464438 - protein, 21 aa, Mycobacterium tuberculosis
RALTRAAAFIHHLPVDQVFTL

SEQ ID NO: 1464439 - protein, 19 aa, Mycobacterium tuberculosis
RASGLEVRDEFVVGSLAGP

SEQ ID NO: 1464440 - protein, 19 aa, Mycobacterium tuberculosis
RDGKVCALWDIANPDKFTG

SEQ ID NO: 1464441 - protein, 23 aa, Mycobacterium tuberculosis
RDGMAGWYFTKWQRVLNDGLDAV

SEQ ID NO: 1464442 - protein, 21 aa, Mycobacterium tuberculosis
RDTLLWAKLIDKYQGTMTAAP

SEQ ID NO: 1464443 - protein, 19 aa, Mycobacterium tuberculosis
RDVVAGLVSDIAWDTPVST

SEQ ID NO: 1464444 - protein, 24 aa, Mycobacterium tuberculosis
REDLPSAIYHRFGRVHTYAKARKT

SEQ ID NO: 1464445 - protein, 21 aa, Mycobacterium tuberculosis
REQALRFGADLRMEDVESVSL

SEQ ID NO: 1464446 - protein, 22 aa, Mycobacterium tuberculosis
RGCSRPGCDAPAYHSEVHHVTP

SEQ ID NO: 1464447 - protein, 28 aa, Mycobacterium tuberculosis
RGEIARRVFATCRRLGLGTVAVYTDPDA

SEQ ID NO: 1464448 - protein, 24 aa, Mycobacterium tuberculosis
RGLDHSRLLIASVEVFGHCDLRAM

SEQ ID NO: 1464449 - protein, 27 aa, Mycobacterium tuberculosis
RGLRRTHGWPAAMGILREMGMAHHRKW

SEQ ID NO: 1464450 - protein, 17 aa, Mycobacterium tuberculosis
RGPNLFENMGFTYIGPV

SEQ ID NO: 1464451 - protein, 20 aa, Mycobacterium tuberculosis
RGPQVPFTDVFLHGLIRDES

SEQ ID NO: 1464452 - protein, 23 aa, Mycobacterium tuberculosis
RGRRRICWQAYLGAETDSHPLGT

SEQ ID NO: 1464453 - protein, 20 aa, Mycobacterium tuberculosis
RGVPPTRLRLIYLADGQLLD

SEQ ID NO: 1464454 - protein, 20 aa, Mycobacterium tuberculosis
RHLEACPGCLRHYGLEERIK

SEQ ID NO: 1464455 - protein, 20 aa, Mycobacterium tuberculosis
RHPWPAPARCCRHEWRTMRR

SEQ ID NO: 1464456 - protein, 24 aa, Mycobacterium tuberculosis
RHRAMIQAFVQWRAQSRSELTEVG

SEQ ID NO: 1464457 - protein, 17 aa, Mycobacterium tuberculosis
RIFCVRADIAVEGTAVT

SEQ ID NO: 1464458 - protein, 18 aa, Mycobacterium tuberculosis
RITTTGGIGPIVIPDTTI

SEQ ID NO: 1464459 - protein, 27 aa, Mycobacterium tuberculosis
RITVPAFGIPFTLQFQTNVPALQPPGG

SEQ ID NO: 1464460 - protein, 24 aa, Mycobacterium tuberculosis
RIVSPRTGSLLDHAQRVAEGRLLD

SEQ ID NO: 1464461 - protein, 17 aa, Mycobacterium tuberculosis
RKGKIVVEFGSVDDLAR

SEQ ID NO: 1464462 - protein, 19 aa, Mycobacterium tuberculosis
RLAAHLRFLGQVDDAGKAS

SEQ ID NO: 1464463 - protein, 18 aa, Mycobacterium tuberculosis
RLASVLRRCTVLDAHLRG

SEQ ID NO: 1464464 - protein, 20 aa, Mycobacterium tuberculosis
RLDIPAATAVRFEPGIPQIV

SEQ ID NO: 1464465 - protein, 32 aa, Mycobacterium tuberculosis
RLEAARLLGWERIPVHVCHTIADVVDRAKAER

SEQ ID NO: 1464466 - protein, 20 aa, Mycobacterium tuberculosis
RLGVGYTVERRGRRRAEPLG

SEQ ID NO: 1464467 - protein, 23 aa, Mycobacterium tuberculosis
RLLAEPTAWLFGPEAHGLSAEIA

SEQ ID NO: 1464468 - protein, 22 aa, Mycobacterium tuberculosis
RLLRSGGVIVVHRAALGGRAGD

SEQ ID NO: 1464469 - protein, 18 aa, Mycobacterium tuberculosis
RLMRFDKHGPLDLILYHD

SEQ ID NO: 1464470 - protein, 30 aa, Mycobacterium tuberculosis; identical to SEQ ID NO: 205571

SEQ ID NO: 1464471 - protein, 17 aa, Mycobacterium tuberculosis
RLRDVRNGMSIPPALTL

SEQ ID NO: 1464472 - protein, 18 aa, Mycobacterium tuberculosis
RLREFSAKAGRQVFKDYV

SEQ ID NO: 1464473 - protein, 24 aa, Mycobacterium tuberculosis
RLTDPKAGPLIAVKLHILTRKTLG

SEQ ID NO: 1464474 - protein, 18 aa, Mycobacterium tuberculosis
RLWQEVAGLPAERIQRRG

SEQ ID NO: 1464475 - protein, 22 aa, Mycobacterium tuberculosis
RMALPPCHAFFQFYVADGRLSC

SEQ ID NO: 1464476 - protein, 26 aa, Mycobacterium tuberculosis
RNVTHGCINLSPANAKWFYDNFGSGD

SEQ ID NO: 1464477 - protein, 21 aa, Mycobacterium tuberculosis
RPCDAPGWFLYLTDIPRAGVE

SEQ ID NO: 1464478 - protein, 25 aa, Mycobacterium tuberculosis
RPDETVPCLTQRQVLDQAPDAVDGR

SEQ ID NO: 1464479 - protein, 18 aa, Mycobacterium tuberculosis
RPGAELRRLTPRNTDQLL

SEQ ID NO: 1464480 - protein, 19 aa, Mycobacterium tuberculosis
RPLMSDAMLRVFFEAYEIV

SEQ ID NO: 1464481 - protein, 26 aa, Mycobacterium tuberculosis
RPLYYLEMPPALFAPIVENLANVRLL

SEQ ID NO: 1464482 - protein, 19 aa, Mycobacterium tuberculosis
RPPRMLVLLHLDESVQRPS

SEQ ID NO: 1464483 - protein, 23 aa, Mycobacterium tuberculosis
RPSWLSSSAWPWQPYLLSHHQGG

SEQ ID NO: 1464484 - protein, 19 aa, Mycobacterium tuberculosis
RPTGTFTFAELLAHELSVE

SEQ ID NO: 1464485 - protein, 17 aa, Mycobacterium tuberculosis
RPYRIRIGIPAFGKSQW

SEQ ID NO: 1464486 - protein, 20 aa, Mycobacterium tuberculosis
RQAMLPGHAVVLHPGPMVRG

SEQ ID NO: 1464487 - protein, 19 aa, Mycobacterium tuberculosis
RQGIRVNALCPGPVNTPLL

SEQ ID NO: 1464488 - protein, 18 aa, Mycobacterium tuberculosis
RQGPGVLQHPDLVILRGR

SEQ ID NO: 1464489 - protein, 17 aa, Mycobacterium tuberculosis
RQRAAPVAPVLSARERE

SEQ ID NO: 1464490 - protein, 30 aa, Mycobacterium tuberculosis; identical to SEQ ID NO: 205778

SEQ ID NO: 1464491 - protein, 18 aa, Mycobacterium tuberculosis
RQTDQRWAELVYDGLWYS

SEQ ID NO: 1464492 - protein, 26 aa, Mycobacterium tuberculosis
RRAAELGVTCSIFVDQIHYWGDVIVD

SEQ ID NO: 1464493 - protein, 25 aa, Mycobacterium tuberculosis
RRAILRYPKWRVAEIDGELETVALD

SEQ ID NO: 1464494 - protein, 17 aa, Mycobacterium tuberculosis
RRDRMVLVEVVLPRLEI

SEQ ID NO: 1464495 - protein, 26 aa, Mycobacterium tuberculosis
RREDKPFWWAHFDRLNYPVDEWSDST

SEQ ID NO: 1464496 - protein, 17 aa, Mycobacterium tuberculosis
RRGGLSFDLRRINPAEL

SEQ ID NO: 1464497 - protein, 18 aa, Mycobacterium tuberculosis
RRIEPLLATLRAIAVDVD

SEQ ID NO: 1464498 - protein, 25 aa, Mycobacterium tuberculosis
RRISIPSCRPGWCGPITASTECWDV

SEQ ID NO: 1464499 - protein, 19 aa, Mycobacterium tuberculosis
RRLHGCGLEIEWVGTGKRV

SEQ ID NO: 1464500 - protein, 17 aa, Mycobacterium tuberculosis
RRLRRCDRGLGMLADQR

SEQ ID NO: 1464501 - protein, 20 aa, Mycobacterium tuberculosis
RRNDPLLGRHVIITGASSGI

SEQ ID NO: 1464502 - protein, 17 aa, Mycobacterium tuberculosis
RRRGHRPVRTAVLAATT

SEQ ID NO: 1464503 - protein, 17 aa, Mycobacterium tuberculosis
RRRLRMICHGLGHVEGF

SEQ ID NO: 1464504 - protein, 22 aa, Mycobacterium tuberculosis
RRRRLIKYISQIDVERYRSLIE

SEQ ID NO: 1464505 - protein, 21 aa, Mycobacterium tuberculosis
RRVQLASLLVGEWDVIALDEP

SEQ ID NO: 1464506 - protein, 17 aa, Mycobacterium tuberculosis
RSTRGAIAQTWWSERFI

SEQ ID NO: 1464507 - protein, 17 aa, Mycobacterium tuberculosis
RTFTWKPLSGVNVPHVG

SEQ ID NO: 1464508 - protein, 19 aa, Mycobacterium tuberculosis
RTPIPKVYLCSAATPPGAG

SEQ ID NO: 1464509 - protein, 21 aa, Mycobacterium tuberculosis
RTYQPRIVFVDAYNKPIDMGH

SEQ ID NO: 1464510 - protein, 17 aa, Mycobacterium tuberculosis
RVAATASVLADWLDGPG

SEQ ID NO: 1464511 - protein, 25 aa, Mycobacterium tuberculosis
RVAGILAAAGWPLAGVDVGESESGS

SEQ ID NO: 1464512 - protein, 17 aa, Mycobacterium tuberculosis
RVFAELSPHPLLTHAVD

SEQ ID NO: 1464513 - protein, 17 aa, Mycobacterium tuberculosis
RVGARLIHVSTDYVFDG

SEQ ID NO: 1464514 - protein, 22 aa, Mycobacterium tuberculosis
RVHAAGARWILDLGPGDILTRL

SEQ ID NO: 1464515 - protein, 17 aa, Mycobacterium tuberculosis
RVLEMVASIQGVRPPTR

SEQ ID NO: 1464516 - protein, 27 aa, Mycobacterium tuberculosis
RVQPGCDAWCLAALAAVLVQENLCNEA

SEQ ID NO: 1464517 - protein, 19 aa, Mycobacterium tuberculosis
RVRATLVLDGDTLRVETNS

SEQ ID NO: 1464518 - protein, 17 aa, Mycobacterium tuberculosis
RVVGHKVGLSSPIMQQM

SEQ ID NO: 1464519 - protein, 23 aa, Mycobacterium tuberculosis
RVYPEMPENLVAVVQDGWRNIRR

SEQ ID NO: 1464520 - protein, 20 aa, Mycobacterium tuberculosis
RWARERAQRAVSGMASVAIA

SEQ ID NO: 1464521 - protein, 19 aa, Mycobacterium tuberculosis
RWMTAAALVRPRGAGGVVT

SEQ ID NO: 1464522 - protein, 17 aa, Mycobacterium tuberculosis
RYGTALGATELDAESPQ

SEQ ID NO: 1464523 - protein, 24 aa, Mycobacterium tuberculosis
RYMLDRRRALGGFVPERRTKSKAL

SEQ ID NO: 1464524 - protein, 19 aa, Mycobacterium tuberculosis
RYVAECLAVARAEGARLDD

SEQ ID NO: 1464525 - protein, 17 aa, Mycobacterium tuberculosis
SAGRIAVIGGYAHLGVP

SEQ ID NO: 1464526 - protein, 17 aa, Mycobacterium tuberculosis
SAGRIVWDPVNGTLNGL

SEQ ID NO: 1464527 - protein, 21 aa, Mycobacterium tuberculosis
SAPRPAPFRLRVVKRHTLGYD

SEQ ID NO: 1464528 - protein, 18 aa, Mycobacterium tuberculosis
SARMGRFGDVDRLAERAS

SEQ ID NO: 1464529 - protein, 27 aa, Mycobacterium tuberculosis
SDGSIFLRPFLKYQIITVVAPNSPLAA

SEQ ID NO: 1464530 - protein, 17 aa, Mycobacterium tuberculosis
SDLLRPWANWVTPEAEL

SEQ ID NO: 1464531 - protein, 19 aa, Mycobacterium tuberculosis
SDMHAPILVISQFTLYADT

SEQ ID NO: 1464532 - protein, 18 aa, Mycobacterium tuberculosis
SDPWRKLSANRDNRVFVV

SEQ ID NO: 1464533 - protein, 18 aa, Mycobacterium tuberculosis
SDVAGRAAPLPAPPPSGC

SEQ ID NO: 1464534 - protein, 17 aa, Mycobacterium tuberculosis
SEGATPCEIAADELPQA

SEQ ID NO: 1464535 - protein, 22 aa, Mycobacterium tuberculosis
SEKHFRRARGRKVELVLSDGSR

SEQ ID NO: 1464536 - protein, 25 aa, Mycobacterium tuberculosis
SELPSRLAANPSIAGWLRELEAVCT

SEQ ID NO: 1464537 - protein, 17 aa, Mycobacterium tuberculosis
SGARFTPYLSVPGAENA

SEQ ID NO: 1464538 - protein, 17 aa, Mycobacterium tuberculosis
SGDVLMVAWMNDEALAR

SEQ ID NO: 1464539 - protein, 20 aa, Mycobacterium tuberculosis
SGLQRRLGTTTVYVTHDQVE

SEQ ID NO: 1464540 - protein, 19 aa, Mycobacterium tuberculosis
SGPARWFLDHARVALSSGH

SEQ ID NO: 1464541 - protein, 24 aa, Mycobacterium tuberculosis
SGQPLDWFCLFSSAAALTGSPGQS

SEQ ID NO: 1464542 - protein, 20 aa, Mycobacterium tuberculosis
SGSGPAYFFLLVEALVDAGV

SEQ ID NO: 1464543 - protein, 17 aa, Mycobacterium tuberculosis
SIPTVQSLIRWDPVGHA

SEQ ID NO: 1464544 - protein, 25 aa, Mycobacterium tuberculosis
SISPITVRIDPVFDLGPITVQDITI

SEQ ID NO: 1464545 - protein, 24 aa, Mycobacterium tuberculosis
SITMAAAVAPYVAWISVTAGQAEQ

SEQ ID NO: 1464546 - protein, 22 aa, Mycobacterium tuberculosis
SLPDAMGALLARSIVGIVEQVE

SEQ ID NO: 1464547 - protein, 23 aa, Mycobacterium tuberculosis
SLQTETRLAAPLLAKGLPACPGV

SEQ ID NO: 1464548 - protein, 17 aa, Mycobacterium tuberculosis
SMCTEWAPRYVGSSDPR

SEQ ID NO: 1464549 - protein, 23 aa, Mycobacterium tuberculosis
SMEQGRLAAYHAFGEPTDGITEL

SEQ ID NO: 1464550 - protein, 17 aa, Mycobacterium tuberculosis
SMGGARALEWVVGYPDR

SEQ ID NO: 1464551 - protein, 17 aa, Mycobacterium tuberculosis
SMHGDPLLAPSALDSLR

SEQ ID NO: 1464552 - protein, 24 aa, Mycobacterium tuberculosis
SPAQVRVGFRLGEPAAGELGVRDA

SEQ ID NO: 1464553 - protein, 24 aa, Mycobacterium tuberculosis
SPHLGTLEVRICDGVSNLRELGAL

SEQ ID NO: 1464554 - protein, 17 aa, Mycobacterium tuberculosis
SPPEVHSALLSSGPGPG

SEQ ID NO: 1464555 - protein, 24 aa, Mycobacterium tuberculosis
SPSLRRPQPLFSLVNFFDAQVGPL

SEQ ID NO: 1464556 - protein, 32 aa, Mycobacterium tuberculosis; identical to SEQ ID NO: 206598

SEQ ID NO: 1464557 - protein, 33 aa, Mycobacterium tuberculosis; identical to SEQ ID NO: 211795

SEQ ID NO: 1464558 - protein, 20 aa, Mycobacterium tuberculosis
SRGAPWRRVESRAVDGVSFR

SEQ ID NO: 1464559 - protein, 24 aa, Mycobacterium tuberculosis
SRLPRWRAMAAHALCKRDDLARQK

SEQ ID NO: 1464560 - protein, 17 aa, Mycobacterium tuberculosis
SRLRPLLPDTPATATLR

SEQ ID NO: 1464561 - protein, 25 aa, Mycobacterium tuberculosis
SRLTKPPLLVPVLRAGLGMVDEAHA

SEQ ID NO: 1464562 - protein, 17 aa, Mycobacterium tuberculosis
SRQIAMYLCRELTDLSL

SEQ ID NO: 1464563 - protein, 23 aa, Mycobacterium tuberculosis
SRVRVWCGGTLVADHDRIWAKHQ

SEQ ID NO: 1464564 - protein, 19 aa, Mycobacterium tuberculosis
SRYQPGRRCASWVKDKHWN

SEQ ID NO: 1464565 - protein, 23 aa, Mycobacterium tuberculosis
SSPDEIAHILVLHSEFDGGFTSE

SEQ ID NO: 1464566 - protein, 22 aa, Mycobacterium tuberculosis
SSYHAELFWWTGAFETSEGIPH

SEQ ID NO: 1464567 - protein, 19 aa, Mycobacterium tuberculosis
STIGRRLAKALGVGLLDTD

SEQ ID NO: 1464568 - protein, 23 aa, Mycobacterium tuberculosis
STLSRTAFQLGVLERGLQMTAEY

SEQ ID NO: 1464569 - protein, 17 aa, Mycobacterium tuberculosis
SVATIAWMGYHPPPNPL

SEQ ID NO: 1464570 - protein, 22 aa, Mycobacterium tuberculosis
SVPRTLAGLTIVVTGSLTGFSR

SEQ ID NO: 1464571 - protein, 24 aa, Mycobacterium tuberculosis
SVQRESGIEFGRYLTEAVCEPLGM

SEQ ID NO: 1464572 - protein, 22 aa, Mycobacterium tuberculosis
SVRARWERRLAEVGVDRLHAEL

SEQ ID NO: 1464573 - protein, 21 aa, Mycobacterium tuberculosis
SWLPCFHDMGMVGFLTIPMFF

SEQ ID NO: 1464574 - protein, 18 aa, Mycobacterium tuberculosis
SYQIYRLDAVPNTAKLPY

SEQ ID NO: 1464575 - protein, 24 aa, Mycobacterium tuberculosis
TAETWPNPWPMYRALRDHDPVHHV

SEQ ID NO: 1464576 - protein, 17 aa, Mycobacterium tuberculosis
TAHSIRLAKACAAEGAH

SEQ ID NO: 1464577 - protein, 18 aa, Mycobacterium tuberculosis
TAIVARVPVRAFINPANR

SEQ ID NO: 1464578 - protein, 29 aa, Mycobacterium tuberculosis
TANAYLGAWGIVDCFERGADVVVTGRVTD

SEQ ID NO: 1464579 - protein, 18 aa, Mycobacterium tuberculosis
TAPTAIGLRGIYRGIAGA

SEQ ID NO: 1464580 - protein, 22 aa, Mycobacterium tuberculosis
TAQKYPAILAMTSLNDTRVYYV

SEQ ID NO: 1464581 - protein, 17 aa, Mycobacterium tuberculosis
TATGIWYLQDRVIVAEF

SEQ ID NO: 1464582 - protein, 24 aa, Mycobacterium tuberculosis
TAVAARLWPTTALIVDHGLQPGSA

SEQ ID NO: 1464583 - protein, 27 aa, Mycobacterium tuberculosis
TAVPVKLHVPIFLDIPVTGTLGTFTVH

SEQ ID NO: 1464584 - protein, 23 aa, Mycobacterium tuberculosis
TEFAELRPRLVYDRDTGTLTARP

SEQ ID NO: 1464585 - protein, 21 aa, Mycobacterium tuberculosis
TELRTTGWFTGLVPITVPVAS

SEQ ID NO: 1464586 - protein, 20 aa, Mycobacterium tuberculosis
TGCAEMFRIGYIDVNQFTCQ

SEQ ID NO: 1464587 - protein, 25 aa, Mycobacterium tuberculosis
TGGAGAIGMHYARYLAEHGARRIVL

SEQ ID NO: 1464588 - protein, 25 aa, Mycobacterium tuberculosis
TGKFEWLDNDVVQWVPDRFWPAHST

SEQ ID NO: 1464589 - protein, 23 aa, Mycobacterium tuberculosis
TGLRAGRNGGFALVIAVDAHGDA

SEQ ID NO: 1464590 - protein, 33 aa, Mycobacterium tuberculosis
TGNFSNGILWRGDYQGLAGFAVGYTLPLFPAVG

SEQ ID NO: 1464591 - protein, 28 aa, Mycobacterium tuberculosis
TGVGSCRDSAWLLVSILRQFGLAARFVS

SEQ ID NO: 1464592 - protein, 23 aa, Mycobacterium tuberculosis
THDSGRVLVMIGVRSREPIVELL

SEQ ID NO: 1464593 - protein, 19 aa, Mycobacterium tuberculosis
THLGLPADFLLDADGTVAA

SEQ ID NO: 1464594 - protein, 17 aa, Mycobacterium tuberculosis
TIIDKWLPLSWSLNMVN

SEQ ID NO: 1464595 - protein, 19 aa, Mycobacterium tuberculosis
TKDHIEAIANWDPKAEPSI

SEQ ID NO: 1464596 - protein, 22 aa, Mycobacterium tuberculosis
TKIRLLTRIAFGFRSPEALIAL

SEQ ID NO: 1464597 - protein, 24 aa, Mycobacterium tuberculosis
TLDGRFRVPFVMRAEEKLLSYNRN

SEQ ID NO: 1464598 - protein, 21 aa, Mycobacterium tuberculosis
TLLRLLHPVIPFLTEALWLAL

SEQ ID NO: 1464599 - protein, 24 aa, Mycobacterium tuberculosis
TLRRWRYGRRRHVRSLGSQVIDVR

SEQ ID NO: 1464600 - protein, 28 aa, Mycobacterium tuberculosis
TMADPGSVSYLFSRKGVVTLEKNGLTED

SEQ ID NO: 1464601 - protein, 17 aa, Mycobacterium tuberculosis
TMFAHGYTFGGHPVSAA

SEQ ID NO: 1464602 - protein, 21 aa, Mycobacterium tuberculosis
TMVELLPRFETITYRELWARA

SEQ ID NO: 1464603 - protein, 22 aa, Mycobacterium tuberculosis
TRDETIAAIAARAADLDVLGAD

SEQ ID NO: 1464604 - protein, 20 aa, Mycobacterium tuberculosis
TRGLLAPGCFIPVAESINLA

SEQ ID NO: 1464605 - protein, 24 aa, Mycobacterium tuberculosis
TRVPGIGKRGAERMVLELRDKVGV

SEQ ID NO: 1464606 - protein, 27 aa, Mycobacterium tuberculosis
TSGEQRLSGFLLWQSAYSEMWFTEAHW

SEQ ID NO: 1464607 - protein, 25 aa, Mycobacterium tuberculosis
TVIARDRAEAIAGLRALAAGQPRVG

SEQ ID NO: 1464608 - protein, 17 aa, Mycobacterium tuberculosis
TVRFAHRHQVDKLIVEG

SEQ ID NO: 1464609 - protein, 24 aa, Mycobacterium tuberculosis
TWLADHLRRRWARNTGGLLVVTHD

SEQ ID NO: 1464610 - protein, 23 aa, Mycobacterium tuberculosis
TYAFQRRRFWLSGDGVAADAAGL

SEQ ID NO: 1464611 - protein, 17 aa, Mycobacterium tuberculosis
TYGLIVYQEQIMRIAQK

SEQ ID NO: 1464612 - protein, 23 aa, Mycobacterium tuberculosis
TYMRAIWTGSIAFGLVNVPVKVY

SEQ ID NO: 1464613 - protein, 27 aa, Mycobacterium tuberculosis
VAANRARLAAAIGLPGNRVVWMNQVHG

SEQ ID NO: 1464614 - protein, 21 aa, Mycobacterium tuberculosis
VAARRAGVPITELTETLPSGT

SEQ ID NO: 1464615 - protein, 29 aa, Mycobacterium tuberculosis
VAFLRAGDAIACALELQLSTLAPMRPRVG

SEQ ID NO: 1464616 - protein, 31 aa, Mycobacterium tuberculosis
VALAAEICDGWLPIFYSPRMAGMYNEWLDEG

SEQ ID NO: 1464617 - protein, 19 aa, Mycobacterium tuberculosis
VAQLAPWQQVLRNLGIDIG

SEQ ID NO: 1464618 - protein, 19 aa, Mycobacterium tuberculosis
VAQLHVWARREHPTYEDIV

SEQ ID NO: 1464619 - protein, 17 aa, Mycobacterium tuberculosis
VARGVSVYAALKRAADT

SEQ ID NO: 1464620 - protein, 23 aa, Mycobacterium tuberculosis
VARHLVSRYGVRQVVLASRAGEH

SEQ ID NO: 1464621 - protein, 20 aa, Mycobacterium tuberculosis
VARRLAREEGLLVGISSGAA

SEQ ID NO: 1464622 - protein, 27 aa, Mycobacterium tuberculosis
VAVDLRDDWPAALIAAGFDGTQPTAWL

SEQ ID NO: 1464623 - protein, 23 aa, Mycobacterium tuberculosis
VAVKRGREAAAWLPNNPETGCKS

SEQ ID NO: 1464624 - protein, 22 aa, Mycobacterium tuberculosis
VAVLLRITEVFGVDATFFASQD

SEQ ID NO: 1464625 - protein, 24 aa, Mycobacterium tuberculosis
VAVRRISMSFVNVAPQLVSTAAAD

SEQ ID NO: 1464626 - protein, 18 aa, Mycobacterium tuberculosis
VDAISGWWNTGAATEADG

SEQ ID NO: 1464627 - protein, 18 aa, Mycobacterium tuberculosis
VDFYDKFGYDRPVYTLSH

SEQ ID NO: 1464628 - protein, 18 aa, Mycobacterium tuberculosis
VDGARWLSLEGRAAVNSD

SEQ ID NO: 1464629 - protein, 19 aa, Mycobacterium tuberculosis
VDIGRGRNGVLYAGEVNWD

SEQ ID NO: 1464630 - protein, 20 aa, Mycobacterium tuberculosis
VDRTGCRDALRRDGADTVVT

SEQ ID NO: 1464631 - protein, 25 aa, Mycobacterium tuberculosis
VDTHFGRLVRRWRWTTAEDPVKVEQ

SEQ ID NO: 1464632 - protein, 20 aa, Mycobacterium tuberculosis
VEAYVGLDSFRHLAKERALM

SEQ ID NO: 1464633 - protein, 24 aa, Mycobacterium tuberculosis
VEESRGRLSAVVQRELADEAYHGG

SEQ ID NO: 1464634 - protein, 18 aa, Mycobacterium tuberculosis
VERALIAGHDFVLLGERG

SEQ ID NO: 1464635 - protein, 17 aa, Mycobacterium tuberculosis
VERPHYMPLFVAPQPIP

SEQ ID NO: 1464636 - protein, 18 aa, Mycobacterium tuberculosis
VGCYVGASALEYGPALTE

SEQ ID NO: 1464637 - protein, 20 aa, Mycobacterium tuberculosis
VGDPSGFVKLVADAKHGELL

SEQ ID NO: 1464638 - protein, 35 aa, Mycobacterium tuberculosis
VGETAEFLRWTAGQALDASGYWPAPAVANYALSGE

SEQ ID NO: 1464639 - protein, 19 aa, Mycobacterium tuberculosis
VGGHPAKRTFQALRIAVND

SEQ ID NO: 1464640 - protein, 20 aa, Mycobacterium tuberculosis
VGGWDFSWLDGRATEERPSW

SEQ ID NO: 1464641 - protein, 18 aa, Mycobacterium tuberculosis
VGKFEFRASAVIVASGGI

SEQ ID NO: 1464642 - protein, 33 aa, Mycobacterium tuberculosis; identical to SEQ ID NO: 207779

SEQ ID NO: 1464643 - protein, 24 aa, Mycobacterium tuberculosis
VGMSVDCARYWLDADKPISKSDAV

SEQ ID NO: 1464644 - protein, 18 aa, Mycobacterium tuberculosis
VGRKLLAWERPLRKSDRE

SEQ ID NO: 1464645 - protein, 24 aa, Mycobacterium tuberculosis
VGSFKKGPFRIAMAAKIPIVPIVI

SEQ ID NO: 1464646 - protein, 18 aa, Mycobacterium tuberculosis
VGVLAGFPVEIAPTAQAL

SEQ ID NO: 1464647 - protein, 18 aa, Mycobacterium tuberculosis
VGVRSRFGAAVLGSRTIR

SEQ ID NO: 1464648 - protein, 17 aa, Mycobacterium tuberculosis
VHRADLIGQHIGETEAK

SEQ ID NO: 1464649 - protein, 40 aa, Mycobacterium tuberculosis; identical to SEQ ID NO: 211970

SEQ ID NO: 1464650 - protein, 19 aa, Mycobacterium tuberculosis
VLAQRCFELLTPALTRYYP

SEQ ID NO: 1464651 - protein, 24 aa, Mycobacterium tuberculosis
VLCAFGTALHPRFGPDSSARHRRS

SEQ ID NO: 1464652 - protein, 26 aa, Mycobacterium tuberculosis
VLGAGIPLFGICFGNQILGRALGLST

SEQ ID NO: 1464653 - protein, 18 aa, Mycobacterium tuberculosis
VMPGRPRPGYLPRVIDGA

SEQ ID NO: 1464654 - protein, 17 aa, Mycobacterium tuberculosis
VNHEPFVTLGIHIGART

SEQ ID NO: 1464655 - protein, 17 aa, Mycobacterium tuberculosis
VNSVSMRGVVVIGEGEK

SEQ ID NO: 1464656 - protein, 18 aa, Mycobacterium tuberculosis
VNVMLARDTIRRRLAGEG

SEQ ID NO: 1464657 - protein, 21 aa, Mycobacterium tuberculosis
VPATFDGTILIGDIPIPIIDV

SEQ ID NO: 1464658 - protein, 23 aa, Mycobacterium tuberculosis
VPEVLEVRGEVFFRLDDFQALNA

SEQ ID NO: 1464659 - protein, 19 aa, Mycobacterium tuberculosis
VPGMRAKLFDAARLAASAI

SEQ ID NO: 1464660 - protein, 25 aa, Mycobacterium tuberculosis
VPLGKTLRGYSAWVTGLRRVDAPTR

SEQ ID NO: 1464661 - protein, 18 aa, Mycobacterium tuberculosis
VPQGWSFAQAAAVPVVFL

SEQ ID NO: 1464662 - protein, 18 aa, Mycobacterium tuberculosis
VPRSLWFVDEVKRSPAGK

SEQ ID NO: 1464663 - protein, 17 aa, Mycobacterium tuberculosis
VPVVKVLAPGLVLSSAS

SEQ ID NO: 1464664 - protein, 18 aa, Mycobacterium tuberculosis
VQAAWAVLVAYFNRLRCG

SEQ ID NO: 1464665 - protein, 19 aa, Mycobacterium tuberculosis
VRAGARILLAPDGPDLRVQ

SEQ ID NO: 1464666 - protein, 17 aa, Mycobacterium tuberculosis
VREIPLAEIVKAVVQVE

SEQ ID NO: 1464667 - protein, 22 aa, Mycobacterium tuberculosis
VSESIPLNFSFGSPASTVKSMI

SEQ ID NO: 1464668 - protein, 25 aa, Mycobacterium tuberculosis
VSGMGLDWASVFSGYRPKRVELPTY

SEQ ID NO: 1464669 - protein, 17 aa, Mycobacterium tuberculosis
VSIPTLILFKDGQPVKR

SEQ ID NO: 1464670 - protein, 20 aa, Mycobacterium tuberculosis
VSLGKRKGKIVVEFGSVDDL

SEQ ID NO: 1464671 - protein, 18 aa, Mycobacterium tuberculosis
VSRLPAPLRRGQIRPLGL

SEQ ID NO: 1464672 - protein, 35 aa, Mycobacterium tuberculosis
VSSAQFPRPAPRSSYSALSSRQWALAGLTPLRHWR

SEQ ID NO: 1464673 - protein, 23 aa, Mycobacterium tuberculosis
VTYARIGERWRIGSDGLVLEVSA

SEQ ID NO: 1464674 - protein, 25 aa, Mycobacterium tuberculosis
VTYREVRAGHQVRWTILLDGAVRIS

SEQ ID NO: 1464675 - protein, 25 aa, Mycobacterium tuberculosis
VVIACGDCALNRGVFADAYGVVGAV

SEQ ID NO: 1464676 - protein, 17 aa, Mycobacterium tuberculosis
VVIEAPEGITFAVQAPT

SEQ ID NO: 1464677 - protein, 18 aa, Mycobacterium tuberculosis
VVIYLEYLGTTIGDLLGA

SEQ ID NO: 1464678 - protein, 18 aa, Mycobacterium tuberculosis
VVRGEACADSFYAALESA

SEQ ID NO: 1464679 - protein, 18 aa, Mycobacterium tuberculosis
VVSKPAALVHGMFVALPA

SEQ ID NO: 1464680 - protein, 24 aa, Mycobacterium tuberculosis
VVWNTILAIGFEWGVALQHLEIGK

SEQ ID NO: 1464681 - protein, 21 aa, Mycobacterium tuberculosis
VWLEAGKQGFLGMAVPEEYGG

SEQ ID NO: 1464682 - protein, 19 aa, Mycobacterium tuberculosis
VYLDKRLKPSLRQRVIAAW

SEQ ID NO: 1464683 - protein, 17 aa, Mycobacterium tuberculosis
WAAMPTVRTPAGGGDAH

SEQ ID NO: 1464684 - protein, 17 aa, Mycobacterium tuberculosis
WAEAYIPGAGWIGLDPT

SEQ ID NO: 1464685 - protein, 24 aa, Mycobacterium tuberculosis
WGGATYDVALRFLKEDPWERLATL

SEQ ID NO: 1464686 - protein, 26 aa, Mycobacterium tuberculosis
WKAGPALACGNAFVLKPSERDPSVPV

SEQ ID NO: 1464687 - protein, 19 aa, Mycobacterium tuberculosis
WKKVAPKLSAGRVQSVATR

SEQ ID NO: 1464688 - protein, 18 aa, Mycobacterium tuberculosis
WLAALRGSARLVIGTRSA

SEQ ID NO: 1464689 - protein, 20 aa, Mycobacterium tuberculosis
WLADTWRDRFEQMLQRAEAR

SEQ ID NO: 1464690 - protein, 20 aa, Mycobacterium tuberculosis
WLHPPGIDFGPALLADVQVA

SEQ ID NO: 1464691 - protein, 28 aa, Mycobacterium tuberculosis
WMSPTQVRWRPFEFWPANTAVNIDAAGT

SEQ ID NO: 1464692 - protein, 25 aa, Mycobacterium tuberculosis
WPLTDAAGVPVVFLTAYYALRVLAQ

SEQ ID NO: 1464693 - protein, 17 aa, Mycobacterium tuberculosis
WPPAGAVPVEVADGYQQ

SEQ ID NO: 1464694 - protein, 22 aa, Mycobacterium tuberculosis
WRDHIRHGAAIAAALRERLDPA

SEQ ID NO: 1464695 - protein, 17 aa, Mycobacterium tuberculosis
WREVIAKFVARRSGGKT

SEQ ID NO: 1464696 - protein, 28 aa, Mycobacterium tuberculosis
WRPFGLPPHRWRLAPWYWRGLQVTLEPG

SEQ ID NO: 1464697 - protein, 20 aa, Mycobacterium tuberculosis
WRTSTRLPRDHYVRLDGNDY

SEQ ID NO: 1464698 - protein, 17 aa, Mycobacterium tuberculosis
WSGGSFIYVPPGVHVDI

SEQ ID NO: 1464699 - protein, 24 aa, Mycobacterium tuberculosis
WTATLKRHCVRVIPWEITGRHFRF

SEQ ID NO: 1464700 - protein, 18 aa, Mycobacterium tuberculosis
WVKLVGDWIDRQIGDLAP

SEQ ID NO: 1464701 - protein, 19 aa, Mycobacterium tuberculosis
YDDRLLYLDRYWREEEQVC

SEQ ID NO: 1464702 - protein, 17 aa, Mycobacterium tuberculosis
YDPLPWPDDFEVPPMPA

SEQ ID NO: 1464703 - protein, 19 aa, Mycobacterium tuberculosis
YEFSRACESLYHFAWDEFC

SEQ ID NO: 1464704 - protein, 24 aa, Mycobacterium tuberculosis
YFRTKRWPDVLAQFPEATQWRHPE

SEQ ID NO: 1464705 - protein, 24 aa, Mycobacterium tuberculosis
YFTKLRIPGARVIPTIYFLRHSTD

SEQ ID NO: 1464706 - protein, 21 aa, Mycobacterium tuberculosis
YRELQPGKSLIVRYGPGMGQA

SEQ ID NO: 1464707 - protein, 27 aa, Mycobacterium tuberculosis
YSLDVPRITIVDAHLDGGFGPVVLPPI

SEQ ID NO: 1464708 - protein, 19 aa, Mycobacterium tuberculosis
YSRVRVDGVVHPLTDPPKL

SEQ ID NO: 1464709 - protein, 27 aa, Mycobacterium tuberculosis
YTKGFKFSTYATWWIRQAITRGMADQS

SEQ ID NO: 1464710 - protein, 17 aa, Mycobacterium tuberculosis
YVPDPAPTKRQLLSAAF

SEQ ID NO: 1464711 - protein, 18 aa, Mycobacterium tuberculosis
YWLAPSGFTRAPQNSVDR

SEQ ID NO: 1464712 - protein, 25 aa, Mycobacterium tuberculosis
AAAEAEYELMWAADVAAMAGYHSGA

SEQ ID NO: 1464713 - protein, 25 aa, Mycobacterium tuberculosis
AAAGRAAPRLTVWVPVAVNPGAAAH

SEQ ID NO: 1464714 - protein, 17 aa, Mycobacterium tuberculosis
AAAHVAGALCLPDAAML

SEQ ID NO: 1464715 - protein, 26 aa, Mycobacterium tuberculosis
AAATAWGELAEELLASIASLGSVTSE

SEQ ID NO: 1464716 - protein, 26 aa, Mycobacterium tuberculosis
AADLTNRSTIRWTLHQMVASGVVSVY

SEQ ID NO: 1464717 - protein, 22 aa, Mycobacterium tuberculosis
AAEVYKRSLAVFFLSEPPEGFD

SEQ ID NO: 1464718 - protein, 29 aa, Mycobacterium tuberculosis
AAGGLNWASLPLKLFAGGNAKFWDPADID

SEQ ID NO: 1464719 - protein, 18 aa, Mycobacterium tuberculosis
AAGTPPIYFGFGSTPVQT

SEQ ID NO: 1464720 - protein, 23 aa, Mycobacterium tuberculosis
AAGVRRLVLASSMVVYGQGRYDC

SEQ ID NO: 1464721 - protein, 19 aa, Mycobacterium tuberculosis
AALDFGASFDGVRPHAIRV

SEQ ID NO: 1464722 - protein, 22 aa, Mycobacterium tuberculosis
AAMAGYHFDASAAVAQLAPWQQ

SEQ ID NO: 1464723 - protein, 17 aa, Mycobacterium tuberculosis
AANNPKAYFYGKPITIE

SEQ ID NO: 1464724 - protein, 25 aa, Mycobacterium tuberculosis
AAQLGEPWRAVHVGDELPLAELTVR

SEQ ID NO: 1464725 - protein, 18 aa, Mycobacterium tuberculosis
AASSLRKAKKLRVRLPLP

SEQ ID NO: 1464726 - protein, 17 aa, Mycobacterium tuberculosis
AATLGPWTLVLDECHHL

SEQ ID NO: 1464727 - protein, 19 aa, Mycobacterium tuberculosis
AAVVGRLRVVVCAPACAVD

SEQ ID NO: 1464728 - protein, 23 aa, Mycobacterium tuberculosis
AAWEARVRKRFAFLTDLDADEQR

SEQ ID NO: 1464729 - protein, 24 aa, Mycobacterium tuberculosis
ACDVPSLGWRVYRLVPADEAPGWE

SEQ ID NO: 1464730 - protein, 24 aa, Mycobacterium tuberculosis
ADALKADGIVGVRLNWRHHGEGGE

SEQ ID NO: 1464731 - protein, 17 aa, Mycobacterium tuberculosis
ADDGELLVRGGVVFSGY

SEQ ID NO: 1464732 - protein, 18 aa, Mycobacterium tuberculosis
ADERAAGVLRAHGYPTDH

SEQ ID NO: 1464733 - protein, 25 aa, Mycobacterium tuberculosis
ADIDGLRYLDWLAAYSAVNLGHRNP

SEQ ID NO: 1464734 - protein, 19 aa, Mycobacterium tuberculosis
ADLARLGREGVLALSTAEA

SEQ ID NO: 1464735 - protein, 21 aa, Mycobacterium tuberculosis
ADVPGLIPGASRGRGLGLDFL

SEQ ID NO: 1464736 - protein, 22 aa, Mycobacterium tuberculosis
AEAQGGLLPWAVREYEAQTGRK

SEQ ID NO: 1464737 - protein, 28 aa, Mycobacterium tuberculosis
AEAQRLAEACGLDLVALGKVVRHSDSFT

SEQ ID NO: 1464738 - protein, 20 aa, Mycobacterium tuberculosis
AEIYRRSFAVIRAEADLARF

SEQ ID NO: 1464739 - protein, 20 aa, Mycobacterium tuberculosis
AELLVPHLAARFGRAARDIA

SEQ ID NO: 1464740 - protein, 19 aa, Mycobacterium tuberculosis
AELRAKHGLIPEDEALRAI

SEQ ID NO: 1464741 - protein, 27 aa, Mycobacterium tuberculosis
AEQFARVHLDACDRWSVGLSGGPDSLA

SEQ ID NO: 1464742 - protein, 20 aa, Mycobacterium tuberculosis
AETAELLYGTALLAEGGALE

SEQ ID NO: 1464743 - protein, 27 aa, Mycobacterium tuberculosis
AEVELAWEILDPALEHWAAHGTPDAYE

SEQ ID NO: 1464744 - protein, 25 aa, Mycobacterium tuberculosis
AFDRIDERLVVVGLDNTVTYKNGDP

SEQ ID NO: 1464745 - protein, 26 aa, Mycobacterium tuberculosis
AFEEARRRFEASWNRENGEHPINDSA

SEQ ID NO: 1464746 - protein, 19 aa, Mycobacterium tuberculosis
AFGEMFARQGHLGAMPATV

SEQ ID NO: 1464747 - protein, 21 aa, Mycobacterium tuberculosis
AFGQRFPDRLFDVGIAEQHAM

SEQ ID NO: 1464748 - protein, 21 aa, Mycobacterium tuberculosis
AFKTHGCQPWQNTGSEGAAPA

SEQ ID NO: 1464749 - protein, 17 aa, Mycobacterium tuberculosis
AFLAWQAARCVANWDGA

SEQ ID NO: 1464750 - protein, 20 aa, Mycobacterium tuberculosis
AGAPAYYTICELLHRHGFAG

SEQ ID NO: 1464751 - protein, 23 aa, Mycobacterium tuberculosis
AGASFLRRDGSVWTTDKDGIIMA

SEQ ID NO: 1464752 - protein, 17 aa, Mycobacterium tuberculosis
AGDGVWAIYTVDADGGA

SEQ ID NO: 1464753 - protein, 22 aa, Mycobacterium tuberculosis
AGFEPIELVMGVSVYHVGFQFS

SEQ ID NO: 1464754 - protein, 21 aa, Mycobacterium tuberculosis
AGFPLGWVHDVVWAPRPIGGP

SEQ ID NO: 1464755 - protein, 18 aa, Mycobacterium tuberculosis
AGGFGILGAVAHSPKRLE

SEQ ID NO: 1464756 - protein, 28 aa, Mycobacterium tuberculosis
AGIKLCKKRHRLPGLDFVRGDAENLPFD

SEQ ID NO: 1464757 - protein, 19 aa, Mycobacterium tuberculosis
AGLDGYSAADCVALLREAA

SEQ ID NO: 1464758 - protein, 19 aa, Mycobacterium tuberculosis
AGLKAIYLSGWQVAGDANL

SEQ ID NO: 1464759 - protein, 18 aa, Mycobacterium tuberculosis
AGLLRPPAAQRLVSALRS

SEQ ID NO: 1464760 - protein, 18 aa, Mycobacterium tuberculosis
AGNLVLMVQPPRGFGENP

SEQ ID NO: 1464761 - protein, 19 aa, Mycobacterium tuberculosis
AGSDPDWDARVALHRARRP

SEQ ID NO: 1464762 - protein, 17 aa, Mycobacterium tuberculosis
AGSKCFYTTPLKALSNQ

SEQ ID NO: 1464763 - protein, 17 aa, Mycobacterium tuberculosis
AGVARRGAQGSAMQQLR

SEQ ID NO: 1464764 - protein, 19 aa, Mycobacterium tuberculosis
AHVDLYFEAAVAGAIPVIR

SEQ ID NO: 1464765 - protein, 18 aa, Mycobacterium tuberculosis
AIDDTWLRTGDLGVYLDG

SEQ ID NO: 1464766 - protein, 20 aa, Mycobacterium tuberculosis
AIGKAAPVGLFVETFGTETE

SEQ ID NO: 1464767 - protein, 24 aa, Mycobacterium tuberculosis
AIRPDGQGLVAFVGVTHGDDLDKA

SEQ ID NO: 1464768 - protein, 18 aa, Mycobacterium tuberculosis
AKEEVIHLVPDVNKERGP

SEQ ID NO: 1464769 - protein, 22 aa, Mycobacterium tuberculosis
AKMFNCTGWKIGWACGPAELIA

SEQ ID NO: 1464770 - protein, 17 aa, Mycobacterium tuberculosis
AKSALDAVVSRWHAESS

SEQ ID NO: 1464771 - protein, 35 aa, Mycobacterium tuberculosis; identical to SEQ ID NO: 196570

SEQ ID NO: 1464772 - protein, 18 aa, Mycobacterium tuberculosis
ALEHRGFESLFLAEHTHI

SEQ ID NO: 1464773 - protein, 17 aa, Mycobacterium tuberculosis
ALELTWRSLGEIGNLSS

SEQ ID NO: 1464774 - protein, 20 aa, Mycobacterium tuberculosis
ALHGAWGVRVHDVRASVDAI

SEQ ID NO: 1464775 - protein, 18 aa, Mycobacterium tuberculosis
ALVGRVEIIELWPFSQGE

SEQ ID NO: 1464776 - protein, 17 aa, Mycobacterium tuberculosis
ANGFILDGYPRSVEQAK

SEQ ID NO: 1464777 - protein, 26 aa, Mycobacterium tuberculosis
APGESRLRLLGFERVELEPGQTRRVR

SEQ ID NO: 1464778 - protein, 19 aa, Mycobacterium tuberculosis
APGLLSWRDIARVMSENPA

SEQ ID NO: 1464779 - protein, 36 aa, Mycobacterium tuberculosis
APNRIEGWMPFGRVFETLAWGRRHVVMGANQVDRYG

SEQ ID NO: 1464780 - protein, 17 aa, Mycobacterium tuberculosis
APPSKIFRTRALRVPGV

SEQ ID NO: 1464781 - protein, 18 aa, Mycobacterium tuberculosis
AQARRIAEEIGYPVLVRP

SEQ ID NO: 1464782 - protein, 18 aa, Mycobacterium tuberculosis
AQGLRVTAVRSRLMAPLS

SEQ ID NO: 1464783 - protein, 24 aa, Mycobacterium tuberculosis
AQNFNQTITLAWPVSSITIPQIQQ

SEQ ID NO: 1464784 - protein, 21 aa, Mycobacterium tuberculosis
AQRALHRVVTLLAAGRPVLTH

SEQ ID NO: 1464785 - protein, 23 aa, Mycobacterium tuberculosis
AQYRIRLGGTWKKPGTSDIEIVC

SEQ ID NO: 1464786 - protein, 25 aa, Mycobacterium tuberculosis
ARAAFEHAGLDWQQYVKFDQRYLRP

SEQ ID NO: 1464787 - protein, 18 aa, Mycobacterium tuberculosis
ARGLRRILTEGGPTLLGT

SEQ ID NO: 1464788 - protein, 17 aa, Mycobacterium tuberculosis
ARHTGGTFVFRIEDTDA

SEQ ID NO: 1464789 - protein, 26 aa, Mycobacterium tuberculosis
ARLGHFYRGAGLTIYEGYGLSGTSGG

SEQ ID NO: 1464790 - protein, 24 aa, Mycobacterium tuberculosis
ARPRAGLIGCAFADLAEVMAGVFA

SEQ ID NO: 1464791 - protein, 28 aa, Mycobacterium tuberculosis
ARRLAIPELPDAVFIESLRQLIAVDKAW

SEQ ID NO: 1464792 - protein, 23 aa, Mycobacterium tuberculosis
ARVALGALLRRIRNYEVDDDNVV

SEQ ID NO: 1464793 - protein, 26 aa, Mycobacterium tuberculosis
ARVVAKIYCGLGLLKRENIREVHRAD

SEQ ID NO: 1464794 - protein, 21 aa, Mycobacterium tuberculosis
ARYDVTFSLGDGLRPGSIADA

SEQ ID NO: 1464795 - protein, 19 aa, Mycobacterium tuberculosis
ARYVPQRVVEHLPERVITA

SEQ ID NO: 1464796 - protein, 18 aa, Mycobacterium tuberculosis
ASALLTCVARDPDPANVG

SEQ ID NO: 1464797 - protein, 18 aa, Mycobacterium tuberculosis
ASATFPWYQLGRQAHVQG

SEQ ID NO: 1464798 - protein, 22 aa, Mycobacterium tuberculosis
ASIDPEWSRPPGSITDDHVFDA

SEQ ID NO: 1464799 - protein, 22 aa, Mycobacterium tuberculosis
ASIWNRRRVLLLNSTYEPLTAL

SEQ ID NO: 1464800 - protein, 20 aa, Mycobacterium tuberculosis
ASTKVQSWDIFKCVRQVLDV

SEQ ID NO: 1464801 - protein, 28 aa, Mycobacterium tuberculosis
ASVTAGLAGQAWQGPAALAMAAAAAPYA

SEQ ID NO: 1464802 - protein, 23 aa, Mycobacterium tuberculosis
ATAVAGYGARFAGVAYPGETLTV

SEQ ID NO: 1464803 - protein, 22 aa, Mycobacterium tuberculosis
ATCGGIRVWSLYVPNGRALDDP

SEQ ID NO: 1464804 - protein, 18 aa, Mycobacterium tuberculosis
ATGLPVLTVRSLVTRPIT

SEQ ID NO: 1464805 - protein, 17 aa, Mycobacterium tuberculosis
ATTTLLRPVKPPPSEGW

SEQ ID NO: 1464806 - protein, 18 aa, Mycobacterium tuberculosis
AVAAIAPMPPGAPEGMPP

SEQ ID NO: 1464807 - protein, 17 aa, Mycobacterium tuberculosis
AVARLRLLCRGSGITDV

SEQ ID NO: 1464808 - protein, 27 aa, Mycobacterium tuberculosis
AVGDKWRLAEVLAWQAYVGFAGEGDPG

SEQ ID NO: 1464809 - protein, 26 aa, Mycobacterium tuberculosis
AVLAAARRLRIIPGIASRTRTGGSAT

SEQ ID NO: 1464810 - protein, 24 aa, Mycobacterium tuberculosis
AVLDVTHITRWAGCIGNRSTVIAV

SEQ ID NO: 1464811 - protein, 19 aa, Mycobacterium tuberculosis
AVWQLLCADGDAIDAIGRS

SEQ ID NO: 1464812 - protein, 19 aa, Mycobacterium tuberculosis
AVWSDGTPITWRDIASQIH

SEQ ID NO: 1464813 - protein, 24 aa, Mycobacterium tuberculosis
AWHKICVERAILPGMQELVRRIGD

SEQ ID NO: 1464814 - protein, 20 aa, Mycobacterium tuberculosis
AWNPEFLREGFAVHDTLNPD

SEQ ID NO: 1464815 - protein, 17 aa, Mycobacterium tuberculosis
AYHGRWGFEEFSHRKSV

SEQ ID NO: 1464816 - protein, 21 aa, Mycobacterium tuberculosis
CAAISAPLRPGSGMPPIGVPV

SEQ ID NO: 1464817 - protein, 19 aa, Mycobacterium tuberculosis
CAVEGIPVKVALINNGNLG

SEQ ID NO: 1464818 - protein, 22 aa, Mycobacterium tuberculosis
CELADRGLRVLILDQENRANVG

SEQ ID NO: 1464819 - protein, 19 aa, Mycobacterium tuberculosis
CGLAPSSIYWHFGSKEGVL

SEQ ID NO: 1464820 - protein, 24 aa, Mycobacterium tuberculosis
CPICRKEQLTLVSWVFGEHLGAVS

SEQ ID NO: 1464821 - protein, 23 aa, Mycobacterium tuberculosis
CRAKHRLPGLQFVQGDAQNLPFP

SEQ ID NO: 1464822 - protein, 17 aa, Mycobacterium tuberculosis
CRIGERSSHTWFVLTHL

SEQ ID NO: 1464823 - protein, 18 aa, Mycobacterium tuberculosis
CRRQHTFSSTLTVESPQV

SEQ ID NO: 1464824 - protein, 24 aa, Mycobacterium tuberculosis
CVGAGIPAVTFWAAVPHYVSHPPN

SEQ ID NO: 1464825 - protein, 20 aa, Mycobacterium tuberculosis
CVGSLDFTSGEFQYCTAGHP

SEQ ID NO: 1464826 - protein, 21 aa, Mycobacterium tuberculosis
DAARPWLTRLCDERTVVAVLQ

SEQ ID NO: 1464827 - protein, 18 aa, Mycobacterium tuberculosis
DAGMEVCCGGILGMGETL

SEQ ID NO: 1464828 - protein, 17 aa, Mycobacterium tuberculosis
DAIMVVLALAMKEAGEL

SEQ ID NO: 1464829 - protein, 17 aa, Mycobacterium tuberculosis
DAPKRLGSFMDSRLWRL

SEQ ID NO: 1464830 - protein, 17 aa, Mycobacterium tuberculosis
DAVRLRGLMSHMVYADK

SEQ ID NO: 1464831 - protein, 19 aa, Mycobacterium tuberculosis
DDQKWVWGGAGVIEPDYTR

SEQ ID NO: 1464832 - protein, 20 aa, Mycobacterium tuberculosis
DDRFRLLTGGARSTVQRQQT

SEQ ID NO: 1464833 - protein, 33 aa, Mycobacterium tuberculosis
DDVLKQLFGYLVWRDTKAAILLFIRNKDVTAVI

SEQ ID NO: 1464834 - protein, 20 aa, Mycobacterium tuberculosis
DELPVSLSVQVRGELAAEEV

SEQ ID NO: 1464835 - protein, 22 aa, Mycobacterium tuberculosis
DEVYGIMLMHGWAVQHVECERR

SEQ ID NO: 1464836 - protein, 28 aa, Mycobacterium tuberculosis
DGEGWAGCFTEDGAFEFDGWVIRGRPAL

SEQ ID NO: 1464837 - protein, 24 aa, Mycobacterium tuberculosis
DGKARWYRNRWVRTPAVCAALGEP

SEQ ID NO: 1464838 - protein, 20 aa, Mycobacterium tuberculosis
DGPESRFAKTMALVAEHGAA

SEQ ID NO: 1464839 - protein, 19 aa, Mycobacterium tuberculosis
DGQFGKWLQGARDWSISRN

SEQ ID NO: 1464840 - protein, 20 aa, Mycobacterium tuberculosis
DGRRLRRRRLDAGDQAGFPL

SEQ ID NO: 1464841 - protein, 22 aa, Mycobacterium tuberculosis
DGYEIRSAAVAGNIPCITTVQG

SEQ ID NO: 1464842 - protein, 25 aa, Mycobacterium tuberculosis
DHFARRGRRVHRLAVSHAFHSLLME

SEQ ID NO: 1464843 - protein, 23 aa, Mycobacterium tuberculosis
DHGKAPVRRACYAADRTGHMILQ

SEQ ID NO: 1464844 - protein, 21 aa, Mycobacterium tuberculosis
DHPDEACGVLAGPEGSDRPER

SEQ ID NO: 1464845 - protein, 24 aa, Mycobacterium tuberculosis
DIALRRPSLDHVFLAMTTDPTESL

SEQ ID NO: 1464846 - protein, 17 aa, Mycobacterium tuberculosis
DIARRSGAHLVRHPINL

SEQ ID NO: 1464847 - protein, 23 aa, Mycobacterium tuberculosis
DIVIPAFGGGIGIPINIGPLTIT

SEQ ID NO: 1464848 - protein, 19 aa, Mycobacterium tuberculosis
DKHKLALEREMLGLYVSGH

SEQ ID NO: 1464849 - protein, 25 aa, Mycobacterium tuberculosis
DKLVLRRRGGYCFEHNGLMGYVLAE

SEQ ID NO: 1464850 - protein, 20 aa, Mycobacterium tuberculosis
DLAARCSFEQVAFLLWRGEL

SEQ ID NO: 1464851 - protein, 18 aa, Mycobacterium tuberculosis
DLPRQPVHPELRVVDLAI

SEQ ID NO: 1464852 - protein, 17 aa, Mycobacterium tuberculosis
DPALVGRKVELVFDPFD

SEQ ID NO: 1464853 - protein, 23 aa, Mycobacterium tuberculosis
DPARAARVLGFRAAVDPGEGLRE

SEQ ID NO: 1464854 - protein, 25 aa, Mycobacterium tuberculosis
DPFWDRLRFPAALDRVQVPVLLVGG

SEQ ID NO: 1464855 - protein, 24 aa, Mycobacterium tuberculosis
DPGHSFPAIALCQRFRAAADTPTL

SEQ ID NO: 1464856 - protein, 19 aa, Mycobacterium tuberculosis
DPLFTRTGAGLAFTPGGLR

SEQ ID NO: 1464857 - protein, 26 aa, Mycobacterium tuberculosis
DPLTPGRMTTKWGGFVPDVAGFDAEF

SEQ ID NO: 1464858 - protein, 23 aa, Mycobacterium tuberculosis
DPQHRLLLETSWEAMEHGGLTPN

SEQ ID NO: 1464859 - protein, 25 aa, Mycobacterium tuberculosis
DPQQRLMLEVSWEALEHAGIDPLSL

SEQ ID NO: 1464860 - protein, 20 aa, Mycobacterium tuberculosis
DQAALAWRLATAQRQMREVE

SEQ ID NO: 1464861 - protein, 24 aa, Mycobacterium tuberculosis
DQARLLCEKAAWTIDQHGNKEARH

SEQ ID NO: 1464862 - protein, 22 aa, Mycobacterium tuberculosis
DQLGRRVHRVACDYQAVRTHFF

SEQ ID NO: 1464863 - protein, 24 aa, Mycobacterium tuberculosis
DRDGFVFGEAGALMLIETEEHAKA

SEQ ID NO: 1464864 - protein, 17 aa, Mycobacterium tuberculosis
DRIGVAMLQAAEQAGLI

SEQ ID NO: 1464865 - protein, 20 aa, Mycobacterium tuberculosis
DRLPMDKLLAGVAHVVHEMH

SEQ ID NO: 1464866 - protein, 23 aa, Mycobacterium tuberculosis
DRNRISGTLGVRFARSGETAVTL

SEQ ID NO: 1464867 - protein, 24 aa, Mycobacterium tuberculosis
DRPAFKTCVAHGIVLGFDGQKMSK

SEQ ID NO: 1464868 - protein, 18 aa, Mycobacterium tuberculosis
DRTRPCGRWSYARPDANL

SEQ ID NO: 1464869 - protein, 22 aa, Mycobacterium tuberculosis
DTPIEIDFGPSPAINLNIGKPD

SEQ ID NO: 1464870 - protein, 18 aa, Mycobacterium tuberculosis
DTVLEFSNTVTRVHEDPR

SEQ ID NO: 1464871 - protein, 23 aa, Mycobacterium tuberculosis
DVADFGCGSGRAVKLMAQAFGAS

SEQ ID NO: 1464872 - protein, 18 aa, Mycobacterium tuberculosis
DVAIKRPIFVTGLVRTGT

SEQ ID NO: 1464873 - protein, 27 aa, Mycobacterium tuberculosis
DVELRIPKLRKGSFFPAILEPRRRIDQ

SEQ ID NO: 1464874 - protein, 17 aa, Mycobacterium tuberculosis
DVLRRLLDHAATTPGRA

SEQ ID NO: 1464875 - protein, 22 aa, Mycobacterium tuberculosis
DYLKRLTADLRRTRRRLSDLEA

SEQ ID NO: 1464876 - protein, 25 aa, Mycobacterium tuberculosis
EAAAFVRGRRAEVFGISRAGDGDGA

SEQ ID NO: 1464877 - protein, 17 aa, Mycobacterium tuberculosis
EAEGAKADARRKVRDGG

SEQ ID NO: 1464878 - protein, 18 aa, Mycobacterium tuberculosis
EALATLVVNAIRKTLKAV

SEQ ID NO: 1464879 - protein, 23 aa, Mycobacterium tuberculosis
EAVLARELELCYAAIALVTDVDA

SEQ ID NO: 1464880 - protein, 17 aa, Mycobacterium tuberculosis
EAVRPGARLILVGDADQ

SEQ ID NO: 1464881 - protein, 19 aa, Mycobacterium tuberculosis
EDHLDWHATMAEYTAAKAR

SEQ ID NO: 1464882 - protein, 22 aa, Mycobacterium tuberculosis
EDVPGFCKSATLAEIKATDYAL

SEQ ID NO: 1464883 - protein, 26 aa, Mycobacterium tuberculosis
EELNEAICPWCIADGSAASRFDATFT

SEQ ID NO: 1464884 - protein, 36 aa, Mycobacterium tuberculosis
EEVLTELWALIGYRIPTPIPRIGYAEAMRRFGTDKP

SEQ ID NO: 1464885 - protein, 19 aa, Mycobacterium tuberculosis
EFDTELGPVVANFLLADEI

SEQ ID NO: 1464886 - protein, 18 aa, Mycobacterium tuberculosis
EFLTRWATGELDAADVDD

SEQ ID NO: 1464887 - protein, 20 aa, Mycobacterium tuberculosis
EFPDRPALELDGWAYARPLA

SEQ ID NO: 1464888 - protein, 18 aa, Mycobacterium tuberculosis
EGDPLWTADGKQWGLEYL

SEQ ID NO: 1464889 - protein, 22 aa, Mycobacterium tuberculosis
EGLPPGSALLVVKRGPNAGSRF

SEQ ID NO: 1464890 - protein, 17 aa, Mycobacterium tuberculosis
EGVRLFRFDRIVDAAEL

SEQ ID NO: 1464891 - protein, 22 aa, Mycobacterium tuberculosis
EHGFHLDIWALNYAGPRHEVSG

SEQ ID NO: 1464892 - protein, 20 aa, Mycobacterium tuberculosis
EHKTRIRGASFVDRDGNELF

SEQ ID NO: 1464893 - protein, 19 aa, Mycobacterium tuberculosis
EHRRIMSLVAIGAAVENVK

SEQ ID NO: 1464894 - protein, 22 aa, Mycobacterium tuberculosis
EIAFPARLPAPLVRSTITAIDW

SEQ ID NO: 1464895 - protein, 21 aa, Mycobacterium tuberculosis
EIEPRSGRHLGNFPQAFTHLA

SEQ ID NO: 1464896 - protein, 23 aa, Mycobacterium tuberculosis
EIGNTEWPKWETVMAADPVDPAE

SEQ ID NO: 1464897 - protein, 20 aa, Mycobacterium tuberculosis
EIPGAWRLPLSGDEADADIA

SEQ ID NO: 1464898 - protein, 34 aa, Mycobacterium tuberculosis
EIVERYDLVLSFHCKQRFPAALIDGVRCVNVHPG

SEQ ID NO: 1464899 - protein, 21 aa, Mycobacterium tuberculosis
EKELERVRMASARAAATNAAA

SEQ ID NO: 1464900 - protein, 24 aa, Mycobacterium tuberculosis
EKPGRREGWDYPDMARESGTKALR

SEQ ID NO: 1464901 - protein, 23 aa, Mycobacterium tuberculosis
ELLQRPGQRLAYNGRLLELPDIK

SEQ ID NO: 1464902 - protein, 25 aa, Mycobacterium tuberculosis
ELQWPAMRISHCRPPGSDRDVVLMC

SEQ ID NO: 1464903 - protein, 21 aa, Mycobacterium tuberculosis
ELVGTCGVGKASVRVFDDYAH

SEQ ID NO: 1464904 - protein, 18 aa, Mycobacterium tuberculosis
ENIREVHRADLIGQHIGE

SEQ ID NO: 1464905 - protein, 19 aa, Mycobacterium tuberculosis
ENLEDAGVSWKVYQNKLLG

SEQ ID NO: 1464906 - protein, 20 aa, Mycobacterium tuberculosis
EPRFIKLTGELASEQTLSFD

SEQ ID NO: 1464907 - protein, 21 aa, Mycobacterium tuberculosis
EPRVAWWALCTDFDVPRSMGR

SEQ ID NO: 1464908 - protein, 17 aa, Mycobacterium tuberculosis
EQFGRLDIVVANAGVLG

SEQ ID NO: 1464909 - protein, 18 aa, Mycobacterium tuberculosis
EQWLKTTGLNTLRPDFEV

SEQ ID NO: 1464910 - protein, 21 aa, Mycobacterium tuberculosis
ERQLKTLPLVERFYQADRSVA

SEQ ID NO: 1464911 - protein, 17 aa, Mycobacterium tuberculosis
ERWPGRRFEGAGPAGWI

SEQ ID NO: 1464912 - protein, 18 aa, Mycobacterium tuberculosis
ESEINGLITSWRGPSSTI

SEQ ID NO: 1464913 - protein, 18 aa, Mycobacterium tuberculosis
ESHCGWPSFFDPKSSDAV

SEQ ID NO: 1464914 - protein, 18 aa, Mycobacterium tuberculosis
EVAPMLGHDVSIAAVNGP

SEQ ID NO: 1464915 - protein, 17 aa, Mycobacterium tuberculosis
EVLEKLTPEFVAPVVAY

SEQ ID NO: 1464916 - protein, 19 aa, Mycobacterium tuberculosis
EVNSALMYAGPGSGPMLAA

SEQ ID NO: 1464917 - protein, 21 aa, Mycobacterium tuberculosis
FAPRELVELAVAAEAHGMDSA

SEQ ID NO: 1464918 - protein, 17 aa, Mycobacterium tuberculosis
FARFRRLRWRHPLDGQT

SEQ ID NO: 1464919 - protein, 20 aa, Mycobacterium tuberculosis
FARMWRGYARGVLEKLSALL

SEQ ID NO: 1464920 - protein, 19 aa, Mycobacterium tuberculosis
FAVDPDRSAQFLLVVLTQA

SEQ ID NO: 1464921 - protein, 25 aa, Mycobacterium tuberculosis
FDLETDWPIRAALLSTPEQTVLSLV

SEQ ID NO: 1464922 - protein, 35 aa, Mycobacterium tuberculosis; identical to SEQ ID NO: 210782

SEQ ID NO: 1464923 - protein, 18 aa, Mycobacterium tuberculosis
FERIARGVPVAAPWDARR

SEQ ID NO: 1464924 - protein, 19 aa, Mycobacterium tuberculosis
FEVEQMLPLDGHTPLTTQL

SEQ ID NO: 1464925 - protein, 22 aa, Mycobacterium tuberculosis
FFKDPVKGFFRALDYTLPWDVD

SEQ ID NO: 1464926 - protein, 18 aa, Mycobacterium tuberculosis
FFLDRGCKVLCTEPRGEN

SEQ ID NO: 1464927 - protein, 18 aa, Mycobacterium tuberculosis
FGGEVERGLSMVDGVLLL

SEQ ID NO: 1464928 - protein, 24 aa, Mycobacterium tuberculosis
FGGGVRRCLGFGFALTEGAVILQE

SEQ ID NO: 1464929 - protein, 24 aa, Mycobacterium tuberculosis
FGLEIPGNIYTRIGNPTTDVVEQR

SEQ ID NO: 1464930 - protein, 24 aa, Mycobacterium tuberculosis
FGQVTSGLTAGVWQGAAAAAMAAA

SEQ ID NO: 1464931 - protein, 18 aa, Mycobacterium tuberculosis
FHGDFTFGQALYSYDVNA

SEQ ID NO: 1464932 - protein, 20 aa, Mycobacterium tuberculosis
FHGFRQGRNPFWDRLSRAMY

SEQ ID NO: 1464933 - protein, 21 aa, Mycobacterium tuberculosis
FIDHLRHLGRIPATIRYTTQG

SEQ ID NO: 1464934 - protein, 17 aa, Mycobacterium tuberculosis
FIGQPIPIAGLYLGSAG

SEQ ID NO: 1464935 - protein, 20 aa, Mycobacterium tuberculosis
FKLFGPRNQAPLSFPIPGWN

SEQ ID NO: 1464936 - protein, 19 aa, Mycobacterium tuberculosis
FLAPPGRAPVLVYGPGPAG

SEQ ID NO: 1464937 - protein, 19 aa, Mycobacterium tuberculosis
FLCACGPAYLPERDQRMGE

SEQ ID NO: 1464938 - protein, 21 aa, Mycobacterium tuberculosis
FLDKRGPGIQQLACRVSDLDA

SEQ ID NO: 1464939 - protein, 18 aa, Mycobacterium tuberculosis
FLKRVRKVVDDEFPGRVL

SEQ ID NO: 1464940 - protein, 18 aa, Mycobacterium tuberculosis
FLLAFLACFDAGDRVAMA

SEQ ID NO: 1464941 - protein, 22 aa, Mycobacterium tuberculosis
FPDDIAHYLWTWTDRSAGSLRA

SEQ ID NO: 1464942 - protein, 24 aa, Mycobacterium tuberculosis
FPTADDVVVAWPHRYLAAQAEAGG

SEQ ID NO: 1464943 - protein, 23 aa, Mycobacterium tuberculosis
FQVSAEWSWLVLVGAVVGDWLVS

SEQ ID NO: 1464944 - protein, 21 aa, Mycobacterium tuberculosis
FRPVALESLSHFPVTVAAHRS

SEQ ID NO: 1464945 - protein, 19 aa, Mycobacterium tuberculosis
FSAKAGRQVFKDYVAFPAL

SEQ ID NO: 1464946 - protein, 27 aa, Mycobacterium tuberculosis
FSIEPGIYFPGRWGARIEDIVIVTEDG

SEQ ID NO: 1464947 - protein, 27 aa, Mycobacterium tuberculosis
FTEVLDWSGAPFAKWFVGGELNVAYNC

SEQ ID NO: 1464948 - protein, 19 aa, Mycobacterium tuberculosis
FTIPAQTPVTVGMEVANDG

SEQ ID NO: 1464949 - protein, 21 aa, Mycobacterium tuberculosis
FTKARLSDGVLGVRAEYLAAA

SEQ ID NO: 1464950 - protein, 19 aa, Mycobacterium tuberculosis
FTSMYRRIVGSAGPITDDP

SEQ ID NO: 1464951 - protein, 17 aa, Mycobacterium tuberculosis
FVERLSRATIDVSKGHP

SEQ ID NO: 1464952 - protein, 17 aa, Mycobacterium tuberculosis
FVSGVLPTAPVSAVADP

SEQ ID NO: 1464953 - protein, 18 aa, Mycobacterium tuberculosis
GAPSGAYVRRAGDDVQPG

SEQ ID NO: 1464954 - protein, 24 aa, Mycobacterium tuberculosis
GASGFYAKWLPKLVFGEGQLPTTY

SEQ ID NO: 1464955 - protein, 19 aa, Mycobacterium tuberculosis
GASVLSRPVAKIMSTTVAT

SEQ ID NO: 1464956 - protein, 17 aa, Mycobacterium tuberculosis
GAYRVALVVGLELEKTV

SEQ ID NO: 1464957 - protein, 23 aa, Mycobacterium tuberculosis
GDGFVSAPGHGRCEVICFSADHT

SEQ ID NO: 1464958 - protein, 25 aa, Mycobacterium tuberculosis
GDHRMLPRATFCQPNVASFGLTEQQ

SEQ ID NO: 1464959 - protein, 24 aa, Mycobacterium tuberculosis
GDLARYWHDGTLEFVGRADHRVKI

SEQ ID NO: 1464960 - protein, 30 aa, Mycobacterium tuberculosis; identical to SEQ ID NO: 199644

SEQ ID NO: 1464961 - protein, 23 aa, Mycobacterium tuberculosis
GEDLSWLWDVRFEHFEKTRVVAA

SEQ ID NO: 1464962 - protein, 18 aa, Mycobacterium tuberculosis
GEFDEWQRLYLFTRADTI

SEQ ID NO: 1464963 - protein, 21 aa, Mycobacterium tuberculosis
GEGVSALLIRVGESGVAPDRL

SEQ ID NO: 1464964 - protein, 18 aa, Mycobacterium tuberculosis
GENVFFCATGVTDGDLLK

SEQ ID NO: 1464965 - protein, 21 aa, Mycobacterium tuberculosis
GFERSKYASGEFFDKYTDQIW

SEQ ID NO: 1464966 - protein, 18 aa, Mycobacterium tuberculosis
GFPRLAIARLMTSYFELT

SEQ ID NO: 1464967 - protein, 19 aa, Mycobacterium tuberculosis
GGCELATACDVCIATDDAR

SEQ ID NO: 1464968 - protein, 18 aa, Mycobacterium tuberculosis
GGLFAGITARYLALVATT

SEQ ID NO: 1464969 - protein, 19 aa, Mycobacterium tuberculosis
GGLNLVGGLRRSMAKAGYC

SEQ ID NO: 1464970 - protein, 19 aa, Mycobacterium tuberculosis
GGQLCLPLYGALVTNCGLD

SEQ ID NO: 1464971 - protein, 21 aa, Mycobacterium tuberculosis
GGTCPLWNVYETFANPGKILV

SEQ ID NO: 1464972 - protein, 18 aa, Mycobacterium tuberculosis
GHPLPGESLPGAIRRRLA

SEQ ID NO: 1464973 - protein, 21 aa, Mycobacterium tuberculosis
GHRIHAAIHFDDLQWERRYNR

SEQ ID NO: 1464974 - protein, 22 aa, Mycobacterium tuberculosis
GKRVHNAIIRRMQRMSFEELRE

SEQ ID NO: 1464975 - protein, 23 aa, Mycobacterium tuberculosis
GLAAFCDICVRAFADFAVVKPQV

SEQ ID NO: 1464976 - protein, 17 aa, Mycobacterium tuberculosis
GLAIAKRAARDGANIAL

SEQ ID NO: 1464977 - protein, 21 aa, Mycobacterium tuberculosis
GLETLSLRIERHVANAQRVAE

SEQ ID NO: 1464978 - protein, 17 aa, Mycobacterium tuberculosis
GLLPGDRVALRMGSNAE

SEQ ID NO: 1464979 - protein, 17 aa, Mycobacterium tuberculosis
GLLPYLPGDAADRLFDM

SEQ ID NO: 1464980 - protein, 18 aa, Mycobacterium tuberculosis
GLYPGRKFGGGALSVYID

SEQ ID NO: 1464981 - protein, 17 aa, Mycobacterium tuberculosis
GMLKYGFDDARPVLERA

SEQ ID NO: 1464982 - protein, 19 aa, Mycobacterium tuberculosis
GNFSTGLFNPGHGNTGFLN

SEQ ID NO: 1464983 - protein, 27 aa, Mycobacterium tuberculosis
GNMIKPMLARGELRLVGATTLDEYRKH

SEQ ID NO: 1464984 - protein, 17 aa, Mycobacterium tuberculosis
GNVPVTMGFYTRRDLPI

SEQ ID NO: 1464985 - protein, 17 aa, Mycobacterium tuberculosis
GPAEKIYDPGIILDKDR

SEQ ID NO: 1464986 - protein, 19 aa, Mycobacterium tuberculosis
GPCPPRQDMAYSIEADIYL

SEQ ID NO: 1464987 - protein, 19 aa, Mycobacterium tuberculosis
GPITLGFQVPGSVNAITLF

SEQ ID NO: 1464988 - protein, 31 aa, Mycobacterium tuberculosis; identical to SEQ ID NO: 200221

SEQ ID NO: 1464989 - protein, 23 aa, Mycobacterium tuberculosis
GQAAETFAILNLAGAGDHIVSSP

SEQ ID NO: 1464990 - protein, 20 aa, Mycobacterium tuberculosis
GQDAEAMYGYAATAATATEA

SEQ ID NO: 1464991 - protein, 25 aa, Mycobacterium tuberculosis
GQDKLRLLLEFANELPALPSHLAES

SEQ ID NO: 1464992 - protein, 17 aa, Mycobacterium tuberculosis
GQGSKPVIGTVMRQGYQ

SEQ ID NO: 1464993 - protein, 25 aa, Mycobacterium tuberculosis
GQPGRWGRTAVCARLSSADQKVDLD

SEQ ID NO: 1464994 - protein, 19 aa, Mycobacterium tuberculosis
GQPVKGRLTVPPSAPTTKP

SEQ ID NO: 1464995 - protein, 20 aa, Mycobacterium tuberculosis
GQRLAAFVVLKPGVSATPET

SEQ ID NO: 1464996 - protein, 19 aa, Mycobacterium tuberculosis
GRAALLARLDEAITSPAAY

SEQ ID NO: 1464997 - protein, 20 aa, Mycobacterium tuberculosis
GREAYPGDVFYLHSRLLERC

SEQ ID NO: 1464998 - protein, 19 aa, Mycobacterium tuberculosis
GREPVVVVVDGVRVGLTVC

SEQ ID NO: 1464999 - protein, 25 aa, Mycobacterium tuberculosis
GRFPYRNDGALGWVGTSPVGRFPAN

SEQ ID NO: 1465000 - protein, 23 aa, Mycobacterium tuberculosis
GRGDALRLARRIAAALNASDNNA

SEQ ID NO: 1465001 - protein, 20 aa, Mycobacterium tuberculosis
GRKRGHWMWFVFPQLRGLGS

SEQ ID NO: 1465002 - protein, 18 aa, Mycobacterium tuberculosis
GRKVLAREVDIRDDAELR

SEQ ID NO: 1465003 - protein, 17 aa, Mycobacterium tuberculosis
GRLLVAAAISFIEDVAR

SEQ ID NO: 1465004 - protein, 20 aa, Mycobacterium tuberculosis
GRPDVLTAWMDAAVIDENDP

SEQ ID NO: 1465005 - protein, 25 aa, Mycobacterium tuberculosis
GRRGEPGPPFFAAYGEWMATPPPTW

SEQ ID NO: 1465006 - protein, 20 aa, Mycobacterium tuberculosis
GSAGLLINGCKTWISNARRS

SEQ ID NO: 1465007 - protein, 17 aa, Mycobacterium tuberculosis
GSLLAAEYDEFLAGSAE

SEQ ID NO: 1465008 - protein, 19 aa, Mycobacterium tuberculosis
GSPGLELYSPAQLGLDHGH

SEQ ID NO: 1465009 - protein, 21 aa, Mycobacterium tuberculosis
GSPGLMIAMGPGFCSELVLLR

SEQ ID NO: 1465010 - protein, 29 aa, Mycobacterium tuberculosis
GTAAAYWLGRHGYSVTMVERHPGLRPGGQ

SEQ ID NO: 1465011 - protein, 18 aa, Mycobacterium tuberculosis
GTGNWGVFNSGSYNTGIG

SEQ ID NO: 1465012 - protein, 19 aa, Mycobacterium tuberculosis
GTIPYQRFRGAEIAGLTAG

SEQ ID NO: 1465013 - protein, 24 aa, Mycobacterium tuberculosis
GTPRPRWRSAQALTSRSCNGSLDT

SEQ ID NO: 1465014 - protein, 25 aa, Mycobacterium tuberculosis
GTTPNRLYWMSAWIDPDGTDGGPVL

SEQ ID NO: 1465015 - protein, 40 aa, Mycobacterium tuberculosis; identical to SEQ ID NO: 672988

SEQ ID NO: 1465016 - protein, 25 aa, Mycobacterium tuberculosis
GVTPVEHGLVLPSGPLIHGGTGGYG

SEQ ID NO: 1465017 - protein, 19 aa, Mycobacterium tuberculosis
GWRTIGRVLDGPARVLVDG

SEQ ID NO: 1465018 - protein, 34 aa, Mycobacterium tuberculosis; identical to SEQ ID NO: 200617

SEQ ID NO: 1465019 - protein, 22 aa, Mycobacterium tuberculosis
HAFAGSLLRDYGLLLPLEPDTR

SEQ ID NO: 1465020 - protein, 17 aa, Mycobacterium tuberculosis
HAKEQKAKVLAICNTNG

SEQ ID NO: 1465021 - protein, 23 aa, Mycobacterium tuberculosis
HAPDRRKVLEEAFRVLRPGGELI

SEQ ID NO: 1465022 - protein, 18 aa, Mycobacterium tuberculosis
HATLASDLMEVWRAPIID

SEQ ID NO: 1465023 - protein, 17 aa, Mycobacterium tuberculosis
HCTVSVPMVDAALGVTV

SEQ ID NO: 1465024 - protein, 20 aa, Mycobacterium tuberculosis
HGGLQRWRAAETVHGRVRTG

SEQ ID NO: 1465025 - protein, 23 aa, Mycobacterium tuberculosis
HGPAPRPTIPMRGGLDSGTLLER

SEQ ID NO: 1465026 - protein, 25 aa, Mycobacterium tuberculosis
HGPMDRFHRRLLWPIRTSAGEVVGF

SEQ ID NO: 1465027 - protein, 21 aa, Mycobacterium tuberculosis
HGRPLLRHRVELGAGSLADDV

SEQ ID NO: 1465028 - protein, 18 aa, Mycobacterium tuberculosis
HGRQARYSGLGSMEPKPE

SEQ ID NO: 1465029 - protein, 29 aa, Mycobacterium tuberculosis
HIAEELPLLGSCTFKAAGHVIEIRGTSVL

SEQ ID NO: 1465030 - protein, 19 aa, Mycobacterium tuberculosis
HIDTAILPNGWRDRLVSWT

SEQ ID NO: 1465031 - protein, 18 aa, Mycobacterium tuberculosis
HLRDGHYSGAAALGNAQG

SEQ ID NO: 1465032 - protein, 24 aa, Mycobacterium tuberculosis
HPRPRLFSLLHEFVHVVLHTEGLC

SEQ ID NO: 1465033 - protein, 26 aa, Mycobacterium tuberculosis
HRHLFTVLMDREWKHGVAAAVDVTLL

SEQ ID NO: 1465034 - protein, 25 aa, Mycobacterium tuberculosis
HRLLETWHPLGVVGVITAFNFPVAV

SEQ ID NO: 1465035 - protein, 25 aa, Mycobacterium tuberculosis
HSDPEFAAAAGFPRPILHGLCTYGM

SEQ ID NO: 1465036 - protein, 17 aa, Mycobacterium tuberculosis
HTMVLFRAGLLTEEQRD

SEQ ID NO: 1465037 - protein, 18 aa, Mycobacterium tuberculosis
HVAYWWSAEPQRLSMAAS

SEQ ID NO: 1465038 - protein, 23 aa, Mycobacterium tuberculosis
HVKEVRLSTRLTESPACLITDAF

SEQ ID NO: 1465039 - protein, 17 aa, Mycobacterium tuberculosis
IAANRALLMALLATNFL

SEQ ID NO: 1465040 - protein, 17 aa, Mycobacterium tuberculosis
IAASSAFAEHAAPGLIE

SEQ ID NO: 1465041 - protein, 18 aa, Mycobacterium tuberculosis
IAEVKRASPSAGALATIA

SEQ ID NO: 1465042 - protein, 26 aa, Mycobacterium tuberculosis
IAEVSARAGVEVTVFEPAEALITAGR

SEQ ID NO: 1465043 - protein, 22 aa, Mycobacterium tuberculosis
IAPSRFHVVPVLAYSPDPGPVA

SEQ ID NO: 1465044 - protein, 18 aa, Mycobacterium tuberculosis
IDGAFAHMALCMALSTSE

SEQ ID NO: 1465045 - protein, 20 aa, Mycobacterium tuberculosis
IDLRQDWPKALQKAGFDPSK

SEQ ID NO: 1465046 - protein, 17 aa, Mycobacterium tuberculosis
IDVGWSLVKTRAMFEHR

SEQ ID NO: 1465047 - protein, 20 aa, Mycobacterium tuberculosis
IEAAEALMLAIVGRLSAYVP

SEQ ID NO: 1465048 - protein, 17 aa, Mycobacterium tuberculosis
IEPCAAVGLELQRRGHD

SEQ ID NO: 1465049 - protein, 17 aa, Mycobacterium tuberculosis
IFGNRIEQMAGLLEPGR

SEQ ID NO: 1465050 - protein, 18 aa, Mycobacterium tuberculosis
IFVMSRITGWTAHIMEQA

SEQ ID NO: 1465051 - protein, 26 aa, Mycobacterium tuberculosis
IGGPVKRDAALCLAVLRVGADPEGVP

SEQ ID NO: 1465052 - protein, 20 aa, Mycobacterium tuberculosis
IGLLGKFMPNYLFAPDSTLP

SEQ ID NO: 1465053 - protein, 19 aa, Mycobacterium tuberculosis
IGNSGRFNTGIGNSGTAST

SEQ ID NO: 1465054 - protein, 19 aa, Mycobacterium tuberculosis
ILEREVFDVVAARLRADYA

SEQ ID NO: 1465055 - protein, 17 aa, Mycobacterium tuberculosis
ILRRVELSTTTTSGERP

SEQ ID NO: 1465056 - protein, 19 aa, Mycobacterium tuberculosis
ININETLYLGPLVVPPINV

SEQ ID NO: 1465057 - protein, 22 aa, Mycobacterium tuberculosis
IPESKKAVVVFPTYEDYAAVMR

SEQ ID NO: 1465058 - protein, 20 aa, Mycobacterium tuberculosis
IPFAAALHGPCDTNAFAAAI

SEQ ID NO: 1465059 - protein, 21 aa, Mycobacterium tuberculosis
IPGWAWSDVLEHFRAIETDLD

SEQ ID NO: 1465060 - protein, 20 aa, Mycobacterium tuberculosis
IQGLLTEAARTWADRLIGAA

SEQ ID NO: 1465061 - protein, 17 aa, Mycobacterium tuberculosis
IQITGGFIGIREFTLPE

SEQ ID NO: 1465062 - protein, 18 aa, Mycobacterium tuberculosis
IRSTGRWRGRPKNQDAYP

SEQ ID NO: 1465063 - protein, 17 aa, Mycobacterium tuberculosis
IRVADEVSVAFTAVRAK

SEQ ID NO: 1465064 - protein, 22 aa, Mycobacterium tuberculosis
ISAERAAAMVIRGLVEKPARID

SEQ ID NO: 1465065 - protein, 17 aa, Mycobacterium tuberculosis
ISDYLAALIRDTPHGYL

SEQ ID NO: 1465066 - protein, 17 aa, Mycobacterium tuberculosis
ISPAGSVEWLCVPRPDS

SEQ ID NO: 1465067 - protein, 22 aa, Mycobacterium tuberculosis
ITDEIKRRILAMAQPDADGNRP

SEQ ID NO: 1465068 - protein, 21 aa, Mycobacterium tuberculosis
ITKRAGVSVGALFRHFETMGD

SEQ ID NO: 1465069 - protein, 34 aa, Mycobacterium tuberculosis
IVGLERIGLRFVLEIRVPAGVDGRITWSNWIDEQ

SEQ ID NO: 1465070 - protein, 26 aa, Mycobacterium tuberculosis
KAVAGIRLALSLGFRVRVAATVASPA

SEQ ID NO: 1465071 - protein, 21 aa, Mycobacterium tuberculosis
KDGKRSLVVAGIKRCETMRFA

SEQ ID NO: 1465072 - protein, 20 aa, Mycobacterium tuberculosis
KDVFVPRHRFLSYKAMNDHT

SEQ ID NO: 1465073 - protein, 18 aa, Mycobacterium tuberculosis
KHRCSLDPLGGGFRSRRA

SEQ ID NO: 1465074 - protein, 19 aa, Mycobacterium tuberculosis
KIFRTRALRVPGVGTGAPG

SEQ ID NO: 1465075 - protein, 28 aa, Mycobacterium tuberculosis
KRLPRLTRMQRFWISLYFPLTMRSLCNA

SEQ ID NO: 1465076 - protein, 25 aa, Mycobacterium tuberculosis
KRRFLPRCAAGAISAFLLTEPDVGS

SEQ ID NO: 1465077 - protein, 33 aa, Mycobacterium tuberculosis
KRWAYYPWRRMVVAILGLRGFRAVRLDRNRHLI

SEQ ID NO: 1465078 - protein, 32 aa, Mycobacterium tuberculosis
KSLPGMLMAAARLDLAAVFLYAGSILPGRAKL

SEQ ID NO: 1465079 - protein, 21 aa, Mycobacterium tuberculosis
KVGLFPRPLPREAAITQVADW

SEQ ID NO: 1465080 - protein, 21 aa, Mycobacterium tuberculosis
KVSHPIVFGHAVRIFYKDAFA

SEQ ID NO: 1465081 - protein, 22 aa, Mycobacterium tuberculosis
KWDPGNLSMDWFRAEVAKDTRG

SEQ ID NO: 1465082 - protein, 24 aa, Mycobacterium tuberculosis
KYLNRLSDLLFILSRVANPDGDVL

SEQ ID NO: 1465083 - protein, 18 aa, Mycobacterium tuberculosis
LAAAIPMMVFSGVMNAGQ

SEQ ID NO: 1465084 - protein, 17 aa, Mycobacterium tuberculosis
LAAELARLRQRRDRLEV

SEQ ID NO: 1465085 - protein, 23 aa, Mycobacterium tuberculosis
LAERRGEAWFDPDGLILAFGDSP

SEQ ID NO: 1465086 - protein, 30 aa, Mycobacterium tuberculosis; identical to SEQ ID NO: 201892

SEQ ID NO: 1465087 - protein, 17 aa, Mycobacterium tuberculosis
LAIARPDLQVVLLEPLL

SEQ ID NO: 1465088 - protein, 19 aa, Mycobacterium tuberculosis
LALAADWRVSGDNVKFGAT

SEQ ID NO: 1465089 - protein, 25 aa, Mycobacterium tuberculosis
LAPVRFFNPIAMRFAQKATREDIDD

SEQ ID NO: 1465090 - protein, 17 aa, Mycobacterium tuberculosis
LARRAAQVIADRTGIGE

SEQ ID NO: 1465091 - protein, 18 aa, Mycobacterium tuberculosis
LASRLIDVTGWLATQPDT

SEQ ID NO: 1465092 - protein, 19 aa, Mycobacterium tuberculosis
LATESWYLATLRDKPAVAK

SEQ ID NO: 1465093 - protein, 17 aa, Mycobacterium tuberculosis
LAVDEVFQMQSEARAEA

SEQ ID NO: 1465094 - protein, 18 aa, Mycobacterium tuberculosis
LAVDGCVPLDVDTWDDYR

SEQ ID NO: 1465095 - protein, 20 aa, Mycobacterium tuberculosis
LAVLQRLVSRWDRPLRDVDI

SEQ ID NO: 1465096 - protein, 22 aa, Mycobacterium tuberculosis
LCSVSNRPAIYVATYFGDPGAA

SEQ ID NO: 1465097 - protein, 19 aa, Mycobacterium tuberculosis
LDAAAIPEAHWRLGDACEL

SEQ ID NO: 1465098 - protein, 24 aa, Mycobacterium tuberculosis
LDFRPKHRLAVLVVSAIPLAEPVR

SEQ ID NO: 1465099 - protein, 19 aa, Mycobacterium tuberculosis
LDGCAALIVALLGACPALR

SEQ ID NO: 1465100 - protein, 20 aa, Mycobacterium tuberculosis
LDHVREVVCEDSLGLAEEFE

SEQ ID NO: 1465101 - protein, 18 aa, Mycobacterium tuberculosis
LDQALARTAVLGVQTNVE

SEQ ID NO: 1465102 - protein, 29 aa, Mycobacterium tuberculosis
LDQQRQWILHMAKLSAAMAKQAQYVAQLH

SEQ ID NO: 1465103 - protein, 20 aa, Mycobacterium tuberculosis
LDSWRNYQWHQLARAFLMYV

SEQ ID NO: 1465104 - protein, 20 aa, Mycobacterium tuberculosis
LDVLERMGLLAAAQEHKTRI

SEQ ID NO: 1465105 - protein, 25 aa, Mycobacterium tuberculosis
LDVMMPRLDGLEVCRQLRGTGDDLP

SEQ ID NO: 1465106 - protein, 17 aa, Mycobacterium tuberculosis
LEAEGHRILKLNIGNPA

SEQ ID NO: 1465107 - protein, 17 aa, Mycobacterium tuberculosis
LERAAALGSRLGGHIVQ

SEQ ID NO: 1465108 - protein, 19 aa, Mycobacterium tuberculosis
LFDVHEIVEIGPFTIPQVD

SEQ ID NO: 1465109 - protein, 56 aa, Mycobacterium tuberculosis; identical to SEQ ID NO: 202255

SEQ ID NO: 1465110 - protein, 21 aa, Mycobacterium tuberculosis
LGEPHAISAMHGRGVADLLDG

SEQ ID NO: 1465111 - protein, 18 aa, Mycobacterium tuberculosis
LGEVLRRYPKVVAPELNL

SEQ ID NO: 1465112 - protein, 19 aa, Mycobacterium tuberculosis
LGLFLSLPGVSQWRTLQRV

SEQ ID NO: 1465113 - protein, 21 aa, Mycobacterium tuberculosis
LGPAGRFASIYDRVHAWASVP

SEQ ID NO: 1465114 - protein, 17 aa, Mycobacterium tuberculosis
LGRMIGAAFEISRDIIA

SEQ ID NO: 1465115 - protein, 18 aa, Mycobacterium tuberculosis
LIAEEALTLMAGAATLVA

SEQ ID NO: 1465116 - protein, 21 aa, Mycobacterium tuberculosis
LIEGPAGWGEFGAFVEYQSAQ

SEQ ID NO: 1465117 - protein, 18 aa, Mycobacterium tuberculosis
LIERIEAEYARYFTPTGR

SEQ ID NO: 1465118 - protein, 17 aa, Mycobacterium tuberculosis
LKAAGAVIVGKTNTCEL

SEQ ID NO: 1465119 - protein, 25 aa, Mycobacterium tuberculosis
LKPTLAGAVPTIWNDVMHYLEKDPD

SEQ ID NO: 1465120 - protein, 19 aa, Mycobacterium tuberculosis
LKQVCNHPAQLLHDRSPVG

SEQ ID NO: 1465121 - protein, 25 aa, Mycobacterium tuberculosis
LKRFVKGISAEAVFQKRAPANRPDW

SEQ ID NO: 1465122 - protein, 24 aa, Mycobacterium tuberculosis
LLARRMGKTRVIAETGAGQHGVAT

SEQ ID NO: 1465123 - protein, 19 aa, Mycobacterium tuberculosis
LLDYFPEDFLLVIDESHVT

SEQ ID NO: 1465124 - protein, 19 aa, Mycobacterium tuberculosis
LLEPLRSVPIVGNPLANLV

SEQ ID NO: 1465125 - protein, 18 aa, Mycobacterium tuberculosis
LLGCGAVLDHFRVAMAAA

SEQ ID NO: 1465126 - protein, 18 aa, Mycobacterium tuberculosis
LLLAKGYEVHGLIRRAST

SEQ ID NO: 1465127 - protein, 18 aa, Mycobacterium tuberculosis
LLNAALEAGETVLLEGSQ

SEQ ID NO: 1465128 - protein, 22 aa, Mycobacterium tuberculosis
LLQLKSWRLSTAKEQNVPAYVV

SEQ ID NO: 1465129 - protein, 26 aa, Mycobacterium tuberculosis
LLSAVPRALQGLALPTASQSASATPQ

SEQ ID NO: 1465130 - protein, 17 aa, Mycobacterium tuberculosis
LLTELGWALRRAPLPPT

SEQ ID NO: 1465131 - protein, 18 aa, Mycobacterium tuberculosis
LLVAAAISFIEDVARTWH

SEQ ID NO: 1465132 - protein, 34 aa, Mycobacterium tuberculosis
LLVAECLRTGAWEGLKPAELAGVVSAVVYETRGG

SEQ ID NO: 1465133 - protein, 19 aa, Mycobacterium tuberculosis
LMGRLAVVVDFAMEADAQY

SEQ ID NO: 1465134 - protein, 17 aa, Mycobacterium tuberculosis
LMRYPRRNTVCISSQAG

SEQ ID NO: 1465135 - protein, 23 aa, Mycobacterium tuberculosis
LNDFAQLLAALGRRYDGDERLSV

SEQ ID NO: 1465136 - protein, 19 aa, Mycobacterium tuberculosis
LNEGLPHWAMTPSIEQAAQ

SEQ ID NO: 1465137 - protein, 17 aa, Mycobacterium tuberculosis
LPALIRRYDEAKASGAP

SEQ ID NO: 1465138 - protein, 19 aa, Mycobacterium tuberculosis
LPALKSFVLPGGSPLSALL

SEQ ID NO: 1465139 - protein, 18 aa, Mycobacterium tuberculosis
LPAPLRRGQIRPLGLDRY

SEQ ID NO: 1465140 - protein, 27 aa, Mycobacterium tuberculosis
LPDGALMRRAAFGLATEIGRELTARTG

SEQ ID NO: 1465141 - protein, 22 aa, Mycobacterium tuberculosis
LPEGADPFVLLFSESAGRVLVA

SEQ ID NO: 1465142 - protein, 19 aa, Mycobacterium tuberculosis
LPEQLLKILARETGADLTL

SEQ ID NO: 1465143 - protein, 24 aa, Mycobacterium tuberculosis
LPFSPRSQYLVGHLAPVKLTGAAL

SEQ ID NO: 1465144 - protein, 19 aa, Mycobacterium tuberculosis
LPLPPRRRRRIPVVIHEAN

SEQ ID NO: 1465145 - protein, 19 aa, Mycobacterium tuberculosis
LPPGPRLSGSVQAVLMLRH

SEQ ID NO: 1465146 - protein, 19 aa, Mycobacterium tuberculosis
LPQCVPNAVLGTVTKTAIP

SEQ ID NO: 1465147 - protein, 18 aa, Mycobacterium tuberculosis
LQDPKGQRWVMQTWSQVV

SEQ ID NO: 1465148 - protein, 20 aa, Mycobacterium tuberculosis
LRAGIPTLILWVTSDQPIWA

SEQ ID NO: 1465149 - protein, 17 aa, Mycobacterium tuberculosis
LRAGLGMVDEAHAALPE

SEQ ID NO: 1465150 - protein, 28 aa, Mycobacterium tuberculosis
LRDEGITAMHFVPSLLGLFLSLPGVSQW

SEQ ID NO: 1465151 - protein, 32 aa, Mycobacterium tuberculosis
LREANDLCALPVAVFRCGMILADTSYAGQLNM

SEQ ID NO: 1465152 - protein, 19 aa, Mycobacterium tuberculosis
LREGIACAVLRRPDHRDTY

SEQ ID NO: 1465153 - protein, 17 aa, Mycobacterium tuberculosis
LRFISPIQNICRTTRVD

SEQ ID NO: 1465154 - protein, 17 aa, Mycobacterium tuberculosis
LRIERHVANAQRVAEFL

SEQ ID NO: 1465155 - protein, 22 aa, Mycobacterium tuberculosis
LRLAGEMLELAGIHGRDPAQTL

SEQ ID NO: 1465156 - protein, 23 aa, Mycobacterium tuberculosis
LRMGHVLSQAILRSARRHEAADQ

SEQ ID NO: 1465157 - protein, 20 aa, Mycobacterium tuberculosis
LRNMWRFWYQIPMSLPVIGP

SEQ ID NO: 1465158 - protein, 17 aa, Mycobacterium tuberculosis
LRPAGHGLATPRRRPHR

SEQ ID NO: 1465159 - protein, 17 aa, Mycobacterium tuberculosis
LRQISFRLAADDDQFMT

SEQ ID NO: 1465160 - protein, 17 aa, Mycobacterium tuberculosis
LRRVTALTQAGVRRRLG

SEQ ID NO: 1465161 - protein, 20 aa, Mycobacterium tuberculosis
LRRWHIDGLLCIGDAAHAMS

SEQ ID NO: 1465162 - protein, 28 aa, Mycobacterium tuberculosis
LSLRDLLKFEFLFSGRAQFEKDLANEVL

SEQ ID NO: 1465163 - protein, 18 aa, Mycobacterium tuberculosis
LSTGIALAFPRGPFVPAA

SEQ ID NO: 1465164 - protein, 17 aa, Mycobacterium tuberculosis
LTEAIPVQIIWGTKDVV

SEQ ID NO: 1465165 - protein, 24 aa, Mycobacterium tuberculosis
LTFLDREGWDSLTINALATQLGTK

SEQ ID NO: 1465166 - protein, 24 aa, Mycobacterium tuberculosis
LTVPEKPRGIVVFAHGSGSSRHSI

SEQ ID NO: 1465167 - protein, 19 aa, Mycobacterium tuberculosis
LVAFPEIRSISYFTQVVEE

SEQ ID NO: 1465168 - protein, 17 aa, Mycobacterium tuberculosis
LVAHPTESFGLRITDPS

SEQ ID NO: 1465169 - protein, 20 aa, Mycobacterium tuberculosis
LVGARLNWLLGNGESPQWSA

SEQ ID NO: 1465170 - protein, 19 aa, Mycobacterium tuberculosis
LVGWRRHIHRYPELGRQEY

SEQ ID NO: 1465171 - protein, 17 aa, Mycobacterium tuberculosis
LVKSIRAGEGVSYGHTW

SEQ ID NO: 1465172 - protein, 20 aa, Mycobacterium tuberculosis
LVNLPNWLSLTFRIDGGAWF

SEQ ID NO: 1465173 - protein, 17 aa, Mycobacterium tuberculosis
LVQRGTLRVGDSVVAGD

SEQ ID NO: 1465174 - protein, 21 aa, Mycobacterium tuberculosis
LVVSAGFMRILGPQFLSRFYG

SEQ ID NO: 1465175 - protein, 17 aa, Mycobacterium tuberculosis
LVVVVDVPGYLPGVDQE

SEQ ID NO: 1465176 - protein, 22 aa, Mycobacterium tuberculosis
LWPHPPEALAPRYVDALGGIDR

SEQ ID NO: 1465177 - protein, 25 aa, Mycobacterium tuberculosis
LWYCGPWTLWVMAGRGVASGAGVWR

SEQ ID NO: 1465178 - protein, 25 aa, Mycobacterium tuberculosis
LYPRKGVSELTRFTPEAVVEKYGLT

SEQ ID NO: 1465179 - protein, 20 aa, Mycobacterium tuberculosis
MAAAAAPYVTWMSGTSAQAK

SEQ ID NO: 1465180 - protein, 17 aa, Mycobacterium tuberculosis
MAVDIRIPDSYRLGEAG

SEQ ID NO: 1465181 - protein, 18 aa, Mycobacterium tuberculosis
MCAGLFAGVGRKFSDEEL

SEQ ID NO: 1465182 - protein, 17 aa, Mycobacterium tuberculosis
MELFKTALRLARHRELV

SEQ ID NO: 1465183 - protein, 23 aa, Mycobacterium tuberculosis
MFQMKFYAVALFRSRGVPPTRLR

SEQ ID NO: 1465184 - protein, 25 aa, Mycobacterium tuberculosis
MKEGDDVFVALSWTKHPPPQTYDEA

SEQ ID NO: 1465185 - protein, 17 aa, Mycobacterium tuberculosis
MKGNLAKAAGLFNAPAS

SEQ ID NO: 1465186 - protein, 20 aa, Mycobacterium tuberculosis
MKSLHLILSHFQMPGFQVPE

SEQ ID NO: 1465187 - protein, 19 aa, Mycobacterium tuberculosis
MPFTESLAFGATRNPWCLN

SEQ ID NO: 1465188 - protein, 18 aa, Mycobacterium tuberculosis
MRARFKKVADVLGIEQTI

SEQ ID NO: 1465189 - protein, 23 aa, Mycobacterium tuberculosis
MSLLDRWYAAIGHELHTLGGKPH

SEQ ID NO: 1465190 - protein, 17 aa, Mycobacterium tuberculosis
MVIDRELAYLAIDPNAP

SEQ ID NO: 1465191 - protein, 20 aa, Mycobacterium tuberculosis
NAGDYGFFWITAVTTDGSIV

SEQ ID NO: 1465192 - protein, 19 aa, Mycobacterium tuberculosis
NELCFVSGVLPTAPVSAVA

SEQ ID NO: 1465193 - protein, 25 aa, Mycobacterium tuberculosis
NILRRNGIEVSRYFAELDWERNFLR

SEQ ID NO: 1465194 - protein, 24 aa, Mycobacterium tuberculosis
NNRGRAGYRLLYSVRQYALEKLSE

SEQ ID NO: 1465195 - protein, 25 aa, Mycobacterium tuberculosis
NNRLPKVSWVLPGFLLSEHPAFPVN

SEQ ID NO: 1465196 - protein, 18 aa, Mycobacterium tuberculosis
NPVPREVLVPCLPSNAEE

SEQ ID NO: 1465197 - protein, 17 aa, Mycobacterium tuberculosis
NRSALDVMLDWDPTTAY

SEQ ID NO: 1465198 - protein, 18 aa, Mycobacterium tuberculosis
NRTGVFWIQDRLTIGQLR

SEQ ID NO: 1465199 - protein, 26 aa, Mycobacterium tuberculosis
NRVLPLLGGLAVMFGDLPPLPTTARF

SEQ ID NO: 1465200 - protein, 32 aa, Mycobacterium tuberculosis
NSFSKYYAMTGWRLGWLLVPTVLRRAVDCLTG

SEQ ID NO: 1465201 - protein, 18 aa, Mycobacterium tuberculosis
NYGSLNWGSGNTGTGNAG

SEQ ID NO: 1465202 - protein, 25 aa, Mycobacterium tuberculosis
PAAWFPSAEHLASWVRLCPGNHESA

SEQ ID NO: 1465203 - protein, 17 aa, Mycobacterium tuberculosis
PADRPALPAALTILRDI

SEQ ID NO: 1465204 - protein, 23 aa, Mycobacterium tuberculosis
PAKTARRPRVIGVVSNGDTAAAP

SEQ ID NO: 1465205 - protein, 17 aa, Mycobacterium tuberculosis
PALLRPTDEKIIYGDCS

SEQ ID NO: 1465206 - protein, 33 aa, Mycobacterium tuberculosis; identical to SEQ ID NO: 1380240

SEQ ID NO: 1465207 - protein, 23 aa, Mycobacterium tuberculosis
PAWLEPGQWWALVRVGCAGQLVY

SEQ ID NO: 1465208 - protein, 20 aa, Mycobacterium tuberculosis
PCWLVGLLFPSADGCAGHSD

SEQ ID NO: 1465209 - protein, 30 aa, Mycobacterium tuberculosis
PDEYVKGLAELGCFGLKIPSEYGGLNMSQV

SEQ ID NO: 1465210 - protein, 18 aa, Mycobacterium tuberculosis
PDGDYRFGQQIVVSHDGG

SEQ ID NO: 1465211 - protein, 22 aa, Mycobacterium tuberculosis
PDRVAAAAAFHPGGLVANSPDS

SEQ ID NO: 1465212 - protein, 23 aa, Mycobacterium tuberculosis
PDSLHWDCFSFGVIQRADSFTFY

SEQ ID NO: 1465213 - protein, 23 aa, Mycobacterium tuberculosis
PDTAELLRWLDAQTKRNLVITFG

SEQ ID NO: 1465214 - protein, 26 aa, Mycobacterium tuberculosis
PDWDARVALHRARRPPTWLTVETADV

SEQ ID NO: 1465215 - protein, 20 aa, Mycobacterium tuberculosis
PEVIARIAAGVAEGNAKLSR

SEQ ID NO: 1465216 - protein, 22 aa, Mycobacterium tuberculosis
PFSDKQLDMMAAFADQAALAWR

SEQ ID NO: 1465217 - protein, 19 aa, Mycobacterium tuberculosis
PGDVISLGATSWRITEITH

SEQ ID NO: 1465218 - protein, 17 aa, Mycobacterium tuberculosis
PGGLTVFDVRVEAMAPF

SEQ ID NO: 1465219 - protein, 18 aa, Mycobacterium tuberculosis
PGGVVLYATCSPHLAETV

SEQ ID NO: 1465220 - protein, 18 aa, Mycobacterium tuberculosis
PGPESMLAAAAAWDGVAA

SEQ ID NO: 1465221 - protein, 26 aa, Mycobacterium tuberculosis
PGQGSQWLGMGIELLDTAPAFAQQID

SEQ ID NO: 1465222 - protein, 18 aa, Mycobacterium tuberculosis
PGVISAPLTPPVKASAYR

SEQ ID NO: 1465223 - protein, 24 aa, Mycobacterium tuberculosis
PHYDFRLERDGVLVSWAVPKNLPD

SEQ ID NO: 1465224 - protein, 18 aa, Mycobacterium tuberculosis
PIAIVGMACRYPGGVNSP

SEQ ID NO: 1465225 - protein, 19 aa, Mycobacterium tuberculosis
PKRRPVPLRLRDWREVYEE

SEQ ID NO: 1465226 - protein, 18 aa, Mycobacterium tuberculosis
PLCPFAYQTSVWIRDVRA

SEQ ID NO: 1465227 - protein, 24 aa, Mycobacterium tuberculosis
PLGRANLYSVCFDLATTDRKLTPA

SEQ ID NO: 1465228 - protein, 19 aa, Mycobacterium tuberculosis
PLSALLHVARTVVRRAERS

SEQ ID NO: 1465229 - protein, 24 aa, Mycobacterium tuberculosis
PNIQPLQHYSWRIMPENLEDAGVS

SEQ ID NO: 1465230 - protein, 22 aa, Mycobacterium tuberculosis
PPELETRIAILRKKAQMERLAV

SEQ ID NO: 1465231 - protein, 24 aa, Mycobacterium tuberculosis
PPNPKATIALLRRVEDVLDVEVPL

SEQ ID NO: 1465232 - protein, 17 aa, Mycobacterium tuberculosis
PPPADIGRLLLRCHDRP

SEQ ID NO: 1465233 - protein, 24 aa, Mycobacterium tuberculosis
PQLFKQLLMVAGMERYYQIARCYR

SEQ ID NO: 1465234 - protein, 21 aa, Mycobacterium tuberculosis
PQVHTLLDFHFRPHLTAASGK

SEQ ID NO: 1465235 - protein, 19 aa, Mycobacterium tuberculosis
PRARAGWDRATGRIPADAP

SEQ ID NO: 1465236 - protein, 17 aa, Mycobacterium tuberculosis
PRFSPGKGLGVIPREGY

SEQ ID NO: 1465237 - protein, 19 aa, Mycobacterium tuberculosis
PRIDCRGGVQARRTAPDTV

SEQ ID NO: 1465238 - protein, 22 aa, Mycobacterium tuberculosis
PRSGLPVIEVLDTELVRGRTAG

SEQ ID NO: 1465239 - protein, 22 aa, Mycobacterium tuberculosis
PRSNLARFGISPTYPLDFAADV

SEQ ID NO: 1465240 - protein, 27 aa, Mycobacterium tuberculosis
PRVLQIRALVLGGALDWLKDNKASTNH

SEQ ID NO: 1465241 - protein, 18 aa, Mycobacterium tuberculosis
PRVLRPGPVSTERIAEVL

SEQ ID NO: 1465242 - protein, 18 aa, Mycobacterium tuberculosis
PSAGTPVGPWLRTGDSGF

SEQ ID NO: 1465243 - protein, 19 aa, Mycobacterium tuberculosis
PSFDHAASLGFTLTDQTPA

SEQ ID NO: 1465244 - protein, 24 aa, Mycobacterium tuberculosis
PSGEGLHVGHPLGYIATDVYARYF

SEQ ID NO: 1465245 - protein, 17 aa, Mycobacterium tuberculosis
PSIGWRTSTRLPRDHYV

SEQ ID NO: 1465246 - protein, 31 aa, Mycobacterium tuberculosis; identical to SEQ ID NO: 204408

SEQ ID NO: 1465247 - protein, 21 aa, Mycobacterium tuberculosis
PSLVIRIAPPVGRQLDWMVCR

SEQ ID NO: 1465248 - protein, 21 aa, Mycobacterium tuberculosis
PTIRRDGSYDAGERWPDAQIV

SEQ ID NO: 1465249 - protein, 25 aa, Mycobacterium tuberculosis
PTRAEPDCLLDSLLLEDPGLLADDL

SEQ ID NO: 1465250 - protein, 20 aa, Mycobacterium tuberculosis
PTRRGNWWYYARTFEGKQYG

SEQ ID NO: 1465251 - protein, 18 aa, Mycobacterium tuberculosis
PTVVVSVPRVFEKVYNTA

SEQ ID NO: 1465252 - protein, 25 aa, Mycobacterium tuberculosis
PVAHPLYCRRMQQKLVEFAEAGFPG

SEQ ID NO: 1465253 - protein, 17 aa, Mycobacterium tuberculosis
PVFFPGLAAEWSDRRPF

SEQ ID NO: 1465254 - protein, 18 aa, Mycobacterium tuberculosis
PVFVARAGGGIVEDVDGN

SEQ ID NO: 1465255 - protein, 24 aa, Mycobacterium tuberculosis
PVMCFSGPMIFGAGVLGGAQADLL

SEQ ID NO: 1465256 - protein, 20 aa, Mycobacterium tuberculosis
PVSMLIPRVVGFRLTGEIQP

SEQ ID NO: 1465257 - protein, 18 aa, Mycobacterium tuberculosis
PVTIPGFAINPFGLNVPL

SEQ ID NO: 1465258 - protein, 17 aa, Mycobacterium tuberculosis
PVTVLLKALGWTSEQIV

SEQ ID NO: 1465259 - protein, 28 aa, Mycobacterium tuberculosis
QAGRVWVNCYHLYPAHAAFGGYKQSGIG

SEQ ID NO: 1465260 - protein, 22 aa, Mycobacterium tuberculosis
QAGYEKWRIRFASTAWTSTWRR

SEQ ID NO: 1465261 - protein, 17 aa, Mycobacterium tuberculosis
QAIKDVGVDLVMEEYDN

SEQ ID NO: 1465262 - protein, 21 aa, Mycobacterium tuberculosis
QFWSQIHGFVMLELAGFYGDR

SEQ ID NO: 1465263 - protein, 18 aa, Mycobacterium tuberculosis
QHGLPGLRAIFAELLGIA

SEQ ID NO: 1465264 - protein, 21 aa, Mycobacterium tuberculosis
QHGVPAKGWLVGEVHNGIAQM

SEQ ID NO: 1465265 - protein, 18 aa, Mycobacterium tuberculosis
QKLPDGWDADLPHWEPGS

SEQ ID NO: 1465266 - protein, 18 aa, Mycobacterium tuberculosis
QLDLERAMELCAPDECVE

SEQ ID NO: 1465267 - protein, 23 aa, Mycobacterium tuberculosis
QLEHWGCPWSRKPDGRVAVRPFG

SEQ ID NO: 1465268 - protein, 22 aa, Mycobacterium tuberculosis
QLPDDRLEELLALAHEVRMRWC

SEQ ID NO: 1465269 - protein, 18 aa, Mycobacterium tuberculosis
QNGFILPSFPPFSTPDVF

SEQ ID NO: 1465270 - protein, 21 aa, Mycobacterium tuberculosis
QQARGKGGLVRVSWAEASEMV

SEQ ID NO: 1465271 - protein, 25 aa, Mycobacterium tuberculosis
QQSWPTVADWVRWISGDGTKPENIH

SEQ ID NO: 1465272 - protein, 19 aa, Mycobacterium tuberculosis
QRAPDEMRRVGRWVEGVPM

SEQ ID NO: 1465273 - protein, 19 aa, Mycobacterium tuberculosis
QREILILRVVVGLSAEETA

SEQ ID NO: 1465274 - protein, 20 aa, Mycobacterium tuberculosis
QRKGFEFEELEAAGLSRQGR

SEQ ID NO: 1465275 - protein, 21 aa, Mycobacterium tuberculosis
QRLRALAALPELIAAKPDGPR

SEQ ID NO: 1465276 - protein, 17 aa, Mycobacterium tuberculosis
QRREVMRAASKVEPVPV

SEQ ID NO: 1465277 - protein, 18 aa, Mycobacterium tuberculosis
QRTAAGWQPLKTGITTHI

SEQ ID NO: 1465278 - protein, 32 aa, Mycobacterium tuberculosis; identical to SEQ ID NO: 204847

SEQ ID NO: 1465279 - protein, 18 aa, Mycobacterium tuberculosis
QRYRDRYIFAGLQPGQRI

SEQ ID NO: 1465280 - protein, 18 aa, Mycobacterium tuberculosis
QSAFPQLLSAVPRALQGL

SEQ ID NO: 1465281 - protein, 26 aa, Mycobacterium tuberculosis
QSARAGDPFQHWIGRRFDAVATDKPP

SEQ ID NO: 1465282 - protein, 21 aa, Mycobacterium tuberculosis
QSRRRGIGTAMARAALAKTAG

SEQ ID NO: 1465283 - protein, 25 aa, Mycobacterium tuberculosis
QVIGNRPKIGWRRLEAQAVLSRLLN

SEQ ID NO: 1465284 - protein, 21 aa, Mycobacterium tuberculosis
QVVVCGKPSFYTGRGTFSLRL

SEQ ID NO: 1465285 - protein, 26 aa, Mycobacterium tuberculosis
QWKPVGGFPVTFGWIHASRRGHARLH

SEQ ID NO: 1465286 - protein, 25 aa, Mycobacterium tuberculosis
RAAEPWEVAATIAFLASDYSSYLTG

SEQ ID NO: 1465287 - protein, 28 aa, Mycobacterium tuberculosis
RAAHRPLEWDLRNGVIVRKARAHGLATP

SEQ ID NO: 1465288 - protein, 22 aa, Mycobacterium tuberculosis
RAAMPNICLQMLLRGRNTVGYT

SEQ ID NO: 1465289 - protein, 17 aa, Mycobacterium tuberculosis
RAIDPGFFSARKLPDGL

SEQ ID NO: 1465290 - protein, 20 aa, Mycobacterium tuberculosis
RAKAALRYADALIWTPAHLA

SEQ ID NO: 1465291 - protein, 18 aa, Mycobacterium tuberculosis
RAKHAVFDRLVYRKLRAA

SEQ ID NO: 1465292 - protein, 19 aa, Mycobacterium tuberculosis
RARHAKFATVIARDRAEAI

SEQ ID NO: 1465293 - protein, 20 aa, Mycobacterium tuberculosis
RARQANGFELVRAHLEMARR

SEQ ID NO: 1465294 - protein, 18 aa, Mycobacterium tuberculosis
RARTVIDFAARRVNPPVY

SEQ ID NO: 1465295 - protein, 25 aa, Mycobacterium tuberculosis
RASDAVACALGLQRAPLAPIRLRIG

SEQ ID NO: 1465296 - protein, 20 aa, Mycobacterium tuberculosis
RASDDLLLVGGMRVRQRDKL

SEQ ID NO: 1465297 - protein, 17 aa, Mycobacterium tuberculosis
RASKATVYRRWPSKAEL

SEQ ID NO: 1465298 - protein, 19 aa, Mycobacterium tuberculosis
RAVAELALLAAAETTTNGS

SEQ ID NO: 1465299 - protein, 19 aa, Mycobacterium tuberculosis
RAVLECAGVHDILAKSLGS

SEQ ID NO: 1465300 - protein, 22 aa, Mycobacterium tuberculosis
RAVVARARQKGCTLLVTDGDWQ

SEQ ID NO: 1465301 - protein, 18 aa, Mycobacterium tuberculosis
RCATPGPHRAFHIATGGS

SEQ ID NO: 1465302 - protein, 17 aa, Mycobacterium tuberculosis
RDGVPTFLLPANPVSAL

SEQ ID NO: 1465303 - protein, 17 aa, Mycobacterium tuberculosis
RDPRLRRALTPDYEPMC

SEQ ID NO: 1465304 - protein, 18 aa, Mycobacterium tuberculosis
REAVNLALRTLLGEADTA

SEQ ID NO: 1465305 - protein, 22 aa, Mycobacterium tuberculosis
REEIIRMVDLMISRVAGQLKSK

SEQ ID NO: 1465306 - protein, 30 aa, Mycobacterium tuberculosis; identical to SEQ ID NO: 205179

SEQ ID NO: 1465307 - protein, 20 aa, Mycobacterium tuberculosis
RERGWPQFADRLLELAREAE

SEQ ID NO: 1465308 - protein, 17 aa, Mycobacterium tuberculosis
RESLGFEVLPLSGGERP

SEQ ID NO: 1465309 - protein, 27 aa, Mycobacterium tuberculosis
REVPADLRQDWPAALRDAGFDPTARTA

SEQ ID NO: 1465310 - protein, 20 aa, Mycobacterium tuberculosis
RFEQRPGEALALGQVLDTLV

SEQ ID NO: 1465311 - protein, 20 aa, Mycobacterium tuberculosis
RFTLYHLPVALQLPPGATGV

SEQ ID NO: 1465312 - protein, 18 aa, Mycobacterium tuberculosis
RGMCLYFDELPVIVLNGS

SEQ ID NO: 1465313 - protein, 18 aa, Mycobacterium tuberculosis
RGPVPAVSTLVVFGKTAP

SEQ ID NO: 1465314 - protein, 20 aa, Mycobacterium tuberculosis
RGRRGIVAARELLPFADGRA

SEQ ID NO: 1465315 - protein, 19 aa, Mycobacterium tuberculosis
RGYVLRRLLRRVIRSAKLL

SEQ ID NO: 1465316 - protein, 20 aa, Mycobacterium tuberculosis
RHRAVLRAADRLELAEGLRA

SEQ ID NO: 1465317 - protein, 28 aa, Mycobacterium tuberculosis
RHTLKKLSGLRARNGLLTASGDNASGSG

SEQ ID NO: 1465318 - protein, 19 aa, Mycobacterium tuberculosis
RIAALKPDLIVAINAGVDA

SEQ ID NO: 1465319 - protein, 26 aa, Mycobacterium tuberculosis
RICVIATEFELVMPFVERAQSKGLEV

SEQ ID NO: 1465320 - protein, 17 aa, Mycobacterium tuberculosis
RKLGAPGHDEFAVGALA

SEQ ID NO: 1465321 - protein, 17 aa, Mycobacterium tuberculosis
RKLTPRYRIGCKRILNS

SEQ ID NO: 1465322 - protein, 23 aa, Mycobacterium tuberculosis
RLDRPGWFYPPTVITDISKDMAL

SEQ ID NO: 1465323 - protein, 20 aa, Mycobacterium tuberculosis
RLGRRVTEIALVFRRAPHLP

SEQ ID NO: 1465324 - protein, 18 aa, Mycobacterium tuberculosis
RLPDVVSRYGGWGDRQIL

SEQ ID NO: 1465325 - protein, 22 aa, Mycobacterium tuberculosis
RLRPQSAMSFRELLTATRDIAS

SEQ ID NO: 1465326 - protein, 21 aa, Mycobacterium tuberculosis
RLRQAGTFADAALRRVLEVID

SEQ ID NO: 1465327 - protein, 18 aa, Mycobacterium tuberculosis
RLTKVLGLPGPHRRTQRS

SEQ ID NO: 1465328 - protein, 20 aa, Mycobacterium tuberculosis
RMGALALHVAKIARRRHPQH

SEQ ID NO: 1465329 - protein, 22 aa, Mycobacterium tuberculosis
RMLAEHRLPGLLVTAGAGKQYA

SEQ ID NO: 1465330 - protein, 18 aa, Mycobacterium tuberculosis
RMREQAARIGRATLTRYA

SEQ ID NO: 1465331 - protein, 18 aa, Mycobacterium tuberculosis
RNLPTPSGNTFEWDPNST

SEQ ID NO: 1465332 - protein, 20 aa, Mycobacterium tuberculosis
RPAEALAWMCDRAVDLLLLE

SEQ ID NO: 1465333 - protein, 17 aa, Mycobacterium tuberculosis
RPARLVIQSVLGRVRIP

SEQ ID NO: 1465334 - protein, 20 aa, Mycobacterium tuberculosis
RPDPPGPHLLVLARGPEGYR

SEQ ID NO: 1465335 - protein, 26 aa, Mycobacterium tuberculosis
RPELKLPDLELIFAPAPFYDEALVPP

SEQ ID NO: 1465336 - protein, 19 aa, Mycobacterium tuberculosis
RPGEGIVTLEHIARNQHGE

SEQ ID NO: 1465337 - protein, 18 aa, Mycobacterium tuberculosis
RPGPPPARTGADRTSAVL

SEQ ID NO: 1465338 - protein, 17 aa, Mycobacterium tuberculosis
RPILHGLCTYGMTCKAI

SEQ ID NO: 1465339 - protein, 18 aa, Mycobacterium tuberculosis
RPQDGAIITGWDYPACEA

SEQ ID NO: 1465340 - protein, 18 aa, Mycobacterium tuberculosis
RPRPGYLPRVIDGARHHG

SEQ ID NO: 1465341 - protein, 19 aa, Mycobacterium tuberculosis
RPWRLRAPGGRRELDEAVG

SEQ ID NO: 1465342 - protein, 23 aa, Mycobacterium tuberculosis
RPYQQRGLAWLAFLSSLGLGSCL

SEQ ID NO: 1465343 - protein, 23 aa, Mycobacterium tuberculosis
RQQTMRASVDWSHALLTGPEQVL

SEQ ID NO: 1465344 - protein, 17 aa, Mycobacterium tuberculosis
RQSYPVRVAHVLSVNLA

SEQ ID NO: 1465345 - protein, 20 aa, Mycobacterium tuberculosis
RRGPHRVLRGDLAFAGLPGV

SEQ ID NO: 1465346 - protein, 36 aa, Mycobacterium tuberculosis; identical to SEQ ID NO: 205862

SEQ ID NO: 1465347 - protein, 19 aa, Mycobacterium tuberculosis
RRLSTLGIVPVEVYRQRRA

SEQ ID NO: 1465348 - protein, 20 aa, Mycobacterium tuberculosis
RRRRELLRRNNLDGTLQEIK

SEQ ID NO: 1465349 - protein, 18 aa, Mycobacterium tuberculosis
RRRRSVVAPGLRHHHVQR

SEQ ID NO: 1465350 - protein, 17 aa, Mycobacterium tuberculosis
RRVDAHYADPLDLRADS

SEQ ID NO: 1465351 - protein, 18 aa, Mycobacterium tuberculosis
RRVRVAVVFGGRSNEHAI

SEQ ID NO: 1465352 - protein, 19 aa, Mycobacterium tuberculosis
RTACSNLRNPAGVGADDGA

SEQ ID NO: 1465353 - protein, 20 aa, Mycobacterium tuberculosis
RTAEELGRAFPGTAVITSAG

SEQ ID NO: 1465354 - protein, 19 aa, Mycobacterium tuberculosis
RTAVAAGILRTSAQVVALI

SEQ ID NO: 1465355 - protein, 19 aa, Mycobacterium tuberculosis
RTAVERFGGLDVMVNNAGI

SEQ ID NO: 1465356 - protein, 20 aa, Mycobacterium tuberculosis
RTGSWLRRDRRTFTATQLVL

SEQ ID NO: 1465357 - protein, 27 aa, Mycobacterium tuberculosis
RTLFRRDQIGIVFQFFNLIPTLTVLEN

SEQ ID NO: 1465358 - protein, 23 aa, Mycobacterium tuberculosis
RTMLREYLEAMRALWTQEEACYD

SEQ ID NO: 1465359 - protein, 18 aa, Mycobacterium tuberculosis
RTVDFKNTVLIFTSNLGT

SEQ ID NO: 1465360 - protein, 17 aa, Mycobacterium tuberculosis
RTYPVLYLFHGGGTDQD

SEQ ID NO: 1465361 - protein, 26 aa, Mycobacterium tuberculosis
RVAALAAVNCFAWRPTGPLFRGMLAA

SEQ ID NO: 1465362 - protein, 20 aa, Mycobacterium tuberculosis
RVLVWDGEGAIGRWRGGRSE

SEQ ID NO: 1465363 - protein, 17 aa, Mycobacterium tuberculosis
RVRDPRLRRALTPDYEP

SEQ ID NO: 1465364 - protein, 20 aa, Mycobacterium tuberculosis
RWDKPFLAIFGYRDPILGQA

SEQ ID NO: 1465365 - protein, 18 aa, Mycobacterium tuberculosis
RWSALPLPEPDSTLRAHY

SEQ ID NO: 1465366 - protein, 29 aa, Mycobacterium tuberculosis
RYEGPKGGPGMREMLAITGAIKGAGLGKD

SEQ ID NO: 1465367 - protein, 25 aa, Mycobacterium tuberculosis
RYNVANCLVALAILDTVGVSPEQAV

SEQ ID NO: 1465368 - protein, 27 aa, Mycobacterium tuberculosis
SAEGRVAALRRCVPMVGQIKDPTLRDE

SEQ ID NO: 1465369 - protein, 26 aa, Mycobacterium tuberculosis
SAGIGRAGLVGKLSVPQGWTVAAPEI

SEQ ID NO: 1465370 - protein, 19 aa, Mycobacterium tuberculosis
SAIAQHWMYEGKHVLIIFD

SEQ ID NO: 1465371 - protein, 18 aa, Mycobacterium tuberculosis
SALLSRRDVVVVASVSCI

SEQ ID NO: 1465372 - protein, 17 aa, Mycobacterium tuberculosis
SDRPWRLAMSTAGTFEN

SEQ ID NO: 1465373 - protein, 18 aa, Mycobacterium tuberculosis
SELLWYRRGTFVGRVDAA

SEQ ID NO: 1465374 - protein, 17 aa, Mycobacterium tuberculosis
SEVDIYDGLTINIGKPT

SEQ ID NO: 1465375 - protein, 18 aa, Mycobacterium tuberculosis
SGALLNICVSYRITGDID

SEQ ID NO: 1465376 - protein, 26 aa, Mycobacterium tuberculosis
SGDPYRLAAQLGMPPWRVQKAQKQAR

SEQ ID NO: 1465377 - protein, 24 aa, Mycobacterium tuberculosis
SGERFVLGVGFGWNVEELADHGVP

SEQ ID NO: 1465378 - protein, 21 aa, Mycobacterium tuberculosis
SGSGARYGRQGIEYWEHQGEV

SEQ ID NO: 1465379 - protein, 27 aa, Mycobacterium tuberculosis
SGTVGAFPFGFGWQQSPGFFNSTTTPS

SEQ ID NO: 1465380 - protein, 18 aa, Mycobacterium tuberculosis
SHAAVAPHLGVNAADAVT

SEQ ID NO: 1465381 - protein, 18 aa, Mycobacterium tuberculosis
SKIRGREPIRIHPDDAAA

SEQ ID NO: 1465382 - protein, 19 aa, Mycobacterium tuberculosis
SKSPRCTWPAHIVDVKRAI

SEQ ID NO: 1465383 - protein, 24 aa, Mycobacterium tuberculosis
SKTGREFGVTTGRRRRCGWFDAVI

SEQ ID NO: 1465384 - protein, 17 aa, Mycobacterium tuberculosis
SLAEAMSDVAGRAAPLP

SEQ ID NO: 1465385 - protein, 25 aa, Mycobacterium tuberculosis
SMHGTDAWEPYAAVADSEITRVVLG

SEQ ID NO: 1465386 - protein, 17 aa, Mycobacterium tuberculosis
SNLGLHLAMRSAGVTVR

SEQ ID NO: 1465387 - protein, 21 aa, Mycobacterium tuberculosis
SPFAASLLFGYVGAFMYEGDT

SEQ ID NO: 1465388 - protein, 18 aa, Mycobacterium tuberculosis
SPIVFLRLRKAARRHRVP

SEQ ID NO: 1465389 - protein, 17 aa, Mycobacterium tuberculosis
SPTFGRWDSVLLDDQDR

SEQ ID NO: 1465390 - protein, 21 aa, Mycobacterium tuberculosis
SPYVLPRLVPVAGDSAGGVGS

SEQ ID NO: 1465391 - protein, 27 aa, Mycobacterium tuberculosis
SQAGCGMACPFCATGQGGLTRNLSTAE

SEQ ID NO: 1465392 - protein, 20 aa, Mycobacterium tuberculosis
SRDPERHPGLAIGAVAVVNG

SEQ ID NO: 1465393 - protein, 17 aa, Mycobacterium tuberculosis
SRQGLAQGYALRLADRL

SEQ ID NO: 1465394 - protein, 23 aa, Mycobacterium tuberculosis
SRRVRARLARRMTAQRSTTNPVL

SEQ ID NO: 1465395 - protein, 19 aa, Mycobacterium tuberculosis
SRTTPSIVAFARNGEVLVG

SEQ ID NO: 1465396 - protein, 19 aa, Mycobacterium tuberculosis
SSAEQVRWVLQDSEAVVLF

SEQ ID NO: 1465397 - protein, 17 aa, Mycobacterium tuberculosis
SSPLPYMSALHQFSEVQ

SEQ ID NO: 1465398 - protein, 30 aa, Mycobacterium tuberculosis; identical to SEQ ID NO: 206747

SEQ ID NO: 1465399 - protein, 17 aa, Mycobacterium tuberculosis
SVCAHCRPAGSTTPPLG

SEQ ID NO: 1465400 - protein, 25 aa, Mycobacterium tuberculosis
SVDYRLAPRYRFPTAATDVRAAWDW

SEQ ID NO: 1465401 - protein, 18 aa, Mycobacterium tuberculosis
SVRAARDYHNGILDGDAV

SEQ ID NO: 1465402 - protein, 19 aa, Mycobacterium tuberculosis
SWAGTLIVVSHDRYLLERV

SEQ ID NO: 1465403 - protein, 19 aa, Mycobacterium tuberculosis
SYVLHPYQMVKDLRTEYEV

SEQ ID NO: 1465404 - protein, 19 aa, Mycobacterium tuberculosis
TAIPYRVPFPQSMPTQETA

SEQ ID NO: 1465405 - protein, 19 aa, Mycobacterium tuberculosis
TALLAGLGLQCAARVTAVE

SEQ ID NO: 1465406 - protein, 20 aa, Mycobacterium tuberculosis
TARMVRSRLDAELVGNVSIR

SEQ ID NO: 1465407 - protein, 17 aa, Mycobacterium tuberculosis
TATDGWAVAHRGALVAE

SEQ ID NO: 1465408 - protein, 19 aa, Mycobacterium tuberculosis
TDAELGWIATAFDPNVLTV

SEQ ID NO: 1465409 - protein, 17 aa, Mycobacterium tuberculosis
TDEQAWAVFAQWEAAGG

SEQ ID NO: 1465410 - protein, 21 aa, Mycobacterium tuberculosis
TDIDAVLEFRVSEEVLLERLK

SEQ ID NO: 1465411 - protein, 29 aa, Mycobacterium tuberculosis
TDRLARRAWQRFQAIEARGGFVEAHDFLA

SEQ ID NO: 1465412 - protein, 23 aa, Mycobacterium tuberculosis
TEAARAEGGWLLNKDGYRYLQDY

SEQ ID NO: 1465413 - protein, 17 aa, Mycobacterium tuberculosis
TEATIVVAGGRGVGSAE

SEQ ID NO: 1465414 - protein, 17 aa, Mycobacterium tuberculosis
TGAFRVAQRASRSMQRN

SEQ ID NO: 1465415 - protein, 21 aa, Mycobacterium tuberculosis
TGGLGGLGLFLAEKMANAGAG

SEQ ID NO: 1465416 - protein, 17 aa, Mycobacterium tuberculosis
TGIRRAGADIVLTYWAV

SEQ ID NO: 1465417 - protein, 23 aa, Mycobacterium tuberculosis
TGKLRPPVFGILRYITDAVDEID

SEQ ID NO: 1465418 - protein, 23 aa, Mycobacterium tuberculosis
THGHTEWLPPPHLDHGQPRTNTF

SEQ ID NO: 1465419 - protein, 28 aa, Mycobacterium tuberculosis
TKPPKVVSQRGWRHWVHALTRINLGLSP

SEQ ID NO: 1465420 - protein, 27 aa, Mycobacterium tuberculosis
TKSGAWCVAADFSVGMLAAGAARKVPK

SEQ ID NO: 1465421 - protein, 17 aa, Mycobacterium tuberculosis
TLRAVRAIAGYSCPPET

SEQ ID NO: 1465422 - protein, 19 aa, Mycobacterium tuberculosis
TLVGARRGDLEVAAKELDV

SEQ ID NO: 1465423 - protein, 22 aa, Mycobacterium tuberculosis
TMSDLRFLKFLRESIFPGGELP

SEQ ID NO: 1465424 - protein, 25 aa, Mycobacterium tuberculosis
TNPQIDLTIRWDTPPITLFPNGISA

SEQ ID NO: 1465425 - protein, 18 aa, Mycobacterium tuberculosis
TPAPPRRKPIQMPGLQDV

SEQ ID NO: 1465426 - protein, 30 aa, Mycobacterium tuberculosis
TPEDTGLCSARMYFAYGLGNSVWFPLATGG

SEQ ID NO: 1465427 - protein, 17 aa, Mycobacterium tuberculosis
TPWHHQRFWVTDRSAMS

SEQ ID NO: 1465428 - protein, 30 aa, Mycobacterium tuberculosis; identical to SEQ ID NO: 207256

SEQ ID NO: 1465429 - protein, 18 aa, Mycobacterium tuberculosis
TRIGTVLGILKAYTTRVG

SEQ ID NO: 1465430 - protein, 19 aa, Mycobacterium tuberculosis
TRITACLLANGGIFADGHT

SEQ ID NO: 1465431 - protein, 17 aa, Mycobacterium tuberculosis
TRLAERQGLPAPQIRVG

SEQ ID NO: 1465432 - protein, 20 aa, Mycobacterium tuberculosis
TRLRWAQRTVELPAGRYQTI

SEQ ID NO: 1465433 - protein, 21 aa, Mycobacterium tuberculosis
TRPGQYEAPLGITLRELLDYA

SEQ ID NO: 1465434 - protein, 20 aa, Mycobacterium tuberculosis
TRTGAGLAFTPGGLRLASRA

SEQ ID NO: 1465435 - protein, 25 aa, Mycobacterium tuberculosis
TSAHAGVVSPGFIGAPLALAALGQM

SEQ ID NO: 1465436 - protein, 19 aa, Mycobacterium tuberculosis
TSLNEVICHGIPDSTVITD

SEQ ID NO: 1465437 - protein, 21 aa, Mycobacterium tuberculosis
TSVVATCYLLGVSTRRMERLV

SEQ ID NO: 1465438 - protein, 27 aa, Mycobacterium tuberculosis
TVANARVRWDLPAAVVERRIRAVTPNP

SEQ ID NO: 1465439 - protein, 17 aa, Mycobacterium tuberculosis
TVERLEHKLGIKGSDTA

SEQ ID NO: 1465440 - protein, 23 aa, Mycobacterium tuberculosis
TVFDGGWILPGLVDAHCHVGLGK

SEQ ID NO: 1465441 - protein, 18 aa, Mycobacterium tuberculosis
TVQRDGTCVLVIAPAPAL

SEQ ID NO: 1465442 - protein, 27 aa, Mycobacterium tuberculosis
TVRSYNCLKREGVHTVGELVARTESDL

SEQ ID NO: 1465443 - protein, 17 aa, Mycobacterium tuberculosis
VAALCGSPSQARKHADA

SEQ ID NO: 1465444 - protein, 21 aa, Mycobacterium tuberculosis
VAAPRPVRRSTFYRNVEGWLL

SEQ ID NO: 1465445 - protein, 18 aa, Mycobacterium tuberculosis
VAGEQIWRVPPLGHGEAI

SEQ ID NO: 1465446 - protein, 25 aa, Mycobacterium tuberculosis
VAGSRIDPVLARSWLLVNGAHGDRF

SEQ ID NO: 1465447 - protein, 19 aa, Mycobacterium tuberculosis
VARDRAQAIAGLRALAAGQ

SEQ ID NO: 1465448 - protein, 28 aa, Mycobacterium tuberculosis
VARIRSGPPMGFFRIGWVRTLANLNEFF

SEQ ID NO: 1465449 - protein, 17 aa, Mycobacterium tuberculosis
VATFLVLRTRRDGSRNG

SEQ ID NO: 1465450 - protein, 17 aa, Mycobacterium tuberculosis
VAVKGPYFGDRRKAFLE

SEQ ID NO: 1465451 - protein, 19 aa, Mycobacterium tuberculosis
VDAFPRGAGRMLAIMHALD

SEQ ID NO: 1465452 - protein, 20 aa, Mycobacterium tuberculosis
VDAKLAVKVNDLMLPVVKGV

SEQ ID NO: 1465453 - protein, 22 aa, Mycobacterium tuberculosis
VDGLWLAGSHGFELVAPDGSHH

SEQ ID NO: 1465454 - protein, 24 aa, Mycobacterium tuberculosis
VDLSRLAEDIIVWSSTEFGYVTLH

SEQ ID NO: 1465455 - protein, 25 aa, Mycobacterium tuberculosis
VDRHLPAFLRFAGREFIGVQGTQLS

SEQ ID NO: 1465456 - protein, 25 aa, Mycobacterium tuberculosis
VDSCRECNSCTRGIEQYCKPGANFT

SEQ ID NO: 1465457 - protein, 19 aa, Mycobacterium tuberculosis
VDYYNFFLSGGFLAPPGRA

SEQ ID NO: 1465458 - protein, 18 aa, Mycobacterium tuberculosis
VEAVLRLLAGVLGNPASH

SEQ ID NO: 1465459 - protein, 20 aa, Mycobacterium tuberculosis
VELRNRLKTATGLTLPPTVI

SEQ ID NO: 1465460 - protein, 20 aa, Mycobacterium tuberculosis
VERRAVPLPLEQKIFDAEWT

SEQ ID NO: 1465461 - protein, 24 aa, Mycobacterium tuberculosis
VFGHAVRIFYKDAFAKHQELFDDL

SEQ ID NO: 1465462 - protein, 23 aa, Mycobacterium tuberculosis
VFTPEELYPLTGVRSLVLNTSVE

SEQ ID NO: 1465463 - protein, 19 aa, Mycobacterium tuberculosis
VGFGRGRRAPVSSSDQLVR

SEQ ID NO: 1465464 - protein, 17 aa, Mycobacterium tuberculosis
VGHGDRGPVWVFSGQGS

SEQ ID NO: 1465465 - protein, 30 aa, Mycobacterium tuberculosis
VGQTLFLFDFRDGIELNPIVIPGSSIPITM

SEQ ID NO: 1465466 - protein, 18 aa, Mycobacterium tuberculosis
VGRHLLEVNPCFDRLARD

SEQ ID NO: 1465467 - protein, 23 aa, Mycobacterium tuberculosis
VGRPDIMIVVGGVIPPGDFDELY

SEQ ID NO: 1465468 - protein, 20 aa, Mycobacterium tuberculosis
VGTAVRYTAKPGAFRRPNGQ

SEQ ID NO: 1465469 - protein, 19 aa, Mycobacterium tuberculosis
VGVCAEYDALPGIGHACGH

SEQ ID NO: 1465470 - protein, 26 aa, Mycobacterium tuberculosis
VGVSPSLRFGLAFCEASGPRLVRHTG

SEQ ID NO: 1465471 - protein, 25 aa, Mycobacterium tuberculosis
VGYWRRAGLTASRFVACPFGGSGAR

SEQ ID NO: 1465472 - protein, 17 aa, Mycobacterium tuberculosis
VHRLPAWSRNLTAKIKK

SEQ ID NO: 1465473 - protein, 18 aa, Mycobacterium tuberculosis
VHTVEFYTAGTAVRRTGS

SEQ ID NO: 1465474 - protein, 25 aa, Mycobacterium tuberculosis
VILPTRRRARDLGHTTALFRAQTLQ

SEQ ID NO: 1465475 - protein, 19 aa, Mycobacterium tuberculosis
VKAARRARQEWLAERLATL

SEQ ID NO: 1465476 - protein, 31 aa, Mycobacterium tuberculosis
VLAELGYRVRRFAARVVWKLAPDAPLPPQTH

SEQ ID NO: 1465477 - protein, 17 aa, Mycobacterium tuberculosis
VLAPLGLVFDENSPWLN

SEQ ID NO: 1465478 - protein, 28 aa, Mycobacterium tuberculosis
VLRRRWSPDGKPIVGFVGRLAPEKHVDR

SEQ ID NO: 1465479 - protein, 19 aa, Mycobacterium tuberculosis
VLWVGDYQGLFGVSAGSSI

SEQ ID NO: 1465480 - protein, 23 aa, Mycobacterium tuberculosis
VMARLRSPLLAVVKDGSLLGVVT

SEQ ID NO: 1465481 - protein, 19 aa, Mycobacterium tuberculosis
VPVTMGFYTRRDLPIHYLL

SEQ ID NO: 1465482 - protein, 18 aa, Mycobacterium tuberculosis
VQGGRPEALGGLGGAASS

SEQ ID NO: 1465483 - protein, 18 aa, Mycobacterium tuberculosis
VQVLRRLYDRVGDRLALI

SEQ ID NO: 1465484 - protein, 20 aa, Mycobacterium tuberculosis
VRASGVPIEHIVCVDGAPPA

SEQ ID NO: 1465485 - protein, 17 aa, Mycobacterium tuberculosis
VRDIRFEQMLLLDDETP

SEQ ID NO: 1465486 - protein, 25 aa, Mycobacterium tuberculosis
VRIVSYPGSSLWDMVRPRPSSRPAA

SEQ ID NO: 1465487 - protein, 19 aa, Mycobacterium tuberculosis
VRLAREGADIVALDICAPV

SEQ ID NO: 1465488 - protein, 23 aa, Mycobacterium tuberculosis
VRQALRMRPDRIVVGEVRGAEVV

SEQ ID NO: 1465489 - protein, 24 aa, Mycobacterium tuberculosis
VRRDEFSRWLSAKPDYLVTTEQSV

SEQ ID NO: 1465490 - protein, 18 aa, Mycobacterium tuberculosis
VRTDELLDLWAAAYPGGL

SEQ ID NO: 1465491 - protein, 18 aa, Mycobacterium tuberculosis
VSDVVLFPGTGFVELAIR

SEQ ID NO: 1465492 - protein, 17 aa, Mycobacterium tuberculosis
VSELWGFGMDRLVGLDR

SEQ ID NO: 1465493 - protein, 25 aa, Mycobacterium tuberculosis
VSIPLIKIPAAPGFGNSTTSPSSGF

SEQ ID NO: 1465494 - protein, 27 aa, Mycobacterium tuberculosis
VSLALDGAGLGTVWGRQLATSMLADAG

SEQ ID NO: 1465495 - protein, 23 aa, Mycobacterium tuberculosis
VSVELADGLGLPVLSVASMVARP

SEQ ID NO: 1465496 - protein, 21 aa, Mycobacterium tuberculosis
VTARLWPTLIEPLRTREQARR

SEQ ID NO: 1465497 - protein, 24 aa, Mycobacterium tuberculosis
VTESFRLPPSVLTTVYYRVFGGWL

SEQ ID NO: 1465498 - protein, 17 aa, Mycobacterium tuberculosis
VTGGLTFAGGPWSNYVT

SEQ ID NO: 1465499 - protein, 23 aa, Mycobacterium tuberculosis
VVCCRNGSMNLVVWAEGNGVARV

SEQ ID NO: 1465500 - protein, 18 aa, Mycobacterium tuberculosis
VWTLRLYLTGKRLWHDPR

SEQ ID NO: 1465501 - protein, 17 aa, Mycobacterium tuberculosis
WCRQVLDLLDQVRNAAP

SEQ ID NO: 1465502 - protein, 34 aa, Mycobacterium tuberculosis; identical to SEQ ID NO: 208448

SEQ ID NO: 1465503 - protein, 21 aa, Mycobacterium tuberculosis
WETTCLISPAGSVEWLCVPRP

SEQ ID NO: 1465504 - protein, 17 aa, Mycobacterium tuberculosis
WFEVQSIRGHLVDGAVA

SEQ ID NO: 1465505 - protein, 19 aa, Mycobacterium tuberculosis
WGIAAAMTRGDISVAGVDP

SEQ ID NO: 1465506 - protein, 18 aa, Mycobacterium tuberculosis
WHGQRLRALAALPELIAA

SEQ ID NO: 1465507 - protein, 17 aa, Mycobacterium tuberculosis
WHGRPWAHHVPVMRETI

SEQ ID NO: 1465508 - protein, 24 aa, Mycobacterium tuberculosis
WLDDRKWAYVRLEGRAFGDVPLNL

SEQ ID NO: 1465509 - protein, 17 aa, Mycobacterium tuberculosis
WLQEEWLHHCGDAAAFL

SEQ ID NO: 1465510 - protein, 29 aa, Mycobacterium tuberculosis
WPADYGHYGPLFIRMAWHAAGTYRIHDGR

SEQ ID NO: 1465511 - protein, 24 aa, Mycobacterium tuberculosis
WPDALRRGGFDAAEPAAWIAEGLF

SEQ ID NO: 1465512 - protein, 19 aa, Mycobacterium tuberculosis
WPDPRASLCDIARALRPGG

SEQ ID NO: 1465513 - protein, 24 aa, Mycobacterium tuberculosis
WQENWARLGTFNVPNPVGSLAPPD

SEQ ID NO: 1465514 - protein, 21 aa, Mycobacterium tuberculosis
WQQVLRNLGIDIGKNGQINLG

SEQ ID NO: 1465515 - protein, 24 aa, Mycobacterium tuberculosis
WQTVWKRHHRWSLDGTCDEVFAHV

SEQ ID NO: 1465516 - protein, 21 aa, Mycobacterium tuberculosis
WRFENRCELLAFRHDLDPNDA

SEQ ID NO: 1465517 - protein, 18 aa, Mycobacterium tuberculosis
WRIMPENLEDAGVSWKVY

SEQ ID NO: 1465518 - protein, 26 aa, Mycobacterium tuberculosis
WSVDGRPRRAAVSSFGISGTNAHLIL

SEQ ID NO: 1465519 - protein, 17 aa, Mycobacterium tuberculosis
WTSLVVTAWMGEHGGAV

SEQ ID NO: 1465520 - protein, 17 aa, Mycobacterium tuberculosis
WVAENEVADLPLHPGFA

SEQ ID NO: 1465521 - protein, 18 aa, Mycobacterium tuberculosis
WVMSDWGGTPSWECALAG

SEQ ID NO: 1465522 - protein, 17 aa, Mycobacterium tuberculosis
WWLTFSSAAALLGTPGQ

SEQ ID NO: 1465523 - protein, 20 aa, Mycobacterium tuberculosis
WWQVHRRAMIVAEELWIYAS

SEQ ID NO: 1465524 - protein, 19 aa, Mycobacterium tuberculosis
YAEAFCRAVGGSWADVLDG

SEQ ID NO: 1465525 - protein, 23 aa, Mycobacterium tuberculosis
YDALCFPGLAAEWGGRRPFVGAL

SEQ ID NO: 1465526 - protein, 19 aa, Mycobacterium tuberculosis
YDGAVAWLVGEEGRGVPTI

SEQ ID NO: 1465527 - protein, 33 aa, Mycobacterium tuberculosis; identical to SEQ ID NO: 92789

SEQ ID NO: 1465528 - protein, 23 aa, Mycobacterium tuberculosis
YEVLQRVPSFDVVFVGHRRGEVR

SEQ ID NO: 1465529 - protein, 24 aa, Mycobacterium tuberculosis
YFLGCRMDSMFPLGPLLGNAGLNI

SEQ ID NO: 1465530 - protein, 19 aa, Mycobacterium tuberculosis
YGAALPWPASSADGTARPG

SEQ ID NO: 1465531 - protein, 17 aa, Mycobacterium tuberculosis
YGGWARHGGGAFSGKDP

SEQ ID NO: 1465532 - protein, 21 aa, Mycobacterium tuberculosis
YGLDPERIWTTVYFDDDEAVR

SEQ ID NO: 1465533 - protein, 17 aa, Mycobacterium tuberculosis
YGPAFQGLVAIWRRGSE

SEQ ID NO: 1465534 - protein, 17 aa, Mycobacterium tuberculosis
YILGAGMHPWGKWGNDF

SEQ ID NO: 1465535 - protein, 17 aa, Mycobacterium tuberculosis
YIPGAGWIGLDPTSGLL

SEQ ID NO: 1465536 - protein, 24 aa, Mycobacterium tuberculosis
YPKVVLVTGACRFLGGYLTARLAQ

SEQ ID NO: 1465537 - protein, 18 aa, Mycobacterium tuberculosis
YSYLVSLLPSRIVADLGA

SEQ ID NO: 1465538 - protein, 19 aa, Mycobacterium tuberculosis
YTAKPGAFRRPNGQAFSSH

SEQ ID NO: 1465539 - protein, 25 aa, Mycobacterium tuberculosis
AAAADGWAEIALRLATQRHDFYLLD

SEQ ID NO: 1465540 - protein, 17 aa, Mycobacterium tuberculosis
AAAAGARQVVILAAGLD

SEQ ID NO: 1465541 - protein, 17 aa, Mycobacterium tuberculosis
AAACWRPVLQGRDVVAM

SEQ ID NO: 1465542 - protein, 19 aa, Mycobacterium tuberculosis
AAAEFDYELMWAQDVAAML

SEQ ID NO: 1465543 - protein, 18 aa, Mycobacterium tuberculosis
AAALPGVVDIVAASRTVL

SEQ ID NO: 1465544 - protein, 18 aa, Mycobacterium tuberculosis
AAAPYVAWMSVTAVRAEQ

SEQ ID NO: 1465545 - protein, 17 aa, Mycobacterium tuberculosis
AAFQTVFHVHLHVLPPR

SEQ ID NO: 1465546 - protein, 22 aa, Mycobacterium tuberculosis
AAGARFSGGVFACAALAERELT

SEQ ID NO: 1465547 - protein, 17 aa, Mycobacterium tuberculosis
AAIQVMRAPAARNRAYA

SEQ ID NO: 1465548 - protein, 22 aa, Mycobacterium tuberculosis
AAQRRDMMWICRDGDRAKNHLL

SEQ ID NO: 1465549 - protein, 19 aa, Mycobacterium tuberculosis
AAVRRLGHAAGLRVTTGRK

SEQ ID NO: 1465550 - protein, 25 aa, Mycobacterium tuberculosis
ACAEAFAEFVDWSLVDVLRGAPGAP

SEQ ID NO: 1465551 - protein, 17 aa, Mycobacterium tuberculosis
ACPEVFIAAAAERTTHI

SEQ ID NO: 1465552 - protein, 19 aa, Mycobacterium tuberculosis
ADDRFWLAVGRTRSNAYLL

SEQ ID NO: 1465553 - protein, 25 aa, Mycobacterium tuberculosis
AEAKARRGPLCLGIDPHPELLRGWD

SEQ ID NO: 1465554 - protein, 19 aa, Mycobacterium tuberculosis
AEGLVSLAASVQPLRAAAG

SEQ ID NO: 1465555 - protein, 21 aa, Mycobacterium tuberculosis
AEKLVRARLRREVLIDDGTDE

SEQ ID NO: 1465556 - protein, 20 aa, Mycobacterium tuberculosis
AEMWSQDAMAMYGYAGASAA

SEQ ID NO: 1465557 - protein, 22 aa, Mycobacterium tuberculosis
AEQLMPHWMLSLRAADMRRGGT

SEQ ID NO: 1465558 - protein, 25 aa, Mycobacterium tuberculosis
AEQLPAREALAWGLISAVYPDSDFE

SEQ ID NO: 1465559 - protein, 17 aa, Mycobacterium tuberculosis
AFLRRFVVYPSDHELIA

SEQ ID NO: 1465560 - protein, 25 aa, Mycobacterium tuberculosis
AFQSVVWGLTVGSWIGSSAGLMAAA

SEQ ID NO: 1465561 - protein, 25 aa, Mycobacterium tuberculosis
AGEACARAIAWYLAMARRSQGNESA

SEQ ID NO: 1465562 - protein, 18 aa, Mycobacterium tuberculosis
AGGADLAAIAGFCAQAAV

SEQ ID NO: 1465563 - protein, 18 aa, Mycobacterium tuberculosis
AGGPRKVSPLAVQMIMPN

SEQ ID NO: 1465564 - protein, 18 aa, Mycobacterium tuberculosis
AGLLDYPMHIGARCQSVC

SEQ ID NO: 1465565 - protein, 25 aa, Mycobacterium tuberculosis
AGSGPMLAAAAAWDGLADELAVAAS

SEQ ID NO: 1465566 - protein, 17 aa, Mycobacterium tuberculosis
AGVWAFGALVDPLEPQA

SEQ ID NO: 1465567 - protein, 23 aa, Mycobacterium tuberculosis
AGYRVVRHPSTVMLPGPTVDVRM

SEQ ID NO: 1465568 - protein, 19 aa, Mycobacterium tuberculosis
AHALAFAAEGARVVVNDIG

SEQ ID NO: 1465569 - protein, 24 aa, Mycobacterium tuberculosis
AHEGSLRFGDKVVLGRDNVINTYL

SEQ ID NO: 1465570 - protein, 17 aa, Mycobacterium tuberculosis
AHSEWLHRETTRIGRTL

SEQ ID NO: 1465571 - protein, 17 aa, Mycobacterium tuberculosis
AIAKPFGAYGQEYQAVL

SEQ ID NO: 1465572 - protein, 23 aa, Mycobacterium tuberculosis
AKFGLTEAIAAYSTRLKITPTRV

SEQ ID NO: 1465573 - protein, 17 aa, Mycobacterium tuberculosis
AKFLDKRGPGIQQLACR

SEQ ID NO: 1465574 - protein, 21 aa, Mycobacterium tuberculosis
AKNPDCAICGDAPTITELVDD

SEQ ID NO: 1465575 - protein, 23 aa, Mycobacterium tuberculosis
AKVGYPIKWRDYSKLAIDRDDLY

SEQ ID NO: 1465576 - protein, 21 aa, Mycobacterium tuberculosis
ALAYMDLRPGTAMRDIAVDAV

SEQ ID NO: 1465577 - protein, 18 aa, Mycobacterium tuberculosis
ALLFPALCTPTGDPPAPE

SEQ ID NO: 1465578 - protein, 25 aa, Mycobacterium tuberculosis
ALLRRIGLAAAKYWVCKRSTAHAAE

SEQ ID NO: 1465579 - protein, 17 aa, Mycobacterium tuberculosis
ALMDIDTIYVWTHDSIG

SEQ ID NO: 1465580 - protein, 17 aa, Mycobacterium tuberculosis
ALTRPRHPDDWTEIDSA

SEQ ID NO: 1465581 - protein, 26 aa, Mycobacterium tuberculosis
ALVAANRARLVALAVSNLLGQNTPAI

SEQ ID NO: 1465582 - protein, 24 aa, Mycobacterium tuberculosis
ALVCKFASRNARRFTLTVGLMLPR

SEQ ID NO: 1465583 - protein, 23 aa, Mycobacterium tuberculosis
AMVAAAQPYLAWLTYTAEAAAHA

SEQ ID NO: 1465584 - protein, 17 aa, Mycobacterium tuberculosis
ANQWLFHAGEPADSIYI

SEQ ID NO: 1465585 - protein, 17 aa, Mycobacterium tuberculosis
APAAEWFGERGWTAVAT

SEQ ID NO: 1465586 - protein, 20 aa, Mycobacterium tuberculosis
APDRPRIGEILGAFDDKIAA

SEQ ID NO: 1465587 - protein, 23 aa, Mycobacterium tuberculosis
APGHMLGGLPLGHSVNAGSGINN

SEQ ID NO: 1465588 - protein, 20 aa, Mycobacterium tuberculosis
ARAAQRRWARLAPAQRAAGL

SEQ ID NO: 1465589 - protein, 18 aa, Mycobacterium tuberculosis
ARDSAPSLVFLDELDALA

SEQ ID NO: 1465590 - protein, 18 aa, Mycobacterium tuberculosis
ARKVAAWGADAMIVQGGE

SEQ ID NO: 1465591 - protein, 21 aa, Mycobacterium tuberculosis
ARLRADRALVAFPEIRSISYF

SEQ ID NO: 1465592 - protein, 22 aa, Mycobacterium tuberculosis
ARQVPDNGGMYFVPAFSGLFAP

SEQ ID NO: 1465593 - protein, 18 aa, Mycobacterium tuberculosis
ARRLGVLIDAVFNHLGPS

SEQ ID NO: 1465594 - protein, 17 aa, Mycobacterium tuberculosis
ARSRLAGVMPDSSSRLV

SEQ ID NO: 1465595 - protein, 18 aa, Mycobacterium tuberculosis
ARSTVAVDLLRNVGLTVQ

SEQ ID NO: 1465596 - protein, 17 aa, Mycobacterium tuberculosis
ASDLSLAVMRLSRQLRF

SEQ ID NO: 1465597 - protein, 23 aa, Mycobacterium tuberculosis
ASESAGFKWLAPYTGSAIAQHWM

SEQ ID NO: 1465598 - protein, 17 aa, Mycobacterium tuberculosis
ASGLPMGGDLEFADELT

SEQ ID NO: 1465599 - protein, 29 aa, Mycobacterium tuberculosis
ASVESSVLRWARESCGLTEVAAARKLGLP

SEQ ID NO: 1465600 - protein, 31 aa, Mycobacterium tuberculosis
ATARARSGEELRFCLRPDSRDVLGAHETVDL

SEQ ID NO: 1465601 - protein, 25 aa, Mycobacterium tuberculosis
ATFPIAAHYFAVFPLAKHMESAGRR

SEQ ID NO: 1465602 - protein, 25 aa, Mycobacterium tuberculosis
ATLHHRASALIGRLMRELTADWDYS

SEQ ID NO: 1465603 - protein, 17 aa, Mycobacterium tuberculosis
ATLPPGEYRQISGNTAL

SEQ ID NO: 1465604 - protein, 17 aa, Mycobacterium tuberculosis
ATNLWGYTDLMRELGAD

SEQ ID NO: 1465605 - protein, 21 aa, Mycobacterium tuberculosis
ATPQPLQWDCFLFGIIQSDDH

SEQ ID NO: 1465606 - protein, 24 aa, Mycobacterium tuberculosis
AVADCGRLLAGRLHRAVDGASQLR

SEQ ID NO: 1465607 - protein, 22 aa, Mycobacterium tuberculosis
AVADWLYWQYVTGLLDRALAAA

SEQ ID NO: 1465608 - protein, 27 aa, Mycobacterium tuberculosis
AVAREVLRAGPGVPELRAAGERMRDAV

SEQ ID NO: 1465609 - protein, 31 aa, Mycobacterium tuberculosis
AVASAARACGGWTVGVIPKMLVYRELADHDA

SEQ ID NO: 1465610 - protein, 33 aa, Mycobacterium tuberculosis; identical to SEQ ID NO: 197252

SEQ ID NO: 1465611 - protein, 25 aa, Mycobacterium tuberculosis
AVGSELKAADSLAEYVLELARKLIK

SEQ ID NO: 1465612 - protein, 18 aa, Mycobacterium tuberculosis
AVGVCWHAGRGSYPWLPT

SEQ ID NO: 1465613 - protein, 24 aa, Mycobacterium tuberculosis
AVLRHVTVMLGGDVVRMSAGVRFC

SEQ ID NO: 1465614 - protein, 18 aa, Mycobacterium tuberculosis
AVSELVGFISTPRCIQAM

SEQ ID NO: 1465615 - protein, 18 aa, Mycobacterium tuberculosis
AVVISMRLPQRRHAVNRW

SEQ ID NO: 1465616 - protein, 27 aa, Mycobacterium tuberculosis
AWSLAVALRLAAYQLLRVDGGEPVLLL

SEQ ID NO: 1465617 - protein, 20 aa, Mycobacterium tuberculosis
AYETAYRLTVPPPVIAENRT

SEQ ID NO: 1465618 - protein, 29 aa, Mycobacterium tuberculosis
CAPSRSLPLLECWTALAALSRDTTKLRLG

SEQ ID NO: 1465619 - protein, 17 aa, Mycobacterium tuberculosis
CDAEFERMRVEALEVLD

SEQ ID NO: 1465620 - protein, 21 aa, Mycobacterium tuberculosis
CGAVLDHFRVAMAAAGTTANV

SEQ ID NO: 1465621 - protein, 26 aa, Mycobacterium tuberculosis
CGVEPNMRWRTFCDELLAVIDKLNVD

SEQ ID NO: 1465622 - protein, 25 aa, Mycobacterium tuberculosis
CLTLKGFTYSQMRLPGGDTVDVYNL

SEQ ID NO: 1465623 - protein, 22 aa, Mycobacterium tuberculosis
CPAPCEPACVLGINQDPVTIKQ

SEQ ID NO: 1465624 - protein, 27 aa, Mycobacterium tuberculosis
CQDFARLAIACLRANGLAACYVSGYLA

SEQ ID NO: 1465625 - protein, 20 aa, Mycobacterium tuberculosis
CTAQVLLAVLAAMYASYHGA

SEQ ID NO: 1465626 - protein, 25 aa, Mycobacterium tuberculosis
CTRFRSDALQIIAFGRYARTVTAAE

SEQ ID NO: 1465627 - protein, 27 aa, Mycobacterium tuberculosis
DAAVSWAERRRMFELPRSSWGDYDRSL

SEQ ID NO: 1465628 - protein, 25 aa, Mycobacterium tuberculosis
DAGLLSGAVTMVWQREKLLQVNEIG

SEQ ID NO: 1465629 - protein, 20 aa, Mycobacterium tuberculosis
DARLVVKLPNRWPLTDAAGV

SEQ ID NO: 1465630 - protein, 19 aa, Mycobacterium tuberculosis
DASAWVGIGTPDFVEVPID

SEQ ID NO: 1465631 - protein, 25 aa, Mycobacterium tuberculosis
DASLRLLPRGGRFIEMGKTEFGTPR

SEQ ID NO: 1465632 - protein, 18 aa, Mycobacterium tuberculosis
DAYIDYRALGGIDGRYPK

SEQ ID NO: 1465633 - protein, 20 aa, Mycobacterium tuberculosis
DDLLNALIDFLAAVRNGLVP

SEQ ID NO: 1465634 - protein, 25 aa, Mycobacterium tuberculosis
DDVIAWRGERRFVERLSRATIDVSK

SEQ ID NO: 1465635 - protein, 23 aa, Mycobacterium tuberculosis
DDVSAAIAALFATHGQAYQELSA

SEQ ID NO: 1465636 - protein, 19 aa, Mycobacterium tuberculosis
DEIRWDIRPSPHLGTLEVR

SEQ ID NO: 1465637 - protein, 20 aa, Mycobacterium tuberculosis
DFRPFHIDWDLAAAEKGGYE

SEQ ID NO: 1465638 - protein, 21 aa, Mycobacterium tuberculosis
DFWGGAGSAACQGFITQLGRN

SEQ ID NO: 1465639 - protein, 19 aa, Mycobacterium tuberculosis
DGGLHRFLLSAASAFVAGV

SEQ ID NO: 1465640 - protein, 19 aa, Mycobacterium tuberculosis
DGNLPIAAIERFCQITDPA

SEQ ID NO: 1465641 - protein, 18 aa, Mycobacterium tuberculosis
DGPDRVRISGVIGEPPPP

SEQ ID NO: 1465642 - protein, 17 aa, Mycobacterium tuberculosis
DGTAMDRFRRLVAAQGG

SEQ ID NO: 1465643 - protein, 21 aa, Mycobacterium tuberculosis
DIARGSLRLWSLAGGMPLHRY

SEQ ID NO: 1465644 - protein, 23 aa, Mycobacterium tuberculosis
DLAAAVSWTLGRGVISHESALAL

SEQ ID NO: 1465645 - protein, 23 aa, Mycobacterium tuberculosis
DLLRSPRPRWPPNAAGMQVECTD

SEQ ID NO: 1465646 - protein, 20 aa, Mycobacterium tuberculosis
DLTGCMALGITGPILRSTGL

SEQ ID NO: 1465647 - protein, 19 aa, Mycobacterium tuberculosis
DMTEHGWATDEWPALYRRV

SEQ ID NO: 1465648 - protein, 17 aa, Mycobacterium tuberculosis
DPDTVLLGTDFGGDSLT

SEQ ID NO: 1465649 - protein, 17 aa, Mycobacterium tuberculosis
DPNRPTGAFMFLGPTGV

SEQ ID NO: 1465650 - protein, 18 aa, Mycobacterium tuberculosis
DPTPAPGWTIAHQIGHLL

SEQ ID NO: 1465651 - protein, 20 aa, Mycobacterium tuberculosis
DRVGACRQLADALGATVLLK

SEQ ID NO: 1465652 - protein, 18 aa, Mycobacterium tuberculosis
DRVIDRAPLWCAVDLRDG

SEQ ID NO: 1465653 - protein, 22 aa, Mycobacterium tuberculosis
DSEFPPLSWRRDLSVDALLARN

SEQ ID NO: 1465654 - protein, 22 aa, Mycobacterium tuberculosis
DSLLRRLKQYSGRLATEAVSAM

SEQ ID NO: 1465655 - protein, 21 aa, Mycobacterium tuberculosis
DSVRSAHCAGASRFIEVGPGG

SEQ ID NO: 1465656 - protein, 23 aa, Mycobacterium tuberculosis
DVLNRCRGAAVVTPLLLADAYHA

SEQ ID NO: 1465657 - protein, 24 aa, Mycobacterium tuberculosis
DVNIPIHIPITASFTDIVYSGLDL

SEQ ID NO: 1465658 - protein, 18 aa, Mycobacterium tuberculosis
DVRRWWRSDSLWQAHDAR

SEQ ID NO: 1465659 - protein, 20 aa, Mycobacterium tuberculosis
EADARLMAHAVFGLLNSTPH

SEQ ID NO: 1465660 - protein, 19 aa, Mycobacterium tuberculosis
EAFASLATALSRVLGLTFD

SEQ ID NO: 1465661 - protein, 18 aa, Mycobacterium tuberculosis
EALIRMDLAEMLREEGYE

SEQ ID NO: 1465662 - protein, 18 aa, Mycobacterium tuberculosis
EDTVVFPALRDVMSAVEF

SEQ ID NO: 1465663 - protein, 23 aa, Mycobacterium tuberculosis
EELRRLPEELARVDALLDDSAFF

SEQ ID NO: 1465664 - protein, 18 aa, Mycobacterium tuberculosis
EEVRNCFADMAKVAIALG

SEQ ID NO: 1465665 - protein, 18 aa, Mycobacterium tuberculosis
EFVAPVVAYLCTEECADN

SEQ ID NO: 1465666 - protein, 20 aa, Mycobacterium tuberculosis
EGGTVGPVRFDACDPDGNRM

SEQ ID NO: 1465667 - protein, 23 aa, Mycobacterium tuberculosis
EGVRDRLAASFPKIGPLMDDARA

SEQ ID NO: 1465668 - protein, 17 aa, Mycobacterium tuberculosis
EHLRFISPIQNICRTTR

SEQ ID NO: 1465669 - protein, 24 aa, Mycobacterium tuberculosis
EHSAACTTMRWPLHDDQLAAADQL

SEQ ID NO: 1465670 - protein, 26 aa, Mycobacterium tuberculosis
EIAESPIDWDIAWPAGDLQVNLTPAK

SEQ ID NO: 1465671 - protein, 22 aa, Mycobacterium tuberculosis
EIDKVFVVACGTAYHSGLLAKY

SEQ ID NO: 1465672 - protein, 24 aa, Mycobacterium tuberculosis
EILSELQPSLVIEFGTRYGGSAVY

SEQ ID NO: 1465673 - protein, 22 aa, Mycobacterium tuberculosis
EISVLQAPLFTAYGTLYQQVSA

SEQ ID NO: 1465674 - protein, 19 aa, Mycobacterium tuberculosis
EKGFGMDFGALPPEINSGR

SEQ ID NO: 1465675 - protein, 24 aa, Mycobacterium tuberculosis
ELAGEPRPRIALAAPTGKAAARLA

SEQ ID NO: 1465676 - protein, 17 aa, Mycobacterium tuberculosis
ELDSAGDLGDWGGPDAL

SEQ ID NO: 1465677 - protein, 17 aa, Mycobacterium tuberculosis
ELLDSWRNYQWHQLARA

SEQ ID NO: 1465678 - protein, 21 aa, Mycobacterium tuberculosis
ELLEVCRRHGALLLVDEAHGL

SEQ ID NO: 1465679 - protein, 24 aa, Mycobacterium tuberculosis
ELTERPDLFPAWDSMSEAQKRLFA

SEQ ID NO: 1465680 - protein, 22 aa, Mycobacterium tuberculosis
ELTPYRGAWCGNDVWRGALPPA

SEQ ID NO: 1465681 - protein, 19 aa, Mycobacterium tuberculosis
EPAFFGVRPHVVLKGGAIA

SEQ ID NO: 1465682 - protein, 21 aa, Mycobacterium tuberculosis
EPGIPESFKVLLKELQSLCLN

SEQ ID NO: 1465683 - protein, 17 aa, Mycobacterium tuberculosis
EPGLRKLLTDNLAAGRL

SEQ ID NO: 1465684 - protein, 25 aa, Mycobacterium tuberculosis
EPHYGPPPLLLRMVEAGQLGKKSGR

SEQ ID NO: 1465685 - protein, 17 aa, Mycobacterium tuberculosis
EPNHTVWAQAPGANNGS

SEQ ID NO: 1465686 - protein, 17 aa, Mycobacterium tuberculosis
EPPMFEMDTTGLASGNC

SEQ ID NO: 1465687 - protein, 18 aa, Mycobacterium tuberculosis
EPRAWETLQRGWNVVGLA

SEQ ID NO: 1465688 - protein, 22 aa, Mycobacterium tuberculosis
EPRKWARNLIREMSADRLYERL

SEQ ID NO: 1465689 - protein, 22 aa, Mycobacterium tuberculosis
EQLVEFRWELAVGDDPLSEEEI

SEQ ID NO: 1465690 - protein, 22 aa, Mycobacterium tuberculosis
EQPWFTGRFGTIGLPYLGFTQW

SEQ ID NO: 1465691 - protein, 17 aa, Mycobacterium tuberculosis
ERMWAQDVAAMVGYHAG

SEQ ID NO: 1465692 - protein, 17 aa, Mycobacterium tuberculosis
ESVRRLDAIAAELDRAV

SEQ ID NO: 1465693 - protein, 24 aa, Mycobacterium tuberculosis
EVNSLRMYLGAGSGPMLAAAAAWD

SEQ ID NO: 1465694 - protein, 19 aa, Mycobacterium tuberculosis
EVTDSITWRRFCRIPLEGS

SEQ ID NO: 1465695 - protein, 17 aa, Mycobacterium tuberculosis
EVVVCPTAVPPHDPASY

SEQ ID NO: 1465696 - protein, 22 aa, Mycobacterium tuberculosis
EVYELRGSELIRIEAPTDASVS

SEQ ID NO: 1465697 - protein, 23 aa, Mycobacterium tuberculosis
EYLDMFYNLGIAGRAMRRIGAVE

SEQ ID NO: 1465698 - protein, 17 aa, Mycobacterium tuberculosis
FAALADEAQRCRCRGID

SEQ ID NO: 1465699 - protein, 17 aa, Mycobacterium tuberculosis
FADDVERILSETPEYKQ

SEQ ID NO: 1465700 - protein, 26 aa, Mycobacterium tuberculosis
FAGAARRCPDRPGLIDELGTLTWRQL

SEQ ID NO: 1465701 - protein, 24 aa, Mycobacterium tuberculosis
FDPELQLWVAACLYKGGVDVYRTF

SEQ ID NO: 1465702 - protein, 19 aa, Mycobacterium tuberculosis
FEVAAHEFLLFPTVAHSHA

SEQ ID NO: 1465703 - protein, 17 aa, Mycobacterium tuberculosis
FGGGFQHWGDAMMTDGR

SEQ ID NO: 1465704 - protein, 25 aa, Mycobacterium tuberculosis
FGRRVAVVACEFDFLGGSIGVAAAE

SEQ ID NO: 1465705 - protein, 19 aa, Mycobacterium tuberculosis
FIGECKVWSGPRTMDDVLK

SEQ ID NO: 1465706 - protein, 18 aa, Mycobacterium tuberculosis
FLDKVVGGAVPRQFIPSV

SEQ ID NO: 1465707 - protein, 20 aa, Mycobacterium tuberculosis
FLDSARGVHQFLGRRRFVYP

SEQ ID NO: 1465708 - protein, 30 aa, Mycobacterium tuberculosis; identical to SEQ ID NO: 199219

SEQ ID NO: 1465709 - protein, 25 aa, Mycobacterium tuberculosis
FPPGWSRCRAPAGPPVPLIVNSRPT

SEQ ID NO: 1465710 - protein, 19 aa, Mycobacterium tuberculosis
FQIRHHLRRVAMPAPGGRR

SEQ ID NO: 1465711 - protein, 17 aa, Mycobacterium tuberculosis
FRALCRQLEQSKVGTVS

SEQ ID NO: 1465712 - protein, 17 aa, Mycobacterium tuberculosis
FSARRLDGGFSEWLAAD

SEQ ID NO: 1465713 - protein, 18 aa, Mycobacterium tuberculosis
FSDGLNTLSEFKVQRLDR

SEQ ID NO: 1465714 - protein, 20 aa, Mycobacterium tuberculosis
FTSHGLRLGVEASLRSLARV

SEQ ID NO: 1465715 - protein, 24 aa, Mycobacterium tuberculosis
FVAEAIAVLGARVAGSSLAGFATY

SEQ ID NO: 1465716 - protein, 17 aa, Mycobacterium tuberculosis
FVIALAMVNNATVVTQE

SEQ ID NO: 1465717 - protein, 17 aa, Mycobacterium tuberculosis
GAAERGLEVIIAGAGGA

SEQ ID NO: 1465718 - protein, 25 aa, Mycobacterium tuberculosis
GADEVSAAIASLFSGNAQAYQALSA

SEQ ID NO: 1465719 - protein, 23 aa, Mycobacterium tuberculosis
GAEQVRLPSIYFAHRRKVFQRDG

SEQ ID NO: 1465720 - protein, 18 aa, Mycobacterium tuberculosis
GALLPRLHKLVRADCTTR

SEQ ID NO: 1465721 - protein, 22 aa, Mycobacterium tuberculosis
GARCATGILDCWLVHDGDHAEI

SEQ ID NO: 1465722 - protein, 18 aa, Mycobacterium tuberculosis
GCGHAGYLASARERAVNL

SEQ ID NO: 1465723 - protein, 24 aa, Mycobacterium tuberculosis
GDEDKRVAGAIARLGELKARGVDT

SEQ ID NO: 1465724 - protein, 21 aa, Mycobacterium tuberculosis
GDSRRANLWAADRYNRAIARG

SEQ ID NO: 1465725 - protein, 23 aa, Mycobacterium tuberculosis
GEGKRLYPLTADRAKPAVPFGGA

SEQ ID NO: 1465726 - protein, 19 aa, Mycobacterium tuberculosis
GELARMCGVAAVPDSAMVS

SEQ ID NO: 1465727 - protein, 18 aa, Mycobacterium tuberculosis
GESEFRTSLRSCPAEKRR

SEQ ID NO: 1465728 - protein, 19 aa, Mycobacterium tuberculosis
GFNPGGINTGWFNTGHANT

SEQ ID NO: 1465729 - protein, 22 aa, Mycobacterium tuberculosis
GGAIALGHPFGMTGARITTTLL

SEQ ID NO: 1465730 - protein, 26 aa, Mycobacterium tuberculosis
GGAPKGWGWVAPYIGMIWPNGDSTKL

SEQ ID NO: 1465731 - protein, 25 aa, Mycobacterium tuberculosis
GGEMWRVDFAWPDMRLAAEYESIEW

SEQ ID NO: 1465732 - protein, 17 aa, Mycobacterium tuberculosis
GGLGPFTVFPDGYSLPA

SEQ ID NO: 1465733 - protein, 20 aa, Mycobacterium tuberculosis
GGNADFRYNTVITEETCAGR

SEQ ID NO: 1465734 - protein, 24 aa, Mycobacterium tuberculosis
GHIPRNLHFTRWNPAIDASATRLF

SEQ ID NO: 1465735 - protein, 19 aa, Mycobacterium tuberculosis
GIDEPRPITSMPGVVQHTR

SEQ ID NO: 1465736 - protein, 26 aa, Mycobacterium tuberculosis
GLKDPKRPSGSFIFAGPSGVGKTELS

SEQ ID NO: 1465737 - protein, 19 aa, Mycobacterium tuberculosis
GLVGVRVGPTISQFPVTVH

SEQ ID NO: 1465738 - protein, 17 aa, Mycobacterium tuberculosis
GNVEAFLRLVEAGWDAE

SEQ ID NO: 1465739 - protein, 31 aa, Mycobacterium tuberculosis
GNYSNGVLWRGDYQGLLGFSSGANVLPVIPL

SEQ ID NO: 1465740 - protein, 27 aa, Mycobacterium tuberculosis
GPAMSKFEVLTAMAFAAFADAPVDVAV

SEQ ID NO: 1465741 - protein, 18 aa, Mycobacterium tuberculosis
GPGSIVVEGRDIGTVVFP

SEQ ID NO: 1465742 - protein, 17 aa, Mycobacterium tuberculosis
GPLDWRETLSIGVKLAG

SEQ ID NO: 1465743 - protein, 23 aa, Mycobacterium tuberculosis
GPPGELLLYVFGRRAVARVEVSG

SEQ ID NO: 1465744 - protein, 23 aa, Mycobacterium tuberculosis
GPTLMVSDLFDFSLYVDARIEDI

SEQ ID NO: 1465745 - protein, 18 aa, Mycobacterium tuberculosis
GQIGFGSFNSGSGNIGLF

SEQ ID NO: 1465746 - protein, 17 aa, Mycobacterium tuberculosis
GQIGFGSLNSGSGNIGL

SEQ ID NO: 1465747 - protein, 25 aa, Mycobacterium tuberculosis
GQSYFATGMAQFFASIAQQLTFGPG

SEQ ID NO: 1465748 - protein, 21 aa, Mycobacterium tuberculosis
GRKAFARFAGYSSAMHAIAGF

SEQ ID NO: 1465749 - protein, 25 aa, Mycobacterium tuberculosis
GRKEVFRLRLASGREVEATGSHPFM

SEQ ID NO: 1465750 - protein, 33 aa, Mycobacterium tuberculosis
GRRVQLEIFTKFNIPINIARVFHRDQKFRFHRP

SEQ ID NO: 1465751 - protein, 18 aa, Mycobacterium tuberculosis
GRRVRLWGDQTWRSAPEH

SEQ ID NO: 1465752 - protein, 23 aa, Mycobacterium tuberculosis
GRSAACWARRLVFVNGHGGNVGA

SEQ ID NO: 1465753 - protein, 18 aa, Mycobacterium tuberculosis
GSAMMRRAGYMYGTVLAR

SEQ ID NO: 1465754 - protein, 22 aa, Mycobacterium tuberculosis
GSCQAIWRLDDGYLAASDPRRD

SEQ ID NO: 1465755 - protein, 23 aa, Mycobacterium tuberculosis
GSLCKELSADIARRPMAKPVDFG

SEQ ID NO: 1465756 - protein, 24 aa, Mycobacterium tuberculosis
GTAPMLAAAAAWDGLAEELGTAAQ

SEQ ID NO: 1465757 - protein, 18 aa, Mycobacterium tuberculosis
GTFMAGPLSGLRVVELAG

SEQ ID NO: 1465758 - protein, 28 aa, Mycobacterium tuberculosis
GTPEIPAIPPFFPGFPPDYVTVSGQIGP

SEQ ID NO: 1465759 - protein, 20 aa, Mycobacterium tuberculosis
GTPLLNWLRQRGVDEVDVVG

SEQ ID NO: 1465760 - protein, 19 aa, Mycobacterium tuberculosis
GVAGCAAMDGTVLVNLINT

SEQ ID NO: 1465761 - protein, 19 aa, Mycobacterium tuberculosis
GVAITLTWSQLYRRTLNVA

SEQ ID NO: 1465762 - protein, 25 aa, Mycobacterium tuberculosis
GVAWVIAYRWFRAGLLPVPAQRVGR

SEQ ID NO: 1465763 - protein, 17 aa, Mycobacterium tuberculosis
GVLPYMICNQPPEFDFP

SEQ ID NO: 1465764 - protein, 23 aa, Mycobacterium tuberculosis
GVPDLRRLFPTGFDEQRRAAEIA

SEQ ID NO: 1465765 - protein, 18 aa, Mycobacterium tuberculosis
GYMSKIFNDAWMSSYGFL

SEQ ID NO: 1465766 - protein, 18 aa, Mycobacterium tuberculosis
GYSAADCVALLREAALTA

SEQ ID NO: 1465767 - protein, 26 aa, Mycobacterium tuberculosis
HAGPGGYCGYLLYNLTTSGFRPATFA

SEQ ID NO: 1465768 - protein, 21 aa, Mycobacterium tuberculosis
HAGRGSYPWLPTDNANWHMIG

SEQ ID NO: 1465769 - protein, 21 aa, Mycobacterium tuberculosis
HAMAVAIPRERTMPAVLSNLD

SEQ ID NO: 1465770 - protein, 25 aa, Mycobacterium tuberculosis
HCFAGKDRTGFVVALVLEAVGLDRD

SEQ ID NO: 1465771 - protein, 26 aa, Mycobacterium tuberculosis
HDVFHIDRGYPLFVENLVSLGAEIER

SEQ ID NO: 1465772 - protein, 21 aa, Mycobacterium tuberculosis
HEWIRRSGDDTVRVGITDYAQ

SEQ ID NO: 1465773 - protein, 21 aa, Mycobacterium tuberculosis
HGLDLDMSGLVYFGDRTDART

SEQ ID NO: 1465774 - protein, 20 aa, Mycobacterium tuberculosis
HHRVGFGSVCEFPGPYPGYS

SEQ ID NO: 1465775 - protein, 19 aa, Mycobacterium tuberculosis
HILDGFAGTGTFITRLLQS

SEQ ID NO: 1465776 - protein, 17 aa, Mycobacterium tuberculosis
HLAASWQALPIVEIDDE

SEQ ID NO: 1465777 - protein, 18 aa, Mycobacterium tuberculosis
HLRGHTPGSIALALGGPV

SEQ ID NO: 1465778 - protein, 21 aa, Mycobacterium tuberculosis
HPRGPAVWYQRGRSGAPPVGG

SEQ ID NO: 1465779 - protein, 17 aa, Mycobacterium tuberculosis
HTAELDAGVPARGLNGE

SEQ ID NO: 1465780 - protein, 23 aa, Mycobacterium tuberculosis
HTFNYLDLVRYLAVGNLNPSPLG

SEQ ID NO: 1465781 - protein, 18 aa, Mycobacterium tuberculosis
IAASADGSVYVLASSIPL

SEQ ID NO: 1465782 - protein, 23 aa, Mycobacterium tuberculosis
IAASGRPGAVLVDIPKDVLQGQC

SEQ ID NO: 1465783 - protein, 25 aa, Mycobacterium tuberculosis
IAGQRAHFGPITIPNITVVGPTTTV

SEQ ID NO: 1465784 - protein, 23 aa, Mycobacterium tuberculosis
IAGYKVPRSLWFVDEVKRSPAGK

SEQ ID NO: 1465785 - protein, 21 aa, Mycobacterium tuberculosis
IAIDRLPAAIITRLTQTNDPL

SEQ ID NO: 1465786 - protein, 20 aa, Mycobacterium tuberculosis
IANRLCAQILLLAAEDASKD

SEQ ID NO: 1465787 - protein, 20 aa, Mycobacterium tuberculosis
IAVRADKSWVTSAGFADVYV

SEQ ID NO: 1465788 - protein, 19 aa, Mycobacterium tuberculosis
ICDARGGSMSPAITGHYRS

SEQ ID NO: 1465789 - protein, 25 aa, Mycobacterium tuberculosis
ICEPVAVVGIGCRFPGNVTGPESFW

SEQ ID NO: 1465790 - protein, 19 aa, Mycobacterium tuberculosis
IDDFAEWLQRFEASLGALP

SEQ ID NO: 1465791 - protein, 17 aa, Mycobacterium tuberculosis
IDYRALGGIDGRYPKIK

SEQ ID NO: 1465792 - protein, 23 aa, Mycobacterium tuberculosis
IENPCPPTGLGSVVVARDELVVV

SEQ ID NO: 1465793 - protein, 24 aa, Mycobacterium tuberculosis
IGERSSHTWFVLTHLLGKADVRNY

SEQ ID NO: 1465794 - protein, 17 aa, Mycobacterium tuberculosis
IGISAWWANGSVKQYAG

SEQ ID NO: 1465795 - protein, 19 aa, Mycobacterium tuberculosis
IIRCLKRARRTGATRIEVT

SEQ ID NO: 1465796 - protein, 18 aa, Mycobacterium tuberculosis
IKAITGRIDLVHCNDSRD

SEQ ID NO: 1465797 - protein, 19 aa, Mycobacterium tuberculosis
IKGLRLRATDLDWTIGTGP

SEQ ID NO: 1465798 - protein, 25 aa, Mycobacterium tuberculosis
ILTEHPDRFRAMIVERGNPAHSLAD

SEQ ID NO: 1465799 - protein, 17 aa, Mycobacterium tuberculosis
IPGVWARRSSEVAQSVV

SEQ ID NO: 1465800 - protein, 19 aa, Mycobacterium tuberculosis
IPHTLAALDWGGITCQSGA

SEQ ID NO: 1465801 - protein, 18 aa, Mycobacterium tuberculosis
IPIIDVPAVPGFGNTTTA

SEQ ID NO: 1465802 - protein, 20 aa, Mycobacterium tuberculosis
IPKTPEWAAALSGLAAGDLR

SEQ ID NO: 1465803 - protein, 21 aa, Mycobacterium tuberculosis
IQPLPPKRAGLLIRALYRIAK

SEQ ID NO: 1465804 - protein, 17 aa, Mycobacterium tuberculosis
IRPRVGFGRGRRAPVSS

SEQ ID NO: 1465805 - protein, 24 aa, Mycobacterium tuberculosis
IRTETSTYCPFKGEASYYSVTTDA

SEQ ID NO: 1465806 - protein, 17 aa, Mycobacterium tuberculosis
IRVFPGDHFYLNDNLPE

SEQ ID NO: 1465807 - protein, 19 aa, Mycobacterium tuberculosis
ISGGLMRLGSAVAPLLQVG

SEQ ID NO: 1465808 - protein, 28 aa, Mycobacterium tuberculosis
ITIPEIPYRYDLSVPIDIPITGTVVATT

SEQ ID NO: 1465809 - protein, 26 aa, Mycobacterium tuberculosis
ITIPQLPLGLALSGATPAFAFPLEIT

SEQ ID NO: 1465810 - protein, 29 aa, Mycobacterium tuberculosis
IVGHDRLRLALLLCAVRPEIGGALIRGEK

SEQ ID NO: 1465811 - protein, 19 aa, Mycobacterium tuberculosis
IVLQTGARLSRRGRRLGLT

SEQ ID NO: 1465812 - protein, 24 aa, Mycobacterium tuberculosis
IVTELFKPLPSMVVAHYLGVPEED

SEQ ID NO: 1465813 - protein, 18 aa, Mycobacterium tuberculosis
IVWYPGGHTGFFQSRPVR

SEQ ID NO: 1465814 - protein, 17 aa, Mycobacterium tuberculosis
IWYPMVYDMPARAKDAF

SEQ ID NO: 1465815 - protein, 21 aa, Mycobacterium tuberculosis
IYKIRGVAAVTFYGRGRLVSA

SEQ ID NO: 1465816 - protein, 17 aa, Mycobacterium tuberculosis
KAKRRKGVGFATQPSDA

SEQ ID NO: 1465817 - protein, 24 aa, Mycobacterium tuberculosis
KEAKEVIEAGGLYVLGTERHESRR

SEQ ID NO: 1465818 - protein, 19 aa, Mycobacterium tuberculosis
KFQLVEPVAGMSRAAGIVE

SEQ ID NO: 1465819 - protein, 19 aa, Mycobacterium tuberculosis
KGSELMDKWVGSSEKAVRE

SEQ ID NO: 1465820 - protein, 19 aa, Mycobacterium tuberculosis
KGVDAVVVPGGFSYGDYLR

SEQ ID NO: 1465821 - protein, 18 aa, Mycobacterium tuberculosis
KLREAGALWERLTRAVGM

SEQ ID NO: 1465822 - protein, 17 aa, Mycobacterium tuberculosis
KLVEWLLEQGITPDEIR

SEQ ID NO: 1465823 - protein, 21 aa, Mycobacterium tuberculosis
KRAESSALFAMLSGQHAVDTL

SEQ ID NO: 1465824 - protein, 25 aa, Mycobacterium tuberculosis
KRSPAGKPDYRWAKEQTEARPADDV

SEQ ID NO: 1465825 - protein, 18 aa, Mycobacterium tuberculosis
KTTALRMINRMVDPTSGT

SEQ ID NO: 1465826 - protein, 18 aa, Mycobacterium tuberculosis
KTVWGVGIAPSITTASLR

SEQ ID NO: 1465827 - protein, 19 aa, Mycobacterium tuberculosis
KVLASRMVRDYVEHYYAPA

SEQ ID NO: 1465828 - protein, 18 aa, Mycobacterium tuberculosis
KVPTPLLDFIAPKVAGLS

SEQ ID NO: 1465829 - protein, 19 aa, Mycobacterium tuberculosis
LAAFAGRPALLSEMTDDDV

SEQ ID NO: 1465830 - protein, 17 aa, Mycobacterium tuberculosis
LAAITTLGPKFWAQDAI

SEQ ID NO: 1465831 - protein, 22 aa, Mycobacterium tuberculosis
LAKTIKGYALGKHFEGRNATHQ

SEQ ID NO: 1465832 - protein, 22 aa, Mycobacterium tuberculosis
LARLLRLLGFDTRWSSAADDPT

SEQ ID NO: 1465833 - protein, 20 aa, Mycobacterium tuberculosis
LATACDVCIATDDARFGIPL

SEQ ID NO: 1465834 - protein, 26 aa, Mycobacterium tuberculosis
LATALQSAAPWLAKSGGEFIVAGQSA

SEQ ID NO: 1465835 - protein, 17 aa, Mycobacterium tuberculosis
LATDVLRRLRMVKEETE

SEQ ID NO: 1465836 - protein, 17 aa, Mycobacterium tuberculosis
LATEIPLRTWLFRIADD

SEQ ID NO: 1465837 - protein, 17 aa, Mycobacterium tuberculosis
LATEPDAHYVLVSTRDP

SEQ ID NO: 1465838 - protein, 24 aa, Mycobacterium tuberculosis
LAVDPRFAGVTGQYFAGAKAIRSS

SEQ ID NO: 1465839 - protein, 23 aa, Mycobacterium tuberculosis
LDDEVRLALLIMLERLGPAERVV

SEQ ID NO: 1465840 - protein, 22 aa, Mycobacterium tuberculosis
LDFMGCCAFAALADEAQRCRCR

SEQ ID NO: 1465841 - protein, 18 aa, Mycobacterium tuberculosis
LDNWLSSPYSHWAFQHVE

SEQ ID NO: 1465842 - protein, 24 aa, Mycobacterium tuberculosis
LDQEGRDDLALRIAVQPGGCAGLR

SEQ ID NO: 1465843 - protein, 23 aa, Mycobacterium tuberculosis
LDRHLRLPLRNVLWEGDEALLTS

SEQ ID NO: 1465844 - protein, 21 aa, Mycobacterium tuberculosis
LDRLLAQKLPDGWDADLPHWE

SEQ ID NO: 1465845 - protein, 20 aa, Mycobacterium tuberculosis
LDRPFAWALIKLDGADTLLM

SEQ ID NO: 1465846 - protein, 18 aa, Mycobacterium tuberculosis
LDSDALAAVCPIFRDAER

SEQ ID NO: 1465847 - protein, 18 aa, Mycobacterium tuberculosis
LDTAAVCIDTWVPADALV

SEQ ID NO: 1465848 - protein, 19 aa, Mycobacterium tuberculosis
LDVAEGPVYVRKQIVHNTV

SEQ ID NO: 1465849 - protein, 17 aa, Mycobacterium tuberculosis
LDVDARFYFVHSYAAQR

SEQ ID NO: 1465850 - protein, 22 aa, Mycobacterium tuberculosis
LDVDGRLICLVRAESDEDARRR

SEQ ID NO: 1465851 - protein, 32 aa, Mycobacterium tuberculosis
LDVGCGDGLLAARLARRIPYVTAVDIDAPVLR

SEQ ID NO: 1465852 - protein, 26 aa, Mycobacterium tuberculosis
LDYAGGVRAGHRLKFWTPGGSSTPLL

SEQ ID NO: 1465853 - protein, 21 aa, Mycobacterium tuberculosis
LEHDPRLAAAERSELDALITC

SEQ ID NO: 1465854 - protein, 24 aa, Mycobacterium tuberculosis
LEPRRFASGSALGMLSATGRCHAF

SEQ ID NO: 1465855 - protein, 19 aa, Mycobacterium tuberculosis
LETLAAHWGVPQQRPHDAF

SEQ ID NO: 1465856 - protein, 23 aa, Mycobacterium tuberculosis
LFITGRIKELLVVDGANHYPEDI

SEQ ID NO: 1465857 - protein, 19 aa, Mycobacterium tuberculosis
LGADLLAVVARLNRLATQR

SEQ ID NO: 1465858 - protein, 17 aa, Mycobacterium tuberculosis
LGDTFRWKGENVATTQV

SEQ ID NO: 1465859 - protein, 20 aa, Mycobacterium tuberculosis
LGESRTALAAALETQDGPRL

SEQ ID NO: 1465860 - protein, 23 aa, Mycobacterium tuberculosis
LGPSGKRPGAIAERVKKTWELGE

SEQ ID NO: 1465861 - protein, 17 aa, Mycobacterium tuberculosis
LGRGGLADIEWTVQLLQ

SEQ ID NO: 1465862 - protein, 17 aa, Mycobacterium tuberculosis
LGSEVLAAKAIPERAMR

SEQ ID NO: 1465863 - protein, 29 aa, Mycobacterium tuberculosis
LGSKMNRFFLRGALVARLLSQSAWKQYPE

SEQ ID NO: 1465864 - protein, 20 aa, Mycobacterium tuberculosis
LGTASFALGNARRALVESLC

SEQ ID NO: 1465865 - protein, 23 aa, Mycobacterium tuberculosis
LGVRPPVEADWLLLVELAADHDQ

SEQ ID NO: 1465866 - protein, 19 aa, Mycobacterium tuberculosis
LGWVRELGEIIGRDGDPVR

SEQ ID NO: 1465867 - protein, 25 aa, Mycobacterium tuberculosis
LHAGGAGRVRARFASAGADAISVDV

SEQ ID NO: 1465868 - protein, 19 aa, Mycobacterium tuberculosis
LKDAFVYPETMPAWFTEAD

SEQ ID NO: 1465869 - protein, 18 aa, Mycobacterium tuberculosis
LKPPRSGLPVIEVLDTEL

SEQ ID NO: 1465870 - protein, 22 aa, Mycobacterium tuberculosis
LKVTHPAAIVWAAQMGTITLHP

SEQ ID NO: 1465871 - protein, 23 aa, Mycobacterium tuberculosis
LLAHCYRMTGSLHDAEDLVQETL

SEQ ID NO: 1465872 - protein, 17 aa, Mycobacterium tuberculosis
LLALSAFCVVIDKGTSF

SEQ ID NO: 1465873 - protein, 17 aa, Mycobacterium tuberculosis
LLATRFSEFAVHVVEVC

SEQ ID NO: 1465874 - protein, 22 aa, Mycobacterium tuberculosis
LLCGIAAEWTRGAVKTVPPRWL

SEQ ID NO: 1465875 - protein, 23 aa, Mycobacterium tuberculosis
LLDGVCYPGQLAAHLGLTRSNVS

SEQ ID NO: 1465876 - protein, 21 aa, Mycobacterium tuberculosis
LLHELPRRLGGEHSDSTNTEL

SEQ ID NO: 1465877 - protein, 27 aa, Mycobacterium tuberculosis
LLHGFPESWYSWRHQIPALAGAGYRVV

SEQ ID NO: 1465878 - protein, 17 aa, Mycobacterium tuberculosis
LLRNIIENPAWYTAYTP

SEQ ID NO: 1465879 - protein, 18 aa, Mycobacterium tuberculosis
LLVPPSDRPWRLAMSTAG

SEQ ID NO: 1465880 - protein, 17 aa, Mycobacterium tuberculosis
LLVRLAGVADRDAADAL

SEQ ID NO: 1465881 - protein, 23 aa, Mycobacterium tuberculosis
LMAARGVGVGQILAITFTNKAAA

SEQ ID NO: 1465882 - protein, 25 aa, Mycobacterium tuberculosis
LMGPLMRRSGMIFIRRNIGNDPLYK

SEQ ID NO: 1465883 - protein, 22 aa, Mycobacterium tuberculosis
LNIGNPAPFGFEAPDVIMRDII

SEQ ID NO: 1465884 - protein, 28 aa, Mycobacterium tuberculosis
LPAARRAAHRAGHLGAMYPWQSGSDGSE

SEQ ID NO: 1465885 - protein, 27 aa, Mycobacterium tuberculosis
LPAGHYTLRAAIDWQQHKPNGSHVVNY

SEQ ID NO: 1465886 - protein, 22 aa, Mycobacterium tuberculosis
LPDECWHLVIVAHHIVIDGWSL

SEQ ID NO: 1465887 - protein, 22 aa, Mycobacterium tuberculosis
LPHQLLRSWYILYFQLPWLPER

SEQ ID NO: 1465888 - protein, 19 aa, Mycobacterium tuberculosis
LPVGRLRIGDELAEIDSAA

SEQ ID NO: 1465889 - protein, 23 aa, Mycobacterium tuberculosis
LPVSYRPGLLCVRQKRFTHMGEY

SEQ ID NO: 1465890 - protein, 18 aa, Mycobacterium tuberculosis
LQPFDGYTDPVASEKKLV

SEQ ID NO: 1465891 - protein, 19 aa, Mycobacterium tuberculosis
LRARSVLAVARRAQELGWH

SEQ ID NO: 1465892 - protein, 18 aa, Mycobacterium tuberculosis
LRDASGIAQVVFRDPQDT

SEQ ID NO: 1465893 - protein, 21 aa, Mycobacterium tuberculosis
LREREVMGVLAAGMTADHVLE

SEQ ID NO: 1465894 - protein, 17 aa, Mycobacterium tuberculosis
LRHVADLVMTGWPVLMA

SEQ ID NO: 1465895 - protein, 19 aa, Mycobacterium tuberculosis
LRLEGLEVIPSVLPPAPAG

SEQ ID NO: 1465896 - protein, 20 aa, Mycobacterium tuberculosis
LRLLAGRGRLERVGRGVYRV

SEQ ID NO: 1465897 - protein, 18 aa, Mycobacterium tuberculosis
LRPGTAMRDIAVDAVFVG

SEQ ID NO: 1465898 - protein, 17 aa, Mycobacterium tuberculosis
LRQTARQLATWVEEHQD

SEQ ID NO: 1465899 - protein, 20 aa, Mycobacterium tuberculosis
LRRRCLYHWIDYPGPDRAAA

SEQ ID NO: 1465900 - protein, 19 aa, Mycobacterium tuberculosis
LRWCHEAGIELATVYLLST

SEQ ID NO: 1465901 - protein, 21 aa, Mycobacterium tuberculosis
LSGATPAFAFPLEITIDRIPV

SEQ ID NO: 1465902 - protein, 21 aa, Mycobacterium tuberculosis
LSPDGRCKAFAAAADGTGFSE

SEQ ID NO: 1465903 - protein, 19 aa, Mycobacterium tuberculosis
LTDEARMAPDLRGRISMAS

SEQ ID NO: 1465904 - protein, 18 aa, Mycobacterium tuberculosis
LTWSRLKVNVAVTQEQAG

SEQ ID NO: 1465905 - protein, 18 aa, Mycobacterium tuberculosis
LVDRFGLAGERLDMVVGG

SEQ ID NO: 1465906 - protein, 26 aa, Mycobacterium tuberculosis
LVSHYDVYPAFGFRFDLKKSGVSVTF

SEQ ID NO: 1465907 - protein, 18 aa, Mycobacterium tuberculosis
LYEKFFRIGFKKQAEALG

SEQ ID NO: 1465908 - protein, 23 aa, Mycobacterium tuberculosis
MAVGSLRSGECDLALAGGVTVNA

SEQ ID NO: 1465909 - protein, 26 aa, Mycobacterium tuberculosis
MDPQQRMLLELSWEALERAGIDPTGL

SEQ ID NO: 1465910 - protein, 20 aa, Mycobacterium tuberculosis
MGCSICWHGPAGTPTMSVTI

SEQ ID NO: 1465911 - protein, 24 aa, Mycobacterium tuberculosis
MGKSRLALQIGAQIAHEFTYGRWD

SEQ ID NO: 1465912 - protein, 19 aa, Mycobacterium tuberculosis
MIAANRVRPVIGTRLPIQQ

SEQ ID NO: 1465913 - protein, 22 aa, Mycobacterium tuberculosis
MLRGRRALDVAGNGRYARQLVE

SEQ ID NO: 1465914 - protein, 22 aa, Mycobacterium tuberculosis
MMDKLRTAGPWESEQTHDSLRR

SEQ ID NO: 1465915 - protein, 19 aa, Mycobacterium tuberculosis
MNDVKSWVAFGASPRASLG

SEQ ID NO: 1465916 - protein, 21 aa, Mycobacterium tuberculosis
MPEPFAFSMVLPLAVPGHDRG

SEQ ID NO: 1465917 - protein, 21 aa, Mycobacterium tuberculosis
MPGVPNHWHVYFAVDDADATA

SEQ ID NO: 1465918 - protein, 21 aa, Mycobacterium tuberculosis
MPPCTGTGMGIDRLLMSLTGL

SEQ ID NO: 1465919 - protein, 19 aa, Mycobacterium tuberculosis
MVDDCVRRVARWMPQPDGM

SEQ ID NO: 1465920 - protein, 24 aa, Mycobacterium tuberculosis
MYEQMWAADVAAMVGYHGGASAAA

SEQ ID NO: 1465921 - protein, 18 aa, Mycobacterium tuberculosis
NAGSGSWGLANVGVGNIG

SEQ ID NO: 1465922 - protein, 19 aa, Mycobacterium tuberculosis
NATPRERLLALFDRPNRGD

SEQ ID NO: 1465923 - protein, 23 aa, Mycobacterium tuberculosis
NHRPEVRGGVLARECAAPLEAFF

SEQ ID NO: 1465924 - protein, 17 aa, Mycobacterium tuberculosis
NINPIWAYAHVPFGYTG

SEQ ID NO: 1465925 - protein, 22 aa, Mycobacterium tuberculosis
NIPERGGALIALNHTSYVDWVP

SEQ ID NO: 1465926 - protein, 18 aa, Mycobacterium tuberculosis
NNIGFGLTGDNLVGIGAL

SEQ ID NO: 1465927 - protein, 26 aa, Mycobacterium tuberculosis
NNRDGESYNRSWNCGVEGPTDDPDIL

SEQ ID NO: 1465928 - protein, 17 aa, Mycobacterium tuberculosis
NQIRWLFEKLLGESPRR

SEQ ID NO: 1465929 - protein, 21 aa, Mycobacterium tuberculosis
NRPTGAFMFLGPTGVGKTELA

SEQ ID NO: 1465930 - protein, 21 aa, Mycobacterium tuberculosis
NSFGAFVPKGITLRVYGDAND

SEQ ID NO: 1465931 - protein, 20 aa, Mycobacterium tuberculosis
PAGLFSIPNPFAVTYYLIKG

SEQ ID NO: 1465932 - protein, 17 aa, Mycobacterium tuberculosis
PANTWLTDVGKYPLRGL

SEQ ID NO: 1465933 - protein, 19 aa, Mycobacterium tuberculosis
PARRDPCLYPRTGQALPRT

SEQ ID NO: 1465934 - protein, 19 aa, Mycobacterium tuberculosis
PDCKSNVLYKGALQGDPAS

SEQ ID NO: 1465935 - protein, 25 aa, Mycobacterium tuberculosis
PDDGFVRVIYRWSRTGDLAAALAAA

SEQ ID NO: 1465936 - protein, 22 aa, Mycobacterium tuberculosis
PDGEPGLLLSRVNRLQPFDGYT

SEQ ID NO: 1465937 - protein, 24 aa, Mycobacterium tuberculosis
PDPDIAQLVKWGYAATQLLEGLVE

SEQ ID NO: 1465938 - protein, 17 aa, Mycobacterium tuberculosis
PDTWLPMPPEWAALTAE

SEQ ID NO: 1465939 - protein, 24 aa, Mycobacterium tuberculosis
PDVMLGIVEVLRLITDRGDPVIVN

SEQ ID NO: 1465940 - protein, 23 aa, Mycobacterium tuberculosis
PEAFIRKPARWMQLLAKHQAPFS

SEQ ID NO: 1465941 - protein, 20 aa, Mycobacterium tuberculosis
PEARVLDTLVHIWVTSIYGE

SEQ ID NO: 1465942 - protein, 17 aa, Mycobacterium tuberculosis
PECELVIVVGSRNSSNS

SEQ ID NO: 1465943 - protein, 18 aa, Mycobacterium tuberculosis
PECQSPLFLHVDASDPNR

SEQ ID NO: 1465944 - protein, 20 aa, Mycobacterium tuberculosis
PEGMPPIWNTYIAVDDVDAV

SEQ ID NO: 1465945 - protein, 21 aa, Mycobacterium tuberculosis
PEINSGRMFFGAGSGPMLAAA

SEQ ID NO: 1465946 - protein, 21 aa, Mycobacterium tuberculosis
PEPDLPRWRRAVEVATQRWVA

SEQ ID NO: 1465947 - protein, 20 aa, Mycobacterium tuberculosis
PEPHPVLPTTPWQHTQHWIT

SEQ ID NO: 1465948 - protein, 17 aa, Mycobacterium tuberculosis
PERDLAERLGVNRTSLR

SEQ ID NO: 1465949 - protein, 22 aa, Mycobacterium tuberculosis
PFMEFTPGYVLRSLDELPKQGS

SEQ ID NO: 1465950 - protein, 24 aa, Mycobacterium tuberculosis
PGAVSAWVELHARFGRLPFETLFE

SEQ ID NO: 1465951 - protein, 25 aa, Mycobacterium tuberculosis
PGPLRRLSEGIALLITTGFLPQRFR

SEQ ID NO: 1465952 - protein, 17 aa, Mycobacterium tuberculosis
PGQVLGLTFTRKAAGQL

SEQ ID NO: 1465953 - protein, 24 aa, Mycobacterium tuberculosis
PGVNELFALLAYGEVAAFYRLTDE

SEQ ID NO: 1465954 - protein, 18 aa, Mycobacterium tuberculosis
PIQQARGGESLWDENGGE

SEQ ID NO: 1465955 - protein, 20 aa, Mycobacterium tuberculosis
PITAVSLAWLPAGDYERALD

SEQ ID NO: 1465956 - protein, 27 aa, Mycobacterium tuberculosis
PKFDVPLPTAVRWAMRIPGGKAVHRLL

SEQ ID NO: 1465957 - protein, 24 aa, Mycobacterium tuberculosis
PLADLRGGAVWDAAAVRRFAETWE

SEQ ID NO: 1465958 - protein, 22 aa, Mycobacterium tuberculosis
PLPPEGASAIVFRDTAHAAELA

SEQ ID NO: 1465959 - protein, 20 aa, Mycobacterium tuberculosis
PLRFQPRWKELFPTARQLQV

SEQ ID NO: 1465960 - protein, 17 aa, Mycobacterium tuberculosis
PLSGLRVVELAGIGPGP

SEQ ID NO: 1465961 - protein, 20 aa, Mycobacterium tuberculosis
PLWECRRCALGDVDGTISIN

SEQ ID NO: 1465962 - protein, 17 aa, Mycobacterium tuberculosis
PMMARNILESFKLLTNV

SEQ ID NO: 1465963 - protein, 20 aa, Mycobacterium tuberculosis
PNDYGLKIERAIDAYLETWP

SEQ ID NO: 1465964 - protein, 25 aa, Mycobacterium tuberculosis
PNIKTDAMFPARAFDALDALVASAA

SEQ ID NO: 1465965 - protein, 28 aa, Mycobacterium tuberculosis
PPLTMKPDVCWQLPIRRSQEWVTRPDGT

SEQ ID NO: 1465966 - protein, 18 aa, Mycobacterium tuberculosis
PQRRELLRNMGIEHVYDS

SEQ ID NO: 1465967 - protein, 20 aa, Mycobacterium tuberculosis
PRAQALAVSLLLLSPAALNT

SEQ ID NO: 1465968 - protein, 18 aa, Mycobacterium tuberculosis
PRECDAVLYTRAGPEIGV

SEQ ID NO: 1465969 - protein, 21 aa, Mycobacterium tuberculosis
PRIPDVCDALGVPWLTLMGYI

SEQ ID NO: 1465970 - protein, 23 aa, Mycobacterium tuberculosis
PRMKANVGIRRRLAPLLDNDRNQ

SEQ ID NO: 1465971 - protein, 24 aa, Mycobacterium tuberculosis
PRVVLAAAPPGYRLSIPDNTCDLG

SEQ ID NO: 1465972 - protein, 22 aa, Mycobacterium tuberculosis
PSEILPFTVLLSSLGVTHLTPE

SEQ ID NO: 1465973 - protein, 18 aa, Mycobacterium tuberculosis
PSQIPVVRKAYRPSHEKL

SEQ ID NO: 1465974 - protein, 18 aa, Mycobacterium tuberculosis
PTDPNALVFPGRKGGFLP

SEQ ID NO: 1465975 - protein, 22 aa, Mycobacterium tuberculosis
PTYAFQHQKFWLAPAPSVSDPT

SEQ ID NO: 1465976 - protein, 25 aa, Mycobacterium tuberculosis
PVGQPGGDGGILWGNGGNGGDSTSP

SEQ ID NO: 1465977 - protein, 30 aa, Mycobacterium tuberculosis
PVIGTVMRQGYQLGEQVLRHALVGVVDTVV

SEQ ID NO: 1465978 - protein, 21 aa, Mycobacterium tuberculosis
PVMRALIVVAGLRMSRTPPDI

SEQ ID NO: 1465979 - protein, 20 aa, Mycobacterium tuberculosis
PVTVHAIGGVGPLHVAPVPV

SEQ ID NO: 1465980 - protein, 26 aa, Mycobacterium tuberculosis
PVWCSDIRAGAGLVLAGLVADGDTEV

SEQ ID NO: 1465981 - protein, 33 aa, Mycobacterium tuberculosis; identical to SEQ ID NO: 204607

SEQ ID NO: 1465982 - protein, 25 aa, Mycobacterium tuberculosis
QDLRAAEDALWRWMTAAALVRPRGA

SEQ ID NO: 1465983 - protein, 20 aa, Mycobacterium tuberculosis
QELARRCVLAGKDVIVAGHS

SEQ ID NO: 1465984 - protein, 21 aa, Mycobacterium tuberculosis
QFWRSGGRTRTRFGHVEDIPA

SEQ ID NO: 1465985 - protein, 18 aa, Mycobacterium tuberculosis
QGTYLAWLDCRELGFDDA

SEQ ID NO: 1465986 - protein, 25 aa, Mycobacterium tuberculosis
QIERYRAATLMARVRAAKGMKVAQP

SEQ ID NO: 1465987 - protein, 19 aa, Mycobacterium tuberculosis
QQPKRPALRPTKAAATTAA

SEQ ID NO: 1465988 - protein, 22 aa, Mycobacterium tuberculosis
QRDLPVNVARQILAPDTLIGRS

SEQ ID NO: 1465989 - protein, 19 aa, Mycobacterium tuberculosis
QRPVHLITCLAEPDPSWWD

SEQ ID NO: 1465990 - protein, 17 aa, Mycobacterium tuberculosis
QTFATLVGLELRPRKLR

SEQ ID NO: 1465991 - protein, 17 aa, Mycobacterium tuberculosis
RAAVLRFTGELAELAQA

SEQ ID NO: 1465992 - protein, 24 aa, Mycobacterium tuberculosis
RAERYLGIIERVRAAIPHAAITTD

SEQ ID NO: 1465993 - protein, 20 aa, Mycobacterium tuberculosis
RAGADAIYPGYGFLSENPDL

SEQ ID NO: 1465994 - protein, 19 aa, Mycobacterium tuberculosis
RALICRRWAGIAATAVSGL

SEQ ID NO: 1465995 - protein, 18 aa, Mycobacterium tuberculosis
RAQAIAGLRALAAGQHAP

SEQ ID NO: 1465996 - protein, 22 aa, Mycobacterium tuberculosis
RDFRSWACVDLELHPGRTVFVG

SEQ ID NO: 1465997 - protein, 17 aa, Mycobacterium tuberculosis
RDMSLSFGSAVGAYERG

SEQ ID NO: 1465998 - protein, 18 aa, Mycobacterium tuberculosis
RDVKRVKDRFGVTINDVV

SEQ ID NO: 1465999 - protein, 17 aa, Mycobacterium tuberculosis
REFCAPFELSRDAPLRI

SEQ ID NO: 1466000 - protein, 23 aa, Mycobacterium tuberculosis
RELTAELALALGAAAARRLSRSG

SEQ ID NO: 1466001 - protein, 19 aa, Mycobacterium tuberculosis
RFYFLTGRGALLQLGLLQL

SEQ ID NO: 1466002 - protein, 20 aa, Mycobacterium tuberculosis
RGPAKRPARKAARKVPAKKA

SEQ ID NO: 1466003 - protein, 20 aa, Mycobacterium tuberculosis
RGPVATVLVQRGTLRVGDSV

SEQ ID NO: 1466004 - protein, 17 aa, Mycobacterium tuberculosis
RGRELIRQAAKVALHPT

SEQ ID NO: 1466005 - protein, 17 aa, Mycobacterium tuberculosis
RGRTMYPPEVGLHAEAS

SEQ ID NO: 1466006 - protein, 21 aa, Mycobacterium tuberculosis
RGSGRPGFYRPPGRPEVIAKL

SEQ ID NO: 1466007 - protein, 19 aa, Mycobacterium tuberculosis
RGVEAAERLATRRRQSLSA

SEQ ID NO: 1466008 - protein, 17 aa, Mycobacterium tuberculosis
RHHRARASWNYLVTPGQ

SEQ ID NO: 1466009 - protein, 18 aa, Mycobacterium tuberculosis
RIAPVGPSAVSIELADGL

SEQ ID NO: 1466010 - protein, 24 aa, Mycobacterium tuberculosis
RIGRQCLNAGLGFGGGCLPKDIRA

SEQ ID NO: 1466011 - protein, 17 aa, Mycobacterium tuberculosis
RIRAGRLLIFSAYVTHR

SEQ ID NO: 1466012 - protein, 21 aa, Mycobacterium tuberculosis
RISHAYLRGREFYAYNSRFWE

SEQ ID NO: 1466013 - protein, 18 aa, Mycobacterium tuberculosis
RKASLPFTARRTLFNNTA

SEQ ID NO: 1466014 - protein, 17 aa, Mycobacterium tuberculosis
RKLRPGDSLLVDTKAGY

SEQ ID NO: 1466015 - protein, 25 aa, Mycobacterium tuberculosis
RKVVELRPDIAWDKGKALDWIGERL

SEQ ID NO: 1466016 - protein, 26 aa, Mycobacterium tuberculosis
RLGVEEELLRLGARSGCAVTIGEMTF

SEQ ID NO: 1466017 - protein, 18 aa, Mycobacterium tuberculosis
RLSTELSSLAALAYATRR

SEQ ID NO: 1466018 - protein, 17 aa, Mycobacterium tuberculosis
RMAAIGMETHLSRPTNR

SEQ ID NO: 1466019 - protein, 19 aa, Mycobacterium tuberculosis
RPAPSELLVAVHACGVCRT

SEQ ID NO: 1466020 - protein, 20 aa, Mycobacterium tuberculosis
RPDYSITGWVILTLIQHGTP

SEQ ID NO: 1466021 - protein, 19 aa, Mycobacterium tuberculosis
RPEFLNRIDDIIVFHQLTR

SEQ ID NO: 1466022 - protein, 19 aa, Mycobacterium tuberculosis
RPGAAQGWHLHHLLTAGQI

SEQ ID NO: 1466023 - protein, 17 aa, Mycobacterium tuberculosis
RPGDTLFAISTSGNSMS

SEQ ID NO: 1466024 - protein, 19 aa, Mycobacterium tuberculosis
RPGVSLGVRPDPVRPVRSA

SEQ ID NO: 1466025 - protein, 17 aa, Mycobacterium tuberculosis
RPHPLFVAFVGAAIDYK

SEQ ID NO: 1466026 - protein, 18 aa, Mycobacterium tuberculosis
RPIRKGRLGKPVEFGYKA

SEQ ID NO: 1466027 - protein, 18 aa, Mycobacterium tuberculosis
RPRSPLELLDTVPDSLLR

SEQ ID NO: 1466028 - protein, 17 aa, Mycobacterium tuberculosis
RQLILLDAPVVLGWAGF

SEQ ID NO: 1466029 - protein, 31 aa, Mycobacterium tuberculosis; identical to SEQ ID NO: 210048

SEQ ID NO: 1466030 - protein, 18 aa, Mycobacterium tuberculosis
RQYFGSKVLRTVIPRSVK

SEQ ID NO: 1466031 - protein, 21 aa, Mycobacterium tuberculosis
RRESRFPISEIIAQTPPIPDM

SEQ ID NO: 1466032 - protein, 25 aa, Mycobacterium tuberculosis
RRFTLTVGLMLPRRAFLPPPHVDSA

SEQ ID NO: 1466033 - protein, 17 aa, Mycobacterium tuberculosis
RRIAEEIGYPVLVRPSY

SEQ ID NO: 1466034 - protein, 19 aa, Mycobacterium tuberculosis
RRLTEVRKNGVLPYLRPDG

SEQ ID NO: 1466035 - protein, 19 aa, Mycobacterium tuberculosis
RRLVGLFCQQGHFDRSKAE

SEQ ID NO: 1466036 - protein, 22 aa, Mycobacterium tuberculosis
RRPDIAVTILRLANMIGPAMDT

SEQ ID NO: 1466037 - protein, 18 aa, Mycobacterium tuberculosis
RRSGLFAVLCKTDPNATP

SEQ ID NO: 1466038 - protein, 19 aa, Mycobacterium tuberculosis
RRYLGLEVLTRARAALTST

SEQ ID NO: 1466039 - protein, 26 aa, Mycobacterium tuberculosis
RSAIARFTAAGIRKTWVFQAFDDAHE

SEQ ID NO: 1466040 - protein, 18 aa, Mycobacterium tuberculosis
RSSEMIICGGVNIAPDEV

SEQ ID NO: 1466041 - protein, 17 aa, Mycobacterium tuberculosis
RTFVPSKGFGLLPPIVT

SEQ ID NO: 1466042 - protein, 21 aa, Mycobacterium tuberculosis
RTGHGFLDWPAGAREATTARL

SEQ ID NO: 1466043 - protein, 23 aa, Mycobacterium tuberculosis
RTLPRWQRIVALTMIGISTALIG

SEQ ID NO: 1466044 - protein, 22 aa, Mycobacterium tuberculosis
RTSDLLICQKMDMNVHGKPDGL

SEQ ID NO: 1466045 - protein, 18 aa, Mycobacterium tuberculosis
RTVVLERLVKFNGEQHMP

SEQ ID NO: 1466046 - protein, 17 aa, Mycobacterium tuberculosis
RVSAAFIDRICSATRAE

SEQ ID NO: 1466047 - protein, 17 aa, Mycobacterium tuberculosis
RVSALSRRRRGPETTAV

SEQ ID NO: 1466048 - protein, 24 aa, Mycobacterium tuberculosis
RVSRAMFNELWAGFDPDEVPIGSV

SEQ ID NO: 1466049 - protein, 23 aa, Mycobacterium tuberculosis
RVVSLSSLAARRGRIHFDDLQFE

SEQ ID NO: 1466050 - protein, 20 aa, Mycobacterium tuberculosis
RWAKTWEFQALLKARPVVGD

SEQ ID NO: 1466051 - protein, 19 aa, Mycobacterium tuberculosis
RYIILKGRNSEHLFVAAES

SEQ ID NO: 1466052 - protein, 18 aa, Mycobacterium tuberculosis
RYPNMLRLRYEKKRNLPR

SEQ ID NO: 1466053 - protein, 26 aa, Mycobacterium tuberculosis
RYRCTTPQCGRAVFNQDLANVDQYLV

SEQ ID NO: 1466054 - protein, 18 aa, Mycobacterium tuberculosis
SAALRRVELARPRSVVGK

SEQ ID NO: 1466055 - protein, 17 aa, Mycobacterium tuberculosis
SARPGDTLFAISTSGNS

SEQ ID NO: 1466056 - protein, 19 aa, Mycobacterium tuberculosis
SATLFRAAIQVMRAPAARN

SEQ ID NO: 1466057 - protein, 24 aa, Mycobacterium tuberculosis
SAVSRAFIAHSVWQRMGDELLAKA

SEQ ID NO: 1466058 - protein, 26 aa, Mycobacterium tuberculosis
SEGPLPQTRFVLRKALAAHLPVILVV

SEQ ID NO: 1466059 - protein, 21 aa, Mycobacterium tuberculosis
SFSMASGRVAYAMRLHGPAIT

SEQ ID NO: 1466060 - protein, 17 aa, Mycobacterium tuberculosis
SFSTGIANTGDYNTGSF

SEQ ID NO: 1466061 - protein, 25 aa, Mycobacterium tuberculosis
SGAPPVGGLHLQFGRNASTEMVVSW

SEQ ID NO: 1466062 - protein, 18 aa, Mycobacterium tuberculosis
SGPAADDMAVAWAASAAA

SEQ ID NO: 1466063 - protein, 18 aa, Mycobacterium tuberculosis
SGQIGFGSLNSGSHNIGL

SEQ ID NO: 1466064 - protein, 22 aa, Mycobacterium tuberculosis
SGVSIDGLIAILTFPPAESVFD

SEQ ID NO: 1466065 - protein, 22 aa, Mycobacterium tuberculosis
SHLYPDSLRTMGYDVGSAGFEL

SEQ ID NO: 1466066 - protein, 25 aa, Mycobacterium tuberculosis
SIDARLADRLAVNRGLAPVADVRAV

SEQ ID NO: 1466067 - protein, 25 aa, Mycobacterium tuberculosis
SLAGLARAIADIAARARSGNLKPDE

SEQ ID NO: 1466068 - protein, 22 aa, Mycobacterium tuberculosis
SLMHCMTVSLALDGAGLGTVWG

SEQ ID NO: 1466069 - protein, 19 aa, Mycobacterium tuberculosis
SMKMEIPVLAEAAGTVSKV

SEQ ID NO: 1466070 - protein, 26 aa, Mycobacterium tuberculosis
SNGMLWRGDHEGLFGLSYGITIPQFP

SEQ ID NO: 1466071 - protein, 20 aa, Mycobacterium tuberculosis
SPAACRRIAIAAHDGLARTI

SEQ ID NO: 1466072 - protein, 18 aa, Mycobacterium tuberculosis
SPDLPWDLLQRSRISAVS

SEQ ID NO: 1466073 - protein, 23 aa, Mycobacterium tuberculosis
SRPLMQAAAAWQRLANELTATAA

SEQ ID NO: 1466074 - protein, 18 aa, Mycobacterium tuberculosis
SRTPWRLNQNYLRDIRLI

SEQ ID NO: 1466075 - protein, 18 aa, Mycobacterium tuberculosis
SSLQTTRMAFHAIKAGEG

SEQ ID NO: 1466076 - protein, 17 aa, Mycobacterium tuberculosis
SSLVAVHLACLSLLSGE

SEQ ID NO: 1466077 - protein, 18 aa, Mycobacterium tuberculosis
STIALGLLHRLTAMVAKV

SEQ ID NO: 1466078 - protein, 24 aa, Mycobacterium tuberculosis
STLLGVPMESMIGLLAVAALDDLD

SEQ ID NO: 1466079 - protein, 23 aa, Mycobacterium tuberculosis
SVLGRSWPVVCDELLGHYEAVRG

SEQ ID NO: 1466080 - protein, 31 aa, Mycobacterium tuberculosis; identical to SEQ ID NO: 206766

SEQ ID NO: 1466081 - protein, 19 aa, Mycobacterium tuberculosis
SVNGTVVVSVWQPGEPAAK

SEQ ID NO: 1466082 - protein, 42 aa, Mycobacterium tuberculosis; identical to SEQ ID NO: 206782

SEQ ID NO: 1466083 - protein, 23 aa, Mycobacterium tuberculosis
TAELLRLALTGKRKPYIYTSTIA

SEQ ID NO: 1466084 - protein, 19 aa, Mycobacterium tuberculosis
TALVPGRPAPTLVTAAAVE

SEQ ID NO: 1466085 - protein, 20 aa, Mycobacterium tuberculosis
TAPQCTHYPLAEAADAIRAM

SEQ ID NO: 1466086 - protein, 18 aa, Mycobacterium tuberculosis
TAPSGRKPLRFTSFGDQS

SEQ ID NO: 1466087 - protein, 17 aa, Mycobacterium tuberculosis
TATIRMLLAAIQTEEVS

SEQ ID NO: 1466088 - protein, 19 aa, Mycobacterium tuberculosis
TAWLAEGMLIYLPPDPRTG

SEQ ID NO: 1466089 - protein, 17 aa, Mycobacterium tuberculosis
TDFFSDTTFRVFQAPYV

SEQ ID NO: 1466090 - protein, 24 aa, Mycobacterium tuberculosis
TDFLRRQAPELLPASISGGAPLAG

SEQ ID NO: 1466091 - protein, 29 aa, Mycobacterium tuberculosis
TDSLLPLPNIPLLEYAARFITPVHPGYTA

SEQ ID NO: 1466092 - protein, 18 aa, Mycobacterium tuberculosis
TEIGRELTARTGGVVGRR

SEQ ID NO: 1466093 - protein, 21 aa, Mycobacterium tuberculosis
TEQDFRLFSGMSAHYDSLPRL

SEQ ID NO: 1466094 - protein, 19 aa, Mycobacterium tuberculosis
TEQYISVGVGRDYTDVSPL

SEQ ID NO: 1466095 - protein, 17 aa, Mycobacterium tuberculosis
TFEEMLEMAACGAKVLM

SEQ ID NO: 1466096 - protein, 18 aa, Mycobacterium tuberculosis
TGAMYRIVTLAVLRAGAD

SEQ ID NO: 1466097 - protein, 27 aa, Mycobacterium tuberculosis
TGGVLKPILWCPGKATAVQRFAAEHDI

SEQ ID NO: 1466098 - protein, 25 aa, Mycobacterium tuberculosis
TGSHPFMKFEGWTPLAQLKVGDRIA

SEQ ID NO: 1466099 - protein, 20 aa, Mycobacterium tuberculosis
TGVGGTVVFRGGQFGGQFRD

SEQ ID NO: 1466100 - protein, 18 aa, Mycobacterium tuberculosis
THHYRFTLYHLPVALQLP

SEQ ID NO: 1466101 - protein, 25 aa, Mycobacterium tuberculosis
TISEIPIDLQVIGGIGPIHVQPIDI

SEQ ID NO: 1466102 - protein, 17 aa, Mycobacterium tuberculosis
TITIERPAAFLNVDIPV

SEQ ID NO: 1466103 - protein, 25 aa, Mycobacterium tuberculosis
TMGLPATVVDWGLWKSLADVQKDAT

SEQ ID NO: 1466104 - protein, 17 aa, Mycobacterium tuberculosis
TNKRLVDDFGINTDNMF

SEQ ID NO: 1466105 - protein, 19 aa, Mycobacterium tuberculosis
TPGSWRREPLSGIPAATNT

SEQ ID NO: 1466106 - protein, 25 aa, Mycobacterium tuberculosis
TPRYAVGCKRPGFHNTYLSTFNRDN

SEQ ID NO: 1466107 - protein, 18 aa, Mycobacterium tuberculosis
TPTTAFRLGEKVDDPLAM

SEQ ID NO: 1466108 - protein, 20 aa, Mycobacterium tuberculosis
TQFSSNGWATTPITEAGYVR

SEQ ID NO: 1466109 - protein, 18 aa, Mycobacterium tuberculosis
TQVLRCLDAELARSSADP

SEQ ID NO: 1466110 - protein, 23 aa, Mycobacterium tuberculosis
TRDSSIWIGPRVVIPSLALRARV

SEQ ID NO: 1466111 - protein, 17 aa, Mycobacterium tuberculosis
TRGALAMDPRRMAMMFE

SEQ ID NO: 1466112 - protein, 22 aa, Mycobacterium tuberculosis
TRPGATLLLSCFSNAMPPDEEW

SEQ ID NO: 1466113 - protein, 30 aa, Mycobacterium tuberculosis; identical to SEQ ID NO: 85300

SEQ ID NO: 1466114 - protein, 23 aa, Mycobacterium tuberculosis
TVDWEFAASVGERLARPAPPSTE

SEQ ID NO: 1466115 - protein, 19 aa, Mycobacterium tuberculosis
TWLALQPFLAPAGITGVAD

SEQ ID NO: 1466116 - protein, 18 aa, Mycobacterium tuberculosis
VAAASAWNGLAAELSVAA

SEQ ID NO: 1466117 - protein, 20 aa, Mycobacterium tuberculosis
VAAECRWIRENLGVDVPVHF

SEQ ID NO: 1466118 - protein, 18 aa, Mycobacterium tuberculosis
VAAPEIPSPAAALQATRL

SEQ ID NO: 1466119 - protein, 24 aa, Mycobacterium tuberculosis
VALPSRPVQVIGFTSVPGAGDNFL

SEQ ID NO: 1466120 - protein, 22 aa, Mycobacterium tuberculosis
VAMPAALRAAQMLAAEWDVAAD

SEQ ID NO: 1466121 - protein, 17 aa, Mycobacterium tuberculosis
VASSSIGFIAPIPAATN

SEQ ID NO: 1466122 - protein, 27 aa, Mycobacterium tuberculosis
VAVGQRVVLVFLPRCGQCAACATDGRT

SEQ ID NO: 1466123 - protein, 32 aa, Mycobacterium tuberculosis
VDLHTTLSIGPFPFRWDYIPPTPANGPIPAVP

SEQ ID NO: 1466124 - protein, 22 aa, Mycobacterium tuberculosis
VDPTLRCVRCGSDVVRAVVVGA

SEQ ID NO: 1466125 - protein, 24 aa, Mycobacterium tuberculosis
VEELLGVVASEGWQGQAAEAFVAA

SEQ ID NO: 1466126 - protein, 18 aa, Mycobacterium tuberculosis
VEHHAVLDSVNWLVEHEG

SEQ ID NO: 1466127 - protein, 25 aa, Mycobacterium tuberculosis
VEPSDFRLWVCLHEVTHRVQFTANP

SEQ ID NO: 1466128 - protein, 29 aa, Mycobacterium tuberculosis
VFEHLGRLLIIDCGVLFPGHDEPGVDLIL

SEQ ID NO: 1466129 - protein, 24 aa, Mycobacterium tuberculosis
VFQRTPIWCFPKFDVPLPTAVRWA

SEQ ID NO: 1466130 - protein, 22 aa, Mycobacterium tuberculosis
VGDLPGWLALHGYQNSRKRAVA

SEQ ID NO: 1466131 - protein, 32 aa, Mycobacterium tuberculosis
VGGARRCAAQSWPLDRVKAVKDAAGVSLNDVV

SEQ ID NO: 1466132 - protein, 23 aa, Mycobacterium tuberculosis
VGQDIRYGLGAVRNVGANVVGSL

SEQ ID NO: 1466133 - protein, 26 aa, Mycobacterium tuberculosis
VGRAARLGHRLTIAMTRWQALVNWSG

SEQ ID NO: 1466134 - protein, 30 aa, Mycobacterium tuberculosis
VGRLFAEGVAVDWSSVFAGLGGRRVELPTY

SEQ ID NO: 1466135 - protein, 17 aa, Mycobacterium tuberculosis
VGRRARAARLLRSVMAR

SEQ ID NO: 1466136 - protein, 18 aa, Mycobacterium tuberculosis
VGVLPTPAVAYLTGAYDA

SEQ ID NO: 1466137 - protein, 17 aa, Mycobacterium tuberculosis
VGWCIIIAMRSIPASVE

SEQ ID NO: 1466138 - protein, 25 aa, Mycobacterium tuberculosis
VHADAGIDFFEVFCDTPLQDCERRD

SEQ ID NO: 1466139 - protein, 31 aa, Mycobacterium tuberculosis; identical to SEQ ID NO: 207827

SEQ ID NO: 1466140 - protein, 22 aa, Mycobacterium tuberculosis
VIAANRAQLMVLIATNIFGQNT

SEQ ID NO: 1466141 - protein, 24 aa, Mycobacterium tuberculosis
VIARGGFPDGCFQTLLVSSGAVEA

SEQ ID NO: 1466142 - protein, 25 aa, Mycobacterium tuberculosis
VIATGPRWRCPAGRCRRRPSDRAYR

SEQ ID NO: 1466143 - protein, 17 aa, Mycobacterium tuberculosis
VKQHPDRLVAGWHVVAL

SEQ ID NO: 1466144 - protein, 18 aa, Mycobacterium tuberculosis
VLHEVRIMLDQYWPSVPH

SEQ ID NO: 1466145 - protein, 18 aa, Mycobacterium tuberculosis
VLPDPVGLLRCAGGADLA

SEQ ID NO: 1466146 - protein, 23 aa, Mycobacterium tuberculosis
VLVHGLPLYHVHGLVLGLLGSLR

SEQ ID NO: 1466147 - protein, 30 aa, Mycobacterium tuberculosis
VNELDPAGARLCVRPMSEFQSNEAYRELHA

SEQ ID NO: 1466148 - protein, 20 aa, Mycobacterium tuberculosis
VNSARIFAGAGLGPMLAAAS

SEQ ID NO: 1466149 - protein, 17 aa, Mycobacterium tuberculosis
VNTGAFIAGNYSNGVLW

SEQ ID NO: 1466150 - protein, 23 aa, Mycobacterium tuberculosis
VNVSSVLAWLPLGMSYGVSKAAM

SEQ ID NO: 1466151 - protein, 26 aa, Mycobacterium tuberculosis
VPDSPEALPLLFGHIGEGNLHLNVLR

SEQ ID NO: 1466152 - protein, 21 aa, Mycobacterium tuberculosis
VRARLRQSWLERGATDAELGW

SEQ ID NO: 1466153 - protein, 17 aa, Mycobacterium tuberculosis
VRFVDVLPRNAAGKVSK

SEQ ID NO: 1466154 - protein, 18 aa, Mycobacterium tuberculosis
VRMLRSFDPRSGTHALDV

SEQ ID NO: 1466155 - protein, 23 aa, Mycobacterium tuberculosis
VRSRRPGETASIFVPSVPNLLQL

SEQ ID NO: 1466156 - protein, 31 aa, Mycobacterium tuberculosis
VSALVVFEVMVRPLIRLSLGKRHPMRRIVSA

SEQ ID NO: 1466157 - protein, 19 aa, Mycobacterium tuberculosis
VTFGDVWALLVDGNFGSGL

SEQ ID NO: 1466158 - protein, 17 aa, Mycobacterium tuberculosis
VVGRKAFARFAGYSSAM

SEQ ID NO: 1466159 - protein, 18 aa, Mycobacterium tuberculosis
VVVLPCGAGKTLVGAAAM

SEQ ID NO: 1466160 - protein, 18 aa, Mycobacterium tuberculosis
WAALPFDERAAVFLRAAD

SEQ ID NO: 1466161 - protein, 22 aa, Mycobacterium tuberculosis
WADGQTGLFCPLDEQIQQAARH

SEQ ID NO: 1466162 - protein, 17 aa, Mycobacterium tuberculosis
WARPLPATIVMRAGEQT

SEQ ID NO: 1466163 - protein, 17 aa, Mycobacterium tuberculosis
WARRLHIGRSELLRDAL

SEQ ID NO: 1466164 - protein, 25 aa, Mycobacterium tuberculosis
WASANWRLRRGRIVLLEGDSPAGLR

SEQ ID NO: 1466165 - protein, 20 aa, Mycobacterium tuberculosis
WCRDRETFGRPLISRQSVQN

SEQ ID NO: 1466166 - protein, 17 aa, Mycobacterium tuberculosis
WDTPPITLFPNGISAPD

SEQ ID NO: 1466167 - protein, 17 aa, Mycobacterium tuberculosis
WELAVGDDPLSEEEIAA

SEQ ID NO: 1466168 - protein, 21 aa, Mycobacterium tuberculosis
WGLDPYLTPGFTELSSQAGFD

SEQ ID NO: 1466169 - protein, 19 aa, Mycobacterium tuberculosis
WLAPYTGSAIAQHWMYEGK

SEQ ID NO: 1466170 - protein, 17 aa, Mycobacterium tuberculosis
WRRAVEVATQRWVASTA

SEQ ID NO: 1466171 - protein, 17 aa, Mycobacterium tuberculosis
WRRFKRRLSTELSSLAA

SEQ ID NO: 1466172 - protein, 17 aa, Mycobacterium tuberculosis
WSAGLAGSGIRRRASIL

SEQ ID NO: 1466173 - protein, 24 aa, Mycobacterium tuberculosis
YAEGRGWHNARVIPYGPIELDPSA

SEQ ID NO: 1466174 - protein, 24 aa, Mycobacterium tuberculosis
YAGALGARGLFACRQSLRPRYLCM

SEQ ID NO: 1466175 - protein, 22 aa, Mycobacterium tuberculosis
YDISDDFFALFLDPTWVYTCAY

SEQ ID NO: 1466176 - protein, 28 aa, Mycobacterium tuberculosis
YDSLVCGRRRLGAIGAEIENAVAHQRAL

SEQ ID NO: 1466177 - protein, 17 aa, Mycobacterium tuberculosis
YETSSAEQVRWVLQDSE

SEQ ID NO: 1466178 - protein, 19 aa, Mycobacterium tuberculosis
YFAELCGVDRQAADEVIEA

SEQ ID NO: 1466179 - protein, 23 aa, Mycobacterium tuberculosis
YGDLFPHAVKWRGTTYLEDGLHR

SEQ ID NO: 1466180 - protein, 24 aa, Mycobacterium tuberculosis
YGSASILPITWAYIRMMGAEGLRA

SEQ ID NO: 1466181 - protein, 17 aa, Mycobacterium tuberculosis
YGYRFGTAGSRLDDLAA

SEQ ID NO: 1466182 - protein, 18 aa, Mycobacterium tuberculosis
YKSPRLVKPEMLASARFR

SEQ ID NO: 1466183 - protein, 18 aa, Mycobacterium tuberculosis
YLNPFPANLGEVLRRYPK

SEQ ID NO: 1466184 - protein, 18 aa, Mycobacterium tuberculosis
YPRAGHVGDPEFLPLLRR

SEQ ID NO: 1466185 - protein, 17 aa, Mycobacterium tuberculosis
YRALGGIDGRYPKIKQW

SEQ ID NO: 1466186 - protein, 29 aa, Mycobacterium tuberculosis
YRIGREIGCKLVSFGSGAHFCLGAHLARM

SEQ ID NO: 1466187 - protein, 29 aa, Mycobacterium tuberculosis
YRLVGWRHGLCGYRRFFSITSLAGLRQED

SEQ ID NO: 1466188 - protein, 17 aa, Mycobacterium tuberculosis
YSNGLFLSGDYQGLVGL

SEQ ID NO: 1466189 - protein, 17 aa, Mycobacterium tuberculosis
YVHGFLRERMQMLQDEF

SEQ ID NO: 1466190 - protein, 17 aa, Mycobacterium tuberculosis
YVPCEVCQGARYNRETL

SEQ ID NO: 1466191 - protein, 18 aa, Mycobacterium tuberculosis
YWGIIKADIGIRDGRIVG

SEQ ID NO: 1466192 - protein, 25 aa, Mycobacterium tuberculosis
YYEKGLRDVIRYHVSMTSSVNFPDQ

SEQ ID NO: 1466193 - protein, 23 aa, Mycobacterium tuberculosis
AAAAVPYVAWMRATAASAEQAAA

SEQ ID NO: 1466194 - protein, 20 aa, Mycobacterium tuberculosis
AAAPYAGWLSAAAARAAGAA

SEQ ID NO: 1466195 - protein, 18 aa, Mycobacterium tuberculosis
AAATLDWLQAHGHDDQVR

SEQ ID NO: 1466196 - protein, 25 aa, Mycobacterium tuberculosis
AAEHTQSYVRACHLVGYQHPDLTAY

SEQ ID NO: 1466197 - protein, 20 aa, Mycobacterium tuberculosis
AAFADPYCPTLRAAVTGLPG

SEQ ID NO: 1466198 - protein, 17 aa, Mycobacterium tuberculosis
AAGPAWFDIAGVRMAPA

SEQ ID NO: 1466199 - protein, 20 aa, Mycobacterium tuberculosis
AAIRADFPILKRIMRGGNPL

SEQ ID NO: 1466200 - protein, 18 aa, Mycobacterium tuberculosis
AAIREWARRNGHNVSTRG

SEQ ID NO: 1466201 - protein, 28 aa, Mycobacterium tuberculosis
AARAPRVSAVIKVDWRPGVTDAMTQKVA

SEQ ID NO: 1466202 - protein, 18 aa, Mycobacterium tuberculosis
AATVHPMLVAANRNAFVQ

SEQ ID NO: 1466203 - protein, 21 aa, Mycobacterium tuberculosis
AAVAVEFARLYAVELEHYEKL

SEQ ID NO: 1466204 - protein, 28 aa, Mycobacterium tuberculosis
ACRRWPKLMRRLLLWEVRRRLGRSVDMS

SEQ ID NO: 1466205 - protein, 19 aa, Mycobacterium tuberculosis
ADDGQAYGFAAAFGAGPSC

SEQ ID NO: 1466206 - protein, 26 aa, Mycobacterium tuberculosis
ADHCLDLPGLFVWRRYHPSRPSGKAL

SEQ ID NO: 1466207 - protein, 17 aa, Mycobacterium tuberculosis
ADLDFSAVIHTLRARAD

SEQ ID NO: 1466208 - protein, 23 aa, Mycobacterium tuberculosis
ADLPLHPGFAASWQRLRTAPATV

SEQ ID NO: 1466209 - protein, 18 aa, Mycobacterium tuberculosis
ADRWADPTPAPGWTIAHQ

SEQ ID NO: 1466210 - protein, 20 aa, Mycobacterium tuberculosis
AEANAAFEEARRRFEASWNR

SEQ ID NO: 1466211 - protein, 21 aa, Mycobacterium tuberculosis
AEDPAREFLPTGGRVLAVFEP

SEQ ID NO: 1466212 - protein, 26 aa, Mycobacterium tuberculosis
AEGMGVPARRVTTCEEFADALRAAFA

SEQ ID NO: 1466213 - protein, 18 aa, Mycobacterium tuberculosis
AELAEAFHAAGRCTAEAN

SEQ ID NO: 1466214 - protein, 17 aa, Mycobacterium tuberculosis
AELTWQLRGTAEARQVD

SEQ ID NO: 1466215 - protein, 23 aa, Mycobacterium tuberculosis
AFYQAEIFEIVWSLWNLSRTDID

SEQ ID NO: 1466216 - protein, 21 aa, Mycobacterium tuberculosis
AGAPEVSGWLDGLRAAKRALV

SEQ ID NO: 1466217 - protein, 22 aa, Mycobacterium tuberculosis
AGCGDGAFRLGTMPIEVESSVA

SEQ ID NO: 1466218 - protein, 17 aa, Mycobacterium tuberculosis
AGEACPAALVDRWAPGR

SEQ ID NO: 1466219 - protein, 29 aa, Mycobacterium tuberculosis
AGFGVLLPSWWDRRRKLGLVLSAYTPVDG

SEQ ID NO: 1466220 - protein, 25 aa, Mycobacterium tuberculosis
AGIDDSWAALRWVGENAAELGGDPS

SEQ ID NO: 1466221 - protein, 19 aa, Mycobacterium tuberculosis
AGLGLRSAISSGLGSTAPA

SEQ ID NO: 1466222 - protein, 24 aa, Mycobacterium tuberculosis
AGMPERLRLPTARPYPPVADQRGA

SEQ ID NO: 1466223 - protein, 24 aa, Mycobacterium tuberculosis
AGRIPVPVPGFGVWALDSLRRANH

SEQ ID NO: 1466224 - protein, 25 aa, Mycobacterium tuberculosis
AGSPGAVCRWCGRVDPTLRCVRCGS

SEQ ID NO: 1466225 - protein, 19 aa, Mycobacterium tuberculosis
AGTTFPTDICEPVAVVGIG

SEQ ID NO: 1466226 - protein, 23 aa, Mycobacterium tuberculosis
AHAGPEFMLGDGMQRENPPQVAC

SEQ ID NO: 1466227 - protein, 18 aa, Mycobacterium tuberculosis
AHTTRARQVLVATEVGML

SEQ ID NO: 1466228 - protein, 18 aa, Mycobacterium tuberculosis
AIGRPRVPVEVNHEPFVT

SEQ ID NO: 1466229 - protein, 21 aa, Mycobacterium tuberculosis
AKYPDRLTVLHWLESLQGLPS

SEQ ID NO: 1466230 - protein, 22 aa, Mycobacterium tuberculosis
ALAKQMLRHFGVLLDNALAAPD

SEQ ID NO: 1466231 - protein, 22 aa, Mycobacterium tuberculosis
ALAPRRTTLPGGLRVVTEFLPA

SEQ ID NO: 1466232 - protein, 24 aa, Mycobacterium tuberculosis
ALGHPFGGSGARLMTTVLHHMPDK

SEQ ID NO: 1466233 - protein, 17 aa, Mycobacterium tuberculosis
ALGLMKAVLALQHGVVP

SEQ ID NO: 1466234 - protein, 17 aa, Mycobacterium tuberculosis
ALHLARRGIEVEIFTRA

SEQ ID NO: 1466235 - protein, 17 aa, Mycobacterium tuberculosis
AMLQRLDGLDVDRLTDI

SEQ ID NO: 1466236 - protein, 20 aa, Mycobacterium tuberculosis
AMPHLSGPLAGVGVGGQAGA

SEQ ID NO: 1466237 - protein, 21 aa, Mycobacterium tuberculosis
ANAFVLRGGVPVFVDIRPDTL

SEQ ID NO: 1466238 - protein, 19 aa, Mycobacterium tuberculosis
ANNKIAFDRIDERLVVVGL

SEQ ID NO: 1466239 - protein, 25 aa, Mycobacterium tuberculosis
ANRRRFPVEIIRRSRAAVGSDFIIC

SEQ ID NO: 1466240 - protein, 17 aa, Mycobacterium tuberculosis
APANVSGLLNIGTNLAG

SEQ ID NO: 1466241 - protein, 23 aa, Mycobacterium tuberculosis
APSRSAFVAGPWGAVASLSPELF

SEQ ID NO: 1466242 - protein, 32 aa, Mycobacterium tuberculosis; identical to SEQ ID NO: 210562

SEQ ID NO: 1466243 - protein, 17 aa, Mycobacterium tuberculosis
AQAVREVFHAASARAEV

SEQ ID NO: 1466244 - protein, 17 aa, Mycobacterium tuberculosis
ARAISMAAFHSKVTVGF

SEQ ID NO: 1466245 - protein, 17 aa, Mycobacterium tuberculosis
ARKATGHPAGEQPRDGV

SEQ ID NO: 1466246 - protein, 20 aa, Mycobacterium tuberculosis
ARLRVILRRAGKGNKEPRNV

SEQ ID NO: 1466247 - protein, 22 aa, Mycobacterium tuberculosis
ARPGRIGIRARQMFDGYRFQRG

SEQ ID NO: 1466248 - protein, 19 aa, Mycobacterium tuberculosis
ARPHPRTGIIEGGPNTNVL

SEQ ID NO: 1466249 - protein, 19 aa, Mycobacterium tuberculosis
ARPVARRLFAVRAVVGLSL

SEQ ID NO: 1466250 - protein, 24 aa, Mycobacterium tuberculosis
ARQALRLFDDLRLEHGRLDQPIPV

SEQ ID NO: 1466251 - protein, 18 aa, Mycobacterium tuberculosis
ARQHHVFPPGWSRCRAPA

SEQ ID NO: 1466252 - protein, 21 aa, Mycobacterium tuberculosis
ARRVFAPKVTGSWRLHVATAA

SEQ ID NO: 1466253 - protein, 17 aa, Mycobacterium tuberculosis
ARTSLMIHDIGAIVEWI

SEQ ID NO: 1466254 - protein, 21 aa, Mycobacterium tuberculosis
ASAVRARIAPVGPSAVSIELA

SEQ ID NO: 1466255 - protein, 19 aa, Mycobacterium tuberculosis
ASCGSDFGAVVDVIDTRTH

SEQ ID NO: 1466256 - protein, 20 aa, Mycobacterium tuberculosis
ASDLMEVWRAPIIDDTVLRL

SEQ ID NO: 1466257 - protein, 22 aa, Mycobacterium tuberculosis
ASELRRLRRCIAAAAGADHPLL

SEQ ID NO: 1466258 - protein, 23 aa, Mycobacterium tuberculosis
ASGPAPFPAVPVDLPAPADIANG

SEQ ID NO: 1466259 - protein, 17 aa, Mycobacterium tuberculosis
ASLRRFVFTSSYATVGR

SEQ ID NO: 1466260 - protein, 24 aa, Mycobacterium tuberculosis
ASRWPRAGALGPLIRDPDGSVYPS

SEQ ID NO: 1466261 - protein, 33 aa, Mycobacterium tuberculosis
AVFDLPKGAPRRFIRDLYEAISQLAFLPFPFDS

SEQ ID NO: 1466262 - protein, 17 aa, Mycobacterium tuberculosis
AVGLGMPGVGLPVSAAK

SEQ ID NO: 1466263 - protein, 24 aa, Mycobacterium tuberculosis
AVRAWRSADDFPCTEHMAYKIAQV

SEQ ID NO: 1466264 - protein, 17 aa, Mycobacterium tuberculosis
AVSSFGLSGTNAHVVVE

SEQ ID NO: 1466265 - protein, 17 aa, Mycobacterium tuberculosis
AVSYGNEAPKFFNSKGE

SEQ ID NO: 1466266 - protein, 18 aa, Mycobacterium tuberculosis
AWAVLVAYFNRLRCGTGD

SEQ ID NO: 1466267 - protein, 27 aa, Mycobacterium tuberculosis
CEDIGVDIAFTWDHFFPLYGDPDGPHF

SEQ ID NO: 1466268 - protein, 18 aa, Mycobacterium tuberculosis
CKAFAAAADGTGWGEGAG

SEQ ID NO: 1466269 - protein, 25 aa, Mycobacterium tuberculosis
CLAEAGWPVRVWAAALPQQTTSAVA

SEQ ID NO: 1466270 - protein, 19 aa, Mycobacterium tuberculosis
CLDAGVKVGCFRPPTVPAG

SEQ ID NO: 1466271 - protein, 25 aa, Mycobacterium tuberculosis
CLGSGRWPGRLLGSVSSGLLRHAHC

SEQ ID NO: 1466272 - protein, 19 aa, Mycobacterium tuberculosis
CQGFITQLGRNFQVIYEQA

SEQ ID NO: 1466273 - protein, 18 aa, Mycobacterium tuberculosis
DAWLGRIACGDRDLASLK

SEQ ID NO: 1466274 - protein, 18 aa, Mycobacterium tuberculosis
DDERAAGYAGWRKAVQRT

SEQ ID NO: 1466275 - protein, 23 aa, Mycobacterium tuberculosis
DDGRVCGLVAIELATGRIETILA

SEQ ID NO: 1466276 - protein, 21 aa, Mycobacterium tuberculosis
DEIAGIGAGVTWAADNRTVYY

SEQ ID NO: 1466277 - protein, 19 aa, Mycobacterium tuberculosis
DGIDPLRDVVMLGATNRPD

SEQ ID NO: 1466278 - protein, 17 aa, Mycobacterium tuberculosis
DGVIPRRLVTSCEHFHR

SEQ ID NO: 1466279 - protein, 18 aa, Mycobacterium tuberculosis
DHGLRYVVLINGSLVNPS

SEQ ID NO: 1466280 - protein, 23 aa, Mycobacterium tuberculosis
DHLELGESLGLIDMQRGAKVSGS

SEQ ID NO: 1466281 - protein, 25 aa, Mycobacterium tuberculosis
DIELALRLGATVERVAEASGVDPWF

SEQ ID NO: 1466282 - protein, 21 aa, Mycobacterium tuberculosis
DKLKDAGFYWATRSGVTVSMA

SEQ ID NO: 1466283 - protein, 18 aa, Mycobacterium tuberculosis
DNSYVHNLIHGFILAAAH

SEQ ID NO: 1466284 - protein, 24 aa, Mycobacterium tuberculosis
DPLFQRRHLLLSGWIKMQEGQLPS

SEQ ID NO: 1466285 - protein, 22 aa, Mycobacterium tuberculosis
DPWLPSLGNPLTFLSPANIAFA

SEQ ID NO: 1466286 - protein, 18 aa, Mycobacterium tuberculosis
DQLACYRPTPSANSIAWL

SEQ ID NO: 1466287 - protein, 18 aa, Mycobacterium tuberculosis
DRDRLVVIIAGYSSDIDR

SEQ ID NO: 1466288 - protein, 22 aa, Mycobacterium tuberculosis
DRHLLRPLREVMWGHDENLLNS

SEQ ID NO: 1466289 - protein, 24 aa, Mycobacterium tuberculosis
DRIRYHGGEFIDLIVGGSTYDLAA

SEQ ID NO: 1466290 - protein, 21 aa, Mycobacterium tuberculosis
DRSYVNIGFWSSVPVGATEGA

SEQ ID NO: 1466291 - protein, 20 aa, Mycobacterium tuberculosis
DRYLEVWNLVFMQNERGEGT

SEQ ID NO: 1466292 - protein, 23 aa, Mycobacterium tuberculosis
DSILRVLAMHRFAKAPMLVGGQM

SEQ ID NO: 1466293 - protein, 30 aa, Mycobacterium tuberculosis; identical to SEQ ID NO: 87610

SEQ ID NO: 1466294 - protein, 24 aa, Mycobacterium tuberculosis
DVAGVCIEPTLTLPGLRAAVDGAG

SEQ ID NO: 1466295 - protein, 25 aa, Mycobacterium tuberculosis
DVALSVPVSGTWVDIRFTLPANTVD

SEQ ID NO: 1466296 - protein, 21 aa, Mycobacterium tuberculosis
DVTWLDCLGIPTVQAVRPASL

SEQ ID NO: 1466297 - protein, 22 aa, Mycobacterium tuberculosis
DYLPCLVSIQFRLLPDGKDYVF

SEQ ID NO: 1466298 - protein, 22 aa, Mycobacterium tuberculosis
EAADAFEAVRIIARASRVDVTL

SEQ ID NO: 1466299 - protein, 20 aa, Mycobacterium tuberculosis
EAEGADVVQIFLGNPQSWKA

SEQ ID NO: 1466300 - protein, 28 aa, Mycobacterium tuberculosis
EAHLEHPKMPLVPLIDGWETVVEMEAAL

SEQ ID NO: 1466301 - protein, 28 aa, Mycobacterium tuberculosis
EAIRQLAIRAFAAIDCRGLARVDFFLTD

SEQ ID NO: 1466302 - protein, 20 aa, Mycobacterium tuberculosis
EAKLGYPLDRSHTAAIIWYD

SEQ ID NO: 1466303 - protein, 28 aa, Mycobacterium tuberculosis
ECQEVLKQAAAFHGEFTRALAAAGAAYA

SEQ ID NO: 1466304 - protein, 22 aa, Mycobacterium tuberculosis
EDASPAYLGFNLFQHAIARAVI

SEQ ID NO: 1466305 - protein, 19 aa, Mycobacterium tuberculosis
EEAIRIATAAKREYEASVS

SEQ ID NO: 1466306 - protein, 17 aa, Mycobacterium tuberculosis
EEGLEGAGLSELGAAEA

SEQ ID NO: 1466307 - protein, 20 aa, Mycobacterium tuberculosis
EFLPTGGRVLAVFEPAGPGV

SEQ ID NO: 1466308 - protein, 21 aa, Mycobacterium tuberculosis
EGAMTPGALAIRERVRPPSMT

SEQ ID NO: 1466309 - protein, 23 aa, Mycobacterium tuberculosis
EGLEVTPVPGVVVHLPIAQVGPQ

SEQ ID NO: 1466310 - protein, 17 aa, Mycobacterium tuberculosis
EHGDYASNLAMQLAKKV

SEQ ID NO: 1466311 - protein, 24 aa, Mycobacterium tuberculosis
EHHSDWLTARLVDLDSGDIETLVQ

SEQ ID NO: 1466312 - protein, 26 aa, Mycobacterium tuberculosis
EIAIRAFRAAYELGVGTVAVYPYEDR

SEQ ID NO: 1466313 - protein, 26 aa, Mycobacterium tuberculosis
EINSARLYVGAGLAPMLDAAAAWDGL

SEQ ID NO: 1466314 - protein, 20 aa, Mycobacterium tuberculosis
EKWQCDGCSITHQRDDNAAI

SEQ ID NO: 1466315 - protein, 17 aa, Mycobacterium tuberculosis
ELDELRRLIPPWVTLGS

SEQ ID NO: 1466316 - protein, 17 aa, Mycobacterium tuberculosis
ELLSRFGSVRVVEPAEW

SEQ ID NO: 1466317 - protein, 22 aa, Mycobacterium tuberculosis
EPAPALLWIHAGGYVMGTAQQD

SEQ ID NO: 1466318 - protein, 23 aa, Mycobacterium tuberculosis
EPMIPIYIFYSMFGFQRTGDSFW

SEQ ID NO: 1466319 - protein, 21 aa, Mycobacterium tuberculosis
ESARLAEFLDHVDVAVSLHGY

SEQ ID NO: 1466320 - protein, 18 aa, Mycobacterium tuberculosis
ESELKRVRAAGFSDRPFS

SEQ ID NO: 1466321 - protein, 20 aa, Mycobacterium tuberculosis
ESERRYLLCDATFEAWFERD

SEQ ID NO: 1466322 - protein, 21 aa, Mycobacterium tuberculosis
ESTFAKLGVRDEIVRALGEEG

SEQ ID NO: 1466323 - protein, 19 aa, Mycobacterium tuberculosis
FADEAVLASTGWHLMMALI

SEQ ID NO: 1466324 - protein, 17 aa, Mycobacterium tuberculosis
FDDGIVIVGGGLAAART

SEQ ID NO: 1466325 - protein, 26 aa, Mycobacterium tuberculosis
FDGAIPRRWRSPAPLWGDTSFHSVAP

SEQ ID NO: 1466326 - protein, 19 aa, Mycobacterium tuberculosis
FDGYRFQRGPVLVVVEDGR

SEQ ID NO: 1466327 - protein, 22 aa, Mycobacterium tuberculosis
FEQHLRAVLDYPLGDSDAVVPV

SEQ ID NO: 1466328 - protein, 18 aa, Mycobacterium tuberculosis
FEQSRHWSRTYAPGHELK

SEQ ID NO: 1466329 - protein, 19 aa, Mycobacterium tuberculosis
FFLSGGFLAPPGRAPVLVY

SEQ ID NO: 1466330 - protein, 26 aa, Mycobacterium tuberculosis
FGDYFKRGAIELAWALLTNSLAAGGY

SEQ ID NO: 1466331 - protein, 17 aa, Mycobacterium tuberculosis
FGPYLSSASNPWGDGIN

SEQ ID NO: 1466332 - protein, 22 aa, Mycobacterium tuberculosis
FGVEPPVALILQGASLHDLTAD

SEQ ID NO: 1466333 - protein, 26 aa, Mycobacterium tuberculosis
FHLRNRLVVAAMHWDGPKAQVIGLVR

SEQ ID NO: 1466334 - protein, 21 aa, Mycobacterium tuberculosis
FLDPTMAYTCAYFEREDMTLE

SEQ ID NO: 1466335 - protein, 17 aa, Mycobacterium tuberculosis
FLSGGYSLPAIPLGIDV

SEQ ID NO: 1466336 - protein, 28 aa, Mycobacterium tuberculosis
FLTPNGRPFFCGTYYPKAAFLQLLSAIS

SEQ ID NO: 1466337 - protein, 25 aa, Mycobacterium tuberculosis
FNAFPASYWRRWTTCKSVVLRVQVT

SEQ ID NO: 1466338 - protein, 17 aa, Mycobacterium tuberculosis
FNCLTSYSDASKMRDDL

SEQ ID NO: 1466339 - protein, 28 aa, Mycobacterium tuberculosis
FPKVAAMHYPVWRQSWTGILDPYLLDMI

SEQ ID NO: 1466340 - protein, 18 aa, Mycobacterium tuberculosis
FRRVHLSTGDHFDLYDTS

SEQ ID NO: 1466341 - protein, 22 aa, Mycobacterium tuberculosis
FSDGEIAEAAWFTRDEVRAALA

SEQ ID NO: 1466342 - protein, 18 aa, Mycobacterium tuberculosis
FSGNRGSYNIGPANLGNY

SEQ ID NO: 1466343 - protein, 19 aa, Mycobacterium tuberculosis
FSVARRLALLLTFPRFLPT

SEQ ID NO: 1466344 - protein, 17 aa, Mycobacterium tuberculosis
FSWLDGRATEERPSWGY

SEQ ID NO: 1466345 - protein, 19 aa, Mycobacterium tuberculosis
FSYQFSFEQSRHWSRTYAP

SEQ ID NO: 1466346 - protein, 27 aa, Mycobacterium tuberculosis
FTSDIKNLLPMLAVFKPTVVVSVPRVF

SEQ ID NO: 1466347 - protein, 17 aa, Mycobacterium tuberculosis
FVRRQRAWLRTRASRQP

SEQ ID NO: 1466348 - protein, 22 aa, Mycobacterium tuberculosis
FVTGVMSSGFFNFGTGNSGLLV

SEQ ID NO: 1466349 - protein, 23 aa, Mycobacterium tuberculosis
FWYQIPMSLPVIGPRVISDPKGR

SEQ ID NO: 1466350 - protein, 24 aa, Mycobacterium tuberculosis
GADPELKSTGFARDLADYIQEQGW

SEQ ID NO: 1466351 - protein, 28 aa, Mycobacterium tuberculosis
GADRVGPTILRHWSHPATVLVAQPVCGQ

SEQ ID NO: 1466352 - protein, 19 aa, Mycobacterium tuberculosis
GAEALDWVRARNKPTTAAF

SEQ ID NO: 1466353 - protein, 23 aa, Mycobacterium tuberculosis
GAEMHARISGLADYFALDELDAI

SEQ ID NO: 1466354 - protein, 19 aa, Mycobacterium tuberculosis
GDFLSYCLVAEGAVDIAAE

SEQ ID NO: 1466355 - protein, 17 aa, Mycobacterium tuberculosis
GDLLRPSTVSAQMHADA

SEQ ID NO: 1466356 - protein, 20 aa, Mycobacterium tuberculosis
GDLRSLFAFLADRGSSLDAL

SEQ ID NO: 1466357 - protein, 25 aa, Mycobacterium tuberculosis
GDTDRVTLFRAWYSRRNFGQLSGSV

SEQ ID NO: 1466358 - protein, 19 aa, Mycobacterium tuberculosis
GEESYVLLVRVASARALED

SEQ ID NO: 1466359 - protein, 17 aa, Mycobacterium tuberculosis
GELNRFVFAMPEQLGRI

SEQ ID NO: 1466360 - protein, 21 aa, Mycobacterium tuberculosis
GEMWAQDAAAMFGYAAATATA

SEQ ID NO: 1466361 - protein, 22 aa, Mycobacterium tuberculosis
GEYCVVKSGFGLEVAKTADVAI

SEQ ID NO: 1466362 - protein, 17 aa, Mycobacterium tuberculosis
GEYGAGKVIIWDSGTYD

SEQ ID NO: 1466363 - protein, 19 aa, Mycobacterium tuberculosis
GFQLLRPVKGEERYFVVTH

SEQ ID NO: 1466364 - protein, 19 aa, Mycobacterium tuberculosis
GGGLSGVLRVPPRPYVMPH

SEQ ID NO: 1466365 - protein, 28 aa, Mycobacterium tuberculosis
GGIDNARRAELIERFGLDPTKKARTYSK

SEQ ID NO: 1466366 - protein, 20 aa, Mycobacterium tuberculosis
GGLTAIRLAAMAPDLVGELV

SEQ ID NO: 1466367 - protein, 18 aa, Mycobacterium tuberculosis
GHACGHNIIAASAVGTAL

SEQ ID NO: 1466368 - protein, 19 aa, Mycobacterium tuberculosis
GHHSWEDLDDLLLATYSEL

SEQ ID NO: 1466369 - protein, 17 aa, Mycobacterium tuberculosis
GIHPVYKTVDTCAAEFE

SEQ ID NO: 1466370 - protein, 23 aa, Mycobacterium tuberculosis
GKHLGVGVTSIYWYFRKKDDLLN

SEQ ID NO: 1466371 - protein, 26 aa, Mycobacterium tuberculosis
GKSYRFRRLELARFLAALHATVLDNP

SEQ ID NO: 1466372 - protein, 18 aa, Mycobacterium tuberculosis
GLAGVASVGGQPSQATQL

SEQ ID NO: 1466373 - protein, 19 aa, Mycobacterium tuberculosis
GLEIALACHHRIAADVKGS

SEQ ID NO: 1466374 - protein, 24 aa, Mycobacterium tuberculosis
GLGCELRHAHRLVYSEGLDLSGDP

SEQ ID NO: 1466375 - protein, 24 aa, Mycobacterium tuberculosis
GLGRRELLPYSDLDVLLLHDGKPA

SEQ ID NO: 1466376 - protein, 24 aa, Mycobacterium tuberculosis
GLYAKARAGEITHFTGIDSPYQRP

SEQ ID NO: 1466377 - protein, 22 aa, Mycobacterium tuberculosis
GPAELLSAVGALAEATRDGVVA

SEQ ID NO: 1466378 - protein, 20 aa, Mycobacterium tuberculosis
GPGIPRHHRAAGGLQSVAKA

SEQ ID NO: 1466379 - protein, 23 aa, Mycobacterium tuberculosis
GPGTIPGPFGATFNLSTSSLALF

SEQ ID NO: 1466380 - protein, 30 aa, Mycobacterium tuberculosis
GPSASFGTLWIKSPANMLGYWNNPERTAEV

SEQ ID NO: 1466381 - protein, 18 aa, Mycobacterium tuberculosis
GQAVWLGAVPKDAPTGGD

SEQ ID NO: 1466382 - protein, 17 aa, Mycobacterium tuberculosis
GQGSQWLGMGMGLHAGY

SEQ ID NO: 1466383 - protein, 19 aa, Mycobacterium tuberculosis
GRADTYFDFGGVHAAFADP

SEQ ID NO: 1466384 - protein, 18 aa, Mycobacterium tuberculosis
GRADVAVCELVLMELYQL

SEQ ID NO: 1466385 - protein, 19 aa, Mycobacterium tuberculosis
GRARVLAITVRRNGTRLDA

SEQ ID NO: 1466386 - protein, 19 aa, Mycobacterium tuberculosis
GRDADRVCFTTGAMRVEPD

SEQ ID NO: 1466387 - protein, 22 aa, Mycobacterium tuberculosis
GREAAHLRAFRAYAAHSQEIAL

SEQ ID NO: 1466388 - protein, 17 aa, Mycobacterium tuberculosis
GRMKDLIIQDGVNHYPD

SEQ ID NO: 1466389 - protein, 18 aa, Mycobacterium tuberculosis
GSGGPVFGALDGGYQVLL

SEQ ID NO: 1466390 - protein, 29 aa, Mycobacterium tuberculosis
GSGVSGFANRGILPFSVASVVSGFANIGT

SEQ ID NO: 1466391 - protein, 18 aa, Mycobacterium tuberculosis
GSLVTRSRLTDILRAGGR

SEQ ID NO: 1466392 - protein, 25 aa, Mycobacterium tuberculosis
GSTGERGLHHLIWEVVDNAVDEAMA

SEQ ID NO: 1466393 - protein, 22 aa, Mycobacterium tuberculosis
GTTCWRRPVAPVAIASAAEPGA

SEQ ID NO: 1466394 - protein, 17 aa, Mycobacterium tuberculosis
GVKAAGVVMEFANEFGL

SEQ ID NO: 1466395 - protein, 38 aa, Mycobacterium tuberculosis; identical to SEQ ID NO: 200543

SEQ ID NO: 1466396 - protein, 30 aa, Mycobacterium tuberculosis
GVVESWKQFGKSLIHWDEWTTNPNEALGKT

SEQ ID NO: 1466397 - protein, 23 aa, Mycobacterium tuberculosis
GVVREFSIDPALRDDFARAAAAH

SEQ ID NO: 1466398 - protein, 20 aa, Mycobacterium tuberculosis
GWRHLPDWPPATTERAWYLQ

SEQ ID NO: 1466399 - protein, 23 aa, Mycobacterium tuberculosis
HDLSSLRLLGSVGEPINPEAWRW

SEQ ID NO: 1466400 - protein, 26 aa, Mycobacterium tuberculosis
HEDDWLAPGGFNFDAWRFENRCELLA

SEQ ID NO: 1466401 - protein, 19 aa, Mycobacterium tuberculosis
HGGITWRVAATSARSARSL

SEQ ID NO: 1466402 - protein, 20 aa, Mycobacterium tuberculosis
HGNAKRWGWIHADLGDGDVL

SEQ ID NO: 1466403 - protein, 20 aa, Mycobacterium tuberculosis
HHGMLSVFGSPTWRTVTGGS

SEQ ID NO: 1466404 - protein, 21 aa, Mycobacterium tuberculosis
HLKATLKHLACLEYSTVAIQN

SEQ ID NO: 1466405 - protein, 17 aa, Mycobacterium tuberculosis
HLSATAALQAWDTAGAG

SEQ ID NO: 1466406 - protein, 19 aa, Mycobacterium tuberculosis
HLSCLRGCGLVVATYEGRQ

SEQ ID NO: 1466407 - protein, 17 aa, Mycobacterium tuberculosis
HPRAAGGELYRVHRRDL

SEQ ID NO: 1466408 - protein, 29 aa, Mycobacterium tuberculosis
HRTVLPLEFARLAGYYLAEGHACLTNGCE

SEQ ID NO: 1466409 - protein, 19 aa, Mycobacterium tuberculosis
HRVAIEFDPPLPPEYQQLA

SEQ ID NO: 1466410 - protein, 24 aa, Mycobacterium tuberculosis
HTNRGDIKIALFGNHAPKTVANFV

SEQ ID NO: 1466411 - protein, 25 aa, Mycobacterium tuberculosis
IAAVNGFCVGGGIGLVGNSDVIVAS

SEQ ID NO: 1466412 - protein, 17 aa, Mycobacterium tuberculosis
IADLRAAGLQVLATAVD

SEQ ID NO: 1466413 - protein, 17 aa, Mycobacterium tuberculosis
IAEEIGYPVLVRPSYVL

SEQ ID NO: 1466414 - protein, 17 aa, Mycobacterium tuberculosis
ICAASNYDDALCSDAIG

SEQ ID NO: 1466415 - protein, 20 aa, Mycobacterium tuberculosis
ICARRGPTLQWVRSAVTAQD

SEQ ID NO: 1466416 - protein, 17 aa, Mycobacterium tuberculosis
IDFTNIYFYTVLYHALR

SEQ ID NO: 1466417 - protein, 24 aa, Mycobacterium tuberculosis
IDRMTWSQLYSRVTAVSAYLISYG

SEQ ID NO: 1466418 - protein, 26 aa, Mycobacterium tuberculosis
IEQFRLLVLRTAWLIDKHHDYQKVRR

SEQ ID NO: 1466419 - protein, 18 aa, Mycobacterium tuberculosis
IEYLASVVMTRDGVAYPD

SEQ ID NO: 1466420 - protein, 18 aa, Mycobacterium tuberculosis
IFAGAGLGPMLAAASAWD

SEQ ID NO: 1466421 - protein, 23 aa, Mycobacterium tuberculosis
IFKDTLIMSYEWPEDRQSLSWTL

SEQ ID NO: 1466422 - protein, 19 aa, Mycobacterium tuberculosis
IGNVMPGFGHVGLGGSIGW

SEQ ID NO: 1466423 - protein, 26 aa, Mycobacterium tuberculosis
IHRDWLLIELRTDWTVATTRYTAGSL

SEQ ID NO: 1466424 - protein, 27 aa, Mycobacterium tuberculosis
ILDTVARQEPGLSWAAGLRDNGQTTLL

SEQ ID NO: 1466425 - protein, 17 aa, Mycobacterium tuberculosis
ILRAALVCEPVTIRCVL

SEQ ID NO: 1466426 - protein, 19 aa, Mycobacterium tuberculosis
INGQPCRPPHCVASVSPAR

SEQ ID NO: 1466427 - protein, 42 aa, Mycobacterium tuberculosis
IPAITLRALGVTHFSVGPIIVPRIAGTLPVIDINIGDPGGSS

SEQ ID NO: 1466428 - protein, 22 aa, Mycobacterium tuberculosis
IPAQAIAQVCELTWQLRGQATG

SEQ ID NO: 1466429 - protein, 27 aa, Mycobacterium tuberculosis
IQAAYWPRYGLGMGETYESVTVETKDQ

SEQ ID NO: 1466430 - protein, 18 aa, Mycobacterium tuberculosis
IRPDRSYVNIGFWSSVPV

SEQ ID NO: 1466431 - protein, 22 aa, Mycobacterium tuberculosis
ISGNFNNGVLWVGDYQGLFGVS

SEQ ID NO: 1466432 - protein, 20 aa, Mycobacterium tuberculosis
ISVPVGGLLAPLQPVTVTLT

SEQ ID NO: 1466433 - protein, 22 aa, Mycobacterium tuberculosis
ITIPAGTALGAFNLPTLSIPSV

SEQ ID NO: 1466434 - protein, 24 aa, Mycobacterium tuberculosis
IVAIDMRRRRGLPPIAPHSGLGYA

SEQ ID NO: 1466435 - protein, 23 aa, Mycobacterium tuberculosis
IVDEPFLAPARIDLTALRAHAVA

SEQ ID NO: 1466436 - protein, 24 aa, Mycobacterium tuberculosis
IYVRKRLRCGNRHPLQRVKRRLLA

SEQ ID NO: 1466437 - protein, 21 aa, Mycobacterium tuberculosis
KAAGVVMEFANEFGLNMPIAR

SEQ ID NO: 1466438 - protein, 20 aa, Mycobacterium tuberculosis
KALADFLFDDERAMVRIDMS

SEQ ID NO: 1466439 - protein, 17 aa, Mycobacterium tuberculosis
KATFDVRVTAPAHWKVI

SEQ ID NO: 1466440 - protein, 19 aa, Mycobacterium tuberculosis
KAYGAGPCPGHLTDIEHIV

SEQ ID NO: 1466441 - protein, 17 aa, Mycobacterium tuberculosis
KDARLTILEVMAEAIDR

SEQ ID NO: 1466442 - protein, 21 aa, Mycobacterium tuberculosis
KGASEGWCPYCGSPYSFLPQL

SEQ ID NO: 1466443 - protein, 18 aa, Mycobacterium tuberculosis
KGLPGARARRRALSDAAL

SEQ ID NO: 1466444 - protein, 21 aa, Mycobacterium tuberculosis
KLDRSRPLWELWVIEGVEGGR

SEQ ID NO: 1466445 - protein, 17 aa, Mycobacterium tuberculosis
KLIADKMFEEFKEPHYG

SEQ ID NO: 1466446 - protein, 20 aa, Mycobacterium tuberculosis
KLVLRTPVRELAGYRSDDPT

SEQ ID NO: 1466447 - protein, 27 aa, Mycobacterium tuberculosis
KQFSMCINCMLCYSACPVYALDPDFLG

SEQ ID NO: 1466448 - protein, 22 aa, Mycobacterium tuberculosis
KRPEFGKLTPLYPNQRLRLETS

SEQ ID NO: 1466449 - protein, 29 aa, Mycobacterium tuberculosis
KRTVLRLDPRLAPVKAAVLPLSRHADLSP

SEQ ID NO: 1466450 - protein, 20 aa, Mycobacterium tuberculosis
KSTHFDWVLAPYDLTASRAH

SEQ ID NO: 1466451 - protein, 20 aa, Mycobacterium tuberculosis
KVGLRRGKIIVVRPEHDHGL

SEQ ID NO: 1466452 - protein, 30 aa, Mycobacterium tuberculosis; identical to SEQ ID NO: 201838

SEQ ID NO: 1466453 - protein, 17 aa, Mycobacterium tuberculosis
LAQRAVQVLRRLYDRVG

SEQ ID NO: 1466454 - protein, 17 aa, Mycobacterium tuberculosis
LARHHLHRFLPGASTRR

SEQ ID NO: 1466455 - protein, 24 aa, Mycobacterium tuberculosis
LDAVPRMRGMLTLFEGVATGAADG

SEQ ID NO: 1466456 - protein, 19 aa, Mycobacterium tuberculosis
LDGGFGPVVLPPIPVPAVN

SEQ ID NO: 1466457 - protein, 17 aa, Mycobacterium tuberculosis
LDLPPNTAVTVIFFGPV

SEQ ID NO: 1466458 - protein, 18 aa, Mycobacterium tuberculosis
LEDFDVFHPDRMASRILG

SEQ ID NO: 1466459 - protein, 20 aa, Mycobacterium tuberculosis
LELTLHPGVMTGYAHGELAD

SEQ ID NO: 1466460 - protein, 17 aa, Mycobacterium tuberculosis
LEMRATSVGPDLSRVIV

SEQ ID NO: 1466461 - protein, 24 aa, Mycobacterium tuberculosis
LESARELDVWLPVHPVTRRRWPNG

SEQ ID NO: 1466462 - protein, 19 aa, Mycobacterium tuberculosis
LFAGWRSDPAFVLNLSPFD

SEQ ID NO: 1466463 - protein, 27 aa, Mycobacterium tuberculosis
LFDEMLIELDIHFRIEDDLYYPALSAA

SEQ ID NO: 1466464 - protein, 17 aa, Mycobacterium tuberculosis
LGFVEAQGGGTILLARG

SEQ ID NO: 1466465 - protein, 24 aa, Mycobacterium tuberculosis
LGGARMPGIPWYEYTNQAGSQYFP

SEQ ID NO: 1466466 - protein, 18 aa, Mycobacterium tuberculosis
LGLARAYVSGDLQAHGVH

SEQ ID NO: 1466467 - protein, 21 aa, Mycobacterium tuberculosis
LGNALGAVAQWVGLQDDHDAF

SEQ ID NO: 1466468 - protein, 18 aa, Mycobacterium tuberculosis
LGQVRARSLAAYENQDVP

SEQ ID NO: 1466469 - protein, 22 aa, Mycobacterium tuberculosis
LGSLVAGSRYRGDFEERLKKVL

SEQ ID NO: 1466470 - protein, 22 aa, Mycobacterium tuberculosis
LHIPRTTWYDGVRFEEVSVGYP

SEQ ID NO: 1466471 - protein, 28 aa, Mycobacterium tuberculosis
LHRRFGDIVRLVFALVPFRFRKHPRARA

SEQ ID NO: 1466472 - protein, 18 aa, Mycobacterium tuberculosis
LHTLRADIDYGLYEAKTT

SEQ ID NO: 1466473 - protein, 17 aa, Mycobacterium tuberculosis
LKLKELAYMHAEGFAAG

SEQ ID NO: 1466474 - protein, 23 aa, Mycobacterium tuberculosis
LKTSLEFRERFGIEVEELDEYAE

SEQ ID NO: 1466475 - protein, 19 aa, Mycobacterium tuberculosis
LLAWLRDRLSHFKCPRSIA

SEQ ID NO: 1466476 - protein, 18 aa, Mycobacterium tuberculosis
LLNAAVRRIDRHGAGVTV

SEQ ID NO: 1466477 - protein, 29 aa, Mycobacterium tuberculosis
LLRQLRLGDYDVLVGINLLREGLDLPEVS

SEQ ID NO: 1466478 - protein, 27 aa, Mycobacterium tuberculosis
LLSVGYAACHWCHVMAHESFDDDEVAA

SEQ ID NO: 1466479 - protein, 20 aa, Mycobacterium tuberculosis
LNLHAIGGVGPVDIVGGNVP

SEQ ID NO: 1466480 - protein, 18 aa, Mycobacterium tuberculosis
LPAWAESSTSHYVQTKDP

SEQ ID NO: 1466481 - protein, 26 aa, Mycobacterium tuberculosis
LPEHFAEELVRIIGVLRGMQLKKVPS

SEQ ID NO: 1466482 - protein, 17 aa, Mycobacterium tuberculosis
LPGHGHSAWREDGNYSP

SEQ ID NO: 1466483 - protein, 26 aa, Mycobacterium tuberculosis
LPHPTSRRELLAALTKRGRDVVRQVT

SEQ ID NO: 1466484 - protein, 18 aa, Mycobacterium tuberculosis
LPVSLTIPGFTIPGGTLI

SEQ ID NO: 1466485 - protein, 18 aa, Mycobacterium tuberculosis
LRAGDYVNMGLARHAGLP

SEQ ID NO: 1466486 - protein, 22 aa, Mycobacterium tuberculosis
LRRWLDRPQELLLTELGRASRI

SEQ ID NO: 1466487 - protein, 18 aa, Mycobacterium tuberculosis
LSAQAAAFHSQFVQALSG

SEQ ID NO: 1466488 - protein, 25 aa, Mycobacterium tuberculosis
LSECYVRNQVPFFVDYVRRYTDLPF

SEQ ID NO: 1466489 - protein, 36 aa, Mycobacterium tuberculosis
LSLDISPLQARCGWAVGWRKDAFFGRAALLAEKAAG

SEQ ID NO: 1466490 - protein, 24 aa, Mycobacterium tuberculosis
LTAMVAKVGVFRPITRLSAERDYI

SEQ ID NO: 1466491 - protein, 17 aa, Mycobacterium tuberculosis
LTARLAALRSTDPATLI

SEQ ID NO: 1466492 - protein, 18 aa, Mycobacterium tuberculosis
LTIANGLSPDRLRKQLDV

SEQ ID NO: 1466493 - protein, 20 aa, Mycobacterium tuberculosis
LTIRLLGRTEIRRLAKELDF

SEQ ID NO: 1466494 - protein, 17 aa, Mycobacterium tuberculosis
LTLRVYAYSSCCKASYP

SEQ ID NO: 1466495 - protein, 24 aa, Mycobacterium tuberculosis
LTMVCAYSRWLLAMLLPSRCAEDL

SEQ ID NO: 1466496 - protein, 23 aa, Mycobacterium tuberculosis
LTQPVRWDLCTATLREHTVTAIV

SEQ ID NO: 1466497 - protein, 17 aa, Mycobacterium tuberculosis
LTRPVAVTVLAPLDEAS

SEQ ID NO: 1466498 - protein, 18 aa, Mycobacterium tuberculosis
LTTVCYQFGNAKPVYALE

SEQ ID NO: 1466499 - protein, 18 aa, Mycobacterium tuberculosis
LVAVRMVSEGVDVPRLSV

SEQ ID NO: 1466500 - protein, 17 aa, Mycobacterium tuberculosis
LVDACRLSRARVVVTPH

SEQ ID NO: 1466501 - protein, 33 aa, Mycobacterium tuberculosis; identical to SEQ ID NO: 203183

SEQ ID NO: 1466502 - protein, 19 aa, Mycobacterium tuberculosis
LVRAVGVDFFVRMASGELD

SEQ ID NO: 1466503 - protein, 19 aa, Mycobacterium tuberculosis
LYTPCRGQEAAQVGAAACL

SEQ ID NO: 1466504 - protein, 18 aa, Mycobacterium tuberculosis
MLYIEGRLLGKPASIDEA

SEQ ID NO: 1466505 - protein, 21 aa, Mycobacterium tuberculosis
MWKKSMTVRELWVSVTDPDAL

SEQ ID NO: 1466506 - protein, 24 aa, Mycobacterium tuberculosis
NAHLRAAHHLSLCAQCAAEVDDQS

SEQ ID NO: 1466507 - protein, 25 aa, Mycobacterium tuberculosis
NDQVAALFRMWLRDAVRRVATGVLD

SEQ ID NO: 1466508 - protein, 19 aa, Mycobacterium tuberculosis
NGGSARLIGNGGAGGSGGS

SEQ ID NO: 1466509 - protein, 19 aa, Mycobacterium tuberculosis
NGVARVIAYRWLRVGRLPV

SEQ ID NO: 1466510 - protein, 17 aa, Mycobacterium tuberculosis
NLGRLVLGTPAPLPCTP

SEQ ID NO: 1466511 - protein, 22 aa, Mycobacterium tuberculosis
NQFPYQSKTGWVYDSGDYETTM

SEQ ID NO: 1466512 - protein, 25 aa, Mycobacterium tuberculosis
NQIGCSLRLFVYDCAADRAMTARRR

SEQ ID NO: 1466513 - protein, 24 aa, Mycobacterium tuberculosis
NTATRRLCEWAGCKFLGEHDTTNR

SEQ ID NO: 1466514 - protein, 17 aa, Mycobacterium tuberculosis
NVIAWASSGHVGFKGSR

SEQ ID NO: 1466515 - protein, 22 aa, Mycobacterium tuberculosis
NVIDPLDWVEMFGADALRFTLA

SEQ ID NO: 1466516 - protein, 18 aa, Mycobacterium tuberculosis
NWLLGNGESPQWSADAKF

SEQ ID NO: 1466517 - protein, 24 aa, Mycobacterium tuberculosis
PAARTDPMLLAWTVPVVDLDPTAA

SEQ ID NO: 1466518 - protein, 19 aa, Mycobacterium tuberculosis
PARVANLVERLRAAEKELE

SEQ ID NO: 1466519 - protein, 31 aa, Mycobacterium tuberculosis
PATHIGGLWWILTCLMHGGLCVTGGENTTSL

SEQ ID NO: 1466520 - protein, 19 aa, Mycobacterium tuberculosis
PCRPPHCVASVSPARPSAG

SEQ ID NO: 1466521 - protein, 19 aa, Mycobacterium tuberculosis
PDIDPVLKMLLDTFPVTFT

SEQ ID NO: 1466522 - protein, 18 aa, Mycobacterium tuberculosis
PDVNGFGISLKIGSVDYQ

SEQ ID NO: 1466523 - protein, 24 aa, Mycobacterium tuberculosis
PEHPFPVWTERGGPATIVPMFLLY

SEQ ID NO: 1466524 - protein, 21 aa, Mycobacterium tuberculosis
PEIWARLVRALGVVDEADLRP

SEQ ID NO: 1466525 - protein, 20 aa, Mycobacterium tuberculosis
PELLACLQRLEVERRRQGAA

SEQ ID NO: 1466526 - protein, 19 aa, Mycobacterium tuberculosis
PEPSAAWAEARRRVRQRRE

SEQ ID NO: 1466527 - protein, 19 aa, Mycobacterium tuberculosis
PFMIGRPASDPAYFPCYAK

SEQ ID NO: 1466528 - protein, 19 aa, Mycobacterium tuberculosis
PFTRRSHAWLEQQTGCRKA

SEQ ID NO: 1466529 - protein, 17 aa, Mycobacterium tuberculosis
PFWPRNPWTTAYRQERL

SEQ ID NO: 1466530 - protein, 17 aa, Mycobacterium tuberculosis
PGGRRELEELVGRLMSY

SEQ ID NO: 1466531 - protein, 26 aa, Mycobacterium tuberculosis
PGLPYLGLEHRAAWVEAEADGTITSM

SEQ ID NO: 1466532 - protein, 22 aa, Mycobacterium tuberculosis
PGSAALFAWGLNQLVFLGLRPP

SEQ ID NO: 1466533 - protein, 18 aa, Mycobacterium tuberculosis
PGTGMPAAPMVPPTGSPG

SEQ ID NO: 1466534 - protein, 17 aa, Mycobacterium tuberculosis
PGVSQWRTLQRVPIGGE

SEQ ID NO: 1466535 - protein, 18 aa, Mycobacterium tuberculosis
PIPVGFAAVGGIGPIAIP

SEQ ID NO: 1466536 - protein, 17 aa, Mycobacterium tuberculosis
PLGAALAQLCGKDVVLP

SEQ ID NO: 1466537 - protein, 24 aa, Mycobacterium tuberculosis
PLHLPGFPVQFFVYKQIAANNAAR

SEQ ID NO: 1466538 - protein, 19 aa, Mycobacterium tuberculosis
PLLEAVVLSDRFVDIRPVT

SEQ ID NO: 1466539 - protein, 17 aa, Mycobacterium tuberculosis
PLPTAITPHHLWLRAVA

SEQ ID NO: 1466540 - protein, 17 aa, Mycobacterium tuberculosis
PMWAHPEPLPPVSGLTI

SEQ ID NO: 1466541 - protein, 17 aa, Mycobacterium tuberculosis
PPAPSRPSASPAEPPTR

SEQ ID NO: 1466542 - protein, 26 aa, Mycobacterium tuberculosis
PPFPLYMAGARLDSLVPLGPPVMDVA

SEQ ID NO: 1466543 - protein, 17 aa, Mycobacterium tuberculosis
PPNLIRAILRAPVDLLF

SEQ ID NO: 1466544 - protein, 22 aa, Mycobacterium tuberculosis
PPNSALVSWLPFYHDMGLVIGI

SEQ ID NO: 1466545 - protein, 17 aa, Mycobacterium tuberculosis
PPTPWHHQRFWVTDRSA

SEQ ID NO: 1466546 - protein, 18 aa, Mycobacterium tuberculosis
PQYQAWKHTQLIIDVVPG

SEQ ID NO: 1466547 - protein, 23 aa, Mycobacterium tuberculosis
PRPPMVTSGLRIGTPALATRGFG

SEQ ID NO: 1466548 - protein, 19 aa, Mycobacterium tuberculosis
PRRALSELLRRGTRNLTGA

SEQ ID NO: 1466549 - protein, 20 aa, Mycobacterium tuberculosis
PRTDFHTEILRMQKAINAVA

SEQ ID NO: 1466550 - protein, 17 aa, Mycobacterium tuberculosis
PRYGFRPTVMARPPFAG

SEQ ID NO: 1466551 - protein, 17 aa, Mycobacterium tuberculosis
PSHGFRGVLVELSKELR

SEQ ID NO: 1466552 - protein, 17 aa, Mycobacterium tuberculosis
PTLKGEFAHTLNLTDVH

SEQ ID NO: 1466553 - protein, 18 aa, Mycobacterium tuberculosis
PTPGRSRAAHMGRRYGRR

SEQ ID NO: 1466554 - protein, 20 aa, Mycobacterium tuberculosis
PVLPAGRLVNFGTVHRVPAG

SEQ ID NO: 1466555 - protein, 23 aa, Mycobacterium tuberculosis
PVNWPRVLTVWRANLIGSSGKGG

SEQ ID NO: 1466556 - protein, 17 aa, Mycobacterium tuberculosis
PVRIIGYANAYDFFNMW

SEQ ID NO: 1466557 - protein, 17 aa, Mycobacterium tuberculosis
PVSHLMATFAGRSLTER

SEQ ID NO: 1466558 - protein, 19 aa, Mycobacterium tuberculosis
QAEPWRPQAVLNHAGELAR

SEQ ID NO: 1466559 - protein, 20 aa, Mycobacterium tuberculosis
QAWRAPKDVVARAYEFGALA

SEQ ID NO: 1466560 - protein, 21 aa, Mycobacterium tuberculosis
QEAWLRWDSQDTVIADPRAWL

SEQ ID NO: 1466561 - protein, 21 aa, Mycobacterium tuberculosis
QHGKLAYHAVTYGWLLSGLAR

SEQ ID NO: 1466562 - protein, 17 aa, Mycobacterium tuberculosis
QHSKLMRDGGLFHSNSL

SEQ ID NO: 1466563 - protein, 24 aa, Mycobacterium tuberculosis
QQGFCGTCKVRVLAGQVDRRGRII

SEQ ID NO: 1466564 - protein, 20 aa, Mycobacterium tuberculosis
QQRYPPWPASYDASLRVSWR

SEQ ID NO: 1466565 - protein, 19 aa, Mycobacterium tuberculosis
QRAAGEMRSRLRALDAAAR

SEQ ID NO: 1466566 - protein, 23 aa, Mycobacterium tuberculosis
QRDRAKMFALLWQSLRRQRQLLK

SEQ ID NO: 1466567 - protein, 20 aa, Mycobacterium tuberculosis
QRIAAFGAYVVAYDPYVSPA

SEQ ID NO: 1466568 - protein, 22 aa, Mycobacterium tuberculosis
QRIAQMLAELVELFKTEALHRL

SEQ ID NO: 1466569 - protein, 18 aa, Mycobacterium tuberculosis
QRNPEVFVNARVDTYWLR

SEQ ID NO: 1466570 - protein, 25 aa, Mycobacterium tuberculosis
QRQQTLRASMDWSYALLTDTERILF

SEQ ID NO: 1466571 - protein, 19 aa, Mycobacterium tuberculosis
QRRSASVTAVAWRTSAGAA

SEQ ID NO: 1466572 - protein, 20 aa, Mycobacterium tuberculosis
QRTAQRRCCAAVHGGRVVWA

SEQ ID NO: 1466573 - protein, 18 aa, Mycobacterium tuberculosis
QRVPDNLAELGRLTQLPD

SEQ ID NO: 1466574 - protein, 24 aa, Mycobacterium tuberculosis
QSTSWAQRWLAATGNRDYLGAFVK

SEQ ID NO: 1466575 - protein, 25 aa, Mycobacterium tuberculosis
QSVLTRSCKRWFGTGPAAYRNQARL

SEQ ID NO: 1466576 - protein, 19 aa, Mycobacterium tuberculosis
RAAARARARYACFDHACAD

SEQ ID NO: 1466577 - protein, 24 aa, Mycobacterium tuberculosis
RADMIAVAPSTLWSLTVDPDRPGS

SEQ ID NO: 1466578 - protein, 19 aa, Mycobacterium tuberculosis
RALAEVCRRGWAQSVAERE

SEQ ID NO: 1466579 - protein, 20 aa, Mycobacterium tuberculosis
RALVRAGFLAGDALRVLAGT

SEQ ID NO: 1466580 - protein, 17 aa, Mycobacterium tuberculosis
RAPKAVKEYARKHPHSM

SEQ ID NO: 1466581 - protein, 17 aa, Mycobacterium tuberculosis
RAPRIGLVSNVTGQLAG

SEQ ID NO: 1466582 - protein, 18 aa, Mycobacterium tuberculosis
RARQEWLAERLATLNRSE

SEQ ID NO: 1466583 - protein, 17 aa, Mycobacterium tuberculosis
RCGEVLSTILLECTMAG

SEQ ID NO: 1466584 - protein, 28 aa, Mycobacterium tuberculosis
RDHPDFPAAAARLGSRLSIHDQPNLGGS

SEQ ID NO: 1466585 - protein, 25 aa, Mycobacterium tuberculosis
RDIKKLPTLRGRTVVTMFYENSTRT

SEQ ID NO: 1466586 - protein, 23 aa, Mycobacterium tuberculosis
RDVIDAFLAWYVPGLDISDHTML

SEQ ID NO: 1466587 - protein, 17 aa, Mycobacterium tuberculosis
REHIKEIQAFFKELSAA

SEQ ID NO: 1466588 - protein, 19 aa, Mycobacterium tuberculosis
RFVFANADAFSWSQTFESL

SEQ ID NO: 1466589 - protein, 26 aa, Mycobacterium tuberculosis
RGARGPYRLGPEITRMATTVRLGVVT

SEQ ID NO: 1466590 - protein, 17 aa, Mycobacterium tuberculosis
RHHLHRFLPGASTRRSP

SEQ ID NO: 1466591 - protein, 24 aa, Mycobacterium tuberculosis
RIQRELPDWLSADVAILGEPTAGC

SEQ ID NO: 1466592 - protein, 18 aa, Mycobacterium tuberculosis
RIRVDGVAYDREEQTEGI

SEQ ID NO: 1466593 - protein, 18 aa, Mycobacterium tuberculosis
RKDMPTKPAPVLIFVPGG

SEQ ID NO: 1466594 - protein, 25 aa, Mycobacterium tuberculosis
RKPSRVPVWFMRQAGRSLPEYRALR

SEQ ID NO: 1466595 - protein, 19 aa, Mycobacterium tuberculosis
RLAGQWGDRVRPLVGDLTE

SEQ ID NO: 1466596 - protein, 25 aa, Mycobacterium tuberculosis
RLDERGVLRLRALMESFWSDELDRL

SEQ ID NO: 1466597 - protein, 25 aa, Mycobacterium tuberculosis
RLGITTDWKSRWYADKQYAEYVKED

SEQ ID NO: 1466598 - protein, 23 aa, Mycobacterium tuberculosis
RLPADLREQWSIRQVPLHILLDG

SEQ ID NO: 1466599 - protein, 29 aa, Mycobacterium tuberculosis
RLPEIPQLRWRVTGAPLGLDRPWFVEDEE

SEQ ID NO: 1466600 - protein, 17 aa, Mycobacterium tuberculosis
RLPERVQRYLVGRIKST

SEQ ID NO: 1466601 - protein, 23 aa, Mycobacterium tuberculosis
RLSDGIDIVAGWAEKAGLDVALA

SEQ ID NO: 1466602 - protein, 18 aa, Mycobacterium tuberculosis
RMRGAGGSDLDTTRLMPA

SEQ ID NO: 1466603 - protein, 20 aa, Mycobacterium tuberculosis
RMVIAPWLLAPGILSDRVRG

SEQ ID NO: 1466604 - protein, 24 aa, Mycobacterium tuberculosis
RPGRRRPRFAQPMLSIHQRPFDPA

SEQ ID NO: 1466605 - protein, 17 aa, Mycobacterium tuberculosis
RPPRQVPGASYWYAHTD

SEQ ID NO: 1466606 - protein, 25 aa, Mycobacterium tuberculosis
RPVPRLLAMGLLRRIDAETVILPRH

SEQ ID NO: 1466607 - protein, 22 aa, Mycobacterium tuberculosis
RQGEPAVSFLLISSGSAEVSHV

SEQ ID NO: 1466608 - protein, 22 aa, Mycobacterium tuberculosis
RQQVAPWWRRRPHRSLTSLGQW

SEQ ID NO: 1466609 - protein, 18 aa, Mycobacterium tuberculosis
RRASAWFAENGYLHEAVD

SEQ ID NO: 1466610 - protein, 32 aa, Mycobacterium tuberculosis; identical to SEQ ID NO: 210050

SEQ ID NO: 1466611 - protein, 22 aa, Mycobacterium tuberculosis
RRDGWWQGLGPYDVVLDALGGT

SEQ ID NO: 1466612 - protein, 18 aa, Mycobacterium tuberculosis
RRELRPLHPYGVSKAATD

SEQ ID NO: 1466613 - protein, 25 aa, Mycobacterium tuberculosis
RRLDGIPLAIEFAAARVRSMSPLEI

SEQ ID NO: 1466614 - protein, 17 aa, Mycobacterium tuberculosis
RRLNPVRAISAERAAAM

SEQ ID NO: 1466615 - protein, 20 aa, Mycobacterium tuberculosis
RRTFTVKYKLAILDEYDRAD

SEQ ID NO: 1466616 - protein, 19 aa, Mycobacterium tuberculosis
RRYGGVEFYSAIAAGSPER

SEQ ID NO: 1466617 - protein, 20 aa, Mycobacterium tuberculosis
RSRLLPGLPADRIVALGAED

SEQ ID NO: 1466618 - protein, 32 aa, Mycobacterium tuberculosis; identical to SEQ ID NO: 211712

SEQ ID NO: 1466619 - protein, 19 aa, Mycobacterium tuberculosis
RTAQWVLPWPNPRYSKLAR

SEQ ID NO: 1466620 - protein, 21 aa, Mycobacterium tuberculosis
RTRRPPAFPEDIWVPERDPGT

SEQ ID NO: 1466621 - protein, 19 aa, Mycobacterium tuberculosis
RTWLPTGWDSEMSDEYEWA

SEQ ID NO: 1466622 - protein, 18 aa, Mycobacterium tuberculosis
RVAATSARSARSLATTHP

SEQ ID NO: 1466623 - protein, 19 aa, Mycobacterium tuberculosis
RVAWERELLPGAQVVIAPT

SEQ ID NO: 1466624 - protein, 23 aa, Mycobacterium tuberculosis
RVHRVPSRMFPKVTTLPLGVPTF

SEQ ID NO: 1466625 - protein, 24 aa, Mycobacterium tuberculosis
RVVFAGAYHGWGFHEDGAASGLRA

SEQ ID NO: 1466626 - protein, 17 aa, Mycobacterium tuberculosis
RVVLVDIGLDLAHTDVL

SEQ ID NO: 1466627 - protein, 17 aa, Mycobacterium tuberculosis
RWAELVAGDGAFVPYRE

SEQ ID NO: 1466628 - protein, 19 aa, Mycobacterium tuberculosis
RWIEAMPQYGPGHADVVAE

SEQ ID NO: 1466629 - protein, 24 aa, Mycobacterium tuberculosis
RYQRLLHPWVNMAMDTVVAIEPEI

SEQ ID NO: 1466630 - protein, 19 aa, Mycobacterium tuberculosis
SDHPEWVMPTNWAVAVDRP

SEQ ID NO: 1466631 - protein, 19 aa, Mycobacterium tuberculosis
SDIALAGGVYVMLEPRRFA

SEQ ID NO: 1466632 - protein, 18 aa, Mycobacterium tuberculosis
SDQHVWCFLGDGEMDEPE

SEQ ID NO: 1466633 - protein, 20 aa, Mycobacterium tuberculosis
SDVAAALGISVTDARGLVDR

SEQ ID NO: 1466634 - protein, 19 aa, Mycobacterium tuberculosis
SELGLSYLLPRAIGSSRAF

SEQ ID NO: 1466635 - protein, 19 aa, Mycobacterium tuberculosis
SEPGHGLALAALGLDPIVD

SEQ ID NO: 1466636 - protein, 31 aa, Mycobacterium tuberculosis; identical to SEQ ID NO: 206360

SEQ ID NO: 1466637 - protein, 22 aa, Mycobacterium tuberculosis
SGGFGTLLLLGHDWAPPPATFH

SEQ ID NO: 1466638 - protein, 17 aa, Mycobacterium tuberculosis
SGHRGPTGGVSRRRLLR

SEQ ID NO: 1466639 - protein, 27 aa, Mycobacterium tuberculosis
SGLDSRAWRLPWPDGTVVYELDQPKVL

SEQ ID NO: 1466640 - protein, 19 aa, Mycobacterium tuberculosis
SGSGRPWDRDQLLRALGLR

SEQ ID NO: 1466641 - protein, 26 aa, Mycobacterium tuberculosis
SIPEIDIHTLVAFACRELLLSEDVRA

SEQ ID NO: 1466642 - protein, 19 aa, Mycobacterium tuberculosis
SKAARKVWDTADKFTRDTL

SEQ ID NO: 1466643 - protein, 22 aa, Mycobacterium tuberculosis
SLLVRSLVAWFWDQPLRAPLIR

SEQ ID NO: 1466644 - protein, 33 aa, Mycobacterium tuberculosis
SLRDPYHAYTIDWLPEGWFIEVSEVAPGCGQPG

SEQ ID NO: 1466645 - protein, 18 aa, Mycobacterium tuberculosis
SNGGLLMGIMLTGYPEKF

SEQ ID NO: 1466646 - protein, 19 aa, Mycobacterium tuberculosis
SNTIAPFLGLLGGVAAADA

SEQ ID NO: 1466647 - protein, 28 aa, Mycobacterium tuberculosis
SPGATAFPWRRQSALVQWYVETSGSPSE

SEQ ID NO: 1466648 - protein, 19 aa, Mycobacterium tuberculosis
SPRVPGYAPQGGGYAEPAG

SEQ ID NO: 1466649 - protein, 20 aa, Mycobacterium tuberculosis
SPSAWRSVTHRKRGVGVRPS

SEQ ID NO: 1466650 - protein, 24 aa, Mycobacterium tuberculosis
SQGEGGLRIVGISAVGSIDDLSAF

SEQ ID NO: 1466651 - protein, 17 aa, Mycobacterium tuberculosis
SSGVVWGRVPITAPAGA

SEQ ID NO: 1466652 - protein, 24 aa, Mycobacterium tuberculosis
SSSPRVALALGSGGARGYAHIGVI

SEQ ID NO: 1466653 - protein, 26 aa, Mycobacterium tuberculosis
SSTLKWPKLMSGPSWEDDAMRAGADA

SEQ ID NO: 1466654 - protein, 23 aa, Mycobacterium tuberculosis
STGKELFAAQGLPPFEDDHITRF

SEQ ID NO: 1466655 - protein, 17 aa, Mycobacterium tuberculosis
STRGVATFLVLRTRRDG

SEQ ID NO: 1466656 - protein, 23 aa, Mycobacterium tuberculosis
STTMGGFAIPAGPGYFNSSATPS

SEQ ID NO: 1466657 - protein, 22 aa, Mycobacterium tuberculosis
SVCYLPLTYDHRLIDGADAGRF

SEQ ID NO: 1466658 - protein, 17 aa, Mycobacterium tuberculosis
SVSLKFQGFEVYTATNG

SEQ ID NO: 1466659 - protein, 22 aa, Mycobacterium tuberculosis
SVTSELAGGAWQGPASAAMANA

SEQ ID NO: 1466660 - protein, 17 aa, Mycobacterium tuberculosis
SWGSGKDWQVWSGAKVA

SEQ ID NO: 1466661 - protein, 19 aa, Mycobacterium tuberculosis
TADLAMWPPAGAVPVEVAD

SEQ ID NO: 1466662 - protein, 19 aa, Mycobacterium tuberculosis
TAVLRPHLSLVPEAPAPFE

SEQ ID NO: 1466663 - protein, 17 aa, Mycobacterium tuberculosis
TAWRSTPAPVRGALVAR

SEQ ID NO: 1466664 - protein, 22 aa, Mycobacterium tuberculosis
TEPDIGPIIVPSFVLSVPTFAI

SEQ ID NO: 1466665 - protein, 20 aa, Mycobacterium tuberculosis
TERMCARIAAVMGYTDQSTV

SEQ ID NO: 1466666 - protein, 20 aa, Mycobacterium tuberculosis
TFIEVCYLLIYGELPDTDQL

SEQ ID NO: 1466667 - protein, 18 aa, Mycobacterium tuberculosis
TKKHWRAPSKLAYIDAGL

SEQ ID NO: 1466668 - protein, 25 aa, Mycobacterium tuberculosis
TMLPTGEVVRRCYTDVLAAARPATL

SEQ ID NO: 1466669 - protein, 18 aa, Mycobacterium tuberculosis
TPIPRTVALTVYGDLETS

SEQ ID NO: 1466670 - protein, 18 aa, Mycobacterium tuberculosis
TPVLHGHVADLFVVPAVA

SEQ ID NO: 1466671 - protein, 17 aa, Mycobacterium tuberculosis
TSARPGDEAILLADGTI

SEQ ID NO: 1466672 - protein, 19 aa, Mycobacterium tuberculosis
TSLIPWYSALQQWLAENLL

SEQ ID NO: 1466673 - protein, 19 aa, Mycobacterium tuberculosis
TSRLRLTARASLNAGELEL

SEQ ID NO: 1466674 - protein, 20 aa, Mycobacterium tuberculosis
TTARSNVRFGYEVTEPGIPY

SEQ ID NO: 1466675 - protein, 17 aa, Mycobacterium tuberculosis
TVFRLVAAEALKLTAAD

SEQ ID NO: 1466676 - protein, 21 aa, Mycobacterium tuberculosis
TYPTLCRLFAELGVATQESEM

SEQ ID NO: 1466677 - protein, 17 aa, Mycobacterium tuberculosis
VAAAKMWDSVASDLFSA

SEQ ID NO: 1466678 - protein, 18 aa, Mycobacterium tuberculosis
VAAHGAWLTLIRDGQPIE

SEQ ID NO: 1466679 - protein, 24 aa, Mycobacterium tuberculosis
VADAHGVPFLGIRGMSDGPGDPLH

SEQ ID NO: 1466680 - protein, 26 aa, Mycobacterium tuberculosis
VAEELGQPLPLFIKWDDADYGLRAAE

SEQ ID NO: 1466681 - protein, 22 aa, Mycobacterium tuberculosis
VAEPYLPLRAVRHLEKGRVVIF

SEQ ID NO: 1466682 - protein, 18 aa, Mycobacterium tuberculosis
VARAYLDSRVQTIYGGTT

SEQ ID NO: 1466683 - protein, 23 aa, Mycobacterium tuberculosis
VASRIRSAGAIFVGPWSPVSLGD

SEQ ID NO: 1466684 - protein, 25 aa, Mycobacterium tuberculosis
VAVGDWIAMFSMWPIKSTPGLRCQL

SEQ ID NO: 1466685 - protein, 29 aa, Mycobacterium tuberculosis
VCVHDPLIMRRALEYATGLGVLIAQHAEE

SEQ ID NO: 1466686 - protein, 26 aa, Mycobacterium tuberculosis
VDAASARGSLRLSLGHTSVEADVDAA

SEQ ID NO: 1466687 - protein, 21 aa, Mycobacterium tuberculosis
VDAPLPAWSHRFLFYDREGVD

SEQ ID NO: 1466688 - protein, 33 aa, Mycobacterium tuberculosis
VEPLRPGPPPTVWSRRWRQRWAPPTSVAASADH

SEQ ID NO: 1466689 - protein, 19 aa, Mycobacterium tuberculosis
VGAVLCNLATHLDDPADRL

SEQ ID NO: 1466690 - protein, 17 aa, Mycobacterium tuberculosis
VGEEWLYQSWAAAYLPL

SEQ ID NO: 1466691 - protein, 21 aa, Mycobacterium tuberculosis
VGLIAGCLVTSGVMRRNAKAR

SEQ ID NO: 1466692 - protein, 18 aa, Mycobacterium tuberculosis
VGNYPMSLVLDGQALNIT

SEQ ID NO: 1466693 - protein, 28 aa, Mycobacterium tuberculosis
VGSGGSGFWNIAGNLGNSGFLNVGPLTS

SEQ ID NO: 1466694 - protein, 18 aa, Mycobacterium tuberculosis
VGTLRHWRHSDIGPASFT

SEQ ID NO: 1466695 - protein, 21 aa, Mycobacterium tuberculosis
VGYPREWRRRKPYSWLRQVLP

SEQ ID NO: 1466696 - protein, 17 aa, Mycobacterium tuberculosis
VGYSARNETEWQRLMVA

SEQ ID NO: 1466697 - protein, 24 aa, Mycobacterium tuberculosis
VIAENRAELMILIATNLLGQNTPA

SEQ ID NO: 1466698 - protein, 21 aa, Mycobacterium tuberculosis
VKDGYGRNFLLPRGLAIVASR

SEQ ID NO: 1466699 - protein, 21 aa, Mycobacterium tuberculosis
VKTFDELDCLLDRLDGTVPFP

SEQ ID NO: 1466700 - protein, 18 aa, Mycobacterium tuberculosis
VLDAGCDWQRARGQLLAL

SEQ ID NO: 1466701 - protein, 17 aa, Mycobacterium tuberculosis
VLDTRAADTILGYDERG

SEQ ID NO: 1466702 - protein, 18 aa, Mycobacterium tuberculosis
VLEDWLWRNATRVLRLDT

SEQ ID NO: 1466703 - protein, 23 aa, Mycobacterium tuberculosis
VLIAGSWFPRYARNLGTPEPILT

SEQ ID NO: 1466704 - protein, 33 aa, Mycobacterium tuberculosis
VLTPLAVDPAHPFPFVSGLSLNLAVTVRQPEDG

SEQ ID NO: 1466705 - protein, 23 aa, Mycobacterium tuberculosis
VNHLPLTLPLRYLGMSDAEVDQI

SEQ ID NO: 1466706 - protein, 17 aa, Mycobacterium tuberculosis
VPDPRYGQQVAAVVQAR

SEQ ID NO: 1466707 - protein, 29 aa, Mycobacterium tuberculosis
VPFPKECPAPGVMQGCLESTSGLIMGIDS

SEQ ID NO: 1466708 - protein, 25 aa, Mycobacterium tuberculosis
VPIPRAGGLGAPRIRDVELVQMVAD

SEQ ID NO: 1466709 - protein, 23 aa, Mycobacterium tuberculosis
VPPGHKWARRSRVVSARELAQTP

SEQ ID NO: 1466710 - protein, 23 aa, Mycobacterium tuberculosis
VPVLEVALRLGVGYVGAMGSRKT

SEQ ID NO: 1466711 - protein, 19 aa, Mycobacterium tuberculosis
VQEDFAYHQFLIKKSKMPS

SEQ ID NO: 1466712 - protein, 21 aa, Mycobacterium tuberculosis
VQGEAAAGVVLLRPASPGTGV

SEQ ID NO: 1466713 - protein, 19 aa, Mycobacterium tuberculosis
VRARPCQKVVAVLRRSKSH

SEQ ID NO: 1466714 - protein, 17 aa, Mycobacterium tuberculosis
VRATWLKVVPDQLGRSL

SEQ ID NO: 1466715 - protein, 19 aa, Mycobacterium tuberculosis
VRAYGDFLSYCLVAEGAVD

SEQ ID NO: 1466716 - protein, 18 aa, Mycobacterium tuberculosis
VRLLNMVPYFQANPRITR

SEQ ID NO: 1466717 - protein, 24 aa, Mycobacterium tuberculosis
VRLPQKVGIGLARRMSLTGDYLSA

SEQ ID NO: 1466718 - protein, 26 aa, Mycobacterium tuberculosis
VRPETAADEIVRWATPVTAFQRTALR

SEQ ID NO: 1466719 - protein, 22 aa, Mycobacterium tuberculosis
VRVCGAIGVIECDRPVDLAVAT

SEQ ID NO: 1466720 - protein, 17 aa, Mycobacterium tuberculosis
VSCGAGGGASYIARNLG

SEQ ID NO: 1466721 - protein, 22 aa, Mycobacterium tuberculosis
VTHARTRLIAKMSYTNIGFALA

SEQ ID NO: 1466722 - protein, 23 aa, Mycobacterium tuberculosis
VTLPGAAIWHMAWSDKDDAIDWQ

SEQ ID NO: 1466723 - protein, 21 aa, Mycobacterium tuberculosis
VTSAGLVFQGWFHKAPYYPHD

SEQ ID NO: 1466724 - protein, 17 aa, Mycobacterium tuberculosis
VVGFTVHVPHYLTQTDY

SEQ ID NO: 1466725 - protein, 19 aa, Mycobacterium tuberculosis
VVSEFPTDRGWDVEGLYDP

SEQ ID NO: 1466726 - protein, 21 aa, Mycobacterium tuberculosis
VVTQSYCPLALGRLLDNPTVT

SEQ ID NO: 1466727 - protein, 23 aa, Mycobacterium tuberculosis
VVYYHGGGWSLGGLDTHDPVARA

SEQ ID NO: 1466728 - protein, 25 aa, Mycobacterium tuberculosis
VWHRRVPDRYPEVIVQAVSADDIVS

SEQ ID NO: 1466729 - protein, 22 aa, Mycobacterium tuberculosis
VWLAEELTRSWRVQWPELPDAM

SEQ ID NO: 1466730 - protein, 20 aa, Mycobacterium tuberculosis
VYYPDCADVGIGAAVEIRGR

SEQ ID NO: 1466731 - protein, 17 aa, Mycobacterium tuberculosis
WDGPKAQVIGLVRSHLK

SEQ ID NO: 1466732 - protein, 19 aa, Mycobacterium tuberculosis
WDQGIEMARHIDITADLGA

SEQ ID NO: 1466733 - protein, 20 aa, Mycobacterium tuberculosis
WEALEHAGIDPLSLRGSATG

SEQ ID NO: 1466734 - protein, 26 aa, Mycobacterium tuberculosis
WLDPFTEFRFPRIGTAVFDGIEIELR

SEQ ID NO: 1466735 - protein, 19 aa, Mycobacterium tuberculosis
WLGDHRIHNVAALPGAAYC

SEQ ID NO: 1466736 - protein, 19 aa, Mycobacterium tuberculosis
WLRTADRGSWALADATVDP

SEQ ID NO: 1466737 - protein, 24 aa, Mycobacterium tuberculosis
WQAARCVANWDGARVDKGLRRWRA

SEQ ID NO: 1466738 - protein, 18 aa, Mycobacterium tuberculosis
WQPALPNINLGVGNIGNL

SEQ ID NO: 1466739 - protein, 17 aa, Mycobacterium tuberculosis
WRPQAVLNHAGELARMC

SEQ ID NO: 1466740 - protein, 19 aa, Mycobacterium tuberculosis
WRSDPAFVLNLSPFDRGSV

SEQ ID NO: 1466741 - protein, 17 aa, Mycobacterium tuberculosis
WSPKSGYPGHAAYRDFH

SEQ ID NO: 1466742 - protein, 19 aa, Mycobacterium tuberculosis
WTKRKGRIYSDDRIGVALD

SEQ ID NO: 1466743 - protein, 17 aa, Mycobacterium tuberculosis
WTTCKSVVLRVQVTGAG

SEQ ID NO: 1466744 - protein, 18 aa, Mycobacterium tuberculosis
WVPEDIFQTALGRAAEPV

SEQ ID NO: 1466745 - protein, 23 aa, Mycobacterium tuberculosis
YAFDKRRFWLSAEGSGADVSGLG

SEQ ID NO: 1466746 - protein, 23 aa, Mycobacterium tuberculosis
YARTRHNLGFVVADLLAARLGAK

SEQ ID NO: 1466747 - protein, 23 aa, Mycobacterium tuberculosis
YDESACDAWIGRIRCGDTDRVTL

SEQ ID NO: 1466748 - protein, 21 aa, Mycobacterium tuberculosis
YELGYKYSHRIPMQMHNKVTI

SEQ ID NO: 1466749 - protein, 21 aa, Mycobacterium tuberculosis
YGNEAPKFFNSKGEPLSDHSP

SEQ ID NO: 1466750 - protein, 17 aa, Mycobacterium tuberculosis
YLPGCWLDSGPFGCLGS

SEQ ID NO: 1466751 - protein, 22 aa, Mycobacterium tuberculosis
YNHYPIGWAMAFNTPYKLFKRY

SEQ ID NO: 1466752 - protein, 20 aa, Mycobacterium tuberculosis
YPEDAWQFAGRVRELTGGTG

SEQ ID NO: 1466753 - protein, 21 aa, Mycobacterium tuberculosis
YPNFFTVFGPYGYVGSSYFAL

SEQ ID NO: 1466754 - protein, 17 aa, Mycobacterium tuberculosis
YQFGNAKPVYALEGSIA

SEQ ID NO: 1466755 - protein, 17 aa, Mycobacterium tuberculosis
YRRRIEPQVVRFTAATL

SEQ ID NO: 1466756 - protein, 20 aa, Mycobacterium tuberculosis
YSETDWDALRAAYPRDAERV

SEQ ID NO: 1466757 - protein, 23 aa, Mycobacterium tuberculosis
YSFSQFKRSALPNGPKVSHGGAL

SEQ ID NO: 1466758 - protein, 17 aa, Mycobacterium tuberculosis
YSSPTPCDRWDVRALLS

SEQ ID NO: 1466759 - protein, 28 aa, Mycobacterium tuberculosis
YTKGYKFSTYATWWIRQAITRAMADQAR

SEQ ID NO: 1466760 - protein, 28 aa, Mycobacterium tuberculosis
YTLTGPIVIGSFFLPAFNIPGIDVPAIN

SEQ ID NO: 1466761 - protein, 24 aa, Mycobacterium tuberculosis
AAGRVAGLIGTIGIRVGGADLPSA

SEQ ID NO: 1466762 - protein, 24 aa, Mycobacterium tuberculosis
AALELIDWPVALVIATGHILANNH

SEQ ID NO: 1466763 - protein, 21 aa, Mycobacterium tuberculosis
AAQAGRLGRYVRARPALDVVD

SEQ ID NO: 1466764 - protein, 26 aa, Mycobacterium tuberculosis
AARIELRTGGAYRWTVTPGHSAAGTV

SEQ ID NO: 1466765 - protein, 22 aa, Mycobacterium tuberculosis
AARPHVHPVRMIAGAAGLCAVA

SEQ ID NO: 1466766 - protein, 25 aa, Mycobacterium tuberculosis
AARRVGGTDVAVWLGTLSTLSRTAF

SEQ ID NO: 1466767 - protein, 22 aa, Mycobacterium tuberculosis
ADARVGRLLFSTQLANAVITRK

SEQ ID NO: 1466768 - protein, 21 aa, Mycobacterium tuberculosis
ADGMFPPMHIDAEYNADGSLR

SEQ ID NO: 1466769 - protein, 18 aa, Mycobacterium tuberculosis
ADGRCKAFAAAADGTGWG

SEQ ID NO: 1466770 - protein, 18 aa, Mycobacterium tuberculosis
ADNMREYLAAGAKERQRL

SEQ ID NO: 1466771 - protein, 29 aa, Mycobacterium tuberculosis
ADQARTIRIPVHMVEVINKLGRIQRELLQ

SEQ ID NO: 1466772 - protein, 26 aa, Mycobacterium tuberculosis
ADVVIPKLERLVAMHPYRESLWKQLM

SEQ ID NO: 1466773 - protein, 20 aa, Mycobacterium tuberculosis
AEIDDAFRWSEENRNLQRKA

SEQ ID NO: 1466774 - protein, 21 aa, Mycobacterium tuberculosis
AELGLRVCDWVDGDDPYGLVS

SEQ ID NO: 1466775 - protein, 20 aa, Mycobacterium tuberculosis
AELPALFSQLVAGPIRRIID

SEQ ID NO: 1466776 - protein, 17 aa, Mycobacterium tuberculosis
AEPPPNVDIRWSTADLR

SEQ ID NO: 1466777 - protein, 20 aa, Mycobacterium tuberculosis
AEVSGPLLRRKFRPSSAAML

SEQ ID NO: 1466778 - protein, 19 aa, Mycobacterium tuberculosis
AFEAARAATVHPMLVAANR

SEQ ID NO: 1466779 - protein, 22 aa, Mycobacterium tuberculosis
AFVRSRLAGYLEQMDRVVSRVV

SEQ ID NO: 1466780 - protein, 18 aa, Mycobacterium tuberculosis
AGAGIVWAKVNTFGSTAA

SEQ ID NO: 1466781 - protein, 17 aa, Mycobacterium tuberculosis
AGALVVLVDGELAWFLE

SEQ ID NO: 1466782 - protein, 22 aa, Mycobacterium tuberculosis
AGAVSFRFGDRTQINGVARDDA

SEQ ID NO: 1466783 - protein, 19 aa, Mycobacterium tuberculosis
AGLMGRRIAGVLASAGLDV

SEQ ID NO: 1466784 - protein, 21 aa, Mycobacterium tuberculosis
AGLPRTMTFKVIKRQLSAEGV

SEQ ID NO: 1466785 - protein, 25 aa, Mycobacterium tuberculosis
AGRGLRCIAPTWPLGAHPKPLRPGA

SEQ ID NO: 1466786 - protein, 23 aa, Mycobacterium tuberculosis
AGSEPMSAAAVAWDQLAMELASA

SEQ ID NO: 1466787 - protein, 19 aa, Mycobacterium tuberculosis
AGYALAGRHVHVVTINDYL

SEQ ID NO: 1466788 - protein, 17 aa, Mycobacterium tuberculosis
AIFAYWVANPSAYGVVE

SEQ ID NO: 1466789 - protein, 21 aa, Mycobacterium tuberculosis
AIKELFSMSATRYYQVLNALV

SEQ ID NO: 1466790 - protein, 24 aa, Mycobacterium tuberculosis
AKGLEFPVVFVTGWEDGMFPHMRA

SEQ ID NO: 1466791 - protein, 24 aa, Mycobacterium tuberculosis
AKGTGAYAGPRYGFKPTVMPKQVV

SEQ ID NO: 1466792 - protein, 26 aa, Mycobacterium tuberculosis
AKLSSAPMTTMWGAPLHRRWRGSRLR

SEQ ID NO: 1466793 - protein, 19 aa, Mycobacterium tuberculosis
ALDRGEFFLVYQPIIRLAD

SEQ ID NO: 1466794 - protein, 19 aa, Mycobacterium tuberculosis
ALHGARYSGWQGLLDAQRA

SEQ ID NO: 1466795 - protein, 18 aa, Mycobacterium tuberculosis
ALMRIWNQPHWIRVSIDV

SEQ ID NO: 1466796 - protein, 21 aa, Mycobacterium tuberculosis
ALPSRYGQAVAESDVQPLGRP

SEQ ID NO: 1466797 - protein, 18 aa, Mycobacterium tuberculosis
ALRDVMSAVEFRDMAETF

SEQ ID NO: 1466798 - protein, 18 aa, Mycobacterium tuberculosis
ALSDFVRRCTWLEHHPEQ

SEQ ID NO: 1466799 - protein, 19 aa, Mycobacterium tuberculosis
ALTGRSWRAGLRQRAAVRV

SEQ ID NO: 1466800 - protein, 20 aa, Mycobacterium tuberculosis
ALVCECAFCTFPDKNAAAQQ

SEQ ID NO: 1466801 - protein, 25 aa, Mycobacterium tuberculosis
ALWAATFLRRRGAAADAVLLNPDRT

SEQ ID NO: 1466802 - protein, 27 aa, Mycobacterium tuberculosis
AMFPARAFDALAAWVRAAAAKNMVDGR

SEQ ID NO: 1466803 - protein, 22 aa, Mycobacterium tuberculosis
AMSSLRSGECDLALAGGVTVMG

SEQ ID NO: 1466804 - protein, 22 aa, Mycobacterium tuberculosis
ANAGDYGTGAFITGSMNNGLLW

SEQ ID NO: 1466805 - protein, 17 aa, Mycobacterium tuberculosis
ANAYDFFNMWRVRPAGL

SEQ ID NO: 1466806 - protein, 21 aa, Mycobacterium tuberculosis
ANFNAGPALRFMSGNLCHQIE

SEQ ID NO: 1466807 - protein, 19 aa, Mycobacterium tuberculosis
ANFRDVMIALGLYPDPDAV

SEQ ID NO: 1466808 - protein, 17 aa, Mycobacterium tuberculosis
ANMGAAVADFMADHVFN

SEQ ID NO: 1466809 - protein, 28 aa, Mycobacterium tuberculosis
APGTAYRWFRAGLLSVMARRVGRLILVD

SEQ ID NO: 1466810 - protein, 19 aa, Mycobacterium tuberculosis
APLHRRWRGSRLRDPRQAK

SEQ ID NO: 1466811 - protein, 21 aa, Mycobacterium tuberculosis
APRKLLARFFVWLTVGLYDPP

SEQ ID NO: 1466812 - protein, 18 aa, Mycobacterium tuberculosis
APRLARLVDGIAPRTHAA

SEQ ID NO: 1466813 - protein, 17 aa, Mycobacterium tuberculosis
APVGLFVETFGTETEDP

SEQ ID NO: 1466814 - protein, 18 aa, Mycobacterium tuberculosis
APYLGWLSAAAAQAQQAA

SEQ ID NO: 1466815 - protein, 27 aa, Mycobacterium tuberculosis
AQIYAWRKGIKTLYYIRLRQMALEGTE

SEQ ID NO: 1466816 - protein, 21 aa, Mycobacterium tuberculosis
AQLCGYGPIPAAVARTMVASA

SEQ ID NO: 1466817 - protein, 26 aa, Mycobacterium tuberculosis
AQLWPPHVPAMLVAGCDPRPNAEPLP

SEQ ID NO: 1466818 - protein, 21 aa, Mycobacterium tuberculosis
AQMDWSFGEVIAYASRGVTLT

SEQ ID NO: 1466819 - protein, 19 aa, Mycobacterium tuberculosis
AQRLPGYLVPAAVVVIDAL

SEQ ID NO: 1466820 - protein, 21 aa, Mycobacterium tuberculosis
ARAHLLLRFDRGNWIAIDNDS

SEQ ID NO: 1466821 - protein, 19 aa, Mycobacterium tuberculosis
ARLRDSPVRVVTCRQSGVG

SEQ ID NO: 1466822 - protein, 18 aa, Mycobacterium tuberculosis
ARRRGISVLGDRPPMVSV

SEQ ID NO: 1466823 - protein, 24 aa, Mycobacterium tuberculosis
ASEAALLAARWALQTHGAIGFTCE

SEQ ID NO: 1466824 - protein, 17 aa, Mycobacterium tuberculosis
ASVWDIAQRYNKGGPTV

SEQ ID NO: 1466825 - protein, 18 aa, Mycobacterium tuberculosis
ATALPGANRMPHWAAGTL

SEQ ID NO: 1466826 - protein, 19 aa, Mycobacterium tuberculosis
ATMRALTGRSWRAGLRQRA

SEQ ID NO: 1466827 - protein, 18 aa, Mycobacterium tuberculosis
ATPSLGFFNAGIGGNSGF

SEQ ID NO: 1466828 - protein, 27 aa, Mycobacterium tuberculosis
AVDPLLPEVAWSWLVDALTARTDQVRA

SEQ ID NO: 1466829 - protein, 20 aa, Mycobacterium tuberculosis
AVKVCGGAVLGEFATLVNPQ

SEQ ID NO: 1466830 - protein, 25 aa, Mycobacterium tuberculosis
AVRVIRTLRRLGIRSVAVYSDPDVD

SEQ ID NO: 1466831 - protein, 30 aa, Mycobacterium tuberculosis
AVTLWKQWDRCALHWFPGSHLLHVSQLDYL

SEQ ID NO: 1466832 - protein, 20 aa, Mycobacterium tuberculosis
AWPAVCSGLRSEARNGRMLP

SEQ ID NO: 1466833 - protein, 20 aa, Mycobacterium tuberculosis
CAALPVLDTRAADTILGYDE

SEQ ID NO: 1466834 - protein, 17 aa, Mycobacterium tuberculosis
CAPVFVMAAPGQPLPTL

SEQ ID NO: 1466835 - protein, 21 aa, Mycobacterium tuberculosis
CPVVMPAKLFDEWFPANKLVK

SEQ ID NO: 1466836 - protein, 19 aa, Mycobacterium tuberculosis
CTAGLPFLIHAVSARAQAP

SEQ ID NO: 1466837 - protein, 23 aa, Mycobacterium tuberculosis
DAARGRMGAVRFGIYQAGCNSSL

SEQ ID NO: 1466838 - protein, 22 aa, Mycobacterium tuberculosis
DADRYRRLHVIIGDANLAETST

SEQ ID NO: 1466839 - protein, 22 aa, Mycobacterium tuberculosis
DAERRKALEAGYDLNQVLTTED

SEQ ID NO: 1466840 - protein, 19 aa, Mycobacterium tuberculosis
DAEVGPRLFMLSSTSSDAL

SEQ ID NO: 1466841 - protein, 18 aa, Mycobacterium tuberculosis
DAGVPARRRGRGVASEVA

SEQ ID NO: 1466842 - protein, 17 aa, Mycobacterium tuberculosis
DAVPYLFEREGTNCENL

SEQ ID NO: 1466843 - protein, 20 aa, Mycobacterium tuberculosis
DEALVPLVLAGTTHRETPRL

SEQ ID NO: 1466844 - protein, 27 aa, Mycobacterium tuberculosis
DEEKKLFCRMAEVFAGFLSYTDAQIGR

SEQ ID NO: 1466845 - protein, 21 aa, Mycobacterium tuberculosis
DELRAAVSKYWKIDEIRPAFI

SEQ ID NO: 1466846 - protein, 22 aa, Mycobacterium tuberculosis
DEYLALQCGRSVHTRRAYLGDL

SEQ ID NO: 1466847 - protein, 19 aa, Mycobacterium tuberculosis
DFPASAVRFFASARSQGRK

SEQ ID NO: 1466848 - protein, 19 aa, Mycobacterium tuberculosis
DKVLRAKVDGAWNLHELTR

SEQ ID NO: 1466849 - protein, 29 aa, Mycobacterium tuberculosis
DLASGWIPPHIRLPAHITLLEPAPRRRHA

SEQ ID NO: 1466850 - protein, 20 aa, Mycobacterium tuberculosis
DLDGIRVLRSFDESMALRKH

SEQ ID NO: 1466851 - protein, 17 aa, Mycobacterium tuberculosis
DMAGLPPQAAGTVDAAL

SEQ ID NO: 1466852 - protein, 23 aa, Mycobacterium tuberculosis
DNQQGFNFAGGWNSGTANIGLFN

SEQ ID NO: 1466853 - protein, 20 aa, Mycobacterium tuberculosis
DPDTKLIVMIGEIGGDAEER

SEQ ID NO: 1466854 - protein, 24 aa, Mycobacterium tuberculosis
DPPFEGMWWLYVPLAFDDFAVVLI

SEQ ID NO: 1466855 - protein, 25 aa, Mycobacterium tuberculosis
DQRGVIPRDHIKAVLDAADVLIWMT

SEQ ID NO: 1466856 - protein, 18 aa, Mycobacterium tuberculosis
DQRLLVKVPAGWSHTAAA

SEQ ID NO: 1466857 - protein, 22 aa, Mycobacterium tuberculosis
DRAKPAVPFGGAYRLIDFVLSN

SEQ ID NO: 1466858 - protein, 19 aa, Mycobacterium tuberculosis
DRIARLVVANGFLPAAQGR

SEQ ID NO: 1466859 - protein, 24 aa, Mycobacterium tuberculosis
DRLWIPVRRSWRLNERHYGALQGL

SEQ ID NO: 1466860 - protein, 17 aa, Mycobacterium tuberculosis
DVSGWRVVEAVDEPSAI

SEQ ID NO: 1466861 - protein, 17 aa, Mycobacterium tuberculosis
DYAALALREEYRQKTTV

SEQ ID NO: 1466862 - protein, 32 aa, Mycobacterium tuberculosis; identical to SEQ ID NO: 198269

SEQ ID NO: 1466863 - protein, 21 aa, Mycobacterium tuberculosis
DYLGAFVKRVSNPVAGHTTWT

SEQ ID NO: 1466864 - protein, 21 aa, Mycobacterium tuberculosis
EAEAAEPLAEWEQELLASATA

SEQ ID NO: 1466865 - protein, 22 aa, Mycobacterium tuberculosis
EAELRRGRRYSVARRLAGLFAS

SEQ ID NO: 1466866 - protein, 20 aa, Mycobacterium tuberculosis
EAQRCRCRGIDLRLVSHQPI

SEQ ID NO: 1466867 - protein, 24 aa, Mycobacterium tuberculosis
EASWLPASLLTPAMLGAHYRLGRH

SEQ ID NO: 1466868 - protein, 19 aa, Mycobacterium tuberculosis
EAWARHGVEHPMGADFSGV

SEQ ID NO: 1466869 - protein, 21 aa, Mycobacterium tuberculosis
EDKPKPWRVFSAATPAESVSL

SEQ ID NO: 1466870 - protein, 17 aa, Mycobacterium tuberculosis
EETHPLWIVRRTMVDLI

SEQ ID NO: 1466871 - protein, 26 aa, Mycobacterium tuberculosis
EFDSRAIGPGGLFLALPGARADGHDH

SEQ ID NO: 1466872 - protein, 19 aa, Mycobacterium tuberculosis
EIARWTAAMLASGARLDFT

SEQ ID NO: 1466873 - protein, 25 aa, Mycobacterium tuberculosis
EIVRPWADAVWDTGIEFGTVGVGKS

SEQ ID NO: 1466874 - protein, 18 aa, Mycobacterium tuberculosis
EKVLTEYNNKAALEPVNP

SEQ ID NO: 1466875 - protein, 18 aa, Mycobacterium tuberculosis
ELTGLALQRIYLDRVAKL

SEQ ID NO: 1466876 - protein, 18 aa, Mycobacterium tuberculosis
ENRLHAQKALLVWLLERS

SEQ ID NO: 1466877 - protein, 26 aa, Mycobacterium tuberculosis
EQMWAQDVAAMFGYHAGASAAVSALT

SEQ ID NO: 1466878 - protein, 17 aa, Mycobacterium tuberculosis
EQVMLLRGAVGLAAPQA

SEQ ID NO: 1466879 - protein, 22 aa, Mycobacterium tuberculosis
EREIHLTLIPFALRPTAEVPTT

SEQ ID NO: 1466880 - protein, 17 aa, Mycobacterium tuberculosis
EREPEIRCALKHPPKSP

SEQ ID NO: 1466881 - protein, 18 aa, Mycobacterium tuberculosis
ESGIGYAAGDAVAAATYL

SEQ ID NO: 1466882 - protein, 22 aa, Mycobacterium tuberculosis
ESLRELIQVLGHAGVRSLVSQP

SEQ ID NO: 1466883 - protein, 20 aa, Mycobacterium tuberculosis
ESPDAYDLELMWDANDDNQP

SEQ ID NO: 1466884 - protein, 18 aa, Mycobacterium tuberculosis
EVADTYFALMDRLGTDGL

SEQ ID NO: 1466885 - protein, 20 aa, Mycobacterium tuberculosis
EVFVNARVDTYWLRQHADTT

SEQ ID NO: 1466886 - protein, 23 aa, Mycobacterium tuberculosis
FADVLIAFGRFPIIDDREPQLGM

SEQ ID NO: 1466887 - protein, 42 aa, Mycobacterium tuberculosis
FAGFGGSAGGGGWVGAVNFGPISVQGFGLFGHGGDGGNGGDV

SEQ ID NO: 1466888 - protein, 29 aa, Mycobacterium tuberculosis
FANKIGGAAWVEWGGCGMVHPNVLRATGI

SEQ ID NO: 1466889 - protein, 18 aa, Mycobacterium tuberculosis
FDDIADWVEGARCAGMRA

SEQ ID NO: 1466890 - protein, 17 aa, Mycobacterium tuberculosis
FERTLLGRALDFWNEEV

SEQ ID NO: 1466891 - protein, 23 aa, Mycobacterium tuberculosis
FGAADPRFACVVRAFASMFPGRR

SEQ ID NO: 1466892 - protein, 17 aa, Mycobacterium tuberculosis
FGEVIAYASRGVTLTPG

SEQ ID NO: 1466893 - protein, 22 aa, Mycobacterium tuberculosis
FGRKRPGSGPLMIGSIKPNIGH

SEQ ID NO: 1466894 - protein, 18 aa, Mycobacterium tuberculosis
FHERVALHFGAAYGSSVL

SEQ ID NO: 1466895 - protein, 25 aa, Mycobacterium tuberculosis
FIIGRIKDLLIVYGRNHSPDDIEAT

SEQ ID NO: 1466896 - protein, 30 aa, Mycobacterium tuberculosis; identical to SEQ ID NO: 199192

SEQ ID NO: 1466897 - protein, 26 aa, Mycobacterium tuberculosis
FNKASRRIKLAWFLLNAARYMGAGVR

SEQ ID NO: 1466898 - protein, 17 aa, Mycobacterium tuberculosis
FRGGEPTGLLADDPPPA

SEQ ID NO: 1466899 - protein, 21 aa, Mycobacterium tuberculosis
FRLVAAEALKLTAADAALVAV

SEQ ID NO: 1466900 - protein, 17 aa, Mycobacterium tuberculosis
FRRARDSAPSLVFLDEL

SEQ ID NO: 1466901 - protein, 17 aa, Mycobacterium tuberculosis
FSRIGALPITKASDRLQ

SEQ ID NO: 1466902 - protein, 25 aa, Mycobacterium tuberculosis
FTQQLKKLAGLSERLTSAAAAAAGP

SEQ ID NO: 1466903 - protein, 25 aa, Mycobacterium tuberculosis
FTTGVPVQWSAVFAGSGGRRVQLPT

SEQ ID NO: 1466904 - protein, 24 aa, Mycobacterium tuberculosis
FTVFPDGYSLPAIPLGIDVGGGLG

SEQ ID NO: 1466905 - protein, 20 aa, Mycobacterium tuberculosis
GAAIAGRGWTLVWGGGHVSA

SEQ ID NO: 1466906 - protein, 25 aa, Mycobacterium tuberculosis
GAGRGARFLLGLVVSTGVGGGLVLD

SEQ ID NO: 1466907 - protein, 17 aa, Mycobacterium tuberculosis
GALGARMTGGGFGGAVI

SEQ ID NO: 1466908 - protein, 31 aa, Mycobacterium tuberculosis; identical to SEQ ID NO: 199545

SEQ ID NO: 1466909 - protein, 19 aa, Mycobacterium tuberculosis
GATRPALQLSRALLGNQGL

SEQ ID NO: 1466910 - protein, 17 aa, Mycobacterium tuberculosis
GDALWAATFLRRRGAAA

SEQ ID NO: 1466911 - protein, 19 aa, Mycobacterium tuberculosis
GDERHMLWFELMKPMTSTA

SEQ ID NO: 1466912 - protein, 20 aa, Mycobacterium tuberculosis
GDQQLSFALIDGVRRQWRNG

SEQ ID NO: 1466913 - protein, 25 aa, Mycobacterium tuberculosis
GDQTMFRKLFESVLKGHVKVLVGRK

SEQ ID NO: 1466914 - protein, 22 aa, Mycobacterium tuberculosis
GEFPTSALIASRGAAYPATQPN

SEQ ID NO: 1466915 - protein, 23 aa, Mycobacterium tuberculosis
GELSVHYPFPIADLVALDDALTY

SEQ ID NO: 1466916 - protein, 17 aa, Mycobacterium tuberculosis
GEVAGYVVEYNRRTHVR

SEQ ID NO: 1466917 - protein, 19 aa, Mycobacterium tuberculosis
GEVLERSLVHLGLKHYFLV

SEQ ID NO: 1466918 - protein, 18 aa, Mycobacterium tuberculosis
GFGSLRPLLEVAAAHGRG

SEQ ID NO: 1466919 - protein, 19 aa, Mycobacterium tuberculosis
GGPPLVFQLLWYPTTMADL

SEQ ID NO: 1466920 - protein, 18 aa, Mycobacterium tuberculosis
GGVTLGLLSAWRGPNGQD

SEQ ID NO: 1466921 - protein, 24 aa, Mycobacterium tuberculosis
GHAGRITAPRGWELVRHAGPLPSH

SEQ ID NO: 1466922 - protein, 20 aa, Mycobacterium tuberculosis
GILGEVWEFITNALNGLKEL

SEQ ID NO: 1466923 - protein, 18 aa, Mycobacterium tuberculosis
GKDWQVWSGAKVADLVQL

SEQ ID NO: 1466924 - protein, 17 aa, Mycobacterium tuberculosis
GKMTGRSRLEVVDPSAA

SEQ ID NO: 1466925 - protein, 23 aa, Mycobacterium tuberculosis
GKQALDRWISWAQRCRIPVFVEL

SEQ ID NO: 1466926 - protein, 17 aa, Mycobacterium tuberculosis
GLAEYFVHRTGHGIGLC

SEQ ID NO: 1466927 - protein, 24 aa, Mycobacterium tuberculosis
GLDAIEDLHIWTAESVRADRLDFR

SEQ ID NO: 1466928 - protein, 17 aa, Mycobacterium tuberculosis
GLHLAMRSAGVTVRTTA

SEQ ID NO: 1466929 - protein, 24 aa, Mycobacterium tuberculosis
GLREPRGPWGPGRPVEAADAFEAV

SEQ ID NO: 1466930 - protein, 18 aa, Mycobacterium tuberculosis
GNNGLSLFEREAHHQPLN

SEQ ID NO: 1466931 - protein, 36 aa, Mycobacterium tuberculosis
GNPVSALVSFEVFIRPPLRMAMGLPDPYRPHRSAVL

SEQ ID NO: 1466932 - protein, 25 aa, Mycobacterium tuberculosis
GPGPMLAAASAWTGLAGDLGSAAAS

SEQ ID NO: 1466933 - protein, 18 aa, Mycobacterium tuberculosis
GQLSTGWFNSATTSTGWF

SEQ ID NO: 1466934 - protein, 19 aa, Mycobacterium tuberculosis
GQLVSFIGPIVIDTTIPGP

SEQ ID NO: 1466935 - protein, 20 aa, Mycobacterium tuberculosis
GRAAVPVLVHPAPRGVLGGL

SEQ ID NO: 1466936 - protein, 21 aa, Mycobacterium tuberculosis
GRDLAPGMLHRHSAHNEAVAR

SEQ ID NO: 1466937 - protein, 20 aa, Mycobacterium tuberculosis
GRPGPEFRPSEVARLGYLAG

SEQ ID NO: 1466938 - protein, 20 aa, Mycobacterium tuberculosis
GRSPRLWLVTGGGLSVADDE

SEQ ID NO: 1466939 - protein, 27 aa, Mycobacterium tuberculosis
GRVDRRGRLLWSLPKGHIELGETAEQT

SEQ ID NO: 1466940 - protein, 18 aa, Mycobacterium tuberculosis
GRYLDWLTKHSRQILETA

SEQ ID NO: 1466941 - protein, 26 aa, Mycobacterium tuberculosis
GSDGQWRLSPKAMRRLGETALRDVAQ

SEQ ID NO: 1466942 - protein, 23 aa, Mycobacterium tuberculosis
GSDKVVRFILGLVQRYGPGLFGA

SEQ ID NO: 1466943 - protein, 20 aa, Mycobacterium tuberculosis
GSPRPTLGVEWEFALVDSQT

SEQ ID NO: 1466944 - protein, 21 aa, Mycobacterium tuberculosis
GSWGGFPLRDRVAAAVPGVPV

SEQ ID NO: 1466945 - protein, 20 aa, Mycobacterium tuberculosis
GVRRHCRDGSDPVVIAVSTR

SEQ ID NO: 1466946 - protein, 22 aa, Mycobacterium tuberculosis
GYRDTEIMRWLFTPDPSLTITR

SEQ ID NO: 1466947 - protein, 24 aa, Mycobacterium tuberculosis
GYTPRMRIGIHTGRPQRLAADWLG

SEQ ID NO: 1466948 - protein, 23 aa, Mycobacterium tuberculosis
GYYQIRGGIPYAIAKSLAAAPFA

SEQ ID NO: 1466949 - protein, 19 aa, Mycobacterium tuberculosis
HAAGRLDEFAHWAKSLTQR

SEQ ID NO: 1466950 - protein, 23 aa, Mycobacterium tuberculosis
HAHFKIPGWRDALTRTGVVEGTR

SEQ ID NO: 1466951 - protein, 20 aa, Mycobacterium tuberculosis
HDATMWRVGDDVAHPELGHG

SEQ ID NO: 1466952 - protein, 18 aa, Mycobacterium tuberculosis
HGDTEWLPPPHLDHGQPR

SEQ ID NO: 1466953 - protein, 19 aa, Mycobacterium tuberculosis
HGTLFFGVPTVWSRVAADQ

SEQ ID NO: 1466954 - protein, 20 aa, Mycobacterium tuberculosis
HLEIRWDGQVALLADLNSTN

SEQ ID NO: 1466955 - protein, 23 aa, Mycobacterium tuberculosis
HLPPRARDVAMVFQNYALYPNMT

SEQ ID NO: 1466956 - protein, 17 aa, Mycobacterium tuberculosis
HRDCGSYASGGFATGTD

SEQ ID NO: 1466957 - protein, 30 aa, Mycobacterium tuberculosis
HSGWWRAPLRWTLRGSLALRSHLMVRSSLR

SEQ ID NO: 1466958 - protein, 20 aa, Mycobacterium tuberculosis
HTGGALPRTRPFRVSYGTTT

SEQ ID NO: 1466959 - protein, 23 aa, Mycobacterium tuberculosis
HVEGFRPATLHQAYLALRAWGLP

SEQ ID NO: 1466960 - protein, 19 aa, Mycobacterium tuberculosis
IAGIPLLAGAISKAVLPPI

SEQ ID NO: 1466961 - protein, 17 aa, Mycobacterium tuberculosis
IAIGGLYGDITYPVTSP

SEQ ID NO: 1466962 - protein, 17 aa, Mycobacterium tuberculosis
IAVDLRDDWPQALRDSG

SEQ ID NO: 1466963 - protein, 21 aa, Mycobacterium tuberculosis
IDAITLFPGGLTFPANSLLNL

SEQ ID NO: 1466964 - protein, 26 aa, Mycobacterium tuberculosis
IDEFGFPVAPWMFGAAGREHMKKYGT

SEQ ID NO: 1466965 - protein, 17 aa, Mycobacterium tuberculosis
IDGVKRFITSGDSGDLF

SEQ ID NO: 1466966 - protein, 20 aa, Mycobacterium tuberculosis
IEGLPARLRKVTNRWTLRPA

SEQ ID NO: 1466967 - protein, 26 aa, Mycobacterium tuberculosis
IGDSMVEAAICDGDWVVVRQQNVADN

SEQ ID NO: 1466968 - protein, 21 aa, Mycobacterium tuberculosis
IGYTGAGTVEFLADDSPGREG

SEQ ID NO: 1466969 - protein, 35 aa, Mycobacterium tuberculosis; identical to SEQ ID NO: 201199

SEQ ID NO: 1466970 - protein, 24 aa, Mycobacterium tuberculosis
ILAQALIKGGLRLVAAGVNPIALG

SEQ ID NO: 1466971 - protein, 18 aa, Mycobacterium tuberculosis
INIGSWGGFPLRDRVAAA

SEQ ID NO: 1466972 - protein, 22 aa, Mycobacterium tuberculosis
INKEIKRRSRVVGIFPNPAAVI

SEQ ID NO: 1466973 - protein, 21 aa, Mycobacterium tuberculosis
IPEALDLVYSLGFTLTGLLPC

SEQ ID NO: 1466974 - protein, 23 aa, Mycobacterium tuberculosis
IPLLLEMPMVYTGRALTQATCLF

SEQ ID NO: 1466975 - protein, 23 aa, Mycobacterium tuberculosis
IPPELRPMVQLDGGRFATSDLND

SEQ ID NO: 1466976 - protein, 27 aa, Mycobacterium tuberculosis
IQAQDFFFRKIVRDKGVALAHVSGQIQ

SEQ ID NO: 1466977 - protein, 19 aa, Mycobacterium tuberculosis
IRGTGSFDMAVRALQNLAA

SEQ ID NO: 1466978 - protein, 17 aa, Mycobacterium tuberculosis
ISAALGFGDRFDLARTL

SEQ ID NO: 1466979 - protein, 32 aa, Mycobacterium tuberculosis
ISGSYSNGFLWSGNYQGLIGLHAALAIPEIAL

SEQ ID NO: 1466980 - protein, 17 aa, Mycobacterium tuberculosis
IVWDWNGTLCDDRTILL

SEQ ID NO: 1466981 - protein, 19 aa, Mycobacterium tuberculosis
IWTRLFGVRLVKLLYRLER

SEQ ID NO: 1466982 - protein, 20 aa, Mycobacterium tuberculosis
KATLVRAVCDGRRLVTLDGP

SEQ ID NO: 1466983 - protein, 20 aa, Mycobacterium tuberculosis
KDTAAPLWTFPRVAWERELL

SEQ ID NO: 1466984 - protein, 27 aa, Mycobacterium tuberculosis
KEFELLKYLAQHAGRVFTRAQLLHEVW

SEQ ID NO: 1466985 - protein, 22 aa, Mycobacterium tuberculosis
KEPWFLDAYQRAWEWADAVHWR

SEQ ID NO: 1466986 - protein, 21 aa, Mycobacterium tuberculosis
KGSAGGEQWCDAEVLRILRRR

SEQ ID NO: 1466987 - protein, 25 aa, Mycobacterium tuberculosis
KGTLFRRFGSRAGLMMVLLDEDERA

SEQ ID NO: 1466988 - protein, 18 aa, Mycobacterium tuberculosis
KLGKSVAIVERGRMLGGV

SEQ ID NO: 1466989 - protein, 17 aa, Mycobacterium tuberculosis
KNEVPVSEYLFMTDVVA

SEQ ID NO: 1466990 - protein, 21 aa, Mycobacterium tuberculosis
KPKVALIAAHYQIDFSEHYLA

SEQ ID NO: 1466991 - protein, 21 aa, Mycobacterium tuberculosis
KRALAKFSDRFDVVIIDCPPS

SEQ ID NO: 1466992 - protein, 20 aa, Mycobacterium tuberculosis
KRGITMGKQEFDGMSRISGL

SEQ ID NO: 1466993 - protein, 19 aa, Mycobacterium tuberculosis
KSCEQRDNLSIKFVAHEGE

SEQ ID NO: 1466994 - protein, 26 aa, Mycobacterium tuberculosis
LADAIRRSGLPKVPTSVLSRGVCGVA

SEQ ID NO: 1466995 - protein, 18 aa, Mycobacterium tuberculosis
LAEPRYLIGRKILTPPAR

SEQ ID NO: 1466996 - protein, 18 aa, Mycobacterium tuberculosis
LAPGTGLRDGLERILRGR

SEQ ID NO: 1466997 - protein, 23 aa, Mycobacterium tuberculosis
LAPRPALLVRRRLDLVAWATGLP

SEQ ID NO: 1466998 - protein, 19 aa, Mycobacterium tuberculosis
LARLSRMSVLGPLGESFGR

SEQ ID NO: 1466999 - protein, 19 aa, Mycobacterium tuberculosis
LATPALFFAVGQGYRNFTQ

SEQ ID NO: 1467000 - protein, 24 aa, Mycobacterium tuberculosis
LDFRPKHKLAVLVVSAIPLAEPVR

SEQ ID NO: 1467001 - protein, 19 aa, Mycobacterium tuberculosis
LDPDYRFNFGVAYDRSLLF

SEQ ID NO: 1467002 - protein, 17 aa, Mycobacterium tuberculosis
LDSPSLMVADMFAARTI

SEQ ID NO: 1467003 - protein, 17 aa, Mycobacterium tuberculosis
LGGEMFGGGQVGLDPDV

SEQ ID NO: 1467004 - protein, 19 aa, Mycobacterium tuberculosis
LGLDRYGVRFRIEARDGDR

SEQ ID NO: 1467005 - protein, 19 aa, Mycobacterium tuberculosis
LGSVPSRILCAGKLRQSIQ

SEQ ID NO: 1467006 - protein, 23 aa, Mycobacterium tuberculosis
LHDRFRLLTGGSRIAVRRQQTMR

SEQ ID NO: 1467007 - protein, 19 aa, Mycobacterium tuberculosis
LHLRRALVTVGLFGGDAPV

SEQ ID NO: 1467008 - protein, 18 aa, Mycobacterium tuberculosis
LIAGPGVYICDECIDLCN

SEQ ID NO: 1467009 - protein, 21 aa, Mycobacterium tuberculosis
LKSQIRASGLTVSQLVSTAWA

SEQ ID NO: 1467010 - protein, 24 aa, Mycobacterium tuberculosis
LLGALPFDVSRPAALMVPDGVLRA

SEQ ID NO: 1467011 - protein, 25 aa, Mycobacterium tuberculosis
LLILRRPRAGLSYEALLETVEQRLP

SEQ ID NO: 1467012 - protein, 22 aa, Mycobacterium tuberculosis
LPAELTPLAAWVACIADARTVT

SEQ ID NO: 1467013 - protein, 18 aa, Mycobacterium tuberculosis
LPAKLAIPMRVIASVGAI

SEQ ID NO: 1467014 - protein, 21 aa, Mycobacterium tuberculosis
LPDMFTRLMLSLAATGIAPGS

SEQ ID NO: 1467015 - protein, 18 aa, Mycobacterium tuberculosis
LPGFRPGKAPAKLLEARI

SEQ ID NO: 1467016 - protein, 17 aa, Mycobacterium tuberculosis
LPGLLTILHDGGYRDTE

SEQ ID NO: 1467017 - protein, 23 aa, Mycobacterium tuberculosis
LPPPHRIAPVAVHAYLADITSSN

SEQ ID NO: 1467018 - protein, 17 aa, Mycobacterium tuberculosis
LRHGIEALGHPLIDHVR

SEQ ID NO: 1467019 - protein, 19 aa, Mycobacterium tuberculosis
LRKGRYPDRKTARRVAEVV

SEQ ID NO: 1467020 - protein, 18 aa, Mycobacterium tuberculosis
LRKNHKVFRRRRFFEGEP

SEQ ID NO: 1467021 - protein, 19 aa, Mycobacterium tuberculosis
LRLTGRRVMLVPTMGALHE

SEQ ID NO: 1467022 - protein, 20 aa, Mycobacterium tuberculosis
LRPHYIKTLRIWGDTLQSNK

SEQ ID NO: 1467023 - protein, 22 aa, Mycobacterium tuberculosis
LRQTAARLADWVDAQGPELAPA

SEQ ID NO: 1467024 - protein, 26 aa, Mycobacterium tuberculosis
LRRWWPRRYRRSSVYWRLMALDQRFG

SEQ ID NO: 1467025 - protein, 18 aa, Mycobacterium tuberculosis
LRWPCPVPGAMPISEVGD

SEQ ID NO: 1467026 - protein, 23 aa, Mycobacterium tuberculosis
LSAGCAGFGYALGAAADMIRGGG

SEQ ID NO: 1467027 - protein, 28 aa, Mycobacterium tuberculosis
LSFSRFELLRLLAFSRIGALPITKASDR

SEQ ID NO: 1467028 - protein, 26 aa, Mycobacterium tuberculosis
LSPLAPLRGGYIGDITPLGGGATGGI

SEQ ID NO: 1467029 - protein, 24 aa, Mycobacterium tuberculosis
LTDALRIAVAALRAGSADTSGGDQ

SEQ ID NO: 1467030 - protein, 26 aa, Mycobacterium tuberculosis
LTSLGFSYDVLHAFNPRIVLAGSSAF

SEQ ID NO: 1467031 - protein, 23 aa, Mycobacterium tuberculosis
LVRDGRACLVEAHLQRLTQSARL

SEQ ID NO: 1467032 - protein, 19 aa, Mycobacterium tuberculosis
LWAQAGFRPVDPAVAADFA

SEQ ID NO: 1467033 - protein, 18 aa, Mycobacterium tuberculosis
LYPVLDRYDYVLIDCQPS

SEQ ID NO: 1467034 - protein, 23 aa, Mycobacterium tuberculosis
MGLVEIRPELRAVTVDGDLVGAG

SEQ ID NO: 1467035 - protein, 24 aa, Mycobacterium tuberculosis
MGMRARSALTTALLRSRTNGPCRA

SEQ ID NO: 1467036 - protein, 20 aa, Mycobacterium tuberculosis
MGWAGIKVGVDYEGDHHRTD

SEQ ID NO: 1467037 - protein, 17 aa, Mycobacterium tuberculosis
MLCYRRRGHNEGDDPSM

SEQ ID NO: 1467038 - protein, 30 aa, Mycobacterium tuberculosis; identical to SEQ ID NO: 209782

SEQ ID NO: 1467039 - protein, 19 aa, Mycobacterium tuberculosis
MLSRLGRRGAALDLIEEFE

SEQ ID NO: 1467040 - protein, 18 aa, Mycobacterium tuberculosis
MSGTAVFEIFFRKLPPGR

SEQ ID NO: 1467041 - protein, 17 aa, Mycobacterium tuberculosis
MWAASGVDYPTLLATMI

SEQ ID NO: 1467042 - protein, 26 aa, Mycobacterium tuberculosis
NAPVQEWQLADGDVIRLGHSEIIVRM

SEQ ID NO: 1467043 - protein, 18 aa, Mycobacterium tuberculosis
NASALDLATPGFLSGIGN

SEQ ID NO: 1467044 - protein, 24 aa, Mycobacterium tuberculosis
NEIAKAAGCSRATLYRYFDSREAL

SEQ ID NO: 1467045 - protein, 23 aa, Mycobacterium tuberculosis
NERYKLVWKNRLGFARLAIQHGY

SEQ ID NO: 1467046 - protein, 24 aa, Mycobacterium tuberculosis
NHSNGLLWRGDNQGLIDLAIGVDI

SEQ ID NO: 1467047 - protein, 24 aa, Mycobacterium tuberculosis
NPHYDIPKLLSMYKAGKLNLDDMV

SEQ ID NO: 1467048 - protein, 17 aa, Mycobacterium tuberculosis
NQVLPEEVRNCFADMAK

SEQ ID NO: 1467049 - protein, 18 aa, Mycobacterium tuberculosis
NWLSLTFRIDGGAWFNVD

SEQ ID NO: 1467050 - protein, 18 aa, Mycobacterium tuberculosis
PAGSLWRLEFLLQSTQDP

SEQ ID NO: 1467051 - protein, 26 aa, Mycobacterium tuberculosis
PAKLWTIADLGGWGSVDPQLFDKATG

SEQ ID NO: 1467052 - protein, 23 aa, Mycobacterium tuberculosis
PALDMAYKLVAYDGSGRTKFSSG

SEQ ID NO: 1467053 - protein, 24 aa, Mycobacterium tuberculosis
PAPEFTDTGAFPFLAVEGPGVYEI

SEQ ID NO: 1467054 - protein, 28 aa, Mycobacterium tuberculosis
PATIRLRKTVLCAAAHGLGRPPADVTAE

SEQ ID NO: 1467055 - protein, 20 aa, Mycobacterium tuberculosis
PDELALPFAWQGVSLHATGA

SEQ ID NO: 1467056 - protein, 17 aa, Mycobacterium tuberculosis
PDVFYWAHATFFVGTLH

SEQ ID NO: 1467057 - protein, 25 aa, Mycobacterium tuberculosis
PFEKAVVVPLDPTSTFALITQPDRL

SEQ ID NO: 1467058 - protein, 18 aa, Mycobacterium tuberculosis
PGDQLVLGASNPVRDVAL

SEQ ID NO: 1467059 - protein, 25 aa, Mycobacterium tuberculosis
PGGLTFPANSLLNLDVFVGTPGATI

SEQ ID NO: 1467060 - protein, 21 aa, Mycobacterium tuberculosis
PGLREAGFWRFVADPYDPSES

SEQ ID NO: 1467061 - protein, 21 aa, Mycobacterium tuberculosis
PLSLGRLDRGWVVASETAALD

SEQ ID NO: 1467062 - protein, 28 aa, Mycobacterium tuberculosis
PLVRSTITAIDWLYWRMTKGVEDAQRRE

SEQ ID NO: 1467063 - protein, 18 aa, Mycobacterium tuberculosis
PPATVVFARRGKQIARGS

SEQ ID NO: 1467064 - protein, 20 aa, Mycobacterium tuberculosis
PPTARGWEVVAGDEIWNWTD

SEQ ID NO: 1467065 - protein, 18 aa, Mycobacterium tuberculosis
PPYEQRPPVSPGPAAGYG

SEQ ID NO: 1467066 - protein, 21 aa, Mycobacterium tuberculosis
PQNWWEWRDLIGPLAADGNRV

SEQ ID NO: 1467067 - protein, 23 aa, Mycobacterium tuberculosis
PRAPENATAWGLLLTALTGPDVT

SEQ ID NO: 1467068 - protein, 24 aa, Mycobacterium tuberculosis
PSIRTILRALAIHRRPSANSKLGA

SEQ ID NO: 1467069 - protein, 26 aa, Mycobacterium tuberculosis
PTTGGPYAHGWVTWFPPDAPPGTERF

SEQ ID NO: 1467070 - protein, 19 aa, Mycobacterium tuberculosis
PVEQRAAVVAVDMQGYSIA

SEQ ID NO: 1467071 - protein, 18 aa, Mycobacterium tuberculosis
PVGVPAIVVPPVAAPNVL

SEQ ID NO: 1467072 - protein, 52 aa, Mycobacterium tuberculosis
PVSILYRLYRPLIFALYCLPLNWLRRKHGLSSLGWDLCRIFTDGDYTLYADV

SEQ ID NO: 1467073 - protein, 29 aa, Mycobacterium tuberculosis
PYCALACAELLYRAGLPRALYAIVPGPGS

SEQ ID NO: 1467074 - protein, 17 aa, Mycobacterium tuberculosis
PYYLFGVLAKLAVLPSF

SEQ ID NO: 1467075 - protein, 21 aa, Mycobacterium tuberculosis
QAATFHIQFVQALTAGAGSYA

SEQ ID NO: 1467076 - protein, 25 aa, Mycobacterium tuberculosis
QAEYLRWAVGAFRLATSGVSDATQI

SEQ ID NO: 1467077 - protein, 23 aa, Mycobacterium tuberculosis
QATAGAPAHDWLTLTGGAIGYGI

SEQ ID NO: 1467078 - protein, 32 aa, Mycobacterium tuberculosis
QDSTLSPRGYRAMAGIPRLQFAHADLLVRAFG

SEQ ID NO: 1467079 - protein, 22 aa, Mycobacterium tuberculosis
QHLARACARVGARLIHVSTDYV

SEQ ID NO: 1467080 - protein, 18 aa, Mycobacterium tuberculosis
QIKRSAAVPDRDGTSHAA

SEQ ID NO: 1467081 - protein, 19 aa, Mycobacterium tuberculosis
QKAKVLAICNTNGSQIPRE

SEQ ID NO: 1467082 - protein, 24 aa, Mycobacterium tuberculosis
QPIRRYDVDAAILFSDIVVPLRAA

SEQ ID NO: 1467083 - protein, 17 aa, Mycobacterium tuberculosis
QPRRVLNGLSDVRAFFH

SEQ ID NO: 1467084 - protein, 23 aa, Mycobacterium tuberculosis
QPYWGRPVPGWGSKRPRLLILGL

SEQ ID NO: 1467085 - protein, 18 aa, Mycobacterium tuberculosis
QRPELVLDRVRAFLAAGT

SEQ ID NO: 1467086 - protein, 21 aa, Mycobacterium tuberculosis
QTVGDAFARIFGGSIVPQEVE

SEQ ID NO: 1467087 - protein, 23 aa, Mycobacterium tuberculosis
QTVWKRHHRWSLDGTCDEVFAHV

SEQ ID NO: 1467088 - protein, 20 aa, Mycobacterium tuberculosis
RADISFGSAVAVIGLGAVGL

SEQ ID NO: 1467089 - protein, 19 aa, Mycobacterium tuberculosis
RAEGRDAGWCPCTCPGGDP

SEQ ID NO: 1467090 - protein, 17 aa, Mycobacterium tuberculosis
RAKAMAVVMLALPGVVF

SEQ ID NO: 1467091 - protein, 22 aa, Mycobacterium tuberculosis
RALAQRPAWLAAAEALTTEGAD

SEQ ID NO: 1467092 - protein, 34 aa, Mycobacterium tuberculosis; identical to SEQ ID NO: 205000

SEQ ID NO: 1467093 - protein, 20 aa, Mycobacterium tuberculosis
RALPDRQRHASLLPLLHNYR

SEQ ID NO: 1467094 - protein, 17 aa, Mycobacterium tuberculosis
RALVTVGLFGGDAPVRD

SEQ ID NO: 1467095 - protein, 20 aa, Mycobacterium tuberculosis
RARERLTFDEAVGLQWALVA

SEQ ID NO: 1467096 - protein, 17 aa, Mycobacterium tuberculosis
RARSKAARKVWDTADKF

SEQ ID NO: 1467097 - protein, 17 aa, Mycobacterium tuberculosis
RASMPAGALLLSAVIAI

SEQ ID NO: 1467098 - protein, 19 aa, Mycobacterium tuberculosis
RASSMPVNRYRPFAEEVEP

SEQ ID NO: 1467099 - protein, 18 aa, Mycobacterium tuberculosis
RATALRRAGRSAGPRQLG

SEQ ID NO: 1467100 - protein, 20 aa, Mycobacterium tuberculosis
RAVEKFDYTKGYKFSTYATW

SEQ ID NO: 1467101 - protein, 22 aa, Mycobacterium tuberculosis
RDALRCFASLFGDEALDPLDYV

SEQ ID NO: 1467102 - protein, 19 aa, Mycobacterium tuberculosis
RDVDWWLTFSSAAALLGTP

SEQ ID NO: 1467103 - protein, 25 aa, Mycobacterium tuberculosis
REEGRWRCSPMGPKALTSLRAAETE

SEQ ID NO: 1467104 - protein, 29 aa, Mycobacterium tuberculosis
REHAEARLGYPLDRSHTAAVIWGDQAQGD

SEQ ID NO: 1467105 - protein, 20 aa, Mycobacterium tuberculosis
RELAEICGYIAGLPLDRDRP

SEQ ID NO: 1467106 - protein, 18 aa, Mycobacterium tuberculosis
REPHSWDLCVGHAGRITA

SEQ ID NO: 1467107 - protein, 22 aa, Mycobacterium tuberculosis
RETFRRMAMNDVETAALIVGGH

SEQ ID NO: 1467108 - protein, 17 aa, Mycobacterium tuberculosis
RGGRVRGQRGWIVEKPG

SEQ ID NO: 1467109 - protein, 24 aa, Mycobacterium tuberculosis
RGLVRLRAVLPLIDGGAESPQETW

SEQ ID NO: 1467110 - protein, 26 aa, Mycobacterium tuberculosis
RGRRCAPRVAIGWHTPIGDPLAVEGV

SEQ ID NO: 1467111 - protein, 17 aa, Mycobacterium tuberculosis
RGVLSVRAKIKVRLTQL

SEQ ID NO: 1467112 - protein, 19 aa, Mycobacterium tuberculosis
RHAKGWNHFLDRLVVAGQR

SEQ ID NO: 1467113 - protein, 17 aa, Mycobacterium tuberculosis
RIAGVLASAGLDVAITD

SEQ ID NO: 1467114 - protein, 24 aa, Mycobacterium tuberculosis
RIEAHALGMVFGRKRPGSGPLMIG

SEQ ID NO: 1467115 - protein, 18 aa, Mycobacterium tuberculosis
RIPVDLHTTLSIGPFPFR

SEQ ID NO: 1467116 - protein, 18 aa, Mycobacterium tuberculosis
RKSLLEALLNPVPTGDLN

SEQ ID NO: 1467117 - protein, 18 aa, Mycobacterium tuberculosis
RLAARVCGYEITPALRGV

SEQ ID NO: 1467118 - protein, 19 aa, Mycobacterium tuberculosis
RLADRGMRLTLRVYAYSSC

SEQ ID NO: 1467119 - protein, 20 aa, Mycobacterium tuberculosis
RLATAPVITEWCELPTGSSP

SEQ ID NO: 1467120 - protein, 17 aa, Mycobacterium tuberculosis
RLEGRAFGDVPLNLEYK

SEQ ID NO: 1467121 - protein, 24 aa, Mycobacterium tuberculosis
RLGEMCGLAGIAMERATQALLQAD

SEQ ID NO: 1467122 - protein, 24 aa, Mycobacterium tuberculosis
RLGPCPQHRYSFINVRRVASGSNT

SEQ ID NO: 1467123 - protein, 18 aa, Mycobacterium tuberculosis
RLKESVQAHGIYNQNLQA

SEQ ID NO: 1467124 - protein, 17 aa, Mycobacterium tuberculosis
RLWEHPKDKLSHYSDRT

SEQ ID NO: 1467125 - protein, 23 aa, Mycobacterium tuberculosis
RMQGRVGFEVKIHRIGADGAAVL

SEQ ID NO: 1467126 - protein, 20 aa, Mycobacterium tuberculosis
RNAKARLLRDNIVVAENLSI

SEQ ID NO: 1467127 - protein, 20 aa, Mycobacterium tuberculosis
RNTIGLRLATLGPLENADYI

SEQ ID NO: 1467128 - protein, 18 aa, Mycobacterium tuberculosis
RPHDWIVWHFTHADNLPG

SEQ ID NO: 1467129 - protein, 32 aa, Mycobacterium tuberculosis; identical to SEQ ID NO: 205780

SEQ ID NO: 1467130 - protein, 20 aa, Mycobacterium tuberculosis
RRLDGMPLAIELAAARLRSL

SEQ ID NO: 1467131 - protein, 22 aa, Mycobacterium tuberculosis
RRRAEEAWPKIEIADVDSTGLP

SEQ ID NO: 1467132 - protein, 23 aa, Mycobacterium tuberculosis
RRTGAFAHRYGFRHSVITRSPSA

SEQ ID NO: 1467133 - protein, 17 aa, Mycobacterium tuberculosis
RRYSVARRLAGLFASYA

SEQ ID NO: 1467134 - protein, 19 aa, Mycobacterium tuberculosis
RSPAGKPDYRWAKEQTEAR

SEQ ID NO: 1467135 - protein, 22 aa, Mycobacterium tuberculosis
RSRANITVCVGGGIGTPRRAAE

SEQ ID NO: 1467136 - protein, 23 aa, Mycobacterium tuberculosis
RTDQLPLVRALVDMAGLPPQAAG

SEQ ID NO: 1467137 - protein, 29 aa, Mycobacterium tuberculosis
RVGMPYVNQRWLGGMLTNFSTVHKRLQRL

SEQ ID NO: 1467138 - protein, 20 aa, Mycobacterium tuberculosis
RVGTALGVALQRADHVVVAC

SEQ ID NO: 1467139 - protein, 20 aa, Mycobacterium tuberculosis
RVQVGHGLVVDFVRSCGMTA

SEQ ID NO: 1467140 - protein, 21 aa, Mycobacterium tuberculosis
RVTGRKNLHVWAGECHVHAGI

SEQ ID NO: 1467141 - protein, 25 aa, Mycobacterium tuberculosis
RVYGTLPWHPDLWLDSEDALDLQGR

SEQ ID NO: 1467142 - protein, 22 aa, Mycobacterium tuberculosis
RWLREEHYRRMYLAINRTSHVE

SEQ ID NO: 1467143 - protein, 20 aa, Mycobacterium tuberculosis
RYAELIKRTQWWGRQMLIWG

SEQ ID NO: 1467144 - protein, 25 aa, Mycobacterium tuberculosis
SAIAVAKRGATVFALARNGNALDEL

SEQ ID NO: 1467145 - protein, 24 aa, Mycobacterium tuberculosis
SAPMLQAAAAWDGLAAELGTAASS

SEQ ID NO: 1467146 - protein, 23 aa, Mycobacterium tuberculosis
SDPRPALDAIRAAVCNRHGLSVA

SEQ ID NO: 1467147 - protein, 17 aa, Mycobacterium tuberculosis
SEHCSYKSSKVHLRYFG

SEQ ID NO: 1467148 - protein, 17 aa, Mycobacterium tuberculosis
SELATRAGLSVSAVQSR

SEQ ID NO: 1467149 - protein, 24 aa, Mycobacterium tuberculosis
SELGEWLVIHEGWRSELPDQLGEG

SEQ ID NO: 1467150 - protein, 25 aa, Mycobacterium tuberculosis
SGILNRGAGISGVYNTGTLGLVTSA

SEQ ID NO: 1467151 - protein, 19 aa, Mycobacterium tuberculosis
SGMPRLYREAPLMGIWEGS

SEQ ID NO: 1467152 - protein, 25 aa, Mycobacterium tuberculosis
SGVAVSPVTGLVFVTNFDSNTVSVI

SEQ ID NO: 1467153 - protein, 19 aa, Mycobacterium tuberculosis
SLARPVADTVWPTPFLAHQ

SEQ ID NO: 1467154 - protein, 27 aa, Mycobacterium tuberculosis
SLLPSRIVADLGAPVRLARRPFSSYTP

SEQ ID NO: 1467155 - protein, 19 aa, Mycobacterium tuberculosis
SLRIFPATHYVAGPERMAH

SEQ ID NO: 1467156 - protein, 25 aa, Mycobacterium tuberculosis
SPTPFNLLGIYRWIRNFFYLTYYDS

SEQ ID NO: 1467157 - protein, 20 aa, Mycobacterium tuberculosis
SRDLQPWLAVPDRLLPLPAD

SEQ ID NO: 1467158 - protein, 17 aa, Mycobacterium tuberculosis
SRGRGLGLDFLRHIERC

SEQ ID NO: 1467159 - protein, 17 aa, Mycobacterium tuberculosis
SRLPYLIRLPVGAGLVF

SEQ ID NO: 1467160 - protein, 17 aa, Mycobacterium tuberculosis
SRLVGAVLIGRDRAAVA

SEQ ID NO: 1467161 - protein, 40 aa, Mycobacterium tuberculosis; identical to SEQ ID NO: 210155

SEQ ID NO: 1467162 - protein, 18 aa, Mycobacterium tuberculosis
SSKVGLIAGCLVTSGVMR

SEQ ID NO: 1467163 - protein, 23 aa, Mycobacterium tuberculosis
SSSWCAGRRALAEAACRAFDALA

SEQ ID NO: 1467164 - protein, 17 aa, Mycobacterium tuberculosis
SSVPQFWAGELQTVTSP

SEQ ID NO: 1467165 - protein, 20 aa, Mycobacterium tuberculosis
STSLFAFWAVDAAYSLDGRR

SEQ ID NO: 1467166 - protein, 18 aa, Mycobacterium tuberculosis
SVALDWLRNNGYQDLASR

SEQ ID NO: 1467167 - protein, 20 aa, Mycobacterium tuberculosis
SVNGRIAVNLGAPVLLTVRA

SEQ ID NO: 1467168 - protein, 24 aa, Mycobacterium tuberculosis
SYRELPLRLFEFGTVYRYEKSGVV

SEQ ID NO: 1467169 - protein, 17 aa, Mycobacterium tuberculosis
TAAQCDVIADALRSGDV

SEQ ID NO: 1467170 - protein, 26 aa, Mycobacterium tuberculosis
TAPEISARILMKLKRDAEAYLGEDIT

SEQ ID NO: 1467171 - protein, 21 aa, Mycobacterium tuberculosis
TARRRGVVINPVLETSEIPET

SEQ ID NO: 1467172 - protein, 18 aa, Mycobacterium tuberculosis
TCRSLEFHRAVEVIAVGR

SEQ ID NO: 1467173 - protein, 19 aa, Mycobacterium tuberculosis
TDALEHFIDLVARVEAAAT

SEQ ID NO: 1467174 - protein, 28 aa, Mycobacterium tuberculosis
TEEQKKWAVLAAERGWGSTMVLTEPDAG

SEQ ID NO: 1467175 - protein, 20 aa, Mycobacterium tuberculosis
TEPLVPRPVHAINCTPAYLF

SEQ ID NO: 1467176 - protein, 21 aa, Mycobacterium tuberculosis
TESWMGPASMAMVAAAQPYLA

SEQ ID NO: 1467177 - protein, 18 aa, Mycobacterium tuberculosis
TFGGLKPVHALADCGRVV

SEQ ID NO: 1467178 - protein, 24 aa, Mycobacterium tuberculosis
TGVAYIRWLLRARPADYMLALSVA

SEQ ID NO: 1467179 - protein, 21 aa, Mycobacterium tuberculosis
TKIRLLTRIAFGFRSPQALIA

SEQ ID NO: 1467180 - protein, 17 aa, Mycobacterium tuberculosis
TKLRLGTSVLCNSYRHP

SEQ ID NO: 1467181 - protein, 17 aa, Mycobacterium tuberculosis
TKRGGGAALPFKRRLFG

SEQ ID NO: 1467182 - protein, 26 aa, Mycobacterium tuberculosis
TKRLASPAQRIMLFANDRGCTKPGCD

SEQ ID NO: 1467183 - protein, 21 aa, Mycobacterium tuberculosis
TLDAFSFPNISIVLPNIGINL

SEQ ID NO: 1467184 - protein, 20 aa, Mycobacterium tuberculosis
TLRTEMGYPLHGHELSLDIS

SEQ ID NO: 1467185 - protein, 17 aa, Mycobacterium tuberculosis
TRIPGRQGAGIDLPNTD

SEQ ID NO: 1467186 - protein, 21 aa, Mycobacterium tuberculosis
TRLIKRLQAILTDCTAPPASS

SEQ ID NO: 1467187 - protein, 19 aa, Mycobacterium tuberculosis
TVDGPLRFELIDIATATSC

SEQ ID NO: 1467188 - protein, 21 aa, Mycobacterium tuberculosis
TVVSPGDLWDLLRDGREAAGS

SEQ ID NO: 1467189 - protein, 23 aa, Mycobacterium tuberculosis
TWFKHAVFYEVLVRAFFDASADG

SEQ ID NO: 1467190 - protein, 22 aa, Mycobacterium tuberculosis
TWLRERPREMARTVFIELLAWQ

SEQ ID NO: 1467191 - protein, 17 aa, Mycobacterium tuberculosis
TWYRTGDLARYWHDGTL

SEQ ID NO: 1467192 - protein, 20 aa, Mycobacterium tuberculosis
VAELHRRASAWFAENGYLHE

SEQ ID NO: 1467193 - protein, 18 aa, Mycobacterium tuberculosis
VAIAAAFGAHGQAYQALS

SEQ ID NO: 1467194 - protein, 26 aa, Mycobacterium tuberculosis
VAQIRPGQYVRLHWARPRSRLPGQGV

SEQ ID NO: 1467195 - protein, 17 aa, Mycobacterium tuberculosis
VDAHGAMIRALAGLLEA

SEQ ID NO: 1467196 - protein, 21 aa, Mycobacterium tuberculosis
VDDLLGIWGRPEITGKPVYSD

SEQ ID NO: 1467197 - protein, 19 aa, Mycobacterium tuberculosis
VDPRRQLTVVGAREHNLRG

SEQ ID NO: 1467198 - protein, 23 aa, Mycobacterium tuberculosis
VDRIVSIEAFEHFGHENYDDFFK

SEQ ID NO: 1467199 - protein, 19 aa, Mycobacterium tuberculosis
VDVPLKFHHPMWREHCQVD

SEQ ID NO: 1467200 - protein, 18 aa, Mycobacterium tuberculosis
VEDVFPLPRELVGEGTLF

SEQ ID NO: 1467201 - protein, 20 aa, Mycobacterium tuberculosis
VEGGWKINGQKVWTSGAQYC

SEQ ID NO: 1467202 - protein, 26 aa, Mycobacterium tuberculosis
VEGMLALTGYYAWHKICVERAILPGM

SEQ ID NO: 1467203 - protein, 17 aa, Mycobacterium tuberculosis
VELGWICVSINYSKSPR

SEQ ID NO: 1467204 - protein, 20 aa, Mycobacterium tuberculosis
VEPRMLLVHFLRDQLRLTGT

SEQ ID NO: 1467205 - protein, 24 aa, Mycobacterium tuberculosis
VFGDGWIGAQACMWVNKFHEESTV

SEQ ID NO: 1467206 - protein, 17 aa, Mycobacterium tuberculosis
VGAQAIVVSVDYRLAPE

SEQ ID NO: 1467207 - protein, 30 aa, Mycobacterium tuberculosis
VGDRVGGMSPNGCWATFVTCDARLATRLPE

SEQ ID NO: 1467208 - protein, 18 aa, Mycobacterium tuberculosis
VGSGAWTAVHHAFTAPKP

SEQ ID NO: 1467209 - protein, 24 aa, Mycobacterium tuberculosis
VHRRCADVRYLGSWPTGPAAGAQP

SEQ ID NO: 1467210 - protein, 20 aa, Mycobacterium tuberculosis
VIVRQMLRRVTIIDSGSTEF

SEQ ID NO: 1467211 - protein, 17 aa, Mycobacterium tuberculosis
VKEAPGWRVSTDTDETG

SEQ ID NO: 1467212 - protein, 18 aa, Mycobacterium tuberculosis
VKVPAGWSHTAAATTSVV

SEQ ID NO: 1467213 - protein, 23 aa, Mycobacterium tuberculosis
VLASTGWHLMMALIARARVAIAQ

SEQ ID NO: 1467214 - protein, 21 aa, Mycobacterium tuberculosis
VLELAWTTGLIRWEDDPQPGW

SEQ ID NO: 1467215 - protein, 18 aa, Mycobacterium tuberculosis
VLTALGLPTEMDYMGYAD

SEQ ID NO: 1467216 - protein, 19 aa, Mycobacterium tuberculosis
VMSRDCWDAVGGMDLSTFG

SEQ ID NO: 1467217 - protein, 25 aa, Mycobacterium tuberculosis
VNVPRRCCRPGCPHYAVATLTFVYS

SEQ ID NO: 1467218 - protein, 25 aa, Mycobacterium tuberculosis
VPESKRFCWNCGRPVGRSDSETKGA

SEQ ID NO: 1467219 - protein, 24 aa, Mycobacterium tuberculosis
VQDAANLPPDWASVPYGVPFPNNA

SEQ ID NO: 1467220 - protein, 18 aa, Mycobacterium tuberculosis
VQELFEARVPRGKAPIAD

SEQ ID NO: 1467221 - protein, 17 aa, Mycobacterium tuberculosis
VQHLSLVVPNVVAGIAA

SEQ ID NO: 1467222 - protein, 25 aa, Mycobacterium tuberculosis
VRLAFVCAVDMPYLTVELIEDLARR

SEQ ID NO: 1467223 - protein, 21 aa, Mycobacterium tuberculosis
VRTSRGWSASPVRHGLSTIRS

SEQ ID NO: 1467224 - protein, 18 aa, Mycobacterium tuberculosis
VRWIETQDLLFIEEAAGG

SEQ ID NO: 1467225 - protein, 17 aa, Mycobacterium tuberculosis
VSASRARAILSSRHIHR

SEQ ID NO: 1467226 - protein, 20 aa, Mycobacterium tuberculosis
VSERLLTLGWQQRALPEVGD

SEQ ID NO: 1467227 - protein, 23 aa, Mycobacterium tuberculosis
VSRLRPYATTVFAEMSALATRIG

SEQ ID NO: 1467228 - protein, 21 aa, Mycobacterium tuberculosis
VTADVTLTRAWCLRELGDDDA

SEQ ID NO: 1467229 - protein, 24 aa, Mycobacterium tuberculosis
VTIPQLTIPAGITIGGFSLPAIHT

SEQ ID NO: 1467230 - protein, 17 aa, Mycobacterium tuberculosis
VTVCQWGEAAAKDLEGY

SEQ ID NO: 1467231 - protein, 24 aa, Mycobacterium tuberculosis
VVDARTALDPSAPVIRTDLEGKSD

SEQ ID NO: 1467232 - protein, 20 aa, Mycobacterium tuberculosis
WAAWQRSGLQRRWLAASEHG

SEQ ID NO: 1467233 - protein, 17 aa, Mycobacterium tuberculosis
WASSGHVGFKGSRKSTP

SEQ ID NO: 1467234 - protein, 33 aa, Mycobacterium tuberculosis
WDLGPLRASIDPFGWYRSWEEMLTGMAPLAGLG

SEQ ID NO: 1467235 - protein, 17 aa, Mycobacterium tuberculosis
WDNSLWCSWGDRETGYT

SEQ ID NO: 1467236 - protein, 19 aa, Mycobacterium tuberculosis
WGVGIAPSITTASLRAVVS

SEQ ID NO: 1467237 - protein, 20 aa, Mycobacterium tuberculosis
WLRANLPAVDAVLCSTATRA

SEQ ID NO: 1467238 - protein, 22 aa, Mycobacterium tuberculosis
WPSYVRVSAGLPRTMTFKVIKR

SEQ ID NO: 1467239 - protein, 21 aa, Mycobacterium tuberculosis
WQGDTGITYQGWQTQWNQALE

SEQ ID NO: 1467240 - protein, 18 aa, Mycobacterium tuberculosis
WQTYGDVVVRFEQSSNLH

SEQ ID NO: 1467241 - protein, 18 aa, Mycobacterium tuberculosis
WVLANRAYTPWYLVRYWR

SEQ ID NO: 1467242 - protein, 19 aa, Mycobacterium tuberculosis
WVLTKGKLPTSLWIEIVTT

SEQ ID NO: 1467243 - protein, 17 aa, Mycobacterium tuberculosis
WWLRERGTPINTLQVPA

SEQ ID NO: 1467244 - protein, 20 aa, Mycobacterium tuberculosis
YADGRLRIGALTAATSAGST

SEQ ID NO: 1467245 - protein, 17 aa, Mycobacterium tuberculosis
YASMFAALGTKVTVVEK

SEQ ID NO: 1467246 - protein, 19 aa, Mycobacterium tuberculosis
YLCALPEPARAVVDYLAIA

SEQ ID NO: 1467247 - protein, 17 aa, Mycobacterium tuberculosis
YLMSRQTPFSAIITGLT

SEQ ID NO: 1467248 - protein, 20 aa, Mycobacterium tuberculosis
YLVRYWRLLRFKLANPHIIT

SEQ ID NO: 1467249 - protein, 20 aa, Mycobacterium tuberculosis
YPGVRYRAFDLFEPGRPRMH

SEQ ID NO: 1467250 - protein, 22 aa, Mycobacterium tuberculosis
YPIETLDGITLFGRPTMTTPFI

SEQ ID NO: 1467251 - protein, 17 aa, Mycobacterium tuberculosis
YPSKLVVTRTMSKAFAF

SEQ ID NO: 1467252 - protein, 25 aa, Mycobacterium tuberculosis
YRIIGRAGGIYGDFFNFYLCDISLK

SEQ ID NO: 1467253 - protein, 21 aa, Mycobacterium tuberculosis
AAFGLARARSAEGDRVGAVRT

SEQ ID NO: 1467254 - protein, 19 aa, Mycobacterium tuberculosis
AAIPRLRRALVAPCTTTIR

SEQ ID NO: 1467255 - protein, 26 aa, Mycobacterium tuberculosis
AAKPFVRWLTDLCVQLSEVERQIHEI

SEQ ID NO: 1467256 - protein, 17 aa, Mycobacterium tuberculosis
AALVGGWNLLAPGHWPM

SEQ ID NO: 1467257 - protein, 21 aa, Mycobacterium tuberculosis
AAPDLPCEVEVDSLEQLDAVL

SEQ ID NO: 1467258 - protein, 17 aa, Mycobacterium tuberculosis
AAVLLHLGPGLGNGLAN

SEQ ID NO: 1467259 - protein, 23 aa, Mycobacterium tuberculosis
ACPDLLADMARQFGSQCIVLSVD

SEQ ID NO: 1467260 - protein, 24 aa, Mycobacterium tuberculosis
ADEVSAAIATLFGSHAREYQAIST

SEQ ID NO: 1467261 - protein, 24 aa, Mycobacterium tuberculosis
ADILRPVADRLWYPLWDANIRLDH

SEQ ID NO: 1467262 - protein, 18 aa, Mycobacterium tuberculosis
ADPVSLQSAVGFSALGSE

SEQ ID NO: 1467263 - protein, 23 aa, Mycobacterium tuberculosis
ADTDALIRFGVEAYEGADLREGV

SEQ ID NO: 1467264 - protein, 19 aa, Mycobacterium tuberculosis
AEALAPFGSPLASLAAAAE

SEQ ID NO: 1467265 - protein, 17 aa, Mycobacterium tuberculosis
AEALCAALEVVQQADTA

SEQ ID NO: 1467266 - protein, 19 aa, Mycobacterium tuberculosis
AEFTRIAAGISVSKPRIPL

SEQ ID NO: 1467267 - protein, 19 aa, Mycobacterium tuberculosis
AEGARLKDAFVYPETMPAW

SEQ ID NO: 1467268 - protein, 19 aa, Mycobacterium tuberculosis
AEGRLRLPERVQRYLVGRI

SEQ ID NO: 1467269 - protein, 26 aa, Mycobacterium tuberculosis
AEKRPPPAPRLTFRPADSAADVVPIA

SEQ ID NO: 1467270 - protein, 28 aa, Mycobacterium tuberculosis
AELGYKGLLAPLTFICVFGYKAQAAFFK

SEQ ID NO: 1467271 - protein, 17 aa, Mycobacterium tuberculosis
AELRQLLGSPWTDEHGT

SEQ ID NO: 1467272 - protein, 25 aa, Mycobacterium tuberculosis
AEMVSAHPGLACAVVNLHRRYRITT

SEQ ID NO: 1467273 - protein, 17 aa, Mycobacterium tuberculosis
AEVYARRLALAAAATAD

SEQ ID NO: 1467274 - protein, 19 aa, Mycobacterium tuberculosis
AGAMPVLTLYGIPHRDCGS

SEQ ID NO: 1467275 - protein, 18 aa, Mycobacterium tuberculosis
AGLVCAHTGGALPRTRPF

SEQ ID NO: 1467276 - protein, 17 aa, Mycobacterium tuberculosis
AGNWKRWYDNNIPIADQ

SEQ ID NO: 1467277 - protein, 17 aa, Mycobacterium tuberculosis
AGPDRIAQILAELATLF

SEQ ID NO: 1467278 - protein, 35 aa, Mycobacterium tuberculosis; identical to SEQ ID NO: 209070

SEQ ID NO: 1467279 - protein, 25 aa, Mycobacterium tuberculosis
AGSDAAWLRAELNNERGYVFDLETD

SEQ ID NO: 1467280 - protein, 21 aa, Mycobacterium tuberculosis
AGSIDRLAVWNMVATVDAFLS

SEQ ID NO: 1467281 - protein, 18 aa, Mycobacterium tuberculosis
AGTGNWGIGNSGAGNFGI

SEQ ID NO: 1467282 - protein, 17 aa, Mycobacterium tuberculosis
AHAARPHVHPVRMIAGA

SEQ ID NO: 1467283 - protein, 20 aa, Mycobacterium tuberculosis
AHGTVLLAVCGLRIGTGVSE

SEQ ID NO: 1467284 - protein, 20 aa, Mycobacterium tuberculosis
AHGTVMLRMPLHPVAIELLR

SEQ ID NO: 1467285 - protein, 22 aa, Mycobacterium tuberculosis
AHTFPATRFLGAGAAMSLLPEL

SEQ ID NO: 1467286 - protein, 19 aa, Mycobacterium tuberculosis
AIACGRADVVIPKLERLVA

SEQ ID NO: 1467287 - protein, 28 aa, Mycobacterium tuberculosis
AIDIPAIRPEFSANVAIDSFTVPSIPIP

SEQ ID NO: 1467288 - protein, 20 aa, Mycobacterium tuberculosis
AILANRLSPALTFGGANLNF

SEQ ID NO: 1467289 - protein, 30 aa, Mycobacterium tuberculosis
AKEDYFKLGYRGARFAFGYGACPDLEDRAK

SEQ ID NO: 1467290 - protein, 25 aa, Mycobacterium tuberculosis
ALELMRRVGLRPTKLTNAWVPFVVA

SEQ ID NO: 1467291 - protein, 18 aa, Mycobacterium tuberculosis
ALERGHGVLVCAPTGAGK

SEQ ID NO: 1467292 - protein, 26 aa, Mycobacterium tuberculosis
ALMRSCTGWPSGVWIDQPRRTAPDGS

SEQ ID NO: 1467293 - protein, 18 aa, Mycobacterium tuberculosis
ALPRWRGAAGRLEVWYAT

SEQ ID NO: 1467294 - protein, 22 aa, Mycobacterium tuberculosis
ALRAICPWEGFTDAYRDLAFPG

SEQ ID NO: 1467295 - protein, 18 aa, Mycobacterium tuberculosis
ALTAPAPHHTRPTRFVWL

SEQ ID NO: 1467296 - protein, 24 aa, Mycobacterium tuberculosis
AMAAAVAPYLGWLAAAAAQAQRSA

SEQ ID NO: 1467297 - protein, 21 aa, Mycobacterium tuberculosis
AMAFDEMFDAQGIVRGPYKGI

SEQ ID NO: 1467298 - protein, 18 aa, Mycobacterium tuberculosis
ANHEYLGPVLWSPAGKPP

SEQ ID NO: 1467299 - protein, 19 aa, Mycobacterium tuberculosis
APIASELILPIAVAVQNRI

SEQ ID NO: 1467300 - protein, 17 aa, Mycobacterium tuberculosis
APIPSLLAVAGVHHHLV

SEQ ID NO: 1467301 - protein, 26 aa, Mycobacterium tuberculosis
APLRPDRYLRIVAAMRREGMGFTAGF

SEQ ID NO: 1467302 - protein, 17 aa, Mycobacterium tuberculosis
APRAHFEIPDDLGPGRQ

SEQ ID NO: 1467303 - protein, 17 aa, Mycobacterium tuberculosis
APRRRHATVTDLLGTTT

SEQ ID NO: 1467304 - protein, 38 aa, Mycobacterium tuberculosis; identical to SEQ ID NO: 210565

SEQ ID NO: 1467305 - protein, 19 aa, Mycobacterium tuberculosis
ARIGREAMLDQIVNDALPS

SEQ ID NO: 1467306 - protein, 21 aa, Mycobacterium tuberculosis
ARRFARDDYDILLIGHEGHEE

SEQ ID NO: 1467307 - protein, 25 aa, Mycobacterium tuberculosis
ARRSLRPVGIVEVDGFPVFDVPPDA

SEQ ID NO: 1467308 - protein, 22 aa, Mycobacterium tuberculosis
ARYVWEVPYYPQYYIPLADVRM

SEQ ID NO: 1467309 - protein, 27 aa, Mycobacterium tuberculosis
ASIQRTGRCVVMHEGPRSLGYGAGLAA

SEQ ID NO: 1467310 - protein, 26 aa, Mycobacterium tuberculosis
ASMYRAAAGLHRLCDSLSGAQVRDVA

SEQ ID NO: 1467311 - protein, 34 aa, Mycobacterium tuberculosis
ASQLMGVVMARYIVRIEPFASLPAEQIVQTIAPN

SEQ ID NO: 1467312 - protein, 18 aa, Mycobacterium tuberculosis
ASVGSLSVPQAWAAANQA

SEQ ID NO: 1467313 - protein, 20 aa, Mycobacterium tuberculosis
ATLPAAAWQRCRTHYAANHG

SEQ ID NO: 1467314 - protein, 24 aa, Mycobacterium tuberculosis
ATPEVARAWSSYAPTVVRLPDGRV

SEQ ID NO: 1467315 - protein, 22 aa, Mycobacterium tuberculosis
ATVSVAAWGIRLAREAERKAGE

SEQ ID NO: 1467316 - protein, 17 aa, Mycobacterium tuberculosis
AVFGSPGRRIELPTYAF

SEQ ID NO: 1467317 - protein, 24 aa, Mycobacterium tuberculosis
AVTSFRVGRHRAEVVAVADGITYV

SEQ ID NO: 1467318 - protein, 17 aa, Mycobacterium tuberculosis
AWWSRPLEKVYAAVFID

SEQ ID NO: 1467319 - protein, 23 aa, Mycobacterium tuberculosis
AYAAGLAVGFWAAPSDLRANWRE

SEQ ID NO: 1467320 - protein, 19 aa, Mycobacterium tuberculosis
AYAIPGVAVAVWAGGQEYV

SEQ ID NO: 1467321 - protein, 30 aa, Mycobacterium tuberculosis
CGGEYEWTRAKAAYFMIVFSGPIPDDKWLQ

SEQ ID NO: 1467322 - protein, 22 aa, Mycobacterium tuberculosis
DAELFPGSWSEWSSDPTRPVGR

SEQ ID NO: 1467323 - protein, 17 aa, Mycobacterium tuberculosis
DAIDWQAYFHLRNRLVV

SEQ ID NO: 1467324 - protein, 20 aa, Mycobacterium tuberculosis
DAKRMFACFDQPDLKATFDV

SEQ ID NO: 1467325 - protein, 20 aa, Mycobacterium tuberculosis
DAPLNWCNPSGRALGAPPTT

SEQ ID NO: 1467326 - protein, 17 aa, Mycobacterium tuberculosis
DARSWWGACITRSRVCG

SEQ ID NO: 1467327 - protein, 23 aa, Mycobacterium tuberculosis
DARTYLADHGWRTASASTTDLLA

SEQ ID NO: 1467328 - protein, 30 aa, Mycobacterium tuberculosis; identical to SEQ ID NO: 197620

SEQ ID NO: 1467329 - protein, 26 aa, Mycobacterium tuberculosis
DDDAARMWARLRIHLAESGRRVRIND

SEQ ID NO: 1467330 - protein, 17 aa, Mycobacterium tuberculosis
DDLDVLDWPEQVKTMQR

SEQ ID NO: 1467331 - protein, 23 aa, Mycobacterium tuberculosis
DDLKLCSSMTLFARATDANQDFV

SEQ ID NO: 1467332 - protein, 23 aa, Mycobacterium tuberculosis
DESVPGRWALTREGGHSRRRIVH

SEQ ID NO: 1467333 - protein, 25 aa, Mycobacterium tuberculosis
DFCDPEVVEALKFHLRDLAVTFRFG

SEQ ID NO: 1467334 - protein, 17 aa, Mycobacterium tuberculosis
DGAAELFAGEGACVLRP

SEQ ID NO: 1467335 - protein, 19 aa, Mycobacterium tuberculosis
DGIGVPACVGAAGRAVTSV

SEQ ID NO: 1467336 - protein, 35 aa, Mycobacterium tuberculosis; identical to SEQ ID NO: 197774

SEQ ID NO: 1467337 - protein, 18 aa, Mycobacterium tuberculosis
DGTHTEWIEASRANDFGL

SEQ ID NO: 1467338 - protein, 17 aa, Mycobacterium tuberculosis
DGVAHGFTVARHGPDVY

SEQ ID NO: 1467339 - protein, 23 aa, Mycobacterium tuberculosis
DGWWRDRHRAMVMLVERLEGWAI

SEQ ID NO: 1467340 - protein, 18 aa, Mycobacterium tuberculosis
DITCPILAFVGEVDDIGQ

SEQ ID NO: 1467341 - protein, 25 aa, Mycobacterium tuberculosis
DLIDPALLRPGRLERLVFVEPPDAA

SEQ ID NO: 1467342 - protein, 20 aa, Mycobacterium tuberculosis
DLPDGGAWLYAATVRAIKEL

SEQ ID NO: 1467343 - protein, 20 aa, Mycobacterium tuberculosis
DLRDAGCDIVTITQYLRPSA

SEQ ID NO: 1467344 - protein, 21 aa, Mycobacterium tuberculosis
DPMQWRVLERAFSRHSALILI

SEQ ID NO: 1467345 - protein, 20 aa, Mycobacterium tuberculosis
DQAAAVAILQSWLDERLAAM

SEQ ID NO: 1467346 - protein, 19 aa, Mycobacterium tuberculosis
DQHAGGPGRVFVYSGQGSQ

SEQ ID NO: 1467347 - protein, 21 aa, Mycobacterium tuberculosis
DRAAAFAGIKPFLALYMGGMG

SEQ ID NO: 1467348 - protein, 20 aa, Mycobacterium tuberculosis
DRERIALSNVRIKSSVQNYP

SEQ ID NO: 1467349 - protein, 20 aa, Mycobacterium tuberculosis
DRIVSIGAFEHFGHQRYHHF

SEQ ID NO: 1467350 - protein, 27 aa, Mycobacterium tuberculosis
DTACSSSLVAIHWAMSSLRSGECDLAL

SEQ ID NO: 1467351 - protein, 24 aa, Mycobacterium tuberculosis
EAAELHEIYKLGVVSIPTNMPMIR

SEQ ID NO: 1467352 - protein, 18 aa, Mycobacterium tuberculosis
EAHLRRHAPWGAQVTVTR

SEQ ID NO: 1467353 - protein, 26 aa, Mycobacterium tuberculosis
EATLVGRLSVPAAWSTAAPATTAGAT

SEQ ID NO: 1467354 - protein, 29 aa, Mycobacterium tuberculosis
EAVGIAAYRCGDWAQALAELRAARRMGSK

SEQ ID NO: 1467355 - protein, 17 aa, Mycobacterium tuberculosis
EEMLEMAACGAKVLMLR

SEQ ID NO: 1467356 - protein, 18 aa, Mycobacterium tuberculosis
EIESAPTFQAYEVPLTRE

SEQ ID NO: 1467357 - protein, 25 aa, Mycobacterium tuberculosis
ELELYKRLPGDLSILTPSPASDTDT

SEQ ID NO: 1467358 - protein, 29 aa, Mycobacterium tuberculosis
ELGANHALHGVLMATNFFGINTIPIALNE

SEQ ID NO: 1467359 - protein, 17 aa, Mycobacterium tuberculosis
ELMKLRAATELEVDLYH

SEQ ID NO: 1467360 - protein, 27 aa, Mycobacterium tuberculosis
ELSAHAVAFHEQFVQLMSAGAAQYASA

SEQ ID NO: 1467361 - protein, 20 aa, Mycobacterium tuberculosis
EPDLKLGRGGLRDVQLLDAL

SEQ ID NO: 1467362 - protein, 17 aa, Mycobacterium tuberculosis
EPIHILPDIPININETL

SEQ ID NO: 1467363 - protein, 20 aa, Mycobacterium tuberculosis
EPPTRPAPQHSRRARRGHRY

SEQ ID NO: 1467364 - protein, 22 aa, Mycobacterium tuberculosis
ERFRTRYAIPIERHGHTEPAER

SEQ ID NO: 1467365 - protein, 22 aa, Mycobacterium tuberculosis
ERSLVHLGLKHYFLVDFPQEPG

SEQ ID NO: 1467366 - protein, 17 aa, Mycobacterium tuberculosis
ESACLDVADRRALDAEL

SEQ ID NO: 1467367 - protein, 18 aa, Mycobacterium tuberculosis
EVDVLPFQLVTMGQPIAD

SEQ ID NO: 1467368 - protein, 19 aa, Mycobacterium tuberculosis
EVFLVMPFTTDFMKLTPDR

SEQ ID NO: 1467369 - protein, 26 aa, Mycobacterium tuberculosis
EWRRGTLPPGRLGVRRAKEIRNRARD

SEQ ID NO: 1467370 - protein, 22 aa, Mycobacterium tuberculosis
FACALRPTKLIDYEEMFRGAMQ

SEQ ID NO: 1467371 - protein, 21 aa, Mycobacterium tuberculosis
FADAMAIRTHYFDNFFLDATR

SEQ ID NO: 1467372 - protein, 18 aa, Mycobacterium tuberculosis
FAELEPDFQRAYKELAKQ

SEQ ID NO: 1467373 - protein, 24 aa, Mycobacterium tuberculosis
FARQRYWGEPFPIVYDSDGRPHAL

SEQ ID NO: 1467374 - protein, 19 aa, Mycobacterium tuberculosis
FDASAAVAQLAPWQQVLRN

SEQ ID NO: 1467375 - protein, 17 aa, Mycobacterium tuberculosis
FFDFEGDPLWTADGKQW

SEQ ID NO: 1467376 - protein, 28 aa, Mycobacterium tuberculosis
FFIEDWAEIWPCAGMAYPKALADDLRPY

SEQ ID NO: 1467377 - protein, 20 aa, Mycobacterium tuberculosis
FGANMSGWWNQAHTALAGAG

SEQ ID NO: 1467378 - protein, 17 aa, Mycobacterium tuberculosis
FGDRTQINGVARDDAVA

SEQ ID NO: 1467379 - protein, 19 aa, Mycobacterium tuberculosis
FGIALGMAAFRPGRPSRTP

SEQ ID NO: 1467380 - protein, 25 aa, Mycobacterium tuberculosis
FGIVYTYARPNWWANANTVRSMIDA

SEQ ID NO: 1467381 - protein, 18 aa, Mycobacterium tuberculosis
FGNFGANMSGWWNQAHTA

SEQ ID NO: 1467382 - protein, 24 aa, Mycobacterium tuberculosis
FGPLLLPRIVASVFANEPRCRRIM

SEQ ID NO: 1467383 - protein, 19 aa, Mycobacterium tuberculosis
FGVTCTFHGHRRLSPDEVA

SEQ ID NO: 1467384 - protein, 21 aa, Mycobacterium tuberculosis
FHDRFTASRLFGAPPGYVGYE

SEQ ID NO: 1467385 - protein, 20 aa, Mycobacterium tuberculosis
FIQFHPTMLFAGRAGGRRPL

SEQ ID NO: 1467386 - protein, 19 aa, Mycobacterium tuberculosis
FKTALRLARHRELVDGADA

SEQ ID NO: 1467387 - protein, 20 aa, Mycobacterium tuberculosis
FLDGQCLFGPVLVDPPAGPA

SEQ ID NO: 1467388 - protein, 20 aa, Mycobacterium tuberculosis
FLEKEQRIIAALRAAADSPD

SEQ ID NO: 1467389 - protein, 34 aa, Mycobacterium tuberculosis; identical to SEQ ID NO: 199255

SEQ ID NO: 1467390 - protein, 17 aa, Mycobacterium tuberculosis
FPHAIGLSAGMSNDLEV

SEQ ID NO: 1467391 - protein, 19 aa, Mycobacterium tuberculosis
FPTDRGWDVEGLYDPDPDA

SEQ ID NO: 1467392 - protein, 17 aa, Mycobacterium tuberculosis
FRRLAVFPSGFDLDGAQ

SEQ ID NO: 1467393 - protein, 19 aa, Mycobacterium tuberculosis
FRTALRDSLDIYGVMATPG

SEQ ID NO: 1467394 - protein, 24 aa, Mycobacterium tuberculosis
FSIPEQPLPLAINVIGHINALSTP

SEQ ID NO: 1467395 - protein, 19 aa, Mycobacterium tuberculosis
FTRAALPAIRPVNHLVVDG

SEQ ID NO: 1467396 - protein, 23 aa, Mycobacterium tuberculosis
FTVFPDGYSLPAIPLGIDVGGAI

SEQ ID NO: 1467397 - protein, 20 aa, Mycobacterium tuberculosis
FVHAHPRWIAQAFADALGAA

SEQ ID NO: 1467398 - protein, 17 aa, Mycobacterium tuberculosis
FVVEIAAELPMQMICIL

SEQ ID NO: 1467399 - protein, 17 aa, Mycobacterium tuberculosis
GADRLGCGCGRADCAAG

SEQ ID NO: 1467400 - protein, 29 aa, Mycobacterium tuberculosis
GAKTARFVKRYADVGGELRRAAMQYAQEV

SEQ ID NO: 1467401 - protein, 21 aa, Mycobacterium tuberculosis
GANYKRLPLGVFTEASESLTN

SEQ ID NO: 1467402 - protein, 26 aa, Mycobacterium tuberculosis
GAPSSGIGIVEGWRGTIVHRVEIDVD

SEQ ID NO: 1467403 - protein, 17 aa, Mycobacterium tuberculosis
GARPERWIDQTNFDNDE

SEQ ID NO: 1467404 - protein, 20 aa, Mycobacterium tuberculosis
GAVDAYWNWQSCRAGKRAGK

SEQ ID NO: 1467405 - protein, 23 aa, Mycobacterium tuberculosis
GDKVTALQLVWADRRGRWPWAAD

SEQ ID NO: 1467406 - protein, 22 aa, Mycobacterium tuberculosis
GEKRLARMLARPVSAPVLSGDT

SEQ ID NO: 1467407 - protein, 20 aa, Mycobacterium tuberculosis
GELLRPARVLGIAATRDRAR

SEQ ID NO: 1467408 - protein, 26 aa, Mycobacterium tuberculosis
GFSMDGCCKFAAISAHVYCPHQITKT

SEQ ID NO: 1467409 - protein, 19 aa, Mycobacterium tuberculosis
GGEQRRWLQAELANARRDS

SEQ ID NO: 1467410 - protein, 21 aa, Mycobacterium tuberculosis
GGFPGTAAGFARRIARNTQLL

SEQ ID NO: 1467411 - protein, 20 aa, Mycobacterium tuberculosis
GGRRSFILVPGIDVPFHSRV

SEQ ID NO: 1467412 - protein, 17 aa, Mycobacterium tuberculosis
GHEWDLVVIAGLQDGLW

SEQ ID NO: 1467413 - protein, 18 aa, Mycobacterium tuberculosis
GLLAARHGLLGAVVEQPD

SEQ ID NO: 1467414 - protein, 23 aa, Mycobacterium tuberculosis
GLLPPTFSLVGFARRDWSTQDFG

SEQ ID NO: 1467415 - protein, 21 aa, Mycobacterium tuberculosis
GLQSLRLWREGSFLDGLGPQL

SEQ ID NO: 1467416 - protein, 20 aa, Mycobacterium tuberculosis
GNDHWSGFRPDRIKALAGAA

SEQ ID NO: 1467417 - protein, 25 aa, Mycobacterium tuberculosis
GRFEREMADLYGIRPVGHPKPRRLV

SEQ ID NO: 1467418 - protein, 25 aa, Mycobacterium tuberculosis
GRTLGLAGHAAFERRTLATVAKLLA

SEQ ID NO: 1467419 - protein, 17 aa, Mycobacterium tuberculosis
GSIDAITLFPGGLTFPA

SEQ ID NO: 1467420 - protein, 18 aa, Mycobacterium tuberculosis
GSIGLFLEPFRLSDPFIT

SEQ ID NO: 1467421 - protein, 27 aa, Mycobacterium tuberculosis
GSSSGFKVRPSFSFFAVGPDGMPGGEV

SEQ ID NO: 1467422 - protein, 19 aa, Mycobacterium tuberculosis
GTGRNALALARRGHPVDVV

SEQ ID NO: 1467423 - protein, 17 aa, Mycobacterium tuberculosis
GTLTYQMMFELRDLGFS

SEQ ID NO: 1467424 - protein, 20 aa, Mycobacterium tuberculosis
GTRGAPTVRIRGFSLWGDVG

SEQ ID NO: 1467425 - protein, 27 aa, Mycobacterium tuberculosis
GTTRLLLRAVGDWLVRPGAQLQAVGSA

SEQ ID NO: 1467426 - protein, 18 aa, Mycobacterium tuberculosis
GYEPMGGDALAYATYTSG

SEQ ID NO: 1467427 - protein, 19 aa, Mycobacterium tuberculosis
HAPKLGGHDSWRLHIHGAK

SEQ ID NO: 1467428 - protein, 20 aa, Mycobacterium tuberculosis
HCHREQWPVAGRMMGRLGWY

SEQ ID NO: 1467429 - protein, 25 aa, Mycobacterium tuberculosis
HDAYQWLRARGYRPEQIVLAGDSAG

SEQ ID NO: 1467430 - protein, 36 aa, Mycobacterium tuberculosis
HIGHVRSGVAFDILRRWLLARGYDVAFIRNVTDIED

SEQ ID NO: 1467431 - protein, 26 aa, Mycobacterium tuberculosis
HIPKGSAAALRFEVLGLVDGVPAVVL

SEQ ID NO: 1467432 - protein, 17 aa, Mycobacterium tuberculosis
HLAQCNWLVPSDQLGGL

SEQ ID NO: 1467433 - protein, 25 aa, Mycobacterium tuberculosis
HLDIPRVPVTLNYLFGSQPGGPLKI

SEQ ID NO: 1467434 - protein, 19 aa, Mycobacterium tuberculosis
HLRVRSLAIQRLAGRCHHR

SEQ ID NO: 1467435 - protein, 19 aa, Mycobacterium tuberculosis
HLSRRLAHWTRLYPEVRVD

SEQ ID NO: 1467436 - protein, 17 aa, Mycobacterium tuberculosis
HPHLTPLAHRVVEPTEA

SEQ ID NO: 1467437 - protein, 24 aa, Mycobacterium tuberculosis
HRRSWRVPVTAFWQAHRDAAAVYS

SEQ ID NO: 1467438 - protein, 22 aa, Mycobacterium tuberculosis
HRVGCPPIACLDEHQQDSRGTF

SEQ ID NO: 1467439 - protein, 29 aa, Mycobacterium tuberculosis
IAAQVVPWASLLQRFPGLGAGATGATGGE

SEQ ID NO: 1467440 - protein, 31 aa, Mycobacterium tuberculosis
IAGNYSNGVLWRGDYQGLIGADIALEIPAIP

SEQ ID NO: 1467441 - protein, 17 aa, Mycobacterium tuberculosis
IAPPVGRQLDWMVCRTV

SEQ ID NO: 1467442 - protein, 22 aa, Mycobacterium tuberculosis
IARGVPVAAPWDARRARELDDV

SEQ ID NO: 1467443 - protein, 17 aa, Mycobacterium tuberculosis
IARSRRRVRVEYRGDGG

SEQ ID NO: 1467444 - protein, 21 aa, Mycobacterium tuberculosis
IASLEMQRFTAMGGAAPSASD

SEQ ID NO: 1467445 - protein, 24 aa, Mycobacterium tuberculosis
IAYLLEILPALSYLHSIGLVYNDL

SEQ ID NO: 1467446 - protein, 17 aa, Mycobacterium tuberculosis
IDRLKGVSPEFVRRHIA

SEQ ID NO: 1467447 - protein, 20 aa, Mycobacterium tuberculosis
IGEAHIKVIRALFRPPARRG

SEQ ID NO: 1467448 - protein, 20 aa, Mycobacterium tuberculosis
IGGGFGNKVPIYPGYVCAIV

SEQ ID NO: 1467449 - protein, 22 aa, Mycobacterium tuberculosis
IKKGVLELADIVVVNKADGEHH

SEQ ID NO: 1467450 - protein, 17 aa, Mycobacterium tuberculosis
IKLHQLGLSLKDSPPSF

SEQ ID NO: 1467451 - protein, 17 aa, Mycobacterium tuberculosis
ILYHAALAHASNHIVTV

SEQ ID NO: 1467452 - protein, 18 aa, Mycobacterium tuberculosis
IMTPEITTPPFAIDPIGL

SEQ ID NO: 1467453 - protein, 17 aa, Mycobacterium tuberculosis
IPPPNSALVSWLPFYHD

SEQ ID NO: 1467454 - protein, 17 aa, Mycobacterium tuberculosis
IPVDSIYSPVLKVTYKV

SEQ ID NO: 1467455 - protein, 18 aa, Mycobacterium tuberculosis
IRLPGRYNVANCLVALAI

SEQ ID NO: 1467456 - protein, 17 aa, Mycobacterium tuberculosis
IRPALVFVAAEAAGADP

SEQ ID NO: 1467457 - protein, 17 aa, Mycobacterium tuberculosis
IRTHYFDNFFLDATRAG

SEQ ID NO: 1467458 - protein, 17 aa, Mycobacterium tuberculosis
IRYFPTLLPEVSDEDPL

SEQ ID NO: 1467459 - protein, 22 aa, Mycobacterium tuberculosis
ITTPALISGFFNTGSNMSGFFG

SEQ ID NO: 1467460 - protein, 24 aa, Mycobacterium tuberculosis
ITVSAADRPAHWRATDVAPTDAGG

SEQ ID NO: 1467461 - protein, 18 aa, Mycobacterium tuberculosis
IVATETFAPILYVLTYDD

SEQ ID NO: 1467462 - protein, 18 aa, Mycobacterium tuberculosis
KEFMVRNTYIYPPKPSMR

SEQ ID NO: 1467463 - protein, 18 aa, Mycobacterium tuberculosis
KEQGAWAELFRHFVDDGV

SEQ ID NO: 1467464 - protein, 40 aa, Mycobacterium tuberculosis; identical to SEQ ID NO: 81452

SEQ ID NO: 1467465 - protein, 19 aa, Mycobacterium tuberculosis
KLFGLSRERVRQIERDVMS

SEQ ID NO: 1467466 - protein, 30 aa, Mycobacterium tuberculosis; identical to SEQ ID NO: 201694

SEQ ID NO: 1467467 - protein, 18 aa, Mycobacterium tuberculosis
KPGLRRLAPLAFVRFRID

SEQ ID NO: 1467468 - protein, 22 aa, Mycobacterium tuberculosis
KQALDRWISWAQRCRIPVFVEL

SEQ ID NO: 1467469 - protein, 20 aa, Mycobacterium tuberculosis
KQILDVVGSWTMSNSAQRDA

SEQ ID NO: 1467470 - protein, 19 aa, Mycobacterium tuberculosis
KRTGLAVLDCAADVVLTTS

SEQ ID NO: 1467471 - protein, 18 aa, Mycobacterium tuberculosis
KSKDMALVLTDAAKALLA

SEQ ID NO: 1467472 - protein, 18 aa, Mycobacterium tuberculosis
KTAAFAIPMLSKIDITSK

SEQ ID NO: 1467473 - protein, 26 aa, Mycobacterium tuberculosis
KVIRALFRPPARRGGCVHPPGRRSRP

SEQ ID NO: 1467474 - protein, 17 aa, Mycobacterium tuberculosis
LAADAGLTSSSWARGPH

SEQ ID NO: 1467475 - protein, 18 aa, Mycobacterium tuberculosis
LAELGWLGLHIDERHGGS

SEQ ID NO: 1467476 - protein, 21 aa, Mycobacterium tuberculosis
LAGGARPGGRVMFYDDVAPVA

SEQ ID NO: 1467477 - protein, 20 aa, Mycobacterium tuberculosis
LAPLHGWGLDPYLTPGFTEL

SEQ ID NO: 1467478 - protein, 19 aa, Mycobacterium tuberculosis
LATASRLVARLGPEAVRII

SEQ ID NO: 1467479 - protein, 27 aa, Mycobacterium tuberculosis
LDARAYRLNWPAGTVVYEIDQPSVLEY

SEQ ID NO: 1467480 - protein, 18 aa, Mycobacterium tuberculosis
LDAVAAFVESGRTVVLGL

SEQ ID NO: 1467481 - protein, 24 aa, Mycobacterium tuberculosis
LDFRPKHKLAVLVVCAIPLAEPVR

SEQ ID NO: 1467482 - protein, 24 aa, Mycobacterium tuberculosis
LDGDARGGAALSVREVTGVPILFA

SEQ ID NO: 1467483 - protein, 20 aa, Mycobacterium tuberculosis
LDSITLFPGGLAFPENPVVS

SEQ ID NO: 1467484 - protein, 28 aa, Mycobacterium tuberculosis
LDSRAYRLRWPAGTIVFEVDQPQVIDFK

SEQ ID NO: 1467485 - protein, 17 aa, Mycobacterium tuberculosis
LELIKAHLPDVALLDYR

SEQ ID NO: 1467486 - protein, 19 aa, Mycobacterium tuberculosis
LFGSHGQHYQAISAQVAAY

SEQ ID NO: 1467487 - protein, 23 aa, Mycobacterium tuberculosis
LGFARLAIQHGYPIVPFASVGAE

SEQ ID NO: 1467488 - protein, 24 aa, Mycobacterium tuberculosis
LGMGSELYAAYPVFAEALDAVVDE

SEQ ID NO: 1467489 - protein, 29 aa, Mycobacterium tuberculosis
LHGSLFEFRCARCGVPYTDALPEMPEPAI

SEQ ID NO: 1467490 - protein, 20 aa, Mycobacterium tuberculosis
LHQLGTVWVRRHLPNVALFH

SEQ ID NO: 1467491 - protein, 17 aa, Mycobacterium tuberculosis
LIVELERLYNHAADLGA

SEQ ID NO: 1467492 - protein, 35 aa, Mycobacterium tuberculosis; identical to SEQ ID NO: 202507

SEQ ID NO: 1467493 - protein, 23 aa, Mycobacterium tuberculosis
LLVSARSLLQCAALHDLVDVVLS

SEQ ID NO: 1467494 - protein, 18 aa, Mycobacterium tuberculosis
LPADAGMVGPMFDVGFPF

SEQ ID NO: 1467495 - protein, 19 aa, Mycobacterium tuberculosis
LPASQVVRFIVPRYVQDDP

SEQ ID NO: 1467496 - protein, 25 aa, Mycobacterium tuberculosis
LPGADLRAPCALPVLVIDGRDEKHL

SEQ ID NO: 1467497 - protein, 25 aa, Mycobacterium tuberculosis
LPGAECERLHLPPMCDRDTTHCVSV

SEQ ID NO: 1467498 - protein, 22 aa, Mycobacterium tuberculosis
LPTQLCAFAAGVLRAEAVHEPG

SEQ ID NO: 1467499 - protein, 17 aa, Mycobacterium tuberculosis
LQAGRIAVPLSVPQGGV

SEQ ID NO: 1467500 - protein, 23 aa, Mycobacterium tuberculosis
LQLASSLQPIWFGRAHLREGLSW

SEQ ID NO: 1467501 - protein, 18 aa, Mycobacterium tuberculosis
LQSAVGFSALGSEHAAIA

SEQ ID NO: 1467502 - protein, 17 aa, Mycobacterium tuberculosis
LQTEEWLGPASTLMVEA

SEQ ID NO: 1467503 - protein, 17 aa, Mycobacterium tuberculosis
LQVRPPVVTVMGHVDHG

SEQ ID NO: 1467504 - protein, 21 aa, Mycobacterium tuberculosis
LRARPADYMLALSVAGGSLPV

SEQ ID NO: 1467505 - protein, 19 aa, Mycobacterium tuberculosis
LRQDGMLALARLQRKMRLV

SEQ ID NO: 1467506 - protein, 20 aa, Mycobacterium tuberculosis
LRQTWLDLHESWLIDKADEI

SEQ ID NO: 1467507 - protein, 21 aa, Mycobacterium tuberculosis
LRRLAPLAFVRFRIDGKDWPA

SEQ ID NO: 1467508 - protein, 18 aa, Mycobacterium tuberculosis
LRSGECDLALAGGVTVMA

SEQ ID NO: 1467509 - protein, 17 aa, Mycobacterium tuberculosis
LSALVAHLVGADALVLL

SEQ ID NO: 1467510 - protein, 21 aa, Mycobacterium tuberculosis
LSKLTPWKAPPPIAHSTVLVA

SEQ ID NO: 1467511 - protein, 18 aa, Mycobacterium tuberculosis
LSTRLEVEIKRDGYEWSQ

SEQ ID NO: 1467512 - protein, 17 aa, Mycobacterium tuberculosis
LSYADGDIWDWAVDWDT

SEQ ID NO: 1467513 - protein, 18 aa, Mycobacterium tuberculosis
LTAARAVLDMAASVGATS

SEQ ID NO: 1467514 - protein, 18 aa, Mycobacterium tuberculosis
LTALVLPAAGAPAVVLPR

SEQ ID NO: 1467515 - protein, 20 aa, Mycobacterium tuberculosis
LTLASLKWVLANRAYTPWYL

SEQ ID NO: 1467516 - protein, 24 aa, Mycobacterium tuberculosis
LVAVRRAGGVVIPQVFFTNSGQVV

SEQ ID NO: 1467517 - protein, 23 aa, Mycobacterium tuberculosis
LVERLEGWAITKARGDDVTVVFE

SEQ ID NO: 1467518 - protein, 20 aa, Mycobacterium tuberculosis
LVKLTCRGRDLPTAVSRARR

SEQ ID NO: 1467519 - protein, 21 aa, Mycobacterium tuberculosis
LVKVRSGYEAALAAALGPAAD

SEQ ID NO: 1467520 - protein, 17 aa, Mycobacterium tuberculosis
LVQLEHWGCPWSRKPDG

SEQ ID NO: 1467521 - protein, 20 aa, Mycobacterium tuberculosis
LVRRCRMVMAGESLPQAEPT

SEQ ID NO: 1467522 - protein, 18 aa, Mycobacterium tuberculosis
LWAGVAVSDLEFIQFHPT

SEQ ID NO: 1467523 - protein, 17 aa, Mycobacterium tuberculosis
LYDLLAQAVAPKFYERD

SEQ ID NO: 1467524 - protein, 23 aa, Mycobacterium tuberculosis
MDEGLRFAIREGGRTVGAGRVTK

SEQ ID NO: 1467525 - protein, 19 aa, Mycobacterium tuberculosis
MEQAMGIAKGYLANQENVM

SEQ ID NO: 1467526 - protein, 24 aa, Mycobacterium tuberculosis
MGPEGRAAIGLGDGVVRISVGLED

SEQ ID NO: 1467527 - protein, 27 aa, Mycobacterium tuberculosis
MNNGVFYRGVGQGSLQFSITTPDLTLP

SEQ ID NO: 1467528 - protein, 19 aa, Mycobacterium tuberculosis
MRRAREEAEQLVAQATAEV

SEQ ID NO: 1467529 - protein, 17 aa, Mycobacterium tuberculosis
MWVRAATTMATYSTVSR

SEQ ID NO: 1467530 - protein, 25 aa, Mycobacterium tuberculosis
NELREMLPHNAVEYFVSYYDYYQPE

SEQ ID NO: 1467531 - protein, 24 aa, Mycobacterium tuberculosis
NSGRMYCGPGSGPMLAAAAAWDGV

SEQ ID NO: 1467532 - protein, 18 aa, Mycobacterium tuberculosis
NTRMPSCRAHLLKEGLRH

SEQ ID NO: 1467533 - protein, 25 aa, Mycobacterium tuberculosis
PAPMANSLPGQWTAHVTLARRVGGH

SEQ ID NO: 1467534 - protein, 21 aa, Mycobacterium tuberculosis
PDARGIYYGRLTEMTTTDFQV

SEQ ID NO: 1467535 - protein, 24 aa, Mycobacterium tuberculosis
PDGQFPALPLFELGYDVAHVGFDQ

SEQ ID NO: 1467536 - protein, 25 aa, Mycobacterium tuberculosis
PEINSLRMYLGAGSAPMLQAAAAWD

SEQ ID NO: 1467537 - protein, 17 aa, Mycobacterium tuberculosis
PEIREVRRSDFCGHYIG

SEQ ID NO: 1467538 - protein, 21 aa, Mycobacterium tuberculosis
PEITTPPFAIDPIGLSGFTLP

SEQ ID NO: 1467539 - protein, 25 aa, Mycobacterium tuberculosis
PELLPGDGAQAFACSRKHGWEGVIA

SEQ ID NO: 1467540 - protein, 18 aa, Mycobacterium tuberculosis
PFEDGGWVWFDITTDTAV

SEQ ID NO: 1467541 - protein, 24 aa, Mycobacterium tuberculosis
PFSVTRPDGLPVWIYQFKISPHPT

SEQ ID NO: 1467542 - protein, 21 aa, Mycobacterium tuberculosis
PGFTIPGGTLIPTLPLGLALS

SEQ ID NO: 1467543 - protein, 25 aa, Mycobacterium tuberculosis
PGLLTLDGTNTWVLRGPLSDELVVV

SEQ ID NO: 1467544 - protein, 20 aa, Mycobacterium tuberculosis
PGWRAGSSPLGYAQLYLPTR

SEQ ID NO: 1467545 - protein, 19 aa, Mycobacterium tuberculosis
PHLVPVVFALGARRPAEAT

SEQ ID NO: 1467546 - protein, 18 aa, Mycobacterium tuberculosis
PHRVCRYLEDLAGDYHRF

SEQ ID NO: 1467547 - protein, 17 aa, Mycobacterium tuberculosis
PKEARAWTIHQGDTAPK

SEQ ID NO: 1467548 - protein, 18 aa, Mycobacterium tuberculosis
PLLVPLRAIPLLGNPLAD

SEQ ID NO: 1467549 - protein, 24 aa, Mycobacterium tuberculosis
PLPPTVGITLHLPFDGILVPPHPV

SEQ ID NO: 1467550 - protein, 22 aa, Mycobacterium tuberculosis
PMGRIAAQLADLVVVTDDNPRD

SEQ ID NO: 1467551 - protein, 18 aa, Mycobacterium tuberculosis
PNRSLDCVDDELAGSAHF

SEQ ID NO: 1467552 - protein, 21 aa, Mycobacterium tuberculosis
PPGSWTKYGHWLREPVGPIHW

SEQ ID NO: 1467553 - protein, 25 aa, Mycobacterium tuberculosis
PPIRMGVDVPDRIAGVAYPQGTTAR

SEQ ID NO: 1467554 - protein, 18 aa, Mycobacterium tuberculosis
PPQTFKIENPLAVVATST

SEQ ID NO: 1467555 - protein, 19 aa, Mycobacterium tuberculosis
PQVWDVLEEVIAEHPVLLN

SEQ ID NO: 1467556 - protein, 22 aa, Mycobacterium tuberculosis
PRIGRRAANAVTVFFDGATLHA

SEQ ID NO: 1467557 - protein, 20 aa, Mycobacterium tuberculosis
PRLSRRILHQLYLGYPDSAA

SEQ ID NO: 1467558 - protein, 19 aa, Mycobacterium tuberculosis
PRVASPRYRCTTPQCGRAV

SEQ ID NO: 1467559 - protein, 19 aa, Mycobacterium tuberculosis
PSKALLRPVIAISDARRVD

SEQ ID NO: 1467560 - protein, 19 aa, Mycobacterium tuberculosis
PSMADAWLGRIACGDRDLA

SEQ ID NO: 1467561 - protein, 20 aa, Mycobacterium tuberculosis
PSSGPNLGRFGSFGRGVTPQ

SEQ ID NO: 1467562 - protein, 26 aa, Mycobacterium tuberculosis
PSTVADMMIYLGWSMAGRGAQEGRTA

SEQ ID NO: 1467563 - protein, 25 aa, Mycobacterium tuberculosis
PTAAPRWVVDPDFNLDFHVRRVRVS

SEQ ID NO: 1467564 - protein, 21 aa, Mycobacterium tuberculosis
PVAEYWPAFGANGKATLTVRD

SEQ ID NO: 1467565 - protein, 22 aa, Mycobacterium tuberculosis
PVGEVRSRFYARAPELHRSPVF

SEQ ID NO: 1467566 - protein, 17 aa, Mycobacterium tuberculosis
PVSILDVRWRLDEPDGH

SEQ ID NO: 1467567 - protein, 18 aa, Mycobacterium tuberculosis
PYEVELCVAEVAHYGETK

SEQ ID NO: 1467568 - protein, 17 aa, Mycobacterium tuberculosis
QAPHDWRVGRKLLAWER

SEQ ID NO: 1467569 - protein, 24 aa, Mycobacterium tuberculosis
QDWWPNRLNLKVLHQNPAVADPMG

SEQ ID NO: 1467570 - protein, 17 aa, Mycobacterium tuberculosis
QGASLAHFADGWNTFNL

SEQ ID NO: 1467571 - protein, 20 aa, Mycobacterium tuberculosis
QGLTAMWRRESELFADVAVP

SEQ ID NO: 1467572 - protein, 19 aa, Mycobacterium tuberculosis
QGYGSLGLMTSVLMTADGK

SEQ ID NO: 1467573 - protein, 17 aa, Mycobacterium tuberculosis
QKRLMTLIHLWLVHRFK

SEQ ID NO: 1467574 - protein, 20 aa, Mycobacterium tuberculosis
QLPAAWAYKRFRDLDDKESY

SEQ ID NO: 1467575 - protein, 24 aa, Mycobacterium tuberculosis
QNVALRLVALVDRLYDAGIPVVAS

SEQ ID NO: 1467576 - protein, 23 aa, Mycobacterium tuberculosis
QPDLRVLVELGYDRTAHQDVPSP

SEQ ID NO: 1467577 - protein, 32 aa, Mycobacterium tuberculosis
QQVSCAGLVIGSWPDPPGLVAASNRSALARIA

SEQ ID NO: 1467578 - protein, 24 aa, Mycobacterium tuberculosis
QSGFTFPLLSDFWPHGAVSQAYGV

SEQ ID NO: 1467579 - protein, 18 aa, Mycobacterium tuberculosis
RAALARELVRAGTTFPTD

SEQ ID NO: 1467580 - protein, 19 aa, Mycobacterium tuberculosis
RAGNFAVVVGINRTGRAAQ

SEQ ID NO: 1467581 - protein, 17 aa, Mycobacterium tuberculosis
RDNEWYVARLCPTPLRP

SEQ ID NO: 1467582 - protein, 20 aa, Mycobacterium tuberculosis
RDPDAWARLIDTYEVTALNF

SEQ ID NO: 1467583 - protein, 17 aa, Mycobacterium tuberculosis
REARKATGHPAGEQPRD

SEQ ID NO: 1467584 - protein, 26 aa, Mycobacterium tuberculosis
REELQPRLPAVMDRLDRAIPRGVGTA

SEQ ID NO: 1467585 - protein, 17 aa, Mycobacterium tuberculosis
RENSSLVAALDRLDAAV

SEQ ID NO: 1467586 - protein, 26 aa, Mycobacterium tuberculosis
RFVNSRPKPLSAYLFTKSRAVRERVI

SEQ ID NO: 1467587 - protein, 18 aa, Mycobacterium tuberculosis
RGARKRPTSGWGALTPTE

SEQ ID NO: 1467588 - protein, 17 aa, Mycobacterium tuberculosis
RGIPAIAPAIAIPIGST

SEQ ID NO: 1467589 - protein, 22 aa, Mycobacterium tuberculosis
RHEFWPDALSFAGVEVAGVVGH

SEQ ID NO: 1467590 - protein, 19 aa, Mycobacterium tuberculosis
RIRELLAAYPRMPATVIAE

SEQ ID NO: 1467591 - protein, 19 aa, Mycobacterium tuberculosis
RLDQSVSLLHLQLILREGG

SEQ ID NO: 1467592 - protein, 18 aa, Mycobacterium tuberculosis
RLLPEWEPIRDLPPRDVA

SEQ ID NO: 1467593 - protein, 17 aa, Mycobacterium tuberculosis
RLLSGRPTSAWQRASYL

SEQ ID NO: 1467594 - protein, 19 aa, Mycobacterium tuberculosis
RLYREAPLMGIWEGSGNVS

SEQ ID NO: 1467595 - protein, 17 aa, Mycobacterium tuberculosis
RMLLWRAASALDDDDAD

SEQ ID NO: 1467596 - protein, 19 aa, Mycobacterium tuberculosis
RMWLDAVGISEDLHRYLDD

SEQ ID NO: 1467597 - protein, 21 aa, Mycobacterium tuberculosis
RPGAQIKYLVRMRSWPGGHAR

SEQ ID NO: 1467598 - protein, 18 aa, Mycobacterium tuberculosis
RPGESDGTCGRGEPQAGR

SEQ ID NO: 1467599 - protein, 17 aa, Mycobacterium tuberculosis
RPIIFNLPATVEMTTPN

SEQ ID NO: 1467600 - protein, 18 aa, Mycobacterium tuberculosis
RPKINTTMHLLDDSLQPV

SEQ ID NO: 1467601 - protein, 20 aa, Mycobacterium tuberculosis
RPTELHPFVELTGPRHTAPA

SEQ ID NO: 1467602 - protein, 21 aa, Mycobacterium tuberculosis
RRDKRARLLAQGRDPYPVAVP

SEQ ID NO: 1467603 - protein, 27 aa, Mycobacterium tuberculosis
RRFSGSSGQLAREWVAAGARIVGGCCR

SEQ ID NO: 1467604 - protein, 18 aa, Mycobacterium tuberculosis
RRRYVEVFAAGQGGGSKG

SEQ ID NO: 1467605 - protein, 18 aa, Mycobacterium tuberculosis
RRSALMTRIAGAGAMASV

SEQ ID NO: 1467606 - protein, 17 aa, Mycobacterium tuberculosis
RRSCPECGRRFTTVETA

SEQ ID NO: 1467607 - protein, 17 aa, Mycobacterium tuberculosis
RSGRLDRDMAVFTRTEM

SEQ ID NO: 1467608 - protein, 24 aa, Mycobacterium tuberculosis
RSSTCAPIAWSRSFRHVQALETDP

SEQ ID NO: 1467609 - protein, 21 aa, Mycobacterium tuberculosis
RTGHVALRVLHDGTAVTGLLV

SEQ ID NO: 1467610 - protein, 20 aa, Mycobacterium tuberculosis
RVPPYAGPPMWFHGDLSRFN

SEQ ID NO: 1467611 - protein, 25 aa, Mycobacterium tuberculosis
RVRRNPRGSYQIAVVGLKGGAGKTT

SEQ ID NO: 1467612 - protein, 20 aa, Mycobacterium tuberculosis
RVSLAHALIGWTRGTGLMGH

SEQ ID NO: 1467613 - protein, 19 aa, Mycobacterium tuberculosis
RYTLGVNWRSDRALVESLQ

SEQ ID NO: 1467614 - protein, 20 aa, Mycobacterium tuberculosis
SADVLLAHLVLRPFLDAYHI

SEQ ID NO: 1467615 - protein, 31 aa, Mycobacterium tuberculosis
SAFQTRPSGLPGLRHKYSLDIAPGNFVTIND

SEQ ID NO: 1467616 - protein, 23 aa, Mycobacterium tuberculosis
SASTICDPGFLVLVEGVLGETGL

SEQ ID NO: 1467617 - protein, 18 aa, Mycobacterium tuberculosis
SDLINVRYLSGFSGSNGA

SEQ ID NO: 1467618 - protein, 19 aa, Mycobacterium tuberculosis
SEGAGVLVVERLVDARRLG

SEQ ID NO: 1467619 - protein, 18 aa, Mycobacterium tuberculosis
SGCGKTTLLSCLGGILRP

SEQ ID NO: 1467620 - protein, 22 aa, Mycobacterium tuberculosis
SGGGARWLIPRLDLPAKKRDAI

SEQ ID NO: 1467621 - protein, 23 aa, Mycobacterium tuberculosis
SGLVRAAACTMFFGETAESLAAE

SEQ ID NO: 1467622 - protein, 31 aa, Mycobacterium tuberculosis; identical to SEQ ID NO: 206407

SEQ ID NO: 1467623 - protein, 24 aa, Mycobacterium tuberculosis
SGPSLARWARANGWSAPPGAGAKE

SEQ ID NO: 1467624 - protein, 19 aa, Mycobacterium tuberculosis
SIRILKMLFEHGIETVISP

SEQ ID NO: 1467625 - protein, 22 aa, Mycobacterium tuberculosis
SLEVIDLRSLAPLDFDTIAASI

SEQ ID NO: 1467626 - protein, 25 aa, Mycobacterium tuberculosis
SLGAGWACGVTVVLPPPGTVGAVDC

SEQ ID NO: 1467627 - protein, 23 aa, Mycobacterium tuberculosis
SLGLEFIGFGGPDVREGLAAHRE

SEQ ID NO: 1467628 - protein, 20 aa, Mycobacterium tuberculosis
SLQLPLAVLAEAAAEVQAKI

SEQ ID NO: 1467629 - protein, 19 aa, Mycobacterium tuberculosis
SPIPTTLIGPIHINTGFSI

SEQ ID NO: 1467630 - protein, 19 aa, Mycobacterium tuberculosis
SSAIPFVFEPVRVRGATWV

SEQ ID NO: 1467631 - protein, 19 aa, Mycobacterium tuberculosis
STYIRSCVDAGDMVAAMEA

SEQ ID NO: 1467632 - protein, 17 aa, Mycobacterium tuberculosis
SVTSGLAGQSWQGAAAA

SEQ ID NO: 1467633 - protein, 24 aa, Mycobacterium tuberculosis
TEIDNWRWAGVPIFVRAGKELPAK

SEQ ID NO: 1467634 - protein, 24 aa, Mycobacterium tuberculosis
TESALRFVGAATFEALSGEPVCTD

SEQ ID NO: 1467635 - protein, 31 aa, Mycobacterium tuberculosis
TGGLGGLGLVVARWLVDRGAGRVVLGGRSDP

SEQ ID NO: 1467636 - protein, 18 aa, Mycobacterium tuberculosis
TGNIFLITGIGYYPNLGV

SEQ ID NO: 1467637 - protein, 25 aa, Mycobacterium tuberculosis
TGRPTGEWSAAVSRLAAAEAAVADC

SEQ ID NO: 1467638 - protein, 23 aa, Mycobacterium tuberculosis
TKDVHIGPSDHVGWLDDRKWAYV

SEQ ID NO: 1467639 - protein, 17 aa, Mycobacterium tuberculosis
TKLGTEHLVGTTLNVLA

SEQ ID NO: 1467640 - protein, 24 aa, Mycobacterium tuberculosis
TKRLASPAQRIMLYAKDRGCSRPG

SEQ ID NO: 1467641 - protein, 17 aa, Mycobacterium tuberculosis
TLLDRAYAKKFRFPTFL

SEQ ID NO: 1467642 - protein, 21 aa, Mycobacterium tuberculosis
TLRRILYDHIYLRHFRPKPDY

SEQ ID NO: 1467643 - protein, 26 aa, Mycobacterium tuberculosis
TNTPRNFARRGIRCHVLPASTTFEQI

SEQ ID NO: 1467644 - protein, 18 aa, Mycobacterium tuberculosis
TPGDLLFHIRAETMDVCF

SEQ ID NO: 1467645 - protein, 20 aa, Mycobacterium tuberculosis
TPPFDLPTVVIDRIPVELHA

SEQ ID NO: 1467646 - protein, 32 aa, Mycobacterium tuberculosis; identical to SEQ ID NO: 211882

SEQ ID NO: 1467647 - protein, 27 aa, Mycobacterium tuberculosis
TQRPAPQFEVMYLLAVCDAAAADQLRD

SEQ ID NO: 1467648 - protein, 22 aa, Mycobacterium tuberculosis
TRDELLAGLAGVVAGRPEAGVV

SEQ ID NO: 1467649 - protein, 26 aa, Mycobacterium tuberculosis
TREGRALDDFATWCALAETYGDDWHR

SEQ ID NO: 1467650 - protein, 28 aa, Mycobacterium tuberculosis
TTALFGHSYGSLLSGIALKDGASSLVDN

SEQ ID NO: 1467651 - protein, 25 aa, Mycobacterium tuberculosis
TTMFRPKLDALALLHRRSLKSPVRH

SEQ ID NO: 1467652 - protein, 21 aa, Mycobacterium tuberculosis
TTRMRVELGYQPKWTTVEAFD

SEQ ID NO: 1467653 - protein, 17 aa, Mycobacterium tuberculosis
TVVVSVWQPGEPAAKLV

SEQ ID NO: 1467654 - protein, 21 aa, Mycobacterium tuberculosis
VAAEATRVGMPYVNQRWLGGM

SEQ ID NO: 1467655 - protein, 24 aa, Mycobacterium tuberculosis
VAANRNAFVQLVLSNLFGQNAPAI

SEQ ID NO: 1467656 - protein, 18 aa, Mycobacterium tuberculosis
VAELLGVPVSKVAQQLRE

SEQ ID NO: 1467657 - protein, 24 aa, Mycobacterium tuberculosis
VAQTRAAPHLARITCPALVLNAEA

SEQ ID NO: 1467658 - protein, 20 aa, Mycobacterium tuberculosis
VASGRVSYVLGLQGPAVSVD

SEQ ID NO: 1467659 - protein, 22 aa, Mycobacterium tuberculosis
VCGVGKPAGKTAFVFAGQGSQW

SEQ ID NO: 1467660 - protein, 22 aa, Mycobacterium tuberculosis
VCTAAARAVSWPAVTSPAGPVT

SEQ ID NO: 1467661 - protein, 24 aa, Mycobacterium tuberculosis
VDLHPRLLVAPVRPDSLRSNWARA

SEQ ID NO: 1467662 - protein, 25 aa, Mycobacterium tuberculosis
VDTLRRAGERFGFAVESMSLVSEHH

SEQ ID NO: 1467663 - protein, 22 aa, Mycobacterium tuberculosis
VEHPVTCPVPIAHTGDRKPIRS

SEQ ID NO: 1467664 - protein, 19 aa, Mycobacterium tuberculosis
VELRNRLTAVTAVTLPATA

SEQ ID NO: 1467665 - protein, 22 aa, Mycobacterium tuberculosis
VGARPRGAGMERSDLLEANGAI

SEQ ID NO: 1467666 - protein, 21 aa, Mycobacterium tuberculosis
VGDGEAGSWLLIDTSNAVDTP

SEQ ID NO: 1467667 - protein, 17 aa, Mycobacterium tuberculosis
VGIAAPVIIQFDSPISD

SEQ ID NO: 1467668 - protein, 19 aa, Mycobacterium tuberculosis
VGISSVLKIGRDLYVIDCG

SEQ ID NO: 1467669 - protein, 21 aa, Mycobacterium tuberculosis
VGRMKDMLIVYGRNHYPEDIE

SEQ ID NO: 1467670 - protein, 23 aa, Mycobacterium tuberculosis
VHGFRFFDNRDLLGFVDGTENPS

SEQ ID NO: 1467671 - protein, 19 aa, Mycobacterium tuberculosis
VIRLRFGLDDGQPRTLDQI

SEQ ID NO: 1467672 - protein, 25 aa, Mycobacterium tuberculosis
VITAFNFPVAVWAWNTAVALVCGDT

SEQ ID NO: 1467673 - protein, 19 aa, Mycobacterium tuberculosis
VKLIQPVAMDEGLRFAIRE

SEQ ID NO: 1467674 - protein, 19 aa, Mycobacterium tuberculosis
VKLPNRWPLTDAAGVPVVF

SEQ ID NO: 1467675 - protein, 19 aa, Mycobacterium tuberculosis
VKVWKGIRYAAPPLGDLRF

SEQ ID NO: 1467676 - protein, 17 aa, Mycobacterium tuberculosis
VLTLYGIPHRDCGSYAS

SEQ ID NO: 1467677 - protein, 22 aa, Mycobacterium tuberculosis
VPAFDRTALVTALRADQAGQTS

SEQ ID NO: 1467678 - protein, 21 aa, Mycobacterium tuberculosis
VPVQLVRIGRLYLIGIPGEPT

SEQ ID NO: 1467679 - protein, 18 aa, Mycobacterium tuberculosis
VRHNMPFGEVGKGEYGTY

SEQ ID NO: 1467680 - protein, 18 aa, Mycobacterium tuberculosis
VRLKARLWFVHRGIEKLF

SEQ ID NO: 1467681 - protein, 19 aa, Mycobacterium tuberculosis
VRVIPCLDVDDGRVVKGVN

SEQ ID NO: 1467682 - protein, 19 aa, Mycobacterium tuberculosis
VSAAIAALFSGHGQDYQAL

SEQ ID NO: 1467683 - protein, 18 aa, Mycobacterium tuberculosis
VSVCNAVEFSVHGSQHVA

SEQ ID NO: 1467684 - protein, 19 aa, Mycobacterium tuberculosis
VTGGLFFSPTIDFLDHPPP

SEQ ID NO: 1467685 - protein, 19 aa, Mycobacterium tuberculosis
VTHRTEYRYSDVVTSSYGR

SEQ ID NO: 1467686 - protein, 17 aa, Mycobacterium tuberculosis
VVFPLFPQGGGFPRNND

SEQ ID NO: 1467687 - protein, 20 aa, Mycobacterium tuberculosis
VVLREILRRVELSTTTTSGE

SEQ ID NO: 1467688 - protein, 23 aa, Mycobacterium tuberculosis
VWVTGPGGERWEVYTVLADSETF

SEQ ID NO: 1467689 - protein, 24 aa, Mycobacterium tuberculosis
WDDLLRPGIEVITPSPLSSGSAKW

SEQ ID NO: 1467690 - protein, 17 aa, Mycobacterium tuberculosis
WDGLAMELASAAASFGS

SEQ ID NO: 1467691 - protein, 20 aa, Mycobacterium tuberculosis
WDLGDAHGTVMLRMPLHPVA

SEQ ID NO: 1467692 - protein, 21 aa, Mycobacterium tuberculosis
WEKTIPNWFFEPDIAADIVGN

SEQ ID NO: 1467693 - protein, 17 aa, Mycobacterium tuberculosis
WGAHYAITVPQIPLLNF

SEQ ID NO: 1467694 - protein, 19 aa, Mycobacterium tuberculosis
WKAPPPIAHSTVLVAPVSP

SEQ ID NO: 1467695 - protein, 19 aa, Mycobacterium tuberculosis
WPPPCNIRIVGRSAAAAPR

SEQ ID NO: 1467696 - protein, 18 aa, Mycobacterium tuberculosis
WRAETLGDDIAWMRFGKD

SEQ ID NO: 1467697 - protein, 21 aa, Mycobacterium tuberculosis
WRSTPAPVRGALVARLGELLT

SEQ ID NO: 1467698 - protein, 22 aa, Mycobacterium tuberculosis
WSMPLIRPNGRMLAIKGERAHD

SEQ ID NO: 1467699 - protein, 18 aa, Mycobacterium tuberculosis
WTCMIPRQVAEELGQPLP

SEQ ID NO: 1467700 - protein, 23 aa, Mycobacterium tuberculosis
WTSSGAIGPTWYSVGRIYNAGDL

SEQ ID NO: 1467701 - protein, 17 aa, Mycobacterium tuberculosis
YCELDFTTPLELAVATI

SEQ ID NO: 1467702 - protein, 20 aa, Mycobacterium tuberculosis
YDAGERWPDAQIVSMRDVAA

SEQ ID NO: 1467703 - protein, 17 aa, Mycobacterium tuberculosis
YDISIAGAHVVVIGRGV

SEQ ID NO: 1467704 - protein, 19 aa, Mycobacterium tuberculosis
YGQHVALDFVGRIRGQKKF

SEQ ID NO: 1467705 - protein, 17 aa, Mycobacterium tuberculosis
YHLWRYGLDGRLRGAPH

SEQ ID NO: 1467706 - protein, 24 aa, Mycobacterium tuberculosis
YIPFKGCVKHVSVTIPITTEHLGP

SEQ ID NO: 1467707 - protein, 41 aa, Mycobacterium tuberculosis; identical to SEQ ID NO: 1379747

SEQ ID NO: 1467708 - protein, 18 aa, Mycobacterium tuberculosis
YRSTLRGFFVWAYEMDRV

SEQ ID NO: 1467709 - protein, 27 aa, Mycobacterium tuberculosis
YSLDVPRITILDAHFTGAFGPVVVPPI

SEQ ID NO: 1467710 - protein, 25 aa, Mycobacterium tuberculosis
YTAELAARLERTWQENWARLGTFNV

SEQ ID NO: 1467711 - protein, 18 aa, Mycobacterium tuberculosis
YVAPRLSRRILHQLYLGY

SEQ ID NO: 1467712 - protein, 26 aa, Mycobacterium tuberculosis
AAEILVYGHVPFELVSYVCCYNTETM

SEQ ID NO: 1467713 - protein, 17 aa, Mycobacterium tuberculosis
AAKVLEDLGWYVADNLP

SEQ ID NO: 1467714 - protein, 21 aa, Mycobacterium tuberculosis
AAKVWICKPVIPKPRGWSNVS

SEQ ID NO: 1467715 - protein, 18 aa, Mycobacterium tuberculosis
AALERRTGELAHELGQAA

SEQ ID NO: 1467716 - protein, 19 aa, Mycobacterium tuberculosis
AAQFIRYEKPRSWLNSGGL

SEQ ID NO: 1467717 - protein, 19 aa, Mycobacterium tuberculosis
AARILLRSGKPVFLAANKV

SEQ ID NO: 1467718 - protein, 26 aa, Mycobacterium tuberculosis
AATDMPGRFVVAAAMVRHLLTDPMLP

SEQ ID NO: 1467719 - protein, 19 aa, Mycobacterium tuberculosis
ACGKMYTRRGTFLEHAGDF

SEQ ID NO: 1467720 - protein, 17 aa, Mycobacterium tuberculosis
ADAFGHAGGCPHPLVVV

SEQ ID NO: 1467721 - protein, 23 aa, Mycobacterium tuberculosis
ADERLRSGVPLGEVVDYLGIPAS

SEQ ID NO: 1467722 - protein, 20 aa, Mycobacterium tuberculosis
ADIGARCELLSGARVWPGVF

SEQ ID NO: 1467723 - protein, 21 aa, Mycobacterium tuberculosis
ADIGARCELLSGARVWPGVFL

SEQ ID NO: 1467724 - protein, 17 aa, Mycobacterium tuberculosis
ADIPYLLIRNHKNRPVL

SEQ ID NO: 1467725 - protein, 18 aa, Mycobacterium tuberculosis
ADVSIIFVPPTFAKDAII

SEQ ID NO: 1467726 - protein, 18 aa, Mycobacterium tuberculosis
AEALLRWEHPTLGTLLPG

SEQ ID NO: 1467727 - protein, 21 aa, Mycobacterium tuberculosis
AEIAPQWHLRMQAAVQRHVEA

SEQ ID NO: 1467728 - protein, 17 aa, Mycobacterium tuberculosis
AELEPDFQRAYKELAKQ

SEQ ID NO: 1467729 - protein, 19 aa, Mycobacterium tuberculosis
AELLRPLLELVPVHDVAFG

SEQ ID NO: 1467730 - protein, 24 aa, Mycobacterium tuberculosis
AEMRIDPFEMWTQGTNGLGITFYS

SEQ ID NO: 1467731 - protein, 17 aa, Mycobacterium tuberculosis
AFAEEYGLPIAIKAAHG

SEQ ID NO: 1467732 - protein, 24 aa, Mycobacterium tuberculosis
AFGIPEVKRGLVAGGGGLLRLPER

SEQ ID NO: 1467733 - protein, 19 aa, Mycobacterium tuberculosis
AFYERLRELFAARKSITTF

SEQ ID NO: 1467734 - protein, 19 aa, Mycobacterium tuberculosis
AGGSVRWDPTNGQGRVYYG

SEQ ID NO: 1467735 - protein, 23 aa, Mycobacterium tuberculosis
AGHSRWLSAEAMAARLNDVGVGR

SEQ ID NO: 1467736 - protein, 17 aa, Mycobacterium tuberculosis
AGIAAAVHAGRAGAQRG

SEQ ID NO: 1467737 - protein, 17 aa, Mycobacterium tuberculosis
AGLAARGGSAPTPAAAA

SEQ ID NO: 1467738 - protein, 17 aa, Mycobacterium tuberculosis
AGLAMLAPIWGYAPLLD

SEQ ID NO: 1467739 - protein, 18 aa, Mycobacterium tuberculosis
AGLAMLAPIWGYAPLLDI

SEQ ID NO: 1467740 - protein, 17 aa, Mycobacterium tuberculosis
AGLRAAGRVAGLIGTIG

SEQ ID NO: 1467741 - protein, 25 aa, Mycobacterium tuberculosis
AGLSHPMGPLRLSDLVGLDTLKLIA

SEQ ID NO: 1467742 - protein, 17 aa, Mycobacterium tuberculosis
AGLTLALAADWRVSGDN

SEQ ID NO: 1467743 - protein, 18 aa, Mycobacterium tuberculosis
AGNWKRWYDNNIPIADQR

SEQ ID NO: 1467744 - protein, 18 aa, Mycobacterium tuberculosis
AGPDRIAQILAELATLFG

SEQ ID NO: 1467745 - protein, 18 aa, Mycobacterium tuberculosis
AGQACLAHALAHRGDTEA

SEQ ID NO: 1467746 - protein, 24 aa, Mycobacterium tuberculosis
AGQLGRPIGFRGLAGGCPVSPLGY

SEQ ID NO: 1467747 - protein, 18 aa, Mycobacterium tuberculosis
AGSNNWGLANLGVGNIGL

SEQ ID NO: 1467748 - protein, 20 aa, Mycobacterium tuberculosis
AGTSGWWNQGHDVLAGAGSG

SEQ ID NO: 1467749 - protein, 17 aa, Mycobacterium tuberculosis
AGVFWSELSSGGVVIAG

SEQ ID NO: 1467750 - protein, 25 aa, Mycobacterium tuberculosis
AGVTYWRKAAQLKRNEANDLRNERS

SEQ ID NO: 1467751 - protein, 21 aa, Mycobacterium tuberculosis
AHTFPATRFLGAGAAMSLLPE

SEQ ID NO: 1467752 - protein, 19 aa, Mycobacterium tuberculosis
AILANRLSPALTFGGANLN

SEQ ID NO: 1467753 - protein, 24 aa, Mycobacterium tuberculosis
AIRALRESRDWSLADLAAATGVST

SEQ ID NO: 1467754 - protein, 17 aa, Mycobacterium tuberculosis
AKAFSAWSPTRSTRGGR

SEQ ID NO: 1467755 - protein, 17 aa, Mycobacterium tuberculosis
AKMWKKSMTVRELWVSV

SEQ ID NO: 1467756 - protein, 26 aa, Mycobacterium tuberculosis
ALADHARLDFLAGLRVVPAELGGAAG

SEQ ID NO: 1467757 - protein, 22 aa, Mycobacterium tuberculosis
ALAGGARPGGRVMFYDDVAPVA

SEQ ID NO: 1467758 - protein, 17 aa, Mycobacterium tuberculosis
ALHGPCDTNAFAAAITD

SEQ ID NO: 1467759 - protein, 21 aa, Mycobacterium tuberculosis
ALRAICPWEGFTDAYRDLAFP

SEQ ID NO: 1467760 - protein, 27 aa, Mycobacterium tuberculosis
AMPNRLVRSLQRWRPFGLPPHRWRLAP

SEQ ID NO: 1467761 - protein, 21 aa, Mycobacterium tuberculosis
APLDRVCMIDGLRIIVLDTSV

SEQ ID NO: 1467762 - protein, 19 aa, Mycobacterium tuberculosis
APPDKIWTLIADVRNTGRF

SEQ ID NO: 1467763 - protein, 22 aa, Mycobacterium tuberculosis
ARALTPPALVARVVEALRDGYA

SEQ ID NO: 1467764 - protein, 23 aa, Mycobacterium tuberculosis
ARALTPPALVARVVEALRDGYAA

SEQ ID NO: 1467765 - protein, 25 aa, Mycobacterium tuberculosis
ARFNKPGTFPLRFQTEVRDGCPSDC

SEQ ID NO: 1467766 - protein, 21 aa, Mycobacterium tuberculosis
ARIAGRPAAVLLHLGPGLGNG

SEQ ID NO: 1467767 - protein, 18 aa, Mycobacterium tuberculosis
ARIGREAMLDQIVNDALP

SEQ ID NO: 1467768 - protein, 17 aa, Mycobacterium tuberculosis
ARLNRLFDTVYPPGRGP

SEQ ID NO: 1467769 - protein, 19 aa, Mycobacterium tuberculosis
ARSLLQCAALHDLVDVVLS

SEQ ID NO: 1467770 - protein, 17 aa, Mycobacterium tuberculosis
ARSVKWVTAITVQPGAS

SEQ ID NO: 1467771 - protein, 27 aa, Mycobacterium tuberculosis
ARVLRPGGRLGLVWNTRDERLGWVREL

SEQ ID NO: 1467772 - protein, 27 aa, Mycobacterium tuberculosis
ASLHAAKGLEWDAVFLVGLADGTLPIS

SEQ ID NO: 1467773 - protein, 17 aa, Mycobacterium tuberculosis
ASPRRALSELLRRGTRN

SEQ ID NO: 1467774 - protein, 21 aa, Mycobacterium tuberculosis
ASTICDPGFLVLVEGVLGETG

SEQ ID NO: 1467775 - protein, 30 aa, Mycobacterium tuberculosis
ASTVFPQTFYLSGLFFFGPVNLSASTLTVP

SEQ ID NO: 1467776 - protein, 21 aa, Mycobacterium tuberculosis
ATLPAAAWQRCRTHYAANHGR

SEQ ID NO: 1467777 - protein, 18 aa, Mycobacterium tuberculosis
ATRVPFVIARIGEKATQP

SEQ ID NO: 1467778 - protein, 22 aa, Mycobacterium tuberculosis
AVRGWRTGDIRPERYDRLAQLR

SEQ ID NO: 1467779 - protein, 17 aa, Mycobacterium tuberculosis
AWPTIRRDGSYDAGERW

SEQ ID NO: 1467780 - protein, 18 aa, Mycobacterium tuberculosis
AWVHGWVQGVGFRWWTRC

SEQ ID NO: 1467781 - protein, 21 aa, Mycobacterium tuberculosis
CGKAIRPALVFVAAEAAGADP

SEQ ID NO: 1467782 - protein, 19 aa, Mycobacterium tuberculosis
CHDGYRWLRLLGYEPEQIV

SEQ ID NO: 1467783 - protein, 22 aa, Mycobacterium tuberculosis
CYEEAHRACLIIGRRDAVVHDV

SEQ ID NO: 1467784 - protein, 18 aa, Mycobacterium tuberculosis
DAAVHFVQRHCETGNSVV

SEQ ID NO: 1467785 - protein, 21 aa, Mycobacterium tuberculosis
DDCHDGYRWLRLLGYEPEQIV

SEQ ID NO: 1467786 - protein, 22 aa, Mycobacterium tuberculosis
DDLKLCSSMTLFARATDANQDF

SEQ ID NO: 1467787 - protein, 27 aa, Mycobacterium tuberculosis
DDPLAMYLFDLCTLPLNLAGHCGMSVP

SEQ ID NO: 1467788 - protein, 23 aa, Mycobacterium tuberculosis
DEDRELLESFDLSYGEDEGGEED

SEQ ID NO: 1467789 - protein, 33 aa, Mycobacterium tuberculosis; identical to SEQ ID NO: 197686

SEQ ID NO: 1467790 - protein, 20 aa, Mycobacterium tuberculosis
DEIGSGLAVFHPKGGIVRRE

SEQ ID NO: 1467791 - protein, 22 aa, Mycobacterium tuberculosis
DEVSAAVAALFGAHGQTYQVLS

SEQ ID NO: 1467792 - protein, 20 aa, Mycobacterium tuberculosis
DEVVFGWRSFELYPPQVRVA

SEQ ID NO: 1467793 - protein, 23 aa, Mycobacterium tuberculosis
DGGLLLPLGVRRLRSYGSARHAR

SEQ ID NO: 1467794 - protein, 17 aa, Mycobacterium tuberculosis
DGTHTEWIEASRANDFG

SEQ ID NO: 1467795 - protein, 21 aa, Mycobacterium tuberculosis
DIKAPLLAALGAADLALATVN

SEQ ID NO: 1467796 - protein, 23 aa, Mycobacterium tuberculosis
DKVGNVDALFLFDVLLHQVSPDW

SEQ ID NO: 1467797 - protein, 24 aa, Mycobacterium tuberculosis
DLLTGWRDAWELGRAARDNSLRLL

SEQ ID NO: 1467798 - protein, 19 aa, Mycobacterium tuberculosis
DLPRMSAAIAEPTSHDPDS

SEQ ID NO: 1467799 - protein, 23 aa, Mycobacterium tuberculosis
DNKRFKVVWQVLNALRSHDERFD

SEQ ID NO: 1467800 - protein, 18 aa, Mycobacterium tuberculosis
DNLERVWAPKATGALRMH

SEQ ID NO: 1467801 - protein, 22 aa, Mycobacterium tuberculosis
DNQQGFNFAGGWNSGSGNSGLF

SEQ ID NO: 1467802 - protein, 25 aa, Mycobacterium tuberculosis
DPHMRPVVSYHLGWSDERGRPVNNN

SEQ ID NO: 1467803 - protein, 19 aa, Mycobacterium tuberculosis
DPHPELLRGWDLATTADGL

SEQ ID NO: 1467804 - protein, 25 aa, Mycobacterium tuberculosis
DPKAVPSRLAWEAGVALADSLLARY

SEQ ID NO: 1467805 - protein, 28 aa, Mycobacterium tuberculosis
DPKTAVLNWKGDQVIVFVELSGSGARYG

SEQ ID NO: 1467806 - protein, 23 aa, Mycobacterium tuberculosis
DPQMLRYFASIGISLDSRLRVLA

SEQ ID NO: 1467807 - protein, 25 aa, Mycobacterium tuberculosis
DPVRNDFRAVISLDMRRFDRLHRID

SEQ ID NO: 1467808 - protein, 19 aa, Mycobacterium tuberculosis
DQMLAYNLSPSFNWDTTGM

SEQ ID NO: 1467809 - protein, 20 aa, Mycobacterium tuberculosis
DQMLAYNLSPSFNWDTTGMT

SEQ ID NO: 1467810 - protein, 25 aa, Mycobacterium tuberculosis
DRGMPVLGICNGFQVLCEAGLLPGA

SEQ ID NO: 1467811 - protein, 18 aa, Mycobacterium tuberculosis
DRPEPVSVMTAAAQGFVS

SEQ ID NO: 1467812 - protein, 28 aa, Mycobacterium tuberculosis
DRRDAIRHAVAWARPGDVVLIAGKGHET

SEQ ID NO: 1467813 - protein, 20 aa, Mycobacterium tuberculosis
DSAGDLGDWGGPDALADLDP

SEQ ID NO: 1467814 - protein, 18 aa, Mycobacterium tuberculosis
DSRFEHLVGYPFAPHYVD

SEQ ID NO: 1467815 - protein, 22 aa, Mycobacterium tuberculosis
DVMPEDLIKFGLIPEFIGRLPV

SEQ ID NO: 1467816 - protein, 23 aa, Mycobacterium tuberculosis
EAAELHEIYKLGVVSIPTNMPMI

SEQ ID NO: 1467817 - protein, 24 aa, Mycobacterium tuberculosis
EAGRAGVFRPLWAHDRTAERQALT

SEQ ID NO: 1467818 - protein, 21 aa, Mycobacterium tuberculosis
EAIRASGLSAGIVDAGLSRGL

SEQ ID NO: 1467819 - protein, 20 aa, Mycobacterium tuberculosis
EAKIKLSDMRSGRMSDDDWT

SEQ ID NO: 1467820 - protein, 19 aa, Mycobacterium tuberculosis
EATFFNFEFPRNGFQLRRP

SEQ ID NO: 1467821 - protein, 19 aa, Mycobacterium tuberculosis
EATRVPFVIARIGEKATQP

SEQ ID NO: 1467822 - protein, 22 aa, Mycobacterium tuberculosis
EAYADMPLFLFHLLEYMDVDYE

SEQ ID NO: 1467823 - protein, 21 aa, Mycobacterium tuberculosis
EDAGRCQRGYFIESLGGAQFA

SEQ ID NO: 1467824 - protein, 23 aa, Mycobacterium tuberculosis
EDGEKRIPLDVAEGDTVIYSKYG

SEQ ID NO: 1467825 - protein, 17 aa, Mycobacterium tuberculosis
EGAALGAAFLGRLAAGL

SEQ ID NO: 1467826 - protein, 19 aa, Mycobacterium tuberculosis
EIGSGLAVFHPKGGIVRRE

SEQ ID NO: 1467827 - protein, 17 aa, Mycobacterium tuberculosis
EIKFRSVLEEPTYEDGI

SEQ ID NO: 1467828 - protein, 20 aa, Mycobacterium tuberculosis
EINSALIFAGAGSGPMLAAA

SEQ ID NO: 1467829 - protein, 18 aa, Mycobacterium tuberculosis
EIVDKWRAAGVRMVDERD

SEQ ID NO: 1467830 - protein, 21 aa, Mycobacterium tuberculosis
EKAYGAGPCSGHLTDIEHFVF

SEQ ID NO: 1467831 - protein, 18 aa, Mycobacterium tuberculosis
ELPHEVHRLRALIVELER

SEQ ID NO: 1467832 - protein, 20 aa, Mycobacterium tuberculosis
ELVFPLQVVINLSDPETDYT

SEQ ID NO: 1467833 - protein, 18 aa, Mycobacterium tuberculosis
EQIDRGQGFLALVDYAHK

SEQ ID NO: 1467834 - protein, 18 aa, Mycobacterium tuberculosis
ERSAWAAVDAHPEGVSVL

SEQ ID NO: 1467835 - protein, 18 aa, Mycobacterium tuberculosis
ERVVFVLHEIFGLPYQQI

SEQ ID NO: 1467836 - protein, 17 aa, Mycobacterium tuberculosis
ESLRVAGGFTLDGLGGW

SEQ ID NO: 1467837 - protein, 20 aa, Mycobacterium tuberculosis
EVCRTCSWNHLVKSYVLGAA

SEQ ID NO: 1467838 - protein, 21 aa, Mycobacterium tuberculosis
EVHRLRALIVELERLYNHAAD

SEQ ID NO: 1467839 - protein, 19 aa, Mycobacterium tuberculosis
EVLNRIACGQSIPAIAAEL

SEQ ID NO: 1467840 - protein, 17 aa, Mycobacterium tuberculosis
EVSEFSRHLKLLAKELE

SEQ ID NO: 1467841 - protein, 21 aa, Mycobacterium tuberculosis
EVSTAIAALFGSHGQHYQAIS

SEQ ID NO: 1467842 - protein, 18 aa, Mycobacterium tuberculosis
FAGLAGLANRIVDAVDSL

SEQ ID NO: 1467843 - protein, 18 aa, Mycobacterium tuberculosis
FDDARPVLERASARETAA

SEQ ID NO: 1467844 - protein, 19 aa, Mycobacterium tuberculosis
FDTRRGMVVGSPVDLVDGI

SEQ ID NO: 1467845 - protein, 23 aa, Mycobacterium tuberculosis
FGIPEVKRGLVAGGGGLLRLPER

SEQ ID NO: 1467846 - protein, 27 aa, Mycobacterium tuberculosis
FIAAEFAHVFSALGVRVTLVIRGSCLL

SEQ ID NO: 1467847 - protein, 21 aa, Mycobacterium tuberculosis
FLDGQCLFGPVLVDPPAGPAA

SEQ ID NO: 1467848 - protein, 19 aa, Mycobacterium tuberculosis
FLEKEQRIIAALRAAADSP

SEQ ID NO: 1467849 - protein, 31 aa, Mycobacterium tuberculosis
FMTGDYSNGLLWRGGYEGLVGVRVGPTISQF

SEQ ID NO: 1467850 - protein, 42 aa, Mycobacterium tuberculosis; identical to SEQ ID NO: 660401

SEQ ID NO: 1467851 - protein, 22 aa, Mycobacterium tuberculosis
FPVLPPEINSVLMYSGAGSSPL

SEQ ID NO: 1467852 - protein, 19 aa, Mycobacterium tuberculosis
FQLDIMRVPGIIVARTDAE

SEQ ID NO: 1467853 - protein, 17 aa, Mycobacterium tuberculosis
FSWKNTGQILADEGHHV

SEQ ID NO: 1467854 - protein, 17 aa, Mycobacterium tuberculosis
FTRMMAGLGEALGFDVD

SEQ ID NO: 1467855 - protein, 28 aa, Mycobacterium tuberculosis
FVLAPWQIHDWILLTPWGLLSWPQINQQ

SEQ ID NO: 1467856 - protein, 17 aa, Mycobacterium tuberculosis
FYERLRELFAARKSITT

SEQ ID NO: 1467857 - protein, 25 aa, Mycobacterium tuberculosis
GADEVSVAISALFGSHAQGYQTLSA

SEQ ID NO: 1467858 - protein, 25 aa, Mycobacterium tuberculosis
GALKFPSLHASPPMLAGKHIWEVSN

SEQ ID NO: 1467859 - protein, 23 aa, Mycobacterium tuberculosis
GANYKRLPLGVFTEASESLTNDF

SEQ ID NO: 1467860 - protein, 26 aa, Mycobacterium tuberculosis
GATSDFWCDAEWAGLRGPVAAGLGRA

SEQ ID NO: 1467861 - protein, 19 aa, Mycobacterium tuberculosis
GDIGISHVVFKPGTIEQIR

SEQ ID NO: 1467862 - protein, 18 aa, Mycobacterium tuberculosis
GDLPEVGGRVTSPPQPPV

SEQ ID NO: 1467863 - protein, 22 aa, Mycobacterium tuberculosis
GDPVALRAFRRGAAALAAMIAS

SEQ ID NO: 1467864 - protein, 19 aa, Mycobacterium tuberculosis
GDVALLRLSFGRFGDEPAL

SEQ ID NO: 1467865 - protein, 26 aa, Mycobacterium tuberculosis
GELMRSGERPMVWSLDERLRMVARPM

SEQ ID NO: 1467866 - protein, 27 aa, Mycobacterium tuberculosis
GEQRWLADHVIAGVVLLAGAAFVELAL

SEQ ID NO: 1467867 - protein, 26 aa, Mycobacterium tuberculosis
GFGLTSGLFPFHFTLNGGIGPISIPT

SEQ ID NO: 1467868 - protein, 27 aa, Mycobacterium tuberculosis
GGADALRYPARYLFVFLDHHGMLSVFG

SEQ ID NO: 1467869 - protein, 20 aa, Mycobacterium tuberculosis
GGLRRSMAKAGYCDLKEFQK

SEQ ID NO: 1467870 - protein, 19 aa, Mycobacterium tuberculosis
GGTPFRPLFTVLAAQLGSD

SEQ ID NO: 1467871 - protein, 17 aa, Mycobacterium tuberculosis
GIIAAVSTFLARAGANI

SEQ ID NO: 1467872 - protein, 18 aa, Mycobacterium tuberculosis
GLAPRFGVGIVATTGAHF

SEQ ID NO: 1467873 - protein, 17 aa, Mycobacterium tuberculosis
GLLGILGSGSSWLDKLW

SEQ ID NO: 1467874 - protein, 19 aa, Mycobacterium tuberculosis
GLMQLLAATNWFGQNAPAL

SEQ ID NO: 1467875 - protein, 19 aa, Mycobacterium tuberculosis
GLRRSMAKAGYCDLKEFQK

SEQ ID NO: 1467876 - protein, 31 aa, Mycobacterium tuberculosis; identical to SEQ ID NO: 200083

SEQ ID NO: 1467877 - protein, 19 aa, Mycobacterium tuberculosis
GLTIPVLLIRGKLSDVVSS

SEQ ID NO: 1467878 - protein, 17 aa, Mycobacterium tuberculosis
GMADGRAAMLLHVSHAV

SEQ ID NO: 1467879 - protein, 17 aa, Mycobacterium tuberculosis
GNYSNGLFLSGDYQGLV

SEQ ID NO: 1467880 - protein, 18 aa, Mycobacterium tuberculosis
GRKFGGGALSVYIDGRQV

SEQ ID NO: 1467881 - protein, 24 aa, Mycobacterium tuberculosis
GRTLGLAGHAAFERRTLATVAKLL

SEQ ID NO: 1467882 - protein, 31 aa, Mycobacterium tuberculosis; identical to SEQ ID NO: 200397

SEQ ID NO: 1467883 - protein, 19 aa, Mycobacterium tuberculosis
GSGPLVVGVCAEYDALPGI

SEQ ID NO: 1467884 - protein, 17 aa, Mycobacterium tuberculosis
GSQWLGMGRQLYGRYSV

SEQ ID NO: 1467885 - protein, 18 aa, Mycobacterium tuberculosis
GSTIAAIWDDVLDRMSWL

SEQ ID NO: 1467886 - protein, 18 aa, Mycobacterium tuberculosis
GSVCWYAPELGPGTGTVF

SEQ ID NO: 1467887 - protein, 20 aa, Mycobacterium tuberculosis
GTAVQFHFIARLVLVLLDET

SEQ ID NO: 1467888 - protein, 17 aa, Mycobacterium tuberculosis
GTLNTGFFSAMTQAGPN

SEQ ID NO: 1467889 - protein, 17 aa, Mycobacterium tuberculosis
GVAACPEMALILEEDDA

SEQ ID NO: 1467890 - protein, 25 aa, Mycobacterium tuberculosis
GVGGKGGASGMLIGNGGNGGSGGVG

SEQ ID NO: 1467891 - protein, 26 aa, Mycobacterium tuberculosis
GVSQRKAAVVARDLLEKVGMADRERT

SEQ ID NO: 1467892 - protein, 20 aa, Mycobacterium tuberculosis
GYEPMGGDALAYATYTSGTT

SEQ ID NO: 1467893 - protein, 17 aa, Mycobacterium tuberculosis
HADCAKVGITSIRRDLP

SEQ ID NO: 1467894 - protein, 17 aa, Mycobacterium tuberculosis
HAVTYGWLLSGLARAVT

SEQ ID NO: 1467895 - protein, 21 aa, Mycobacterium tuberculosis
HEFWPDALSFAGVEVAGVVGH

SEQ ID NO: 1467896 - protein, 17 aa, Mycobacterium tuberculosis
HGARKGLADTALRTADS

SEQ ID NO: 1467897 - protein, 19 aa, Mycobacterium tuberculosis
HGTVLLAVCGLRIGTGVSE

SEQ ID NO: 1467898 - protein, 35 aa, Mycobacterium tuberculosis; identical to SEQ ID NO: 200755

SEQ ID NO: 1467899 - protein, 18 aa, Mycobacterium tuberculosis
HKDARACRNALAEAGIPA

SEQ ID NO: 1467900 - protein, 28 aa, Mycobacterium tuberculosis
HLGQGRVALDWLDRVDVIGHSRSSERFG

SEQ ID NO: 1467901 - protein, 28 aa, Mycobacterium tuberculosis
HLGQGRVALDWLDRVDVIGHSRSSGRFG

SEQ ID NO: 1467902 - protein, 17 aa, Mycobacterium tuberculosis
HPVHIYLQFDGLDEATH

SEQ ID NO: 1467903 - protein, 20 aa, Mycobacterium tuberculosis
HTEWLPPPHLDHGQPRTNTF

SEQ ID NO: 1467904 - protein, 17 aa, Mycobacterium tuberculosis
HVVFKPGTIEQIRSVIR

SEQ ID NO: 1467905 - protein, 26 aa, Mycobacterium tuberculosis
IAAEFAHVFSALGVRVTLVIRGSCLL

SEQ ID NO: 1467906 - protein, 17 aa, Mycobacterium tuberculosis
IAAELYVAPSTVKTHVQ

SEQ ID NO: 1467907 - protein, 17 aa, Mycobacterium tuberculosis
IADRTRRPPAFPEDIWV

SEQ ID NO: 1467908 - protein, 17 aa, Mycobacterium tuberculosis
IAELVLRQQAQHCEIET

SEQ ID NO: 1467909 - protein, 23 aa, Mycobacterium tuberculosis
IAGEDVARLFALVQVVADEHLAD

SEQ ID NO: 1467910 - protein, 17 aa, Mycobacterium tuberculosis
IAMAGAPGFEADDVLGT

SEQ ID NO: 1467911 - protein, 19 aa, Mycobacterium tuberculosis
IAPQHWRLTVGGLVDNPLT

SEQ ID NO: 1467912 - protein, 18 aa, Mycobacterium tuberculosis
IAQPRAGASTAWVPSPTA

SEQ ID NO: 1467913 - protein, 18 aa, Mycobacterium tuberculosis
IARSRRRVRVEYRGDGGG

SEQ ID NO: 1467914 - protein, 26 aa, Mycobacterium tuberculosis
IDLVPEYIGNLLLYFQPDATVTMLDA

SEQ ID NO: 1467915 - protein, 21 aa, Mycobacterium tuberculosis
IDQAAAVAILQSWLDERLAAM

SEQ ID NO: 1467916 - protein, 18 aa, Mycobacterium tuberculosis
IDWQAYFHLRNRLVVAAM

SEQ ID NO: 1467917 - protein, 21 aa, Mycobacterium tuberculosis
IFRSAAPVWRHDPAPTVLNAH

SEQ ID NO: 1467918 - protein, 18 aa, Mycobacterium tuberculosis
IGATMSAYATAWVGDSPL

SEQ ID NO: 1467919 - protein, 28 aa, Mycobacterium tuberculosis
IGRMSGVPPSVWGGLAAARFQDVVDRWN

SEQ ID NO: 1467920 - protein, 23 aa, Mycobacterium tuberculosis
IHVELPLSVTIGPFVSPEITIPQ

SEQ ID NO: 1467921 - protein, 21 aa, Mycobacterium tuberculosis
IKKGVLELADIVVVNKADGEH

SEQ ID NO: 1467922 - protein, 24 aa, Mycobacterium tuberculosis
ILETAYVIDFLAYVYEETRHKVVP

SEQ ID NO: 1467923 - protein, 25 aa, Mycobacterium tuberculosis
ILQHPCALRHGVDLHPRLLVAPVRP

SEQ ID NO: 1467924 - protein, 24 aa, Mycobacterium tuberculosis
IMTPEITTPPFAIDPIGLSGFTLP

SEQ ID NO: 1467925 - protein, 17 aa, Mycobacterium tuberculosis
INLELIDSPTLPTCERI

SEQ ID NO: 1467926 - protein, 18 aa, Mycobacterium tuberculosis
IRYFPTLLPEVSDEDPLA

SEQ ID NO: 1467927 - protein, 20 aa, Mycobacterium tuberculosis
ISVEVGDGWFQRVALTNSAG

SEQ ID NO: 1467928 - protein, 17 aa, Mycobacterium tuberculosis
KDDAIDWQAYFHLRNRL

SEQ ID NO: 1467929 - protein, 18 aa, Mycobacterium tuberculosis
KIKEKLGIGAVVTDDPSN

SEQ ID NO: 1467930 - protein, 31 aa, Mycobacterium tuberculosis
KKLSFETARFIKFIVTEIFPGGRLPSTEMMV

SEQ ID NO: 1467931 - protein, 24 aa, Mycobacterium tuberculosis
KLLYKEDCRGFGWLPNIQNRAFLF

SEQ ID NO: 1467932 - protein, 19 aa, Mycobacterium tuberculosis
KQARISTDIGAPGILDLRR

SEQ ID NO: 1467933 - protein, 20 aa, Mycobacterium tuberculosis
KRFSLEGAESVIPMMDAAID

SEQ ID NO: 1467934 - protein, 21 aa, Mycobacterium tuberculosis
KRIGQVGALAVVLGVGAAVTT

SEQ ID NO: 1467935 - protein, 20 aa, Mycobacterium tuberculosis
KRMGIEAIYLGGWATSAKGS

SEQ ID NO: 1467936 - protein, 17 aa, Mycobacterium tuberculosis
KTAAFAIPMLSKIDITS

SEQ ID NO: 1467937 - protein, 23 aa, Mycobacterium tuberculosis
KTALLRLVGRYGIGEDDVDDLLR

SEQ ID NO: 1467938 - protein, 24 aa, Mycobacterium tuberculosis
KTALLRLVGRYGIGEDDVDDLLRN

SEQ ID NO: 1467939 - protein, 17 aa, Mycobacterium tuberculosis
KTRGFPLGPGYLLDGLP

SEQ ID NO: 1467940 - protein, 18 aa, Mycobacterium tuberculosis
LAAPGSTIAAIWDDVLDR

SEQ ID NO: 1467941 - protein, 19 aa, Mycobacterium tuberculosis
LADAWARRLHIGRSELLRD

SEQ ID NO: 1467942 - protein, 20 aa, Mycobacterium tuberculosis
LADLRESGCLTASTRILRAD

SEQ ID NO: 1467943 - protein, 23 aa, Mycobacterium tuberculosis
LAEPRGYCAGVDRAVETVERALQ

SEQ ID NO: 1467944 - protein, 23 aa, Mycobacterium tuberculosis
LAHPDRRLAVVFGAGGDRDPGKR

SEQ ID NO: 1467945 - protein, 17 aa, Mycobacterium tuberculosis
LAPMLDAAAAWDGLADE

SEQ ID NO: 1467946 - protein, 18 aa, Mycobacterium tuberculosis
LARPRTDFHTEILRMQKA

SEQ ID NO: 1467947 - protein, 21 aa, Mycobacterium tuberculosis
LATRLGRYGIGPKFQHSGGEP

SEQ ID NO: 1467948 - protein, 17 aa, Mycobacterium tuberculosis
LAVGWALELEKLVCGER

SEQ ID NO: 1467949 - protein, 21 aa, Mycobacterium tuberculosis
LDEPWCRTLASHLGHFATTDA

SEQ ID NO: 1467950 - protein, 18 aa, Mycobacterium tuberculosis
LDQSVSLLHLQLILREGG

SEQ ID NO: 1467951 - protein, 23 aa, Mycobacterium tuberculosis
LDRHLRLPLRDVIWGADADLLDS

SEQ ID NO: 1467952 - protein, 24 aa, Mycobacterium tuberculosis
LDSPELIRLAPRPAARTDPMLLAW

SEQ ID NO: 1467953 - protein, 30 aa, Mycobacterium tuberculosis
LDSRLRVLARREFAGMISVAIDSADGATVD

SEQ ID NO: 1467954 - protein, 17 aa, Mycobacterium tuberculosis
LDVLRAALPQTVALLGT

SEQ ID NO: 1467955 - protein, 23 aa, Mycobacterium tuberculosis
LELIDSPTLPTCERIAVLSQSGV

SEQ ID NO: 1467956 - protein, 18 aa, Mycobacterium tuberculosis
LEPPRFCAQCGRRMVVQV

SEQ ID NO: 1467957 - protein, 19 aa, Mycobacterium tuberculosis
LEPPRFCAQCGRRMVVQVR

SEQ ID NO: 1467958 - protein, 22 aa, Mycobacterium tuberculosis
LGGFERRGRWNVPKKLTTFTLW

SEQ ID NO: 1467959 - protein, 27 aa, Mycobacterium tuberculosis
LGGGFARYSVDGAWVVPHFEKMLYDNA

SEQ ID NO: 1467960 - protein, 26 aa, Mycobacterium tuberculosis
LGNFLSRSGAVGVLGIGPNNGFPGTS

SEQ ID NO: 1467961 - protein, 18 aa, Mycobacterium tuberculosis
LHRIVVNACLDRLRRAKA

SEQ ID NO: 1467962 - protein, 18 aa, Mycobacterium tuberculosis
LIEPGVRTGIPLLVDNPK

SEQ ID NO: 1467963 - protein, 24 aa, Mycobacterium tuberculosis
LLAEPRGYCAGVDRAVETVERALQ

SEQ ID NO: 1467964 - protein, 17 aa, Mycobacterium tuberculosis
LLRRKLVNAGFTRKRVK

SEQ ID NO: 1467965 - protein, 17 aa, Mycobacterium tuberculosis
LLVPYLLSAIRMVEAGF

SEQ ID NO: 1467966 - protein, 17 aa, Mycobacterium tuberculosis
LLVSARSLLQCAALHDL

SEQ ID NO: 1467967 - protein, 17 aa, Mycobacterium tuberculosis
LMAARKGRMVEMANHTT

SEQ ID NO: 1467968 - protein, 25 aa, Mycobacterium tuberculosis
LMMSLNMLIEFGDAFDYSAADFRGW

SEQ ID NO: 1467969 - protein, 19 aa, Mycobacterium tuberculosis
LPAAWAYKRFRDLDDKESY

SEQ ID NO: 1467970 - protein, 19 aa, Mycobacterium tuberculosis
LPDPGIEALAHTKIASTIS

SEQ ID NO: 1467971 - protein, 18 aa, Mycobacterium tuberculosis
LPEFPRLWAEMVGPGQGW

SEQ ID NO: 1467972 - protein, 20 aa, Mycobacterium tuberculosis
LPGYALPLFVRVVGSLAHTT

SEQ ID NO: 1467973 - protein, 17 aa, Mycobacterium tuberculosis
LPLGLALSNGIPPVDIP

SEQ ID NO: 1467974 - protein, 17 aa, Mycobacterium tuberculosis
LPLTKRLAEQVAKQARD

SEQ ID NO: 1467975 - protein, 17 aa, Mycobacterium tuberculosis
LPLTSLTSAAERGPGQM

SEQ ID NO: 1467976 - protein, 21 aa, Mycobacterium tuberculosis
LPNRLYWLSATIDPDGQNGGP

SEQ ID NO: 1467977 - protein, 18 aa, Mycobacterium tuberculosis
LPSRVWRAVREARDVLDD

SEQ ID NO: 1467978 - protein, 32 aa, Mycobacterium tuberculosis; identical to SEQ ID NO: 209726

SEQ ID NO: 1467979 - protein, 20 aa, Mycobacterium tuberculosis
LRLVDLCERLGLAKSTTRRL

SEQ ID NO: 1467980 - protein, 19 aa, Mycobacterium tuberculosis
LRMFTGAGSAPMLAASVAW

SEQ ID NO: 1467981 - protein, 21 aa, Mycobacterium tuberculosis
LRPGDFYRPAHQNVYDAILDL

SEQ ID NO: 1467982 - protein, 21 aa, Mycobacterium tuberculosis
LRVPPYAGPPMWFHGDLSRFN

SEQ ID NO: 1467983 - protein, 26 aa, Mycobacterium tuberculosis
LSPLAPLRGGYIADITPLGGGATGGI

SEQ ID NO: 1467984 - protein, 17 aa, Mycobacterium tuberculosis
LSVVDVLLGSQVVNILW

SEQ ID NO: 1467985 - protein, 17 aa, Mycobacterium tuberculosis
LTNYRLVTLRGEGGVGK

SEQ ID NO: 1467986 - protein, 18 aa, Mycobacterium tuberculosis
LVAFAERSRFFEVFSSSN

SEQ ID NO: 1467987 - protein, 24 aa, Mycobacterium tuberculosis
LVAIWRRGSELFAEVVAPGEAGVA

SEQ ID NO: 1467988 - protein, 17 aa, Mycobacterium tuberculosis
LVHPAPRGVLGGLAATV

SEQ ID NO: 1467989 - protein, 18 aa, Mycobacterium tuberculosis
MAPIPSLLAVAGVHHHLV

SEQ ID NO: 1467990 - protein, 19 aa, Mycobacterium tuberculosis
MDGNGRWATQRGLARTEGH

SEQ ID NO: 1467991 - protein, 17 aa, Mycobacterium tuberculosis
MFVRMLKLPEAVRNSYD

SEQ ID NO: 1467992 - protein, 18 aa, Mycobacterium tuberculosis
MGRPEYPTPVGSYTVLSK

SEQ ID NO: 1467993 - protein, 19 aa, Mycobacterium tuberculosis
MPRKPGGDLARLPSRVWRA

SEQ ID NO: 1467994 - protein, 17 aa, Mycobacterium tuberculosis
MRTTLGVRHWQLEGRIG

SEQ ID NO: 1467995 - protein, 35 aa, Mycobacterium tuberculosis; identical to SEQ ID NO: 203440

SEQ ID NO: 1467996 - protein, 18 aa, Mycobacterium tuberculosis
MTGFGGWNSGTGNIGLFN

SEQ ID NO: 1467997 - protein, 17 aa, Mycobacterium tuberculosis
MYRELLELVAADVESGG

SEQ ID NO: 1467998 - protein, 18 aa, Mycobacterium tuberculosis
MYVGLLLILRRPRAGLSY

SEQ ID NO: 1467999 - protein, 17 aa, Mycobacterium tuberculosis
NEAFKIDTQIGIKVFLS

SEQ ID NO: 1468000 - protein, 22 aa, Mycobacterium tuberculosis
NFRDVVAALGMYPGQAPPLGAE

SEQ ID NO: 1468001 - protein, 21 aa, Mycobacterium tuberculosis
NGDKLSVAKGMMLRRDPDREA

SEQ ID NO: 1468002 - protein, 17 aa, Mycobacterium tuberculosis
NGIGTGISASDRATTMR

SEQ ID NO: 1468003 - protein, 17 aa, Mycobacterium tuberculosis
NIIVPGLTVSGQILVTP

SEQ ID NO: 1468004 - protein, 17 aa, Mycobacterium tuberculosis
NTSAAVMLRRCETCAAD

SEQ ID NO: 1468005 - protein, 18 aa, Mycobacterium tuberculosis
NWPALPVAMADTIVPDFP

SEQ ID NO: 1468006 - protein, 25 aa, Mycobacterium tuberculosis
PALGERLRVLDGWRERGHGDFRDIR

SEQ ID NO: 1468007 - protein, 18 aa, Mycobacterium tuberculosis
PAVPNGQPVKGRLTVPPS

SEQ ID NO: 1468008 - protein, 23 aa, Mycobacterium tuberculosis
PCYEEAHRACLIIGRRDAVVHDV

SEQ ID NO: 1468009 - protein, 18 aa, Mycobacterium tuberculosis
PDKPWFSYVCPGAGHAPH

SEQ ID NO: 1468010 - protein, 18 aa, Mycobacterium tuberculosis
PEALGGLGGAASSQLLPA

SEQ ID NO: 1468011 - protein, 26 aa, Mycobacterium tuberculosis
PELLPGDGAQAFACSRKHGWEGVIAK

SEQ ID NO: 1468012 - protein, 18 aa, Mycobacterium tuberculosis
PEPISYTALDRGDLQRAM

SEQ ID NO: 1468013 - protein, 33 aa, Mycobacterium tuberculosis; identical to SEQ ID NO: 203981

SEQ ID NO: 1468014 - protein, 34 aa, Mycobacterium tuberculosis; identical to SEQ ID NO: 707444

SEQ ID NO: 1468015 - protein, 21 aa, Mycobacterium tuberculosis
PFPLAPMQHAMWVGRHDHQQL

SEQ ID NO: 1468016 - protein, 33 aa, Mycobacterium tuberculosis
PGFTIPGGTLIPQLPLGLGLSGGTPPFDLPTVV

SEQ ID NO: 1468017 - protein, 17 aa, Mycobacterium tuberculosis
PGHPVHIYLQFDGLDEA

SEQ ID NO: 1468018 - protein, 18 aa, Mycobacterium tuberculosis
PGIIAAVSTFLARAGANI

SEQ ID NO: 1468019 - protein, 24 aa, Mycobacterium tuberculosis
PGLLTLDGTNTWVLRGPLSDELVV

SEQ ID NO: 1468020 - protein, 20 aa, Mycobacterium tuberculosis
PGPRAQFLTALAGVMRPGDS

SEQ ID NO: 1468021 - protein, 17 aa, Mycobacterium tuberculosis
PGQGDFLIRGLLGADPT

SEQ ID NO: 1468022 - protein, 19 aa, Mycobacterium tuberculosis
PGSVCWYAPELGPGTGTVF

SEQ ID NO: 1468023 - protein, 25 aa, Mycobacterium tuberculosis
PGTIEMADWWAYLNGVRKTYPLSYG

SEQ ID NO: 1468024 - protein, 18 aa, Mycobacterium tuberculosis
PIASELILPIAVAVQNRI

SEQ ID NO: 1468025 - protein, 18 aa, Mycobacterium tuberculosis
PKVAAALKDPSYRLKTTT

SEQ ID NO: 1468026 - protein, 22 aa, Mycobacterium tuberculosis
PMLDAAAAWDGLADELGSAAAS

SEQ ID NO: 1468027 - protein, 21 aa, Mycobacterium tuberculosis
PPEHAHKLVFAVLRGVAAVAP

SEQ ID NO: 1468028 - protein, 20 aa, Mycobacterium tuberculosis
PPTPSRVGISSVLKIGRDLY

SEQ ID NO: 1468029 - protein, 25 aa, Mycobacterium tuberculosis
PPVRELMGYRWLRRDEWLHRRFGDI

SEQ ID NO: 1468030 - protein, 20 aa, Mycobacterium tuberculosis
PRSPSPPGLRGLVKQLPEVH

SEQ ID NO: 1468031 - protein, 18 aa, Mycobacterium tuberculosis
PRTMLRFAGGREITLGDL

SEQ ID NO: 1468032 - protein, 24 aa, Mycobacterium tuberculosis
PSASGRMTTKWGGFVSDVDAFDAD

SEQ ID NO: 1468033 - protein, 25 aa, Mycobacterium tuberculosis
PSTVADMMIYLGWSMAGRGAQEGRT

SEQ ID NO: 1468034 - protein, 22 aa, Mycobacterium tuberculosis
PTTLHFPGFTIPTGPIHIGLPL

SEQ ID NO: 1468035 - protein, 19 aa, Mycobacterium tuberculosis
PVGHPKPRRLVRHAHWPDW

SEQ ID NO: 1468036 - protein, 18 aa, Mycobacterium tuberculosis
PWAHGAISTAQWCGVRLA

SEQ ID NO: 1468037 - protein, 31 aa, Mycobacterium tuberculosis
QAAYACASAWLDALVGWRRASGLPAAVINWG

SEQ ID NO: 1468038 - protein, 18 aa, Mycobacterium tuberculosis
QARISTDIGAPGILDLRR

SEQ ID NO: 1468039 - protein, 20 aa, Mycobacterium tuberculosis
QGDTGITYQAWQAQWNQAME

SEQ ID NO: 1468040 - protein, 17 aa, Mycobacterium tuberculosis
QGINFGFGNIGSLNLGS

SEQ ID NO: 1468041 - protein, 17 aa, Mycobacterium tuberculosis
QLGRGYEYLDLDPETGH

SEQ ID NO: 1468042 - protein, 17 aa, Mycobacterium tuberculosis
QNGWLSRDGVWHTDTDK

SEQ ID NO: 1468043 - protein, 23 aa, Mycobacterium tuberculosis
QNVALRLVALVDRLYDAGIPVVA

SEQ ID NO: 1468044 - protein, 22 aa, Mycobacterium tuberculosis
QPDLRVLVELGYDRTAHQDVPS

SEQ ID NO: 1468045 - protein, 18 aa, Mycobacterium tuberculosis
QRFLRALICRRWAGIAAT

SEQ ID NO: 1468046 - protein, 22 aa, Mycobacterium tuberculosis
QRPGAQIKYLVRMRSWPGGHAR

SEQ ID NO: 1468047 - protein, 28 aa, Mycobacterium tuberculosis
QSPTFQPVRRFGWRIMPQNLSDAGVSWK

SEQ ID NO: 1468048 - protein, 18 aa, Mycobacterium tuberculosis
RAALVGGWNLLAPGHWPM

SEQ ID NO: 1468049 - protein, 18 aa, Mycobacterium tuberculosis
RAGIAAAVHAGRAGAQRG

SEQ ID NO: 1468050 - protein, 18 aa, Mycobacterium tuberculosis
RAGNFAVVVGINRTGRAA

SEQ ID NO: 1468051 - protein, 18 aa, Mycobacterium tuberculosis
RALVPQRRLRSVDSGATP

SEQ ID NO: 1468052 - protein, 20 aa, Mycobacterium tuberculosis
RALYELGMTGIPIVNVNNNC

SEQ ID NO: 1468053 - protein, 18 aa, Mycobacterium tuberculosis
RCRACTTTLAGTHADVRR

SEQ ID NO: 1468054 - protein, 19 aa, Mycobacterium tuberculosis
RDGCPSDCGLCPDHKQHAC

SEQ ID NO: 1468055 - protein, 17 aa, Mycobacterium tuberculosis
RDTRSCPQRNHDALNAE

SEQ ID NO: 1468056 - protein, 17 aa, Mycobacterium tuberculosis
RELATYFVGQVVGSLDR

SEQ ID NO: 1468057 - protein, 18 aa, Mycobacterium tuberculosis
RFAGIIRLYTARQVVEQR

SEQ ID NO: 1468058 - protein, 20 aa, Mycobacterium tuberculosis
RFYDSCRVLPQGDEQPTDLH

SEQ ID NO: 1468059 - protein, 23 aa, Mycobacterium tuberculosis
RGADGRVIVACFASNVDRVQQII

SEQ ID NO: 1468060 - protein, 26 aa, Mycobacterium tuberculosis
RGRVKQLLLKIGWPAEDLAGYVDGEA

SEQ ID NO: 1468061 - protein, 27 aa, Mycobacterium tuberculosis
RGRVKQLLLKIGWPAEDLAGYVDGEAH

SEQ ID NO: 1468062 - protein, 25 aa, Mycobacterium tuberculosis
RHDTLPRIAQAVVVAATRNYGVPDN

SEQ ID NO: 1468063 - protein, 24 aa, Mycobacterium tuberculosis
RIAGEDVARLFALVQVVADEHLAD

SEQ ID NO: 1468064 - protein, 25 aa, Mycobacterium tuberculosis
RLASLDKFSTAWDYRARARAARALH

SEQ ID NO: 1468065 - protein, 19 aa, Mycobacterium tuberculosis
RLHELRLAPSNAVDLFKQY

SEQ ID NO: 1468066 - protein, 19 aa, Mycobacterium tuberculosis
RLPPTLPARSSMAAATVMG

SEQ ID NO: 1468067 - protein, 26 aa, Mycobacterium tuberculosis
RLRPDQRVAFVLHDGFAVPFAEVAEV

SEQ ID NO: 1468068 - protein, 17 aa, Mycobacterium tuberculosis
RLSPSVQGWLADHSVAG

SEQ ID NO: 1468069 - protein, 18 aa, Mycobacterium tuberculosis
RLVDLCERLGLAKSTTRR

SEQ ID NO: 1468070 - protein, 18 aa, Mycobacterium tuberculosis
RMGIEAIYLGGWATSAKG

SEQ ID NO: 1468071 - protein, 23 aa, Mycobacterium tuberculosis
RPPRTRSGAALPRSSDPVTDIAA

SEQ ID NO: 1468072 - protein, 17 aa, Mycobacterium tuberculosis
RPVPAGDTMVFFGGIEP

SEQ ID NO: 1468073 - protein, 26 aa, Mycobacterium tuberculosis
RQRENLSWSAPRLHLVDLQYSDVRLD

SEQ ID NO: 1468074 - protein, 19 aa, Mycobacterium tuberculosis
RQRGLRPIQIWVPDVNAPE

SEQ ID NO: 1468075 - protein, 20 aa, Mycobacterium tuberculosis
RRASGRRKAWLRQAINHLEK

SEQ ID NO: 1468076 - protein, 17 aa, Mycobacterium tuberculosis
RRCRIPVFVELAGGIVR

SEQ ID NO: 1468077 - protein, 18 aa, Mycobacterium tuberculosis
RRCRIPVFVELAGGIVRH

SEQ ID NO: 1468078 - protein, 26 aa, Mycobacterium tuberculosis
RRFSGSSGQLAREWVAAGARIVGGCC

SEQ ID NO: 1468079 - protein, 26 aa, Mycobacterium tuberculosis
RRHLSYKTGWYGSSLVVADRWFPSSK

SEQ ID NO: 1468080 - protein, 27 aa, Mycobacterium tuberculosis
RRHLSYKTGWYGSSLVVADRWFPSSKT

SEQ ID NO: 1468081 - protein, 17 aa, Mycobacterium tuberculosis
RRLGTTTVYVTHDQTEA

SEQ ID NO: 1468082 - protein, 23 aa, Mycobacterium tuberculosis
RRPEMPALLAELGLSDRQLASTG

SEQ ID NO: 1468083 - protein, 18 aa, Mycobacterium tuberculosis
RRSCPECGRRFTTVETAV

SEQ ID NO: 1468084 - protein, 17 aa, Mycobacterium tuberculosis
RSGAGLFGSIAQLVKVR

SEQ ID NO: 1468085 - protein, 21 aa, Mycobacterium tuberculosis
RSLKSPVRHFVLFSSVSGLLG

SEQ ID NO: 1468086 - protein, 19 aa, Mycobacterium tuberculosis
RSPSPPGLRGLVKQLPEVH

SEQ ID NO: 1468087 - protein, 19 aa, Mycobacterium tuberculosis
RVTGRKNLHVWAGECHVHA

SEQ ID NO: 1468088 - protein, 17 aa, Mycobacterium tuberculosis
RVWAPKATGALRMHEAT

SEQ ID NO: 1468089 - protein, 19 aa, Mycobacterium tuberculosis
RWVYHSTRLAVPTHTYSDS

SEQ ID NO: 1468090 - protein, 19 aa, Mycobacterium tuberculosis
RYILPSFIEHSSFGVKESN

SEQ ID NO: 1468091 - protein, 20 aa, Mycobacterium tuberculosis
RYILPSFIEHSSFGVKESNP

SEQ ID NO: 1468092 - protein, 20 aa, Mycobacterium tuberculosis
SAVLRRLLISASEWSGRGLW

SEQ ID NO: 1468093 - protein, 18 aa, Mycobacterium tuberculosis
SAWIAEGLLIYLPATAQE

SEQ ID NO: 1468094 - protein, 17 aa, Mycobacterium tuberculosis
SCGGVLAGWGRARSRQL

SEQ ID NO: 1468095 - protein, 18 aa, Mycobacterium tuberculosis
SDCGLCPDHKQHACLGLI

SEQ ID NO: 1468096 - protein, 19 aa, Mycobacterium tuberculosis
SEGIGAVFHYVPLHDSPAG

SEQ ID NO: 1468097 - protein, 22 aa, Mycobacterium tuberculosis
SGNGPLAAFVHALADVGFDVAV

SEQ ID NO: 1468098 - protein, 19 aa, Mycobacterium tuberculosis
SGRKPLRFTSFGDQSTPAL

SEQ ID NO: 1468099 - protein, 17 aa, Mycobacterium tuberculosis
SLAYLSFPAGRFEREMA

SEQ ID NO: 1468100 - protein, 21 aa, Mycobacterium tuberculosis
SLEVIDLRSLAPLDFDTIAAS

SEQ ID NO: 1468101 - protein, 22 aa, Mycobacterium tuberculosis
SMASAAAPYVAWMSATAVHAEL

SEQ ID NO: 1468102 - protein, 19 aa, Mycobacterium tuberculosis
SPEALAWPLLAVIDASLDE

SEQ ID NO: 1468103 - protein, 21 aa, Mycobacterium tuberculosis
SRKSVRPRPHRPAGARAAFKP

SEQ ID NO: 1468104 - protein, 18 aa, Mycobacterium tuberculosis
SSAIPFVFEPVRVRGATW

SEQ ID NO: 1468105 - protein, 19 aa, Mycobacterium tuberculosis
SVFGSPTWRTVTGGSANYV

SEQ ID NO: 1468106 - protein, 23 aa, Mycobacterium tuberculosis
SVFPFDGTRRWFHLECNPQYDDY

SEQ ID NO: 1468107 - protein, 22 aa, Mycobacterium tuberculosis
SVTAKPKLLGPLGDLFTIMTIP

SEQ ID NO: 1468108 - protein, 24 aa, Mycobacterium tuberculosis
SYADVRTPFGLWPNVPPQVIADAL

SEQ ID NO: 1468109 - protein, 19 aa, Mycobacterium tuberculosis
SYGAAGFAVLERTIAELRA

SEQ ID NO: 1468110 - protein, 18 aa, Mycobacterium tuberculosis
TAAKVLEDLGWYVADNLP

SEQ ID NO: 1468111 - protein, 32 aa, Mycobacterium tuberculosis
TAEALRGPLWRWYPGLRAGGKLMHNPHWPANI

SEQ ID NO: 1468112 - protein, 18 aa, Mycobacterium tuberculosis
TEAARTWADRLIGAAAAA

SEQ ID NO: 1468113 - protein, 18 aa, Mycobacterium tuberculosis
TEIKFRSVLEEPTYEDGI

SEQ ID NO: 1468114 - protein, 18 aa, Mycobacterium tuberculosis
TGMELRAAIDAGDVVVAE

SEQ ID NO: 1468115 - protein, 19 aa, Mycobacterium tuberculosis
TGMELRAAIDAGDVVVAEE

SEQ ID NO: 1468116 - protein, 17 aa, Mycobacterium tuberculosis
THYFDNFFLDATRAGIR

SEQ ID NO: 1468117 - protein, 21 aa, Mycobacterium tuberculosis
TLPALIDRRGYVLIVSSLAAF

SEQ ID NO: 1468118 - protein, 18 aa, Mycobacterium tuberculosis
TLPGGFTISARKAYGRNS

SEQ ID NO: 1468119 - protein, 17 aa, Mycobacterium tuberculosis
TMFADVRRELAIRAAVE

SEQ ID NO: 1468120 - protein, 23 aa, Mycobacterium tuberculosis
TPEVARAWSSYAPTVVRLPDGRV

SEQ ID NO: 1468121 - protein, 23 aa, Mycobacterium tuberculosis
TPKLRARQLISQWERYRRGIYCG

SEQ ID NO: 1468122 - protein, 18 aa, Mycobacterium tuberculosis
TQFGRDFDDRLAVAIHFA

SEQ ID NO: 1468123 - protein, 25 aa, Mycobacterium tuberculosis
TQLLKLLAKLAELVAAAIADIISDV

SEQ ID NO: 1468124 - protein, 18 aa, Mycobacterium tuberculosis
TRLAEGLVQAAALMEGHE

SEQ ID NO: 1468125 - protein, 17 aa, Mycobacterium tuberculosis
TRLAWSVLNWNSDAIAL

SEQ ID NO: 1468126 - protein, 17 aa, Mycobacterium tuberculosis
TSGRADTYFDFGGVHAA

SEQ ID NO: 1468127 - protein, 25 aa, Mycobacterium tuberculosis
TTDPPVEGGWAWLPDEAQGARVHWR

SEQ ID NO: 1468128 - protein, 19 aa, Mycobacterium tuberculosis
TTIRNLVHGIGFQRDVLGA

SEQ ID NO: 1468129 - protein, 24 aa, Mycobacterium tuberculosis
TWGVMGIGMGYAIAAAVETGRPVV

SEQ ID NO: 1468130 - protein, 18 aa, Mycobacterium tuberculosis
TWTGAGGVKGFFEKTFAP

SEQ ID NO: 1468131 - protein, 18 aa, Mycobacterium tuberculosis
TYIRSCVDAGDMVAAMEA

SEQ ID NO: 1468132 - protein, 24 aa, Mycobacterium tuberculosis
VAAHDLRPGTALTPGDVRLEKRSA

SEQ ID NO: 1468133 - protein, 23 aa, Mycobacterium tuberculosis
VAELGLPVVVRPSFTMGGLGSGI

SEQ ID NO: 1468134 - protein, 20 aa, Mycobacterium tuberculosis
VAEMMRACRPITVPLTQAQG

SEQ ID NO: 1468135 - protein, 18 aa, Mycobacterium tuberculosis
VAFAEEYGLPIAIKAAHG

SEQ ID NO: 1468136 - protein, 18 aa, Mycobacterium tuberculosis
VAKCAVAFEADDHNVAEG

SEQ ID NO: 1468137 - protein, 23 aa, Mycobacterium tuberculosis
VANDGFTFFPGGLTFPRASAGVT

SEQ ID NO: 1468138 - protein, 23 aa, Mycobacterium tuberculosis
VASRLIRLPMWVGLQEVDQSRVV

SEQ ID NO: 1468139 - protein, 24 aa, Mycobacterium tuberculosis
VAVDLRDDWPTALQKAGFDNAQRT

SEQ ID NO: 1468140 - protein, 23 aa, Mycobacterium tuberculosis
VAVRRAGGVVIPQVFFTNSGQVV

SEQ ID NO: 1468141 - protein, 19 aa, Mycobacterium tuberculosis
VCDCGGLIRPDIVWFGEPL

SEQ ID NO: 1468142 - protein, 28 aa, Mycobacterium tuberculosis
VDDPLAMYLFDLCTLPLNLAGHCGMSVP

SEQ ID NO: 1468143 - protein, 24 aa, Mycobacterium tuberculosis
VDTLRRAGERFGFAVESMSLVSEH

SEQ ID NO: 1468144 - protein, 20 aa, Mycobacterium tuberculosis
VERFGDLVFDTVITRTVRFP

SEQ ID NO: 1468145 - protein, 19 aa, Mycobacterium tuberculosis
VGLSAKAFSAWSPTRSTRG

SEQ ID NO: 1468146 - protein, 17 aa, Mycobacterium tuberculosis
VGQKRFSLEGAESVIPM

SEQ ID NO: 1468147 - protein, 23 aa, Mycobacterium tuberculosis
VGQKRFSLEGAESVIPMMDAAID

SEQ ID NO: 1468148 - protein, 22 aa, Mycobacterium tuberculosis
VGRMKDMLIVYGRNHYPEDIES

SEQ ID NO: 1468149 - protein, 20 aa, Mycobacterium tuberculosis
VGSWSFVWRDVLLRLANDFR

SEQ ID NO: 1468150 - protein, 17 aa, Mycobacterium tuberculosis
VHRCRLPFCDVTVGLVR

SEQ ID NO: 1468151 - protein, 25 aa, Mycobacterium tuberculosis
VHRRSWRVPVTAFWQAHRDAAAVYS

SEQ ID NO: 1468152 - protein, 19 aa, Mycobacterium tuberculosis
VKYKLAILDEYDRADRTER

SEQ ID NO: 1468153 - protein, 18 aa, Mycobacterium tuberculosis
VLELLHLGGRSLAHAVLM

SEQ ID NO: 1468154 - protein, 19 aa, Mycobacterium tuberculosis
VNTGAFIGGNFSNGAFWQS

SEQ ID NO: 1468155 - protein, 23 aa, Mycobacterium tuberculosis
VPAFDRTALVTALRADQAGQTSF

SEQ ID NO: 1468156 - protein, 21 aa, Mycobacterium tuberculosis
VPDIPIPAIHIGINGVVTVGF

SEQ ID NO: 1468157 - protein, 19 aa, Mycobacterium tuberculosis
VPIPGFPTTVTVFGTPFMG

SEQ ID NO: 1468158 - protein, 32 aa, Mycobacterium tuberculosis
VPSYKSCFLAMVRRFTNWASRSSMVIFSMRLA

SEQ ID NO: 1468159 - protein, 29 aa, Mycobacterium tuberculosis
VPSYKSCFLAMVRRFYELGVKELNGHLLY

SEQ ID NO: 1468160 - protein, 23 aa, Mycobacterium tuberculosis
VPTSWRAARATLRLPADTAARVA

SEQ ID NO: 1468161 - protein, 19 aa, Mycobacterium tuberculosis
VREDARILYHAALAHASNH

SEQ ID NO: 1468162 - protein, 20 aa, Mycobacterium tuberculosis
VRQWLVRWAAHPGRATRGFH

SEQ ID NO: 1468163 - protein, 20 aa, Mycobacterium tuberculosis
VSAGIAALFGAQARAIKRSA

SEQ ID NO: 1468164 - protein, 17 aa, Mycobacterium tuberculosis
VSARSLLQCAALHDLVD

SEQ ID NO: 1468165 - protein, 28 aa, Mycobacterium tuberculosis
VSDDGRWRIVGNIPRGMFVGGRRGSSVT

SEQ ID NO: 1468166 - protein, 23 aa, Mycobacterium tuberculosis
VSWSNPNDWWLVRLLGSITPTER

SEQ ID NO: 1468167 - protein, 19 aa, Mycobacterium tuberculosis
VYLRKRCREHGSFEALVYG

SEQ ID NO: 1468168 - protein, 21 aa, Mycobacterium tuberculosis
VYYRVFGGWLRQRRNIRDMTK

SEQ ID NO: 1468169 - protein, 17 aa, Mycobacterium tuberculosis
WAKVTGRVAPVFDLGIG

SEQ ID NO: 1468170 - protein, 23 aa, Mycobacterium tuberculosis
WDVRCAPAAFRFMSQARHIGKVV

SEQ ID NO: 1468171 - protein, 17 aa, Mycobacterium tuberculosis
WMLVAHVDQVAKTGDYV

SEQ ID NO: 1468172 - protein, 25 aa, Mycobacterium tuberculosis
WPGEERLLRLGLQSLRLWREGSFLD

SEQ ID NO: 1468173 - protein, 21 aa, Mycobacterium tuberculosis
WRTEPGRAVFRTEVAGSDGAE

SEQ ID NO: 1468174 - protein, 22 aa, Mycobacterium tuberculosis
WVTGPGGERWEVYTVLADSETF

SEQ ID NO: 1468175 - protein, 18 aa, Mycobacterium tuberculosis
WYDRPAFYAADVVTHGQI

SEQ ID NO: 1468176 - protein, 17 aa, Mycobacterium tuberculosis
YDRPAFYAADVVTHGQI

SEQ ID NO: 1468177 - protein, 20 aa, Mycobacterium tuberculosis
YERATAQRFADWLVRVVEAF

SEQ ID NO: 1468178 - protein, 20 aa, Mycobacterium tuberculosis
YGSGPLVVGVCAEYDALPGI

SEQ ID NO: 1468179 - protein, 20 aa, Mycobacterium tuberculosis
YNAVCSVYGHLHIPRTTWYD

SEQ ID NO: 1468180 - protein, 18 aa, Mycobacterium tuberculosis
YRLHPVVLDAALQSVGAA

SEQ ID NO: 1468181 - protein, 19 aa, Mycobacterium tuberculosis
YRLIPKHSLGMALDDCHDA

SEQ ID NO: 1468182 - protein, 25 aa, Mycobacterium tuberculosis
YWADNLRHTVRFSAAVRSALDDGYR

SEQ ID NO: 1468183 - protein, 20 aa, Mycobacterium tuberculosis
AAARILLRSGKPVFLAANKV

SEQ ID NO: 1468184 - protein, 17 aa, Mycobacterium tuberculosis
AAEKFFAALAIGDTASA

SEQ ID NO: 1468185 - protein, 18 aa, Mycobacterium tuberculosis
AAEPPPNVDIRWSTADLR

SEQ ID NO: 1468186 - protein, 18 aa, Mycobacterium tuberculosis
AAGALAAGCEYEIDEAAP

SEQ ID NO: 1468187 - protein, 26 aa, Mycobacterium tuberculosis
AAIRARRSLDSAAGWLAPLGGAHLRS

SEQ ID NO: 1468188 - protein, 18 aa, Mycobacterium tuberculosis
AAKLTEWLKLALDEPHLL

SEQ ID NO: 1468189 - protein, 19 aa, Mycobacterium tuberculosis
AALTGEWFGALAVIAPSVS

SEQ ID NO: 1468190 - protein, 18 aa, Mycobacterium tuberculosis
AAMQGRIAMYHALGEGVS

SEQ ID NO: 1468191 - protein, 19 aa, Mycobacterium tuberculosis
AAMQGRIAMYHALGEGVSP

SEQ ID NO: 1468192 - protein, 20 aa, Mycobacterium tuberculosis
AAPDLPCEVEVDSLEQLDAV

SEQ ID NO: 1468193 - protein, 18 aa, Mycobacterium tuberculosis
AAVRAELAKRGWVPSPQT

SEQ ID NO: 1468194 - protein, 17 aa, Mycobacterium tuberculosis
AAVTRYFAAYNLVCGPV

SEQ ID NO: 1468195 - protein, 19 aa, Mycobacterium tuberculosis
ACRPHSGTDLLAGIGGTPE

SEQ ID NO: 1468196 - protein, 25 aa, Mycobacterium tuberculosis
ADLHAAPSQWSWRPWSLTVDVEPGP

SEQ ID NO: 1468197 - protein, 23 aa, Mycobacterium tuberculosis
ADLLGKRLHRVLGPLAHVNLIPL

SEQ ID NO: 1468198 - protein, 24 aa, Mycobacterium tuberculosis
ADQPLDWFCSFSSAAALVGSPGQG

SEQ ID NO: 1468199 - protein, 18 aa, Mycobacterium tuberculosis
ADRVNLAITALRDEVEAE

SEQ ID NO: 1468200 - protein, 22 aa, Mycobacterium tuberculosis
ADVLIAFGRFPIIDDREPQLGM

SEQ ID NO: 1468201 - protein, 20 aa, Mycobacterium tuberculosis
AEGARLKDAFVYPETMPAWF

SEQ ID NO: 1468202 - protein, 18 aa, Mycobacterium tuberculosis
AEGRLRLPERVQRYLVGR

SEQ ID NO: 1468203 - protein, 18 aa, Mycobacterium tuberculosis
AELLRPLLELVPVHDVAF

SEQ ID NO: 1468204 - protein, 17 aa, Mycobacterium tuberculosis
AEMLRWCHEAGIELATV

SEQ ID NO: 1468205 - protein, 17 aa, Mycobacterium tuberculosis
AESQWFAAAGCNLVNMT

SEQ ID NO: 1468206 - protein, 17 aa, Mycobacterium tuberculosis
AEVLWRHVRAHPSEVGA

SEQ ID NO: 1468207 - protein, 21 aa, Mycobacterium tuberculosis
AFVHAHPRWIAQAFADALGAA

SEQ ID NO: 1468208 - protein, 20 aa, Mycobacterium tuberculosis
AFVRSRLAGYLEQMDRVVSR

SEQ ID NO: 1468209 - protein, 24 aa, Mycobacterium tuberculosis
AGGHGGAGGLIWGNGGAGGNGGNG

SEQ ID NO: 1468210 - protein, 17 aa, Mycobacterium tuberculosis
AGLLIRALYRIAKRRFG

SEQ ID NO: 1468211 - protein, 18 aa, Mycobacterium tuberculosis
AGLTLALAADWRVSGDNV

SEQ ID NO: 1468212 - protein, 17 aa, Mycobacterium tuberculosis
AGPIIVPSIQFPAIPLD

SEQ ID NO: 1468213 - protein, 17 aa, Mycobacterium tuberculosis
AGVPGRAAPGVRRPRAW

SEQ ID NO: 1468214 - protein, 17 aa, Mycobacterium tuberculosis
AGYALAGRHVHVVTIND

SEQ ID NO: 1468215 - protein, 30 aa, Mycobacterium tuberculosis; identical to SEQ ID NO: 196461

SEQ ID NO: 1468216 - protein, 18 aa, Mycobacterium tuberculosis
AIAAELYVAPSTVKTHVQ

SEQ ID NO: 1468217 - protein, 28 aa, Mycobacterium tuberculosis
AINAPFLAALGRPLIGNGADGAPGTGAA

SEQ ID NO: 1468218 - protein, 23 aa, Mycobacterium tuberculosis
AKEPWFLDAYQRAWEWADAVHWR

SEQ ID NO: 1468219 - protein, 17 aa, Mycobacterium tuberculosis
AKLRRRPYLQLNTIQDI

SEQ ID NO: 1468220 - protein, 18 aa, Mycobacterium tuberculosis
ALAPLAEFALHTPILGSE

SEQ ID NO: 1468221 - protein, 23 aa, Mycobacterium tuberculosis
ALEEAWETAGLRGCGRAVKVQAP

SEQ ID NO: 1468222 - protein, 24 aa, Mycobacterium tuberculosis
ALEEAWETAGLRGCGRAVKVQAPG

SEQ ID NO: 1468223 - protein, 18 aa, Mycobacterium tuberculosis
ALELIKAHLPDVALLDYR

SEQ ID NO: 1468224 - protein, 17 aa, Mycobacterium tuberculosis
ALERAKGVLRTKVGAGT

SEQ ID NO: 1468225 - protein, 19 aa, Mycobacterium tuberculosis
ALEVLQSWLGADRAATLVV

SEQ ID NO: 1468226 - protein, 17 aa, Mycobacterium tuberculosis
ALGPRVLGLSARRSAGA

SEQ ID NO: 1468227 - protein, 17 aa, Mycobacterium tuberculosis
ALKAFRTGGIDVLVATD

SEQ ID NO: 1468228 - protein, 18 aa, Mycobacterium tuberculosis
ALKAFRTGGIDVLVATDV

SEQ ID NO: 1468229 - protein, 18 aa, Mycobacterium tuberculosis
ALMFARRRGVLVANAVGE

SEQ ID NO: 1468230 - protein, 18 aa, Mycobacterium tuberculosis
ALPLFELGYDVAHVGFDQ

SEQ ID NO: 1468231 - protein, 20 aa, Mycobacterium tuberculosis
ALPSRYGQAVAESDVQPLGR

SEQ ID NO: 1468232 - protein, 18 aa, Mycobacterium tuberculosis
ALTTMPIPVIAAVRGLAV

SEQ ID NO: 1468233 - protein, 18 aa, Mycobacterium tuberculosis
ANKIGGADWVEWGGCGMV

SEQ ID NO: 1468234 - protein, 17 aa, Mycobacterium tuberculosis
ANLGRAASVGSLSVPPA

SEQ ID NO: 1468235 - protein, 19 aa, Mycobacterium tuberculosis
ANYHLAWYAVTTRRGGSRG

SEQ ID NO: 1468236 - protein, 23 aa, Mycobacterium tuberculosis
APAVRRLAERGAPEIQAYDPVFF

SEQ ID NO: 1468237 - protein, 30 aa, Mycobacterium tuberculosis; identical to SEQ ID NO: 210556

SEQ ID NO: 1468238 - protein, 17 aa, Mycobacterium tuberculosis
APTGLPDPGIEALAHTK

SEQ ID NO: 1468239 - protein, 17 aa, Mycobacterium tuberculosis
AQPRAGASTAWVPSPTA

SEQ ID NO: 1468240 - protein, 20 aa, Mycobacterium tuberculosis
AQYGEMWAQDIVAMEGYAGA

SEQ ID NO: 1468241 - protein, 30 aa, Mycobacterium tuberculosis
ARDFQRFLIGKLKDIREVVATASLDAASKS

SEQ ID NO: 1468242 - protein, 19 aa, Mycobacterium tuberculosis
ARERLTFDEAVGLQWALVA

SEQ ID NO: 1468243 - protein, 20 aa, Mycobacterium tuberculosis
ARLRDSPVRVVTCRQSGVGD

SEQ ID NO: 1468244 - protein, 21 aa, Mycobacterium tuberculosis
ARPEPSAAWAEARRRVRQRRE

SEQ ID NO: 1468245 - protein, 20 aa, Mycobacterium tuberculosis
ARRFARDDYDILLIGHEGHE

SEQ ID NO: 1468246 - protein, 30 aa, Mycobacterium tuberculosis; identical to SEQ ID NO: 209135

SEQ ID NO: 1468247 - protein, 28 aa, Mycobacterium tuberculosis
ARVLRPGGRLGLVWNTRDERLGWVRELG

SEQ ID NO: 1468248 - protein, 23 aa, Mycobacterium tuberculosis
ARYVWEVPYYPQYYIPLADVRME

SEQ ID NO: 1468249 - protein, 25 aa, Mycobacterium tuberculosis
ASQLMGVVMARYIVRIEPFASLPAE

SEQ ID NO: 1468250 - protein, 17 aa, Mycobacterium tuberculosis
ATTHWAFAEHFAREFPA

SEQ ID NO: 1468251 - protein, 17 aa, Mycobacterium tuberculosis
AVGELTPSVAALAALAS

SEQ ID NO: 1468252 - protein, 20 aa, Mycobacterium tuberculosis
AVGRPGWPTTTASRRPLVEA

SEQ ID NO: 1468253 - protein, 25 aa, Mycobacterium tuberculosis
AVPYRANMWALRALGVRRVFGPCAV

SEQ ID NO: 1468254 - protein, 21 aa, Mycobacterium tuberculosis
AYADMPLFLFHLLEYMDVDYE

SEQ ID NO: 1468255 - protein, 18 aa, Mycobacterium tuberculosis
AYAIPGVAVAVWAGGQEY

SEQ ID NO: 1468256 - protein, 19 aa, Mycobacterium tuberculosis
AYPPLFVGRFFDMMRIEAL

SEQ ID NO: 1468257 - protein, 28 aa, Mycobacterium tuberculosis
CAELLDWPAKLRLLDGFRQRENLSWSAP

SEQ ID NO: 1468258 - protein, 17 aa, Mycobacterium tuberculosis
CDYRALRVADLFDSQGI

SEQ ID NO: 1468259 - protein, 19 aa, Mycobacterium tuberculosis
CRDERGGSVAVEIKRRGEI

SEQ ID NO: 1468260 - protein, 21 aa, Mycobacterium tuberculosis
CVLAKDCPSFGLGPTEPLLAA

SEQ ID NO: 1468261 - protein, 28 aa, Mycobacterium tuberculosis
DARTAEFVFRPGPVFTNLLLADEINRTP

SEQ ID NO: 1468262 - protein, 24 aa, Mycobacterium tuberculosis
DAYQWLRARGYRPEQIVLAGDSAG

SEQ ID NO: 1468263 - protein, 25 aa, Mycobacterium tuberculosis
DDDAARMWARLRIHLAESGRRVRIN

SEQ ID NO: 1468264 - protein, 20 aa, Mycobacterium tuberculosis
DDLLGIWGRPEITGKPVYSD

SEQ ID NO: 1468265 - protein, 17 aa, Mycobacterium tuberculosis
DEMAARVAAEFEDGQYV

SEQ ID NO: 1468266 - protein, 21 aa, Mycobacterium tuberculosis
DEVVFGWRSFELYPPQVRVAG

SEQ ID NO: 1468267 - protein, 17 aa, Mycobacterium tuberculosis
DFADLFPVPAKLWTIAD

SEQ ID NO: 1468268 - protein, 18 aa, Mycobacterium tuberculosis
DFVVEIAAELPMQMICIL

SEQ ID NO: 1468269 - protein, 20 aa, Mycobacterium tuberculosis
DGEGAIGRWRGGRSELTTEC

SEQ ID NO: 1468270 - protein, 23 aa, Mycobacterium tuberculosis
DGGDGGGLFSIGVGGDGGNAGNG

SEQ ID NO: 1468271 - protein, 17 aa, Mycobacterium tuberculosis
DGLPQIVALDVKPVPDK

SEQ ID NO: 1468272 - protein, 24 aa, Mycobacterium tuberculosis
DGVLRARKLPDWPTGPLPKVRVAA

SEQ ID NO: 1468273 - protein, 24 aa, Mycobacterium tuberculosis
DHAHFKIPGWRDALTRTGVVEGTR

SEQ ID NO: 1468274 - protein, 25 aa, Mycobacterium tuberculosis
DLTWLLSRWACVFGTPACQGTVAGR

SEQ ID NO: 1468275 - protein, 21 aa, Mycobacterium tuberculosis
DNAMLGLLCDAAFDELTRPDV

SEQ ID NO: 1468276 - protein, 23 aa, Mycobacterium tuberculosis
DPPFEGMWWLYVPLAFDDFAVVL

SEQ ID NO: 1468277 - protein, 18 aa, Mycobacterium tuberculosis
DRIARLVVANGFLPAAQG

SEQ ID NO: 1468278 - protein, 21 aa, Mycobacterium tuberculosis
DRIVSIGAFEHFGHQRYHHFF

SEQ ID NO: 1468279 - protein, 28 aa, Mycobacterium tuberculosis
DRLGCGCGRADCAAGKRPAAPPVVIHLI

SEQ ID NO: 1468280 - protein, 17 aa, Mycobacterium tuberculosis
DRPEPVSVMTAAAQGFV

SEQ ID NO: 1468281 - protein, 25 aa, Mycobacterium tuberculosis
DTAYFGNAFPPNYLVNSHTSAEQVG

SEQ ID NO: 1468282 - protein, 18 aa, Mycobacterium tuberculosis
DTDTRIATAVARTVTARL

SEQ ID NO: 1468283 - protein, 23 aa, Mycobacterium tuberculosis
DTHARLAGVGAIMLDGKATRDEI

SEQ ID NO: 1468284 - protein, 18 aa, Mycobacterium tuberculosis
DVIPEVLGPVVELRDGSE

SEQ ID NO: 1468285 - protein, 19 aa, Mycobacterium tuberculosis
DVIPEVLGPVVELRDGSER

SEQ ID NO: 1468286 - protein, 20 aa, Mycobacterium tuberculosis
DVLVPGYLYHYSLDAGQAGR

SEQ ID NO: 1468287 - protein, 25 aa, Mycobacterium tuberculosis
DYHETFDLGPLVIFPPMNIPATVIE

SEQ ID NO: 1468288 - protein, 17 aa, Mycobacterium tuberculosis
EAARTWADRLIGAAAAA

SEQ ID NO: 1468289 - protein, 20 aa, Mycobacterium tuberculosis
EAEAAEPLAEWEQELLASAT

SEQ ID NO: 1468290 - protein, 25 aa, Mycobacterium tuberculosis
EAGRAGVFRPLWAHDRTAERQALTD

SEQ ID NO: 1468291 - protein, 17 aa, Mycobacterium tuberculosis
EALQWRGNKAHALSSPG

SEQ ID NO: 1468292 - protein, 19 aa, Mycobacterium tuberculosis
EALVPLVLAGTTHRETPRL

SEQ ID NO: 1468293 - protein, 25 aa, Mycobacterium tuberculosis
EATLVGRLSVPAAWSTAAPATTAGA

SEQ ID NO: 1468294 - protein, 17 aa, Mycobacterium tuberculosis
EDIELTGPMAARLWVQL

SEQ ID NO: 1468295 - protein, 18 aa, Mycobacterium tuberculosis
EDIELTGPMAARLWVQLD

SEQ ID NO: 1468296 - protein, 17 aa, Mycobacterium tuberculosis
EEVPRDGLLRLLVDVQY

SEQ ID NO: 1468297 - protein, 26 aa, Mycobacterium tuberculosis
EFELLKYLAQHAGRVFTRAQLLHEVW

SEQ ID NO: 1468298 - protein, 18 aa, Mycobacterium tuberculosis
EFQGGGPHAWYLSDGILA

SEQ ID NO: 1468299 - protein, 19 aa, Mycobacterium tuberculosis
EIDDAFRWSEENRNLQRKA

SEQ ID NO: 1468300 - protein, 19 aa, Mycobacterium tuberculosis
EIVEIGPFTIPQVDVPAIP

SEQ ID NO: 1468301 - protein, 17 aa, Mycobacterium tuberculosis
EMRHGFVKIFCRRSTGV

SEQ ID NO: 1468302 - protein, 19 aa, Mycobacterium tuberculosis
EPLARCSRSPGLNESSHMS

SEQ ID NO: 1468303 - protein, 20 aa, Mycobacterium tuberculosis
EPLPEEPWRSAVEATGSADV

SEQ ID NO: 1468304 - protein, 25 aa, Mycobacterium tuberculosis
EPLRLLFKDEVRAVGRELGLPEEIV

SEQ ID NO: 1468305 - protein, 19 aa, Mycobacterium tuberculosis
ERRTTASFCAATSVTRREP

SEQ ID NO: 1468306 - protein, 17 aa, Mycobacterium tuberculosis
ESAVSLWNPRGYGNNAW

SEQ ID NO: 1468307 - protein, 18 aa, Mycobacterium tuberculosis
ETRRQVLDHITFDFEPGE

SEQ ID NO: 1468308 - protein, 20 aa, Mycobacterium tuberculosis
EVMAAAATDLANIGSSISAA

SEQ ID NO: 1468309 - protein, 17 aa, Mycobacterium tuberculosis
FCAYNSVGYREQVREQL

SEQ ID NO: 1468310 - protein, 27 aa, Mycobacterium tuberculosis
FFIEDWAEIWPCAGMAYPKALADDLRP

SEQ ID NO: 1468311 - protein, 24 aa, Mycobacterium tuberculosis
FGNFGGGASGFWNLASATSGLSGF

SEQ ID NO: 1468312 - protein, 28 aa, Mycobacterium tuberculosis
FGNKGTGLFSGFMSGFGNTGFLQSGFGN

SEQ ID NO: 1468313 - protein, 18 aa, Mycobacterium tuberculosis
FLLTAGFFETHRPYPHER

SEQ ID NO: 1468314 - protein, 30 aa, Mycobacterium tuberculosis
FLVDLILFDWPTHMLQLATWLAENPQLLVA

SEQ ID NO: 1468315 - protein, 26 aa, Mycobacterium tuberculosis
FNKASRRIKLAWFLLNAARYMPAQVF

SEQ ID NO: 1468316 - protein, 19 aa, Mycobacterium tuberculosis
FPTDICEPVAVVGIGCRFP

SEQ ID NO: 1468317 - protein, 17 aa, Mycobacterium tuberculosis
FRTALRDSLDIYGVMAT

SEQ ID NO: 1468318 - protein, 17 aa, Mycobacterium tuberculosis
FSKQLINSIKWARDETG

SEQ ID NO: 1468319 - protein, 24 aa, Mycobacterium tuberculosis
FTVFPDGYSLPAIPLGIDVGGAIG

SEQ ID NO: 1468320 - protein, 25 aa, Mycobacterium tuberculosis
FVNSRPKPLSAYLFTKSRAVRERVI

SEQ ID NO: 1468321 - protein, 19 aa, Mycobacterium tuberculosis
GAGGAGMRAAVEAGPRVRT

SEQ ID NO: 1468322 - protein, 26 aa, Mycobacterium tuberculosis
GAGSGPMLAAAAAWDGLAAELGLAAE

SEQ ID NO: 1468323 - protein, 22 aa, Mycobacterium tuberculosis
GAPRLPSSVVSWLPLYHDMGLM

SEQ ID NO: 1468324 - protein, 27 aa, Mycobacterium tuberculosis
GAPSSGIGIVEGWRGTIVHRVEIDVDG

SEQ ID NO: 1468325 - protein, 21 aa, Mycobacterium tuberculosis
GARPRGAGMERSDLLEANGAI

SEQ ID NO: 1468326 - protein, 18 aa, Mycobacterium tuberculosis
GAVAIPFVAKHADPGMTS

SEQ ID NO: 1468327 - protein, 21 aa, Mycobacterium tuberculosis
GAVDAYWNWQSCRAGKRAGKT

SEQ ID NO: 1468328 - protein, 20 aa, Mycobacterium tuberculosis
GDGEAGSWLLIDTSNAVDTP

SEQ ID NO: 1468329 - protein, 17 aa, Mycobacterium tuberculosis
GDQLVLGASNPVRDVAL

SEQ ID NO: 1468330 - protein, 20 aa, Mycobacterium tuberculosis
GEAWARHGVEHPMGADFSGV

SEQ ID NO: 1468331 - protein, 25 aa, Mycobacterium tuberculosis
GELKISIPGFEIPQIATTRFLLDVN

SEQ ID NO: 1468332 - protein, 18 aa, Mycobacterium tuberculosis
GESLRVAGGFTLDGLGGW

SEQ ID NO: 1468333 - protein, 27 aa, Mycobacterium tuberculosis
GESPYWYVYEHNLWPSREDALSISAVV

SEQ ID NO: 1468334 - protein, 23 aa, Mycobacterium tuberculosis
GGAGGAGGWLLGNGGAGGPGGPT

SEQ ID NO: 1468335 - protein, 17 aa, Mycobacterium tuberculosis
GGDDVALAVRCDVTQAD

SEQ ID NO: 1468336 - protein, 18 aa, Mycobacterium tuberculosis
GGELARIGVAADIGAAPA

SEQ ID NO: 1468337 - protein, 18 aa, Mycobacterium tuberculosis
GGEMGRLWYENGKLLDKK

SEQ ID NO: 1468338 - protein, 18 aa, Mycobacterium tuberculosis
GGEQRRWLQAELANARRD

SEQ ID NO: 1468339 - protein, 29 aa, Mycobacterium tuberculosis
GGSGGAGGLIGWAGAAGGTGAGGTGGQGG

SEQ ID NO: 1468340 - protein, 22 aa, Mycobacterium tuberculosis
GHTPGSIALALGGPVTGGVTQL

SEQ ID NO: 1468341 - protein, 19 aa, Mycobacterium tuberculosis
GIQLLPLWRRVHSHILRIS

SEQ ID NO: 1468342 - protein, 18 aa, Mycobacterium tuberculosis
GKATRDEIFGDLKQRVAA

SEQ ID NO: 1468343 - protein, 18 aa, Mycobacterium tuberculosis
GLLQRLSSAASVSWSNPN

SEQ ID NO: 1468344 - protein, 17 aa, Mycobacterium tuberculosis
GLREIRVPGRLEQIDRG

SEQ ID NO: 1468345 - protein, 18 aa, Mycobacterium tuberculosis
GLVQAAALMEGHEADSQT

SEQ ID NO: 1468346 - protein, 22 aa, Mycobacterium tuberculosis
GLVRAAACTMFFGETAESLAAE

SEQ ID NO: 1468347 - protein, 25 aa, Mycobacterium tuberculosis
GNPHYDIPKLLSMYKAGKLNLDDMV

SEQ ID NO: 1468348 - protein, 30 aa, Mycobacterium tuberculosis
GPRPFVRLEGPAVFRWAAFKMGDVGRRAMD

SEQ ID NO: 1468349 - protein, 19 aa, Mycobacterium tuberculosis
GPVIEKAYGAGPCSGHLTD

SEQ ID NO: 1468350 - protein, 18 aa, Mycobacterium tuberculosis
GQHVALDFVGRIRGQKKF

SEQ ID NO: 1468351 - protein, 27 aa, Mycobacterium tuberculosis
GQLKMARDEGRWHVRWTTSGLHPKLGE

SEQ ID NO: 1468352 - protein, 21 aa, Mycobacterium tuberculosis
GQNRFSWKNTGQILADEGHHV

SEQ ID NO: 1468353 - protein, 23 aa, Mycobacterium tuberculosis
GSAGRGGDAGFFYGNGGAGGSGA

SEQ ID NO: 1468354 - protein, 18 aa, Mycobacterium tuberculosis
GSGNVGWANMGLGNIGFG

SEQ ID NO: 1468355 - protein, 17 aa, Mycobacterium tuberculosis
GSGQAWQGAAAAAMVVA

SEQ ID NO: 1468356 - protein, 18 aa, Mycobacterium tuberculosis
GTLFNFGFANDGTLNLGN

SEQ ID NO: 1468357 - protein, 26 aa, Mycobacterium tuberculosis
GVRLAFVCAVDMPYLTVELIEDLARR

SEQ ID NO: 1468358 - protein, 21 aa, Mycobacterium tuberculosis
GWRVVELDVSYGPRTGGKSKV

SEQ ID NO: 1468359 - protein, 21 aa, Mycobacterium tuberculosis
GYRDTEIMRWLFTPDPSLTIT

SEQ ID NO: 1468360 - protein, 20 aa, Mycobacterium tuberculosis
HAARWDLARIISALGDEVAF

SEQ ID NO: 1468361 - protein, 17 aa, Mycobacterium tuberculosis
HLRRYRDHVARGLDMSR

SEQ ID NO: 1468362 - protein, 19 aa, Mycobacterium tuberculosis
HPAGCLVSFATQTSVQPPS

SEQ ID NO: 1468363 - protein, 24 aa, Mycobacterium tuberculosis
HPTSRFRELICSRAVDIAIGPASE

SEQ ID NO: 1468364 - protein, 22 aa, Mycobacterium tuberculosis
HSMGALHSWCLAAERPELVSAL

SEQ ID NO: 1468365 - protein, 22 aa, Mycobacterium tuberculosis
HVELPLSVTIGPFVSPEITIPQ

SEQ ID NO: 1468366 - protein, 19 aa, Mycobacterium tuberculosis
IAPQWHLRMQAAVQRHVEA

SEQ ID NO: 1468367 - protein, 25 aa, Mycobacterium tuberculosis
IAYLLEILPALSYLHSIGLVYNDLK

SEQ ID NO: 1468368 - protein, 17 aa, Mycobacterium tuberculosis
ICQWTRYFPAGDPVAAD

SEQ ID NO: 1468369 - protein, 17 aa, Mycobacterium tuberculosis
IDASGALDPITIFPGGY

SEQ ID NO: 1468370 - protein, 23 aa, Mycobacterium tuberculosis
IDDIKAPLLAALGAADLALATVN

SEQ ID NO: 1468371 - protein, 20 aa, Mycobacterium tuberculosis
IDYLRSRLTGIAGEGNKEID

SEQ ID NO: 1468372 - protein, 25 aa, Mycobacterium tuberculosis
IGGADWVEWGGCGMVHPNVLRATGI

SEQ ID NO: 1468373 - protein, 32 aa, Mycobacterium tuberculosis
IGLSLPLLRSLVQRCGLSVAALWAGNAGGPAH

SEQ ID NO: 1468374 - protein, 19 aa, Mycobacterium tuberculosis
IGPNNGFPGTSSIVTAMPG

SEQ ID NO: 1468375 - protein, 27 aa, Mycobacterium tuberculosis
IGRMSGVPPSVWGGLAAARFQDVVDRW

SEQ ID NO: 1468376 - protein, 20 aa, Mycobacterium tuberculosis
ILETAYVIDFLAYVYEETRH

SEQ ID NO: 1468377 - protein, 21 aa, Mycobacterium tuberculosis
ILHQLGTVWVRRHLPNVALFH

SEQ ID NO: 1468378 - protein, 21 aa, Mycobacterium tuberculosis
INKEIKRRSRVVGIFPNPAAV

SEQ ID NO: 1468379 - protein, 17 aa, Mycobacterium tuberculosis
IPDLAIREALENLWSAS

SEQ ID NO: 1468380 - protein, 25 aa, Mycobacterium tuberculosis
IPKGSAAALRFEVLGLVDGVPAVVL

SEQ ID NO: 1468381 - protein, 17 aa, Mycobacterium tuberculosis
IPLDVAEGDTVIYSKYG

SEQ ID NO: 1468382 - protein, 25 aa, Mycobacterium tuberculosis
IRERLDFSCALFDPDGNLVANAPHI

SEQ ID NO: 1468383 - protein, 18 aa, Mycobacterium tuberculosis
IRGTGSFDMAVRALQNLA

SEQ ID NO: 1468384 - protein, 20 aa, Mycobacterium tuberculosis
IRHRWNWTDVRRWLTDPTGR

SEQ ID NO: 1468385 - protein, 24 aa, Mycobacterium tuberculosis
IRLARHRPEIPIGVNIGKTKKTPA

SEQ ID NO: 1468386 - protein, 23 aa, Mycobacterium tuberculosis
ISTAQWCGVRLADILQAADVHID

SEQ ID NO: 1468387 - protein, 17 aa, Mycobacterium tuberculosis
ITFPRIDASGSVDIGIL

SEQ ID NO: 1468388 - protein, 19 aa, Mycobacterium tuberculosis
IVATETFAPILYVLTYDDL

SEQ ID NO: 1468389 - protein, 20 aa, Mycobacterium tuberculosis
KATGLPIDFTGFISDRHAVA

SEQ ID NO: 1468390 - protein, 24 aa, Mycobacterium tuberculosis
KGTLFRRFGSRAGLMMVLLDEDER

SEQ ID NO: 1468391 - protein, 21 aa, Mycobacterium tuberculosis
KKFYTSLFGWGYDDNPVPGGG

SEQ ID NO: 1468392 - protein, 19 aa, Mycobacterium tuberculosis
KKIKEKLGIGAVVTDDPSN

SEQ ID NO: 1468393 - protein, 21 aa, Mycobacterium tuberculosis
KLALIDVRDPVEWDIVHIDGA

SEQ ID NO: 1468394 - protein, 18 aa, Mycobacterium tuberculosis
KLFGLSRERVRQIERDVM

SEQ ID NO: 1468395 - protein, 19 aa, Mycobacterium tuberculosis
KMMSSMLGGMGIPGIGRKS

SEQ ID NO: 1468396 - protein, 20 aa, Mycobacterium tuberculosis
KNVRCLLIYNQQWIGSTTTV

SEQ ID NO: 1468397 - protein, 17 aa, Mycobacterium tuberculosis
KSPFGVPGMPGLAGLPG

SEQ ID NO: 1468398 - protein, 21 aa, Mycobacterium tuberculosis
KSRPLWEMYLVEGLEKNRIAL

SEQ ID NO: 1468399 - protein, 18 aa, Mycobacterium tuberculosis
KTRGFPLGPGYLLDGLPV

SEQ ID NO: 1468400 - protein, 18 aa, Mycobacterium tuberculosis
KVWKGIRYAAPPLGDLRF

SEQ ID NO: 1468401 - protein, 22 aa, Mycobacterium tuberculosis
LAAKVWICKPVIPKPRGWSNVS

SEQ ID NO: 1468402 - protein, 25 aa, Mycobacterium tuberculosis
LADAIRRSGLPKVPTSVLSRGVCGV

SEQ ID NO: 1468403 - protein, 25 aa, Mycobacterium tuberculosis
LADHVVNGVVLFPGAGFVELVIRAG

SEQ ID NO: 1468404 - protein, 21 aa, Mycobacterium tuberculosis
LAEAACRAFDALAARYDVVVA

SEQ ID NO: 1468405 - protein, 22 aa, Mycobacterium tuberculosis
LAPRPALLVRRRLDLVAWATGL

SEQ ID NO: 1468406 - protein, 20 aa, Mycobacterium tuberculosis
LATRLGRYGIGPKFQHSGGE

SEQ ID NO: 1468407 - protein, 19 aa, Mycobacterium tuberculosis
LAVAASWFGSVTSGLADAA

SEQ ID NO: 1468408 - protein, 17 aa, Mycobacterium tuberculosis
LAYAGGVLFVAENPSRS

SEQ ID NO: 1468409 - protein, 25 aa, Mycobacterium tuberculosis
LDGDARGGAALSVREVTGVPILFAS

SEQ ID NO: 1468410 - protein, 20 aa, Mycobacterium tuberculosis
LDVADGARLVDSIEGEPGLG

SEQ ID NO: 1468411 - protein, 20 aa, Mycobacterium tuberculosis
LEQELACFLGKPAAVLCSTG

SEQ ID NO: 1468412 - protein, 18 aa, Mycobacterium tuberculosis
LERLRPGDFYRPAHQNVY

SEQ ID NO: 1468413 - protein, 17 aa, Mycobacterium tuberculosis
LGAMYPWQSGSDGSEVS

SEQ ID NO: 1468414 - protein, 21 aa, Mycobacterium tuberculosis
LHLRRALVTVGLFGGDAPVRD

SEQ ID NO: 1468415 - protein, 17 aa, Mycobacterium tuberculosis
LITAIGGPCDVQALPES

SEQ ID NO: 1468416 - protein, 27 aa, Mycobacterium tuberculosis
LKLIRARFGVPVPNLTAWRDATVGDMT

SEQ ID NO: 1468417 - protein, 24 aa, Mycobacterium tuberculosis
LLDVKRWVTLTGVGGVGKTRLATQ

SEQ ID NO: 1468418 - protein, 17 aa, Mycobacterium tuberculosis
LLMAVERIELFVDVLLK

SEQ ID NO: 1468419 - protein, 22 aa, Mycobacterium tuberculosis
LLPLYFELDGSFPNHEANPLDP

SEQ ID NO: 1468420 - protein, 18 aa, Mycobacterium tuberculosis
LLVRYGIPAVTDRQRSSS

SEQ ID NO: 1468421 - protein, 24 aa, Mycobacterium tuberculosis
LMMSLNMLIEFGDAFDYSAADFRG

SEQ ID NO: 1468422 - protein, 18 aa, Mycobacterium tuberculosis
LNAIAAGGYYGHSATAFS

SEQ ID NO: 1468423 - protein, 21 aa, Mycobacterium tuberculosis
LPGYALPLFVRVVGSLAHTTT

SEQ ID NO: 1468424 - protein, 17 aa, Mycobacterium tuberculosis
LPPPAALTGEWFGALAV

SEQ ID NO: 1468425 - protein, 19 aa, Mycobacterium tuberculosis
LPRTMLRFAGGREITLGDL

SEQ ID NO: 1468426 - protein, 24 aa, Mycobacterium tuberculosis
LPTQLCAFAAGVLRAEAVHEPGYY

SEQ ID NO: 1468427 - protein, 19 aa, Mycobacterium tuberculosis
LPVPARRVGRVILVDEPAG

SEQ ID NO: 1468428 - protein, 19 aa, Mycobacterium tuberculosis
LRDAGCDIVTITQYLRPSA

SEQ ID NO: 1468429 - protein, 20 aa, Mycobacterium tuberculosis
LRLIEEGFALYGDQPPFDLS

SEQ ID NO: 1468430 - protein, 17 aa, Mycobacterium tuberculosis
LRLVSVIKPTHPSPDDY

SEQ ID NO: 1468431 - protein, 17 aa, Mycobacterium tuberculosis
LRRVERRAVPLPLEQKI

SEQ ID NO: 1468432 - protein, 17 aa, Mycobacterium tuberculosis
LSGLLRGVGDEPELTDF

SEQ ID NO: 1468433 - protein, 33 aa, Mycobacterium tuberculosis
LSPLPLPLGFVDFACRVWRPGQGTVRTTINLPN

SEQ ID NO: 1468434 - protein, 18 aa, Mycobacterium tuberculosis
LSRRLAHWTRLYPEVRVD

SEQ ID NO: 1468435 - protein, 19 aa, Mycobacterium tuberculosis
LTDIPVRVYWPPVVRDNLP

SEQ ID NO: 1468436 - protein, 17 aa, Mycobacterium tuberculosis
LTGCEHFFRKGISNVGQ

SEQ ID NO: 1468437 - protein, 19 aa, Mycobacterium tuberculosis
LTGQGGWPMTCFLTPNGRP

SEQ ID NO: 1468438 - protein, 17 aa, Mycobacterium tuberculosis
LTLPPTVIFDHPTPTAV

SEQ ID NO: 1468439 - protein, 17 aa, Mycobacterium tuberculosis
LTPLYPNQRLRLETSTE

SEQ ID NO: 1468440 - protein, 23 aa, Mycobacterium tuberculosis
LVGGECSYWACVPSKALLRPVIA

SEQ ID NO: 1468441 - protein, 24 aa, Mycobacterium tuberculosis
LVPPGDGPWRLGLGSAGTFENLRL

SEQ ID NO: 1468442 - protein, 24 aa, Mycobacterium tuberculosis
LWADSFRLALVAAHDDGDSLRVVY

SEQ ID NO: 1468443 - protein, 17 aa, Mycobacterium tuberculosis
LWNPRGYGNNAWARVAL

SEQ ID NO: 1468444 - protein, 19 aa, Mycobacterium tuberculosis
LYPVLDRYDYVLIDCQPSL

SEQ ID NO: 1468445 - protein, 18 aa, Mycobacterium tuberculosis
MFFGAGSGPMLAAAAAWD

SEQ ID NO: 1468446 - protein, 18 aa, Mycobacterium tuberculosis
MLCYRRRGHNEGDDPSMT

SEQ ID NO: 1468447 - protein, 18 aa, Mycobacterium tuberculosis
MRRAREEAEQLVAQATAE

SEQ ID NO: 1468448 - protein, 19 aa, Mycobacterium tuberculosis
MSLHFQIGRRQVVKAEVSS

SEQ ID NO: 1468449 - protein, 19 aa, Mycobacterium tuberculosis
MSRAFASSCNTTFAELSSR

SEQ ID NO: 1468450 - protein, 17 aa, Mycobacterium tuberculosis
MWAQDIVAMEGYAGASA

SEQ ID NO: 1468451 - protein, 28 aa, Mycobacterium tuberculosis
NADLARPWLAEAVGLARAVGDKWRLAEV

SEQ ID NO: 1468452 - protein, 25 aa, Mycobacterium tuberculosis
NAPAQALFGRPLIGNGANGTAASPN

SEQ ID NO: 1468453 - protein, 26 aa, Mycobacterium tuberculosis
NELREMLPHNAVEYFVSYYDYYQPEA

SEQ ID NO: 1468454 - protein, 19 aa, Mycobacterium tuberculosis
NFGDPFPAPTQGITIHTGP

SEQ ID NO: 1468455 - protein, 20 aa, Mycobacterium tuberculosis
NFNAGPALRFMSGNLCHQIE

SEQ ID NO: 1468456 - protein, 39 aa, Mycobacterium tuberculosis; identical to SEQ ID NO: 203555

SEQ ID NO: 1468457 - protein, 20 aa, Mycobacterium tuberculosis
NLRRGGIQFADTRGYAYDRR

SEQ ID NO: 1468458 - protein, 25 aa, Mycobacterium tuberculosis
NQDWWPNRLNLKVLHQNPAVADPMG

SEQ ID NO: 1468459 - protein, 17 aa, Mycobacterium tuberculosis
NWQRIRHRWNWTDVRRW

SEQ ID NO: 1468460 - protein, 25 aa, Mycobacterium tuberculosis
NYDDFFKRCFNIMPADGRMTVQSSV

SEQ ID NO: 1468461 - protein, 26 aa, Mycobacterium tuberculosis
NYGSVIARLTGMHWWGPASTSMLAMS

SEQ ID NO: 1468462 - protein, 25 aa, Mycobacterium tuberculosis
PAPLPCTPRGIVHLLRRYDISIAGA

SEQ ID NO: 1468463 - protein, 17 aa, Mycobacterium tuberculosis
PAREVVLGYPVVDPADT

SEQ ID NO: 1468464 - protein, 24 aa, Mycobacterium tuberculosis
PASYDASLRVSWRQLQPTDPRTLP

SEQ ID NO: 1468465 - protein, 18 aa, Mycobacterium tuberculosis
PAVGFGGRHERSDAELLA

SEQ ID NO: 1468466 - protein, 21 aa, Mycobacterium tuberculosis
PDGQFPALPLFELGYDVAHVG

SEQ ID NO: 1468467 - protein, 17 aa, Mycobacterium tuberculosis
PEAGEAILTGWRMLLDE

SEQ ID NO: 1468468 - protein, 24 aa, Mycobacterium tuberculosis
PEAGEAILTGWRMLLDEGRLQDGE

SEQ ID NO: 1468469 - protein, 25 aa, Mycobacterium tuberculosis
PFSVTRPDGLPVWIYQFKISPHPTI

SEQ ID NO: 1468470 - protein, 24 aa, Mycobacterium tuberculosis
PGELSVHYPFPIADLVALDDALTY

SEQ ID NO: 1468471 - protein, 23 aa, Mycobacterium tuberculosis
PGGSGGNGGVWYGNGGAGGAAGQ

SEQ ID NO: 1468472 - protein, 29 aa, Mycobacterium tuberculosis
PGGSHSWFAGYRGDLAFASLIVGGGSSEY

SEQ ID NO: 1468473 - protein, 22 aa, Mycobacterium tuberculosis
PGLREAGFWRFVADPYDPSESQ

SEQ ID NO: 1468474 - protein, 19 aa, Mycobacterium tuberculosis
PGMHALRASTIVAALQYMV

SEQ ID NO: 1468475 - protein, 23 aa, Mycobacterium tuberculosis
PGPMLAAATAWDGLAVELHATAA

SEQ ID NO: 1468476 - protein, 29 aa, Mycobacterium tuberculosis
PGRAAPGVRRPRAWCSRIGRWPEPTGESG

SEQ ID NO: 1468477 - protein, 23 aa, Mycobacterium tuberculosis
PHAWLGDAFHAWVQQFYGAELLF

SEQ ID NO: 1468478 - protein, 17 aa, Mycobacterium tuberculosis
PHRVCRYLEDLAGDYHR

SEQ ID NO: 1468479 - protein, 30 aa, Mycobacterium tuberculosis; identical to SEQ ID NO: 1051995

SEQ ID NO: 1468480 - protein, 23 aa, Mycobacterium tuberculosis
PIVVRYCRARVGTVERSGLSADD

SEQ ID NO: 1468481 - protein, 17 aa, Mycobacterium tuberculosis
PMGGDALAYATYTSGTT

SEQ ID NO: 1468482 - protein, 27 aa, Mycobacterium tuberculosis
PPSVRELAVFWTARSIGCSWCVDFGAM

SEQ ID NO: 1468483 - protein, 19 aa, Mycobacterium tuberculosis
PPTARGWEVVAGDEIWNWT

SEQ ID NO: 1468484 - protein, 23 aa, Mycobacterium tuberculosis
PQHLARACARVGARLIHVSTDYV

SEQ ID NO: 1468485 - protein, 25 aa, Mycobacterium tuberculosis
PQLGKGGGRLPITLWIVDTNASTPA

SEQ ID NO: 1468486 - protein, 25 aa, Mycobacterium tuberculosis
PQLLSESGWYSALFGMQHETSYPKR

SEQ ID NO: 1468487 - protein, 17 aa, Mycobacterium tuberculosis
PRASMPKFLSTARGLAA

SEQ ID NO: 1468488 - protein, 21 aa, Mycobacterium tuberculosis
PRIGRRAANAVTVFFDGATLH

SEQ ID NO: 1468489 - protein, 19 aa, Mycobacterium tuberculosis
PRTVALTVYGDLETSTLRE

SEQ ID NO: 1468490 - protein, 26 aa, Mycobacterium tuberculosis
PSGVAVSPVTGLVFVTNFDSNTVSVI

SEQ ID NO: 1468491 - protein, 21 aa, Mycobacterium tuberculosis
PSSKLGGLWKTVSPHRSPISN

SEQ ID NO: 1468492 - protein, 17 aa, Mycobacterium tuberculosis
PTNGRQVPRRAAVSSYG

SEQ ID NO: 1468493 - protein, 24 aa, Mycobacterium tuberculosis
PVRNDFRAVISLDMRRFDRLHRID

SEQ ID NO: 1468494 - protein, 24 aa, Mycobacterium tuberculosis
QAEYLRWAVGAFRLATSGVSDATQ

SEQ ID NO: 1468495 - protein, 18 aa, Mycobacterium tuberculosis
QLPLPAGLQQFLNTLPNL

SEQ ID NO: 1468496 - protein, 19 aa, Mycobacterium tuberculosis
QLPLPAGLQQFLNTLPNLG

SEQ ID NO: 1468497 - protein, 24 aa, Mycobacterium tuberculosis
QRGVIPRDHIKAVLDAADVLIWMT

SEQ ID NO: 1468498 - protein, 25 aa, Mycobacterium tuberculosis
QRPAPQFEVMYLLAVCDAAAADQLR

SEQ ID NO: 1468499 - protein, 19 aa, Mycobacterium tuberculosis
QRTFGGWLLADLVTVDGSV

SEQ ID NO: 1468500 - protein, 23 aa, Mycobacterium tuberculosis
QSGFTFPLLSDFWPHGAVSQAYG

SEQ ID NO: 1468501 - protein, 17 aa, Mycobacterium tuberculosis
QTGQVWWPECSKEAYAD

SEQ ID NO: 1468502 - protein, 25 aa, Mycobacterium tuberculosis
RAAAARTGHPWWTLSQLSDESAIEL

SEQ ID NO: 1468503 - protein, 20 aa, Mycobacterium tuberculosis
RAAAFAGIKPFLALYMGGMG

SEQ ID NO: 1468504 - protein, 20 aa, Mycobacterium tuberculosis
RALAKFSDRFDVVIIDCPPS

SEQ ID NO: 1468505 - protein, 25 aa, Mycobacterium tuberculosis
RCATYPVLAVQAWAAFHDMTLRAVI

SEQ ID NO: 1468506 - protein, 27 aa, Mycobacterium tuberculosis
RDSLPRIAQAIALPAVRKTGVLENEAE

SEQ ID NO: 1468507 - protein, 17 aa, Mycobacterium tuberculosis
RDTRSCPQRNHDALNAG

SEQ ID NO: 1468508 - protein, 22 aa, Mycobacterium tuberculosis
REAARIALNPTQEWLDEFDRAI

SEQ ID NO: 1468509 - protein, 19 aa, Mycobacterium tuberculosis
REARKGTGHPAGEQPRDGV

SEQ ID NO: 1468510 - protein, 25 aa, Mycobacterium tuberculosis
REGRALDDFATWCALAETYGDDWHR

SEQ ID NO: 1468511 - protein, 17 aa, Mycobacterium tuberculosis
REILRRVELSTTTTSGE

SEQ ID NO: 1468512 - protein, 18 aa, Mycobacterium tuberculosis
RELATYFVGQVVGSLDRV

SEQ ID NO: 1468513 - protein, 24 aa, Mycobacterium tuberculosis
RFQSGDGPPIFLLSLKAGGTGLNL

SEQ ID NO: 1468514 - protein, 21 aa, Mycobacterium tuberculosis
RGFYAGAVGWCDGRGDGHWVV

SEQ ID NO: 1468515 - protein, 23 aa, Mycobacterium tuberculosis
RGPGQMLGGLPVGQMGARAGGGL

SEQ ID NO: 1468516 - protein, 17 aa, Mycobacterium tuberculosis
RHFRFGPEPDRSQTFAC

SEQ ID NO: 1468517 - protein, 19 aa, Mycobacterium tuberculosis
RHVWGWRRLLLKQILECVL

SEQ ID NO: 1468518 - protein, 17 aa, Mycobacterium tuberculosis
RKNLHVWAGECHVHAGI

SEQ ID NO: 1468519 - protein, 20 aa, Mycobacterium tuberculosis
RLDPDYRFNFGVAYDRSLLF

SEQ ID NO: 1468520 - protein, 25 aa, Mycobacterium tuberculosis
RLGFARLAIQHGYPIVPFASVGAEH

SEQ ID NO: 1468521 - protein, 25 aa, Mycobacterium tuberculosis
RLLETRFGVPVPNLTAWRRSVTGDM

SEQ ID NO: 1468522 - protein, 17 aa, Mycobacterium tuberculosis
RLLISASEWSGRGLWAN

SEQ ID NO: 1468523 - protein, 19 aa, Mycobacterium tuberculosis
RLPGFRPGKAPAKLLEARI

SEQ ID NO: 1468524 - protein, 24 aa, Mycobacterium tuberculosis
RLPPPHRIAPVAVHAYLADITSSN

SEQ ID NO: 1468525 - protein, 18 aa, Mycobacterium tuberculosis
RLSFGRFGDEPALTASDD

SEQ ID NO: 1468526 - protein, 23 aa, Mycobacterium tuberculosis
RLVKAGKVDKDWDADATKGIPFG

SEQ ID NO: 1468527 - protein, 18 aa, Mycobacterium tuberculosis
RPAALMVPDGVLRARKLP

SEQ ID NO: 1468528 - protein, 17 aa, Mycobacterium tuberculosis
RPAPVKFMLSAPTEHEG

SEQ ID NO: 1468529 - protein, 19 aa, Mycobacterium tuberculosis
RPGPEFRPSEVARLGYLAG

SEQ ID NO: 1468530 - protein, 18 aa, Mycobacterium tuberculosis
RPRAVNVRGADDAALPPV

SEQ ID NO: 1468531 - protein, 20 aa, Mycobacterium tuberculosis
RPVQPAAVALRLVQTTGADT

SEQ ID NO: 1468532 - protein, 20 aa, Mycobacterium tuberculosis
RRCARRRAEIFTWQRAAASM

SEQ ID NO: 1468533 - protein, 17 aa, Mycobacterium tuberculosis
RRVPLGLIAGARSGDKG

SEQ ID NO: 1468534 - protein, 19 aa, Mycobacterium tuberculosis
RSIGCSWCVDFGAMLQRLD

SEQ ID NO: 1468535 - protein, 18 aa, Mycobacterium tuberculosis
RSNGFGFTFADAENLLDY

SEQ ID NO: 1468536 - protein, 19 aa, Mycobacterium tuberculosis
RWVLDADIKACFDRIDHAD

SEQ ID NO: 1468537 - protein, 24 aa, Mycobacterium tuberculosis
RYIVRIEPFASLPAEQIVQTIAPN

SEQ ID NO: 1468538 - protein, 22 aa, Mycobacterium tuberculosis
RYRPEIESAPTFQAYEVPLTRE

SEQ ID NO: 1468539 - protein, 18 aa, Mycobacterium tuberculosis
RYTLGVNWRSDRALVESL

SEQ ID NO: 1468540 - protein, 18 aa, Mycobacterium tuberculosis
SAAYGRYQPLGVILAVMP

SEQ ID NO: 1468541 - protein, 20 aa, Mycobacterium tuberculosis
SAGKWPDKFLAGAAGVAHGV

SEQ ID NO: 1468542 - protein, 19 aa, Mycobacterium tuberculosis
SATQAAALVAEFEAVRAAM

SEQ ID NO: 1468543 - protein, 22 aa, Mycobacterium tuberculosis
SAVLRRLLISASEWSGRGLWAN

SEQ ID NO: 1468544 - protein, 20 aa, Mycobacterium tuberculosis
SDITPINAFYVRNHGPVPDI

SEQ ID NO: 1468545 - protein, 20 aa, Mycobacterium tuberculosis
SDTGVNMLFTMRAAVVEADL

SEQ ID NO: 1468546 - protein, 18 aa, Mycobacterium tuberculosis
SGVTYSWETVRRLVQMRT

SEQ ID NO: 1468547 - protein, 19 aa, Mycobacterium tuberculosis
SHEARFVLIGTMNPEEGEL

SEQ ID NO: 1468548 - protein, 26 aa, Mycobacterium tuberculosis
SLHAAKGLEWDAVFLVGLADGTLPIS

SEQ ID NO: 1468549 - protein, 17 aa, Mycobacterium tuberculosis
SLVEYVIMGQVLTAGAG

SEQ ID NO: 1468550 - protein, 17 aa, Mycobacterium tuberculosis
SPEGLKRNLRLRDGRWH

SEQ ID NO: 1468551 - protein, 24 aa, Mycobacterium tuberculosis
SRAIYKDGWWACARLDKAPWDLSP

SEQ ID NO: 1468552 - protein, 25 aa, Mycobacterium tuberculosis
SRAIYKDGWWACARLDKAPWDLSPE

SEQ ID NO: 1468553 - protein, 17 aa, Mycobacterium tuberculosis
SRQAIWDLVASFKKLGI

SEQ ID NO: 1468554 - protein, 20 aa, Mycobacterium tuberculosis
SSEIMRLLIAREAVDAHLTA

SEQ ID NO: 1468555 - protein, 19 aa, Mycobacterium tuberculosis
SSGFLNWGAGSASGLLNFG

SEQ ID NO: 1468556 - protein, 18 aa, Mycobacterium tuberculosis
SSVPQFWAGELQTVTSPY

SEQ ID NO: 1468557 - protein, 18 aa, Mycobacterium tuberculosis
STASHHRRALGIQRLLAA

SEQ ID NO: 1468558 - protein, 18 aa, Mycobacterium tuberculosis
STFGPRTALWLLLAKGGG

SEQ ID NO: 1468559 - protein, 17 aa, Mycobacterium tuberculosis
STHRLMVPSRSMHRLIK

SEQ ID NO: 1468560 - protein, 25 aa, Mycobacterium tuberculosis
STPNRWQVRPGPVAARRWDIEPDLT

SEQ ID NO: 1468561 - protein, 18 aa, Mycobacterium tuberculosis
STSIAERVRALLGTPSVD

SEQ ID NO: 1468562 - protein, 24 aa, Mycobacterium tuberculosis
SVHGRPRRAGVSSFGISGTNAHVI

SEQ ID NO: 1468563 - protein, 17 aa, Mycobacterium tuberculosis
SVHPCGVDTPMINNEFF

SEQ ID NO: 1468564 - protein, 25 aa, Mycobacterium tuberculosis
SYADVRTPFGLWPNVPPQVIADALA

SEQ ID NO: 1468565 - protein, 25 aa, Mycobacterium tuberculosis
SYRELPLRLFEFGTVYRYEKSGVVH

SEQ ID NO: 1468566 - protein, 27 aa, Mycobacterium tuberculosis
TADLNFAWPTARIAVIGADGAAQLLMK

SEQ ID NO: 1468567 - protein, 17 aa, Mycobacterium tuberculosis
TALRDSLDIYGVMATPG

SEQ ID NO: 1468568 - protein, 18 aa, Mycobacterium tuberculosis
TAPAPPWAKMPIGEPPPA

SEQ ID NO: 1468569 - protein, 17 aa, Mycobacterium tuberculosis
TEARGVARIGLANYFAG

SEQ ID NO: 1468570 - protein, 20 aa, Mycobacterium tuberculosis
TGLYPPGSTFKMITAGAAVE

SEQ ID NO: 1468571 - protein, 24 aa, Mycobacterium tuberculosis
TGSVPQRLWAKPAITVIGIDTTSV

SEQ ID NO: 1468572 - protein, 21 aa, Mycobacterium tuberculosis
TLASQAAHVVMRFQQGLAELV

SEQ ID NO: 1468573 - protein, 20 aa, Mycobacterium tuberculosis
TLLGRLLVYDALEMSYRTIT

SEQ ID NO: 1468574 - protein, 21 aa, Mycobacterium tuberculosis
TLQSFLPPPFDAIPNPIEDLD

SEQ ID NO: 1468575 - protein, 36 aa, Mycobacterium tuberculosis
TMSPAERWHLLASAWLDLPGRPALIGTRGPDAKPYG

SEQ ID NO: 1468576 - protein, 24 aa, Mycobacterium tuberculosis
TQLLKLLAKLAELVAAAIADIISD

SEQ ID NO: 1468577 - protein, 18 aa, Mycobacterium tuberculosis
TRIPGRQGAGIDLPNTDP

SEQ ID NO: 1468578 - protein, 25 aa, Mycobacterium tuberculosis
TSLGFSYDVLHAFNPRIVLAGSSAF

SEQ ID NO: 1468579 - protein, 18 aa, Mycobacterium tuberculosis
TTEEFSIRVFPGDHFYLN

SEQ ID NO: 1468580 - protein, 32 aa, Mycobacterium tuberculosis; identical to SEQ ID NO: 207350

SEQ ID NO: 1468581 - protein, 25 aa, Mycobacterium tuberculosis
TVCILDRPRHAQLIHDVRATGARIR

SEQ ID NO: 1468582 - protein, 21 aa, Mycobacterium tuberculosis
TWGVMGIGMGYAIAAAVETGR

SEQ ID NO: 1468583 - protein, 19 aa, Mycobacterium tuberculosis
VADQPIWAGAVQRLKVGSA

SEQ ID NO: 1468584 - protein, 20 aa, Mycobacterium tuberculosis
VALDRGEFFLVYQPIIRLAD

SEQ ID NO: 1468585 - protein, 22 aa, Mycobacterium tuberculosis
VAVRRISMSFVNVAPQLVSTAA

SEQ ID NO: 1468586 - protein, 17 aa, Mycobacterium tuberculosis
VDFFVRMASGELDPDEL

SEQ ID NO: 1468587 - protein, 26 aa, Mycobacterium tuberculosis
VDPKAVPSRLAWEAGVALADSLLARY

SEQ ID NO: 1468588 - protein, 25 aa, Mycobacterium tuberculosis
VDPLLPEVAWSWLVDALTARTDQVR

SEQ ID NO: 1468589 - protein, 22 aa, Mycobacterium tuberculosis
VDRIVSIEAFEHFGHENYDDFF

SEQ ID NO: 1468590 - protein, 19 aa, Mycobacterium tuberculosis
VEAHLRRHAPWGAQVTVTR

SEQ ID NO: 1468591 - protein, 19 aa, Mycobacterium tuberculosis
VEFQGGGPHAWYLSDGILA

SEQ ID NO: 1468592 - protein, 17 aa, Mycobacterium tuberculosis
VEQRPELVLDRVRAFLA

SEQ ID NO: 1468593 - protein, 28 aa, Mycobacterium tuberculosis
VERLCRRLADQAVRQWGFMQGLKQKLGP

SEQ ID NO: 1468594 - protein, 18 aa, Mycobacterium tuberculosis
VFLVMPFTTDFMKLTPDR

SEQ ID NO: 1468595 - protein, 19 aa, Mycobacterium tuberculosis
VFVNARVDTYWLRQHADTT

SEQ ID NO: 1468596 - protein, 20 aa, Mycobacterium tuberculosis
VGGTWHWNTYPGIAVDIPSF

SEQ ID NO: 1468597 - protein, 24 aa, Mycobacterium tuberculosis
VGILGQRCAPVFVMAAPGQPLPTL

SEQ ID NO: 1468598 - protein, 28 aa, Mycobacterium tuberculosis
VGMPYVNQRWLGGMLTNFSTVHKRLQRL

SEQ ID NO: 1468599 - protein, 18 aa, Mycobacterium tuberculosis
VHGVDAKLAVKVNDLMLP

SEQ ID NO: 1468600 - protein, 17 aa, Mycobacterium tuberculosis
VHIYLQFDGLDEATHRR

SEQ ID NO: 1468601 - protein, 19 aa, Mycobacterium tuberculosis
VIDLLGAVVAVAAHESNTY

SEQ ID NO: 1468602 - protein, 24 aa, Mycobacterium tuberculosis
VITAFNFPVAVWAWNTAVALVCGD

SEQ ID NO: 1468603 - protein, 17 aa, Mycobacterium tuberculosis
VKGMLTGPVTILAWSFV

SEQ ID NO: 1468604 - protein, 20 aa, Mycobacterium tuberculosis
VLSGSACSALVFATLAAGDV

SEQ ID NO: 1468605 - protein, 17 aa, Mycobacterium tuberculosis
VMHEGPRSLGYGAGLAA

SEQ ID NO: 1468606 - protein, 25 aa, Mycobacterium tuberculosis
VNTHCNLDCPICFADSGHQPDGYAI

SEQ ID NO: 1468607 - protein, 22 aa, Mycobacterium tuberculosis
VPDILECLASVMADAGSNREAV

SEQ ID NO: 1468608 - protein, 19 aa, Mycobacterium tuberculosis
VPGGTAFPHCSGVLVAGDE

SEQ ID NO: 1468609 - protein, 17 aa, Mycobacterium tuberculosis
VPGYRLVDSTGQVVRTL

SEQ ID NO: 1468610 - protein, 26 aa, Mycobacterium tuberculosis
VPSLPFRLIHIADTYTPIAPADLPGR

SEQ ID NO: 1468611 - protein, 18 aa, Mycobacterium tuberculosis
VRDACLLLAGERPYREFP

SEQ ID NO: 1468612 - protein, 18 aa, Mycobacterium tuberculosis
VRDVACRRDFEDVALTLV

SEQ ID NO: 1468613 - protein, 20 aa, Mycobacterium tuberculosis
VRTSRGWSASPVRHGLSTIR

SEQ ID NO: 1468614 - protein, 24 aa, Mycobacterium tuberculosis
VRVIRTLRRLGIRSVAVYSDPDVD

SEQ ID NO: 1468615 - protein, 19 aa, Mycobacterium tuberculosis
VSAAIAALFSAHGQDYQAL

SEQ ID NO: 1468616 - protein, 21 aa, Mycobacterium tuberculosis
VSALRVPGRHPAVAAWADSVQ

SEQ ID NO: 1468617 - protein, 29 aa, Mycobacterium tuberculosis
VSDDGRWRIVGNIPRGMFVGGRRGSSVTV

SEQ ID NO: 1468618 - protein, 25 aa, Mycobacterium tuberculosis
VSLPIFGFGGAPGFGNDTTAPSSGF

SEQ ID NO: 1468619 - protein, 28 aa, Mycobacterium tuberculosis
VTAPAGFRAAGVAAGIKASGALDLALVF

SEQ ID NO: 1468620 - protein, 18 aa, Mycobacterium tuberculosis
VVLREILRRVELSTTTTS

SEQ ID NO: 1468621 - protein, 17 aa, Mycobacterium tuberculosis
VVRQRRSLLAAGITAVS

SEQ ID NO: 1468622 - protein, 17 aa, Mycobacterium tuberculosis
VVVSSRAAAGVYTDDCG

SEQ ID NO: 1468623 - protein, 18 aa, Mycobacterium tuberculosis
WAKVTGRVAPVFDLGIGM

SEQ ID NO: 1468624 - protein, 25 aa, Mycobacterium tuberculosis
WDLGDAHGTVMLRMPLHPVAIELLR

SEQ ID NO: 1468625 - protein, 17 aa, Mycobacterium tuberculosis
WGGRFAGGPSDALAALS

SEQ ID NO: 1468626 - protein, 17 aa, Mycobacterium tuberculosis
WGPRAPFEVLLGKPRAG

SEQ ID NO: 1468627 - protein, 31 aa, Mycobacterium tuberculosis
WPGEERLLRLGLQSLRLWREGSFLDGLGPQL

SEQ ID NO: 1468628 - protein, 18 aa, Mycobacterium tuberculosis
WSGSWGNGRGRGCRCGRG

SEQ ID NO: 1468629 - protein, 19 aa, Mycobacterium tuberculosis
WVWLPTLLAGRVFTHRLGA

SEQ ID NO: 1468630 - protein, 30 aa, Mycobacterium tuberculosis; identical to SEQ ID NO: 234541

SEQ ID NO: 1468631 - protein, 17 aa, Mycobacterium tuberculosis
YAHVTGRVGVCMATSGP

SEQ ID NO: 1468632 - protein, 17 aa, Mycobacterium tuberculosis
YALAGRHVHVVTINDYL

SEQ ID NO: 1468633 - protein, 22 aa, Mycobacterium tuberculosis
YAMAFDEMFDAQGIVRGPYKGI

SEQ ID NO: 1468634 - protein, 17 aa, Mycobacterium tuberculosis
YEVELCVAEVAHYGETK

SEQ ID NO: 1468635 - protein, 26 aa, Mycobacterium tuberculosis
YHWIDYPGPDRAAAIVRRTVPGATAP

SEQ ID NO: 1468636 - protein, 18 aa, Mycobacterium tuberculosis
YITARFLPDKAIDLVDEA

SEQ ID NO: 1468637 - protein, 18 aa, Mycobacterium tuberculosis
YLIGDGRDGWVGGKTPIN

SEQ ID NO: 1468638 - protein, 17 aa, Mycobacterium tuberculosis
YLLEPVSVWAPECSEDL

SEQ ID NO: 1468639 - protein, 17 aa, Mycobacterium tuberculosis
YLYHYSLDAGQAGRELF

SEQ ID NO: 1468640 - protein, 21 aa, Mycobacterium tuberculosis
YNAVCSVYGHLHIPRTTWYDG

SEQ ID NO: 1468641 - protein, 26 aa, Mycobacterium tuberculosis
YRDHVARGLDMSRLMIFTWDLPGRCN

SEQ ID NO: 1468642 - protein, 26 aa, Mycobacterium tuberculosis
YSLARWRKADAALGRPVVSNQVHFSL

SEQ ID NO: 1468643 - protein, 23 aa, Mycobacterium tuberculosis
YTPRMRIGIHTGRPQRLAADWLG

SEQ ID NO: 1468644 - protein, 22 aa, Mycobacterium tuberculosis
YTVQAQKLWAQAGFRPVDPAVA

SEQ ID NO: 1468645 - protein, 17 aa, Mycobacterium tuberculosis
YVIDFLAYVYEETRHKV

SEQ ID NO: 1468646 - protein, 18 aa, Mycobacterium tuberculosis
YYFRDFWGADSGMLAALH

SEQ ID NO: 1468647 - protein, 23 aa, Mycobacterium tuberculosis
AAAAAPYAGWLAAAAARAAGASA

SEQ ID NO: 1468648 - protein, 17 aa, Mycobacterium tuberculosis
AAALWFALDTDLPVLVD

SEQ ID NO: 1468649 - protein, 18 aa, Mycobacterium tuberculosis
AAAVLALNSLRVHSASVN

SEQ ID NO: 1468650 - protein, 19 aa, Mycobacterium tuberculosis
AAHTTRARQVLVATEVGML

SEQ ID NO: 1468651 - protein, 17 aa, Mycobacterium tuberculosis
AAIARRALGDNVIAISV

SEQ ID NO: 1468652 - protein, 23 aa, Mycobacterium tuberculosis
AALHHPCCGDLVYGADPKLAKRL

SEQ ID NO: 1468653 - protein, 26 aa, Mycobacterium tuberculosis
AARQKAERGHPNWSKAFGYLPGPNGP

SEQ ID NO: 1468654 - protein, 23 aa, Mycobacterium tuberculosis
AASCGLGHRKGRIAPGYDADLLA

SEQ ID NO: 1468655 - protein, 22 aa, Mycobacterium tuberculosis
AAVAVEFARLYAVELEHYEKLE

SEQ ID NO: 1468656 - protein, 24 aa, Mycobacterium tuberculosis
AAVNGFCVGGGIGLVGNSDVIVAS

SEQ ID NO: 1468657 - protein, 29 aa, Mycobacterium tuberculosis
ACRRWPKLMRRLLLWEVRRRLGRSVDMSN

SEQ ID NO: 1468658 - protein, 20 aa, Mycobacterium tuberculosis
ADDGQAYGFAAAFGAGPSCE

SEQ ID NO: 1468659 - protein, 23 aa, Mycobacterium tuberculosis
ADEVSAAVAALFSGHAQTYQALS

SEQ ID NO: 1468660 - protein, 20 aa, Mycobacterium tuberculosis
ADLLGKRLHRVLGPLAHVNL

SEQ ID NO: 1468661 - protein, 23 aa, Mycobacterium tuberculosis
ADRDWLAFHASYPGNDPLRDARP

SEQ ID NO: 1468662 - protein, 21 aa, Mycobacterium tuberculosis
ADSILSWAVAGWSDYQRIGLS

SEQ ID NO: 1468663 - protein, 17 aa, Mycobacterium tuberculosis
ADVGRAQFFKDLGVEMI

SEQ ID NO: 1468664 - protein, 24 aa, Mycobacterium tuberculosis
AEAIRASGLSAGIVDAGLSRGLAG

SEQ ID NO: 1468665 - protein, 29 aa, Mycobacterium tuberculosis
AEAIRQLAIRAFAAIDCRGLARVDFFLTD

SEQ ID NO: 1468666 - protein, 18 aa, Mycobacterium tuberculosis
AEALCAALEVVQQADTAA

SEQ ID NO: 1468667 - protein, 19 aa, Mycobacterium tuberculosis
AELSRLSSPIGLDLGARTP

SEQ ID NO: 1468668 - protein, 17 aa, Mycobacterium tuberculosis
AEMWAQDAMAMYGYAGS

SEQ ID NO: 1468669 - protein, 22 aa, Mycobacterium tuberculosis
AESELRAAVNAARAAGDTWAAI

SEQ ID NO: 1468670 - protein, 20 aa, Mycobacterium tuberculosis
AESIRKFRILPVDFTEDTGE

SEQ ID NO: 1468671 - protein, 17 aa, Mycobacterium tuberculosis
AEVDVWFANKIGGADWV

SEQ ID NO: 1468672 - protein, 24 aa, Mycobacterium tuberculosis
AFYQAEIFEIVWSLWNLSRTDIDL

SEQ ID NO: 1468673 - protein, 25 aa, Mycobacterium tuberculosis
AGAVSFRFGDRTQINGVARDDAVAA

SEQ ID NO: 1468674 - protein, 22 aa, Mycobacterium tuberculosis
AGEAILTGWRMLLDEGRLQDGE

SEQ ID NO: 1468675 - protein, 21 aa, Mycobacterium tuberculosis
AGELLRLARVLGIAATRDRAR

SEQ ID NO: 1468676 - protein, 18 aa, Mycobacterium tuberculosis
AGGYGLDPERIWTTVYFD

SEQ ID NO: 1468677 - protein, 26 aa, Mycobacterium tuberculosis
AGKPLLGICGGFQMLGRVIRDPYGIE

SEQ ID NO: 1468678 - protein, 24 aa, Mycobacterium tuberculosis
AGPGAIRRLCCGADVVADTAVSAA

SEQ ID NO: 1468679 - protein, 19 aa, Mycobacterium tuberculosis
AGPRYGFRPTVMARPPFAG

SEQ ID NO: 1468680 - protein, 24 aa, Mycobacterium tuberculosis
AGRGLRCIAPTWPLGAHPKPLRPG

SEQ ID NO: 1468681 - protein, 19 aa, Mycobacterium tuberculosis
AGTSGWWNQGHDVLAGAGS

SEQ ID NO: 1468682 - protein, 24 aa, Mycobacterium tuberculosis
AHAARPHVHPVRMIAGAAGLCAVA

SEQ ID NO: 1468683 - protein, 18 aa, Mycobacterium tuberculosis
AHQLELRASWTATTPDLG

SEQ ID NO: 1468684 - protein, 28 aa, Mycobacterium tuberculosis
AIVIGCGPIGLAVICMLKSRGVHTVIAS

SEQ ID NO: 1468685 - protein, 25 aa, Mycobacterium tuberculosis
AKAVAGAFEAARAAMVDPVVVAANR

SEQ ID NO: 1468686 - protein, 18 aa, Mycobacterium tuberculosis
AKDARLTILEVMAEAIDR

SEQ ID NO: 1468687 - protein, 29 aa, Mycobacterium tuberculosis
AKEDYFKLGYRGARFAFGYGACPDLEDRA

SEQ ID NO: 1468688 - protein, 25 aa, Mycobacterium tuberculosis
AKPGRRCALTSWCALSMRRTHFRST

SEQ ID NO: 1468689 - protein, 19 aa, Mycobacterium tuberculosis
ALGRRRPDIAVTILRLANM

SEQ ID NO: 1468690 - protein, 17 aa, Mycobacterium tuberculosis
ALMFARRRGVLVANAVG

SEQ ID NO: 1468691 - protein, 19 aa, Mycobacterium tuberculosis
ANVGVWVRTDEQWRWLAHT

SEQ ID NO: 1468692 - protein, 30 aa, Mycobacterium tuberculosis
ANVGVWVRTDEQWRWLAHTLTVELLKELLP

SEQ ID NO: 1468693 - protein, 20 aa, Mycobacterium tuberculosis
APALLWIHAGGYVMGTAQQD

SEQ ID NO: 1468694 - protein, 24 aa, Mycobacterium tuberculosis
APAVRRLAERGAPEIQAYDPVFFP

SEQ ID NO: 1468695 - protein, 20 aa, Mycobacterium tuberculosis
APLQRPILCTEYLARSQGST

SEQ ID NO: 1468696 - protein, 17 aa, Mycobacterium tuberculosis
AQDWLHNRVPALDGQRF

SEQ ID NO: 1468697 - protein, 23 aa, Mycobacterium tuberculosis
AQMDWSFGEVIAYASRGVTLTPG

SEQ ID NO: 1468698 - protein, 18 aa, Mycobacterium tuberculosis
AQRLPGYLVPAAVVVIDA

SEQ ID NO: 1468699 - protein, 19 aa, Mycobacterium tuberculosis
ARARLVERLGALKPATMRA

SEQ ID NO: 1468700 - protein, 21 aa, Mycobacterium tuberculosis
ARGGSSIGVSRVSSWDQLPAA

SEQ ID NO: 1468701 - protein, 25 aa, Mycobacterium tuberculosis
ARGLVRLRAVLPLIDGGAESPQETW

SEQ ID NO: 1468702 - protein, 17 aa, Mycobacterium tuberculosis
ARIAIGGLYGDITYPVT

SEQ ID NO: 1468703 - protein, 25 aa, Mycobacterium tuberculosis
ARMHLLRLASEFGLTPAAEQRLAVA

SEQ ID NO: 1468704 - protein, 20 aa, Mycobacterium tuberculosis
ARQLLDGLLLVSGNDAANTL

SEQ ID NO: 1468705 - protein, 24 aa, Mycobacterium tuberculosis
ARVPQRFVPDLTKYQYWNGDSNSW

SEQ ID NO: 1468706 - protein, 23 aa, Mycobacterium tuberculosis
ASGELIATVAMPPRVPRAVDADT

SEQ ID NO: 1468707 - protein, 18 aa, Mycobacterium tuberculosis
ASLLTPAMLGAHYRLGRH

SEQ ID NO: 1468708 - protein, 22 aa, Mycobacterium tuberculosis
ASRLIRLPMWVGLQEVDQSRVV

SEQ ID NO: 1468709 - protein, 23 aa, Mycobacterium tuberculosis
ASRWPRAGALGPLIRDPDGSVYP

SEQ ID NO: 1468710 - protein, 17 aa, Mycobacterium tuberculosis
ATALRRAGRSAGPRQLG

SEQ ID NO: 1468711 - protein, 19 aa, Mycobacterium tuberculosis
ATNFGPLQPLFDVINAPTL

SEQ ID NO: 1468712 - protein, 19 aa, Mycobacterium tuberculosis
AVEDVFPLPRELVGEGTLF

SEQ ID NO: 1468713 - protein, 30 aa, Mycobacterium tuberculosis
AVERLCRRLADQAVRQWGFMQGLKQKLGPG

SEQ ID NO: 1468714 - protein, 17 aa, Mycobacterium tuberculosis
AVLRRCGRCGRKASWYD

SEQ ID NO: 1468715 - protein, 19 aa, Mycobacterium tuberculosis
AYAMEANWALLLLDDDGAG

SEQ ID NO: 1468716 - protein, 17 aa, Mycobacterium tuberculosis
CARNLAEGLLLTMDQPY

SEQ ID NO: 1468717 - protein, 20 aa, Mycobacterium tuberculosis
CGADRVVLVLLDRAGSSAVV

SEQ ID NO: 1468718 - protein, 25 aa, Mycobacterium tuberculosis
CGTIRVGSFRGRWLDPRHAGPATAA

SEQ ID NO: 1468719 - protein, 23 aa, Mycobacterium tuberculosis
CLGSGRWPGRLLGSVSSGLLRHA

SEQ ID NO: 1468720 - protein, 20 aa, Mycobacterium tuberculosis
CPVVMPAKLFDEWFPANKLV

SEQ ID NO: 1468721 - protein, 18 aa, Mycobacterium tuberculosis
CRDERGGSVAVEIKRRGE

SEQ ID NO: 1468722 - protein, 24 aa, Mycobacterium tuberculosis
CRLPADLREQWSIRQVPLHILLDG

SEQ ID NO: 1468723 - protein, 20 aa, Mycobacterium tuberculosis
CRQLADALGATVLLKGNVTV

SEQ ID NO: 1468724 - protein, 21 aa, Mycobacterium tuberculosis
DAIVGKAQWSPLVDEATFWAA

SEQ ID NO: 1468725 - protein, 21 aa, Mycobacterium tuberculosis
DAKRMFACFDQPDLKATFDVR

SEQ ID NO: 1468726 - protein, 27 aa, Mycobacterium tuberculosis
DARTAEFVFRPGPVFTNLLLADEINRT

SEQ ID NO: 1468727 - protein, 25 aa, Mycobacterium tuberculosis
DAVLPLRWTDGGMSRVRVLRGAPSG

SEQ ID NO: 1468728 - protein, 22 aa, Mycobacterium tuberculosis
DDGRVCGLVAIELATGRIETIL

SEQ ID NO: 1468729 - protein, 30 aa, Mycobacterium tuberculosis
DDYVYPGHAIWWLARGLEFFQDGEQFGELL

SEQ ID NO: 1468730 - protein, 22 aa, Mycobacterium tuberculosis
DELRAAVSKYWKIDEIRPAFIH

SEQ ID NO: 1468731 - protein, 21 aa, Mycobacterium tuberculosis
DENYILLEWGIDRDFEHYRKA

SEQ ID NO: 1468732 - protein, 22 aa, Mycobacterium tuberculosis
DGGLLLPLGVRRLRSYGSARHA

SEQ ID NO: 1468733 - protein, 17 aa, Mycobacterium tuberculosis
DGHYRIGLRPSGNGPTA

SEQ ID NO: 1468734 - protein, 17 aa, Mycobacterium tuberculosis
DGMRADLVVARTAAAHA

SEQ ID NO: 1468735 - protein, 18 aa, Mycobacterium tuberculosis
DGVAHGFTVARHGPDVYV

SEQ ID NO: 1468736 - protein, 17 aa, Mycobacterium tuberculosis
DGYARIAGRPAAVLLHL

SEQ ID NO: 1468737 - protein, 17 aa, Mycobacterium tuberculosis
DIFVEFSRWRGLSPDGR

SEQ ID NO: 1468738 - protein, 18 aa, Mycobacterium tuberculosis
DIGISHVVFKPGTIEQIR

SEQ ID NO: 1468739 - protein, 17 aa, Mycobacterium tuberculosis
DIRETFRRMAMNDVETA

SEQ ID NO: 1468740 - protein, 24 aa, Mycobacterium tuberculosis
DIRETFRRMAMNDVETAALIVGGH

SEQ ID NO: 1468741 - protein, 19 aa, Mycobacterium tuberculosis
DKRVLRLVNWQRIRHRWNW

SEQ ID NO: 1468742 - protein, 19 aa, Mycobacterium tuberculosis
DLDGIRVLRSFDESMALRK

SEQ ID NO: 1468743 - protein, 17 aa, Mycobacterium tuberculosis
DLPLPLRWGEYRAGGLA

SEQ ID NO: 1468744 - protein, 23 aa, Mycobacterium tuberculosis
DNAMLGLLCDAAFDELTRPDVVI

SEQ ID NO: 1468745 - protein, 21 aa, Mycobacterium tuberculosis
DPQMLRYFASIGISLDSRLRV

SEQ ID NO: 1468746 - protein, 19 aa, Mycobacterium tuberculosis
DRLPLSASVWDIAQRYNKG

SEQ ID NO: 1468747 - protein, 17 aa, Mycobacterium tuberculosis
DRPALYMVECARARGDI

SEQ ID NO: 1468748 - protein, 17 aa, Mycobacterium tuberculosis
DRVYRLAYRLSGNQHDA

SEQ ID NO: 1468749 - protein, 17 aa, Mycobacterium tuberculosis
DSVWLCDHFLTISPGEY

SEQ ID NO: 1468750 - protein, 26 aa, Mycobacterium tuberculosis
DTACSSSLVAIHWAMSSLRSGECDLA

SEQ ID NO: 1468751 - protein, 24 aa, Mycobacterium tuberculosis
DVEPCAAVGVELRRRGHAVHMAVP

SEQ ID NO: 1468752 - protein, 23 aa, Mycobacterium tuberculosis
DVPEMFRELVGLPAGSPEFQRHR

SEQ ID NO: 1468753 - protein, 19 aa, Mycobacterium tuberculosis
EAALRVARDIAAKDTRVIR

SEQ ID NO: 1468754 - protein, 20 aa, Mycobacterium tuberculosis
EAARIALNPTQEWLDEFDRA

SEQ ID NO: 1468755 - protein, 17 aa, Mycobacterium tuberculosis
EAGKVYRLWVVGRLQLW

SEQ ID NO: 1468756 - protein, 20 aa, Mycobacterium tuberculosis
EARCNAIAAAVLMPADVVRA

SEQ ID NO: 1468757 - protein, 21 aa, Mycobacterium tuberculosis
EDGEKRIPLDVAEGDTVIYSK

SEQ ID NO: 1468758 - protein, 20 aa, Mycobacterium tuberculosis
EFSRHLKLLAKELEVPVVAI

SEQ ID NO: 1468759 - protein, 17 aa, Mycobacterium tuberculosis
EILDSRGNPTVEVEVAL

SEQ ID NO: 1468760 - protein, 26 aa, Mycobacterium tuberculosis
ELPHEVHRLRALIVELERLYNHAADL

SEQ ID NO: 1468761 - protein, 26 aa, Mycobacterium tuberculosis
ELVIPVCTRLGLSPPDVRTLSKLVRH

SEQ ID NO: 1468762 - protein, 22 aa, Mycobacterium tuberculosis
EPFPLAPMQHAMWVGRHDHQQL

SEQ ID NO: 1468763 - protein, 25 aa, Mycobacterium tuberculosis
EPPFALCGPRGTLIARGVRTRYCDV

SEQ ID NO: 1468764 - protein, 18 aa, Mycobacterium tuberculosis
ERKWDVWGSVARAVTGGH

SEQ ID NO: 1468765 - protein, 18 aa, Mycobacterium tuberculosis
ERVGKRGLGFGAEVRSKA

SEQ ID NO: 1468766 - protein, 21 aa, Mycobacterium tuberculosis
ESELRAAVNAARAAGDTWAAI

SEQ ID NO: 1468767 - protein, 20 aa, Mycobacterium tuberculosis
FADEAVLASTGWHLMMALIA

SEQ ID NO: 1468768 - protein, 28 aa, Mycobacterium tuberculosis
FASTAWTSTWRRWCIPANAATSSTTCAP

SEQ ID NO: 1468769 - protein, 17 aa, Mycobacterium tuberculosis
FASVGGFIAGDRPVVDY

SEQ ID NO: 1468770 - protein, 18 aa, Mycobacterium tuberculosis
FASVGGFIAGDRPVVDYI

SEQ ID NO: 1468771 - protein, 18 aa, Mycobacterium tuberculosis
FGDPFPAPTQGITIHTGP

SEQ ID NO: 1468772 - protein, 23 aa, Mycobacterium tuberculosis
FSAAIPPNLPLPAKIVMQVLDPI

SEQ ID NO: 1468773 - protein, 17 aa, Mycobacterium tuberculosis
FSFEQSRHWSRTYAPGH

SEQ ID NO: 1468774 - protein, 18 aa, Mycobacterium tuberculosis
FTRMMAGLGEALGFDVDT

SEQ ID NO: 1468775 - protein, 29 aa, Mycobacterium tuberculosis
FVLAPWQIHDWILLTPWGLLSWPQINQQL

SEQ ID NO: 1468776 - protein, 19 aa, Mycobacterium tuberculosis
FWGGAGSVACQEFITALGR

SEQ ID NO: 1468777 - protein, 25 aa, Mycobacterium tuberculosis
GAGSLFNGAPGFGGPGGSGGASLLG

SEQ ID NO: 1468778 - protein, 19 aa, Mycobacterium tuberculosis
GALRRFLLEHGVLPEAPLV

SEQ ID NO: 1468779 - protein, 20 aa, Mycobacterium tuberculosis
GARGYAHIGVIQALRERGYD

SEQ ID NO: 1468780 - protein, 26 aa, Mycobacterium tuberculosis
GAVGGVGGNGGWLYGNGGAGGLGGTG

SEQ ID NO: 1468781 - protein, 17 aa, Mycobacterium tuberculosis
GDPGGSTAIRIPATASV

SEQ ID NO: 1468782 - protein, 19 aa, Mycobacterium tuberculosis
GDQQLSFALIDGVRRQWRN

SEQ ID NO: 1468783 - protein, 21 aa, Mycobacterium tuberculosis
GEATGLPSMVVLQPATSAVAA

SEQ ID NO: 1468784 - protein, 21 aa, Mycobacterium tuberculosis
GEFPTSALIASRGAAYPATQP

SEQ ID NO: 1468785 - protein, 17 aa, Mycobacterium tuberculosis
GEYALRRASCERAAADL

SEQ ID NO: 1468786 - protein, 18 aa, Mycobacterium tuberculosis
GFTVFPQGFTVDRIPVDL

SEQ ID NO: 1468787 - protein, 17 aa, Mycobacterium tuberculosis
GGIGPIVVPDITIPGIP

SEQ ID NO: 1468788 - protein, 23 aa, Mycobacterium tuberculosis
GGNGGAGGLLFGNGGNGGNAGAG

SEQ ID NO: 1468789 - protein, 17 aa, Mycobacterium tuberculosis
GHRYHWGASAAMIRGLR

SEQ ID NO: 1468790 - protein, 17 aa, Mycobacterium tuberculosis
GIARELSDLPGAVPRMY

SEQ ID NO: 1468791 - protein, 17 aa, Mycobacterium tuberculosis
GIGAVFHYVPLHDSPAG

SEQ ID NO: 1468792 - protein, 25 aa, Mycobacterium tuberculosis
GKSTLLLEVAHRWAQSGRRALYVSG

SEQ ID NO: 1468793 - protein, 18 aa, Mycobacterium tuberculosis
GLDRYGVRFRIEARDGDR

SEQ ID NO: 1468794 - protein, 17 aa, Mycobacterium tuberculosis
GLLQRLSSAASVSWSNP

SEQ ID NO: 1468795 - protein, 17 aa, Mycobacterium tuberculosis
GMHALRASTIVAALQYM

SEQ ID NO: 1468796 - protein, 23 aa, Mycobacterium tuberculosis
GMLTGPVTILAWSFVRDDQPLAD

SEQ ID NO: 1468797 - protein, 18 aa, Mycobacterium tuberculosis
GMRVDTGLARLLGLSRTA

SEQ ID NO: 1468798 - protein, 18 aa, Mycobacterium tuberculosis
GNAGQVFGDGGTGGTGGA

SEQ ID NO: 1468799 - protein, 21 aa, Mycobacterium tuberculosis
GPLLLPRIVASVFANEPRCRR

SEQ ID NO: 1468800 - protein, 17 aa, Mycobacterium tuberculosis
GQAVWLGAVPKDAPTGG

SEQ ID NO: 1468801 - protein, 23 aa, Mycobacterium tuberculosis
GQLLPRRAAQKFADFANARTAAN

SEQ ID NO: 1468802 - protein, 22 aa, Mycobacterium tuberculosis
GRDLAPGMLHRHSAHNEAVARI

SEQ ID NO: 1468803 - protein, 17 aa, Mycobacterium tuberculosis
GRLLGSVSSGLLRHAHC

SEQ ID NO: 1468804 - protein, 19 aa, Mycobacterium tuberculosis
GRPKINTTMHLLDDSLQPV

SEQ ID NO: 1468805 - protein, 17 aa, Mycobacterium tuberculosis
GRRVHRLAVSHAFHSAL

SEQ ID NO: 1468806 - protein, 17 aa, Mycobacterium tuberculosis
GRVAALSRSRASDDPEF

SEQ ID NO: 1468807 - protein, 19 aa, Mycobacterium tuberculosis
GSAYLARVPQRFVPDLTKY

SEQ ID NO: 1468808 - protein, 17 aa, Mycobacterium tuberculosis
GSLRAGERVLIHAAAGG

SEQ ID NO: 1468809 - protein, 17 aa, Mycobacterium tuberculosis
GSSNWGFGNNGIGNIGF

SEQ ID NO: 1468810 - protein, 25 aa, Mycobacterium tuberculosis
GSVACQEFITALGRNFAVIYQQANA

SEQ ID NO: 1468811 - protein, 19 aa, Mycobacterium tuberculosis
GSWSFVWRDVLLRLANDFR

SEQ ID NO: 1468812 - protein, 19 aa, Mycobacterium tuberculosis
GTAGYAGGLTYNYNTYSTT

SEQ ID NO: 1468813 - protein, 19 aa, Mycobacterium tuberculosis
GTCRETPDGLVITATPLRP

SEQ ID NO: 1468814 - protein, 20 aa, Mycobacterium tuberculosis
GTGGVGKTRLAIQIASASEL

SEQ ID NO: 1468815 - protein, 23 aa, Mycobacterium tuberculosis
GVKAAGVVMEFANEFGLNMPIAR

SEQ ID NO: 1468816 - protein, 24 aa, Mycobacterium tuberculosis
GVVREFSIDPALRDDFARAAAAHR

SEQ ID NO: 1468817 - protein, 19 aa, Mycobacterium tuberculosis
GWCVQAFRFTLNPTQTQAA

SEQ ID NO: 1468818 - protein, 17 aa, Mycobacterium tuberculosis
GWRLHGRTARWIEIAAE

SEQ ID NO: 1468819 - protein, 22 aa, Mycobacterium tuberculosis
GWRVVELDVSYGPRTGGKSKVS

SEQ ID NO: 1468820 - protein, 17 aa, Mycobacterium tuberculosis
GYSLPAIPLGIDVGGGL

SEQ ID NO: 1468821 - protein, 26 aa, Mycobacterium tuberculosis
HAGTGGRGGLLAGQHANSGNGGGGGT

SEQ ID NO: 1468822 - protein, 19 aa, Mycobacterium tuberculosis
HDATMWRVGDDVAHPELGH

SEQ ID NO: 1468823 - protein, 22 aa, Mycobacterium tuberculosis
HDLSSLRLLGSVGEPINPEAWR

SEQ ID NO: 1468824 - protein, 29 aa, Mycobacterium tuberculosis
HFDYALVCGGGDWRRAGIPARSAQFSHPL

SEQ ID NO: 1468825 - protein, 20 aa, Mycobacterium tuberculosis
HGRTARWIEIAAEWGTRDYW

SEQ ID NO: 1468826 - protein, 20 aa, Mycobacterium tuberculosis
HGTLFFGVPTVWSRVAADQA

SEQ ID NO: 1468827 - protein, 22 aa, Mycobacterium tuberculosis
HIVAPVVVGWPVGQLYANMTEW

SEQ ID NO: 1468828 - protein, 18 aa, Mycobacterium tuberculosis
HNRVPALDGQRFLLTAGF

SEQ ID NO: 1468829 - protein, 17 aa, Mycobacterium tuberculosis
HRFLSYKAMNDHTAGGL

SEQ ID NO: 1468830 - protein, 25 aa, Mycobacterium tuberculosis
HRGHEWKFAITKNGRHSLTHYDTLE

SEQ ID NO: 1468831 - protein, 25 aa, Mycobacterium tuberculosis
HTNRGDIKIALFGNHAPKTVANFVG

SEQ ID NO: 1468832 - protein, 24 aa, Mycobacterium tuberculosis
IACPDLLADMARQFGSQCIVLSVD

SEQ ID NO: 1468833 - protein, 25 aa, Mycobacterium tuberculosis
IAIRAFRAAYELGVGTVAVYPYEDR

SEQ ID NO: 1468834 - protein, 22 aa, Mycobacterium tuberculosis
IAKAAGCSRATLYRYFDSREAL

SEQ ID NO: 1468835 - protein, 17 aa, Mycobacterium tuberculosis
IARRLMILASEDIGMAG

SEQ ID NO: 1468836 - protein, 20 aa, Mycobacterium tuberculosis
IASLEMQRFTAMGGAAPSAS

SEQ ID NO: 1468837 - protein, 19 aa, Mycobacterium tuberculosis
ICARRGPTLQWVRSAVTAQ

SEQ ID NO: 1468838 - protein, 26 aa, Mycobacterium tuberculosis
ICLAEAGWPVRVWAAALPQQTTSAVA

SEQ ID NO: 1468839 - protein, 17 aa, Mycobacterium tuberculosis
IDGVPWSQMAVIVRSVP

SEQ ID NO: 1468840 - protein, 26 aa, Mycobacterium tuberculosis
IDLEIAPGVVTTWMKLAIRDRILPDD

SEQ ID NO: 1468841 - protein, 19 aa, Mycobacterium tuberculosis
IDYLRSRLTGIAGEGNKEI

SEQ ID NO: 1468842 - protein, 23 aa, Mycobacterium tuberculosis
IFTWDLPGRCNIRAMNYAINAHL

SEQ ID NO: 1468843 - protein, 17 aa, Mycobacterium tuberculosis
IGDAVGLTSTSSVAHQL

SEQ ID NO: 1468844 - protein, 23 aa, Mycobacterium tuberculosis
IGDPGGSTAIRIPATASVGPFDV

SEQ ID NO: 1468845 - protein, 18 aa, Mycobacterium tuberculosis
IGMGYAIAAAVETGRPVV

SEQ ID NO: 1468846 - protein, 18 aa, Mycobacterium tuberculosis
IGNVMPGFGHVGLGGSIG

SEQ ID NO: 1468847 - protein, 22 aa, Mycobacterium tuberculosis
IGYTGAGTVEFLADDSPGREGE

SEQ ID NO: 1468848 - protein, 23 aa, Mycobacterium tuberculosis
IHINTGFSIPVTFSYSTPALTLF

SEQ ID NO: 1468849 - protein, 18 aa, Mycobacterium tuberculosis
IHQARAAMIAAVLEKHAR

SEQ ID NO: 1468850 - protein, 17 aa, Mycobacterium tuberculosis
IKPLFVLFDSCWDPLPR

SEQ ID NO: 1468851 - protein, 17 aa, Mycobacterium tuberculosis
ILHVDLDQFLASVELLR

SEQ ID NO: 1468852 - protein, 18 aa, Mycobacterium tuberculosis
ILYHAALAHASNHIVTVL

SEQ ID NO: 1468853 - protein, 18 aa, Mycobacterium tuberculosis
INIDAGVVTLQGFSIVAA

SEQ ID NO: 1468854 - protein, 17 aa, Mycobacterium tuberculosis
IPGGPGYFNSSTAPSSG

SEQ ID NO: 1468855 - protein, 31 aa, Mycobacterium tuberculosis
IPHRTVLPLEFARLAGYYLAEGHACLTNGCE

SEQ ID NO: 1468856 - protein, 19 aa, Mycobacterium tuberculosis
IPLTARMVFEHPVLCELAA

SEQ ID NO: 1468857 - protein, 22 aa, Mycobacterium tuberculosis
IQHADLLVVRRGEKVVVEVSVV

SEQ ID NO: 1468858 - protein, 17 aa, Mycobacterium tuberculosis
IRLLTRIAFGFRSPQAL

SEQ ID NO: 1468859 - protein, 24 aa, Mycobacterium tuberculosis
IRPDRSYVNIGFWSSVPVGATEGA

SEQ ID NO: 1468860 - protein, 17 aa, Mycobacterium tuberculosis
IRPNGRMLAIKGERAHD

SEQ ID NO: 1468861 - protein, 17 aa, Mycobacterium tuberculosis
ISCVSAGSILRNLDSRR

SEQ ID NO: 1468862 - protein, 32 aa, Mycobacterium tuberculosis
ISGNYSNGAFWRGDYQGLLGFSYTSTIIPEFT

SEQ ID NO: 1468863 - protein, 26 aa, Mycobacterium tuberculosis
ISPTPFNLLGIYRWIRNFFYLTYYDS

SEQ ID NO: 1468864 - protein, 37 aa, Mycobacterium tuberculosis
ITGNFSNGILWRGNYEGLAGFSFGYPIPLFPAVGADV

SEQ ID NO: 1468865 - protein, 22 aa, Mycobacterium tuberculosis
ITIPQFRTLVILSNHGPINLAT

SEQ ID NO: 1468866 - protein, 25 aa, Mycobacterium tuberculosis
IVELLRSRVFFDWFDAMGVDDIPAV

SEQ ID NO: 1468867 - protein, 17 aa, Mycobacterium tuberculosis
IVHKLRRVLSGLDSHQA

SEQ ID NO: 1468868 - protein, 20 aa, Mycobacterium tuberculosis
IVRLKARLWFVHRGIEKLFH

SEQ ID NO: 1468869 - protein, 17 aa, Mycobacterium tuberculosis
IVSCPDLLPDLWGVADG

SEQ ID NO: 1468870 - protein, 19 aa, Mycobacterium tuberculosis
IYAGLATDTGSFRWASVRG

SEQ ID NO: 1468871 - protein, 22 aa, Mycobacterium tuberculosis
KARFVPGNENFQMGAYLKSNDG

SEQ ID NO: 1468872 - protein, 17 aa, Mycobacterium tuberculosis
KATRDEIFGDLKQRVAA

SEQ ID NO: 1468873 - protein, 17 aa, Mycobacterium tuberculosis
KDARACRNALAEAGIPA

SEQ ID NO: 1468874 - protein, 25 aa, Mycobacterium tuberculosis
KGLYAKARAGEITHFTGIDSPYQRP

SEQ ID NO: 1468875 - protein, 18 aa, Mycobacterium tuberculosis
KLFESVLKGHVKVLVGRK

SEQ ID NO: 1468876 - protein, 17 aa, Mycobacterium tuberculosis
KLGYTVAPMEQRAELVV

SEQ ID NO: 1468877 - protein, 17 aa, Mycobacterium tuberculosis
KSLLEALLNPVPTGDLN

SEQ ID NO: 1468878 - protein, 28 aa, Mycobacterium tuberculosis
KTFVGAAARGGRRLVIAMMYGLVKEGGP

SEQ ID NO: 1468879 - protein, 17 aa, Mycobacterium tuberculosis
LAACTKTGAYVPHLPYS

SEQ ID NO: 1468880 - protein, 23 aa, Mycobacterium tuberculosis
LDERDFPASAVRFFASARSQGRK

SEQ ID NO: 1468881 - protein, 18 aa, Mycobacterium tuberculosis
LDGQRFLLTAGFFETHRP

SEQ ID NO: 1468882 - protein, 18 aa, Mycobacterium tuberculosis
LDIDLVFSPFFNALPIRR

SEQ ID NO: 1468883 - protein, 17 aa, Mycobacterium tuberculosis
LDLVLAILRARQLFGGA

SEQ ID NO: 1468884 - protein, 22 aa, Mycobacterium tuberculosis
LDRHLRLPLRDVIWGADADLLD

SEQ ID NO: 1468885 - protein, 25 aa, Mycobacterium tuberculosis
LDRQWLHARSLAFAHPADGRRVEIV

SEQ ID NO: 1468886 - protein, 23 aa, Mycobacterium tuberculosis
LFAGWRSDPAFVLNLSPFDRGSV

SEQ ID NO: 1468887 - protein, 24 aa, Mycobacterium tuberculosis
LGAGWACGVTVVLPPPGTVGAVDC

SEQ ID NO: 1468888 - protein, 17 aa, Mycobacterium tuberculosis
LGAKGKVGATMVRAVAA

SEQ ID NO: 1468889 - protein, 23 aa, Mycobacterium tuberculosis
LGMGSELYAAYPVFAEALDAVVD

SEQ ID NO: 1468890 - protein, 19 aa, Mycobacterium tuberculosis
LGPLISALLNPGARNAAPL

SEQ ID NO: 1468891 - protein, 18 aa, Mycobacterium tuberculosis
LGPPPDEPNQFVVEGAPR

SEQ ID NO: 1468892 - protein, 18 aa, Mycobacterium tuberculosis
LIVELERLYNHAADLGAL

SEQ ID NO: 1468893 - protein, 18 aa, Mycobacterium tuberculosis
LLEAVVLSDRFVDIRPVT

SEQ ID NO: 1468894 - protein, 17 aa, Mycobacterium tuberculosis
LLSALKNNGSFISFGPI

SEQ ID NO: 1468895 - protein, 27 aa, Mycobacterium tuberculosis
LMAATPKPSWPWVRTLLHSIYDQPDAE

SEQ ID NO: 1468896 - protein, 23 aa, Mycobacterium tuberculosis
LMDSHPFTWLPLLSRVLGSAQLV

SEQ ID NO: 1468897 - protein, 19 aa, Mycobacterium tuberculosis
LMRRGELVMVFPGGAREVN

SEQ ID NO: 1468898 - protein, 24 aa, Mycobacterium tuberculosis
LNAQAAAFHHSFVQTLNAAGGAYS

SEQ ID NO: 1468899 - protein, 19 aa, Mycobacterium tuberculosis
LPDGGAWLYAATVRAIKEL

SEQ ID NO: 1468900 - protein, 19 aa, Mycobacterium tuberculosis
LPDRLRVHSLARTLGTTSR

SEQ ID NO: 1468901 - protein, 17 aa, Mycobacterium tuberculosis
LPLSGLLRGVGDEPELT

SEQ ID NO: 1468902 - protein, 23 aa, Mycobacterium tuberculosis
LPPEINSALMFAGAGPGPMLAAA

SEQ ID NO: 1468903 - protein, 17 aa, Mycobacterium tuberculosis
LPQLVVHPYTLTGPIVI

SEQ ID NO: 1468904 - protein, 17 aa, Mycobacterium tuberculosis
LPVKGTWAFIPPGEAAI

SEQ ID NO: 1468905 - protein, 18 aa, Mycobacterium tuberculosis
LQRTAPWVESLGLDHVRE

SEQ ID NO: 1468906 - protein, 18 aa, Mycobacterium tuberculosis
LQSRPEDRRAFIEEAAGV

SEQ ID NO: 1468907 - protein, 19 aa, Mycobacterium tuberculosis
LRANLPAVDAVLCSTATRA

SEQ ID NO: 1468908 - protein, 17 aa, Mycobacterium tuberculosis
LRRCGRCGRKASWYDRG

SEQ ID NO: 1468909 - protein, 24 aa, Mycobacterium tuberculosis
LSAGCAGFGYALGAAADMIRGGGA

SEQ ID NO: 1468910 - protein, 30 aa, Mycobacterium tuberculosis
LSFSRFELLRLLAFSRIGALPITKASDRLQ

SEQ ID NO: 1468911 - protein, 26 aa, Mycobacterium tuberculosis
LSKLTPWKAPPPIAHSTVLVAPVSPS

SEQ ID NO: 1468912 - protein, 17 aa, Mycobacterium tuberculosis
LSPEVLLAWQMNSEPLP

SEQ ID NO: 1468913 - protein, 17 aa, Mycobacterium tuberculosis
LVDGELAWFLERGGRSL

SEQ ID NO: 1468914 - protein, 17 aa, Mycobacterium tuberculosis
LVHCGRLSVEKHADRSI

SEQ ID NO: 1468915 - protein, 21 aa, Mycobacterium tuberculosis
LVLGCGPGRADGVCAGIAFRN

SEQ ID NO: 1468916 - protein, 24 aa, Mycobacterium tuberculosis
LVMQRWVYHSTRLAVPTHTYSDST

SEQ ID NO: 1468917 - protein, 17 aa, Mycobacterium tuberculosis
LVQAAALMEGHEADSQT

SEQ ID NO: 1468918 - protein, 24 aa, Mycobacterium tuberculosis
LVSTAAADAARIGSAINTANTAAA

SEQ ID NO: 1468919 - protein, 18 aa, Mycobacterium tuberculosis
LWQECSQVGMPRAVVITK

SEQ ID NO: 1468920 - protein, 17 aa, Mycobacterium tuberculosis
LYMVECARARGDIAPGA

SEQ ID NO: 1468921 - protein, 22 aa, Mycobacterium tuberculosis
MANSLPGQWTAHVTLARRVGGH

SEQ ID NO: 1468922 - protein, 26 aa, Mycobacterium tuberculosis
MHAVRAWRSADDFPCTEHMAYKIAQV

SEQ ID NO: 1468923 - protein, 17 aa, Mycobacterium tuberculosis
MKDRPALYMVECARARG

SEQ ID NO: 1468924 - protein, 21 aa, Mycobacterium tuberculosis
MLAAARAWRSLDVEMTAVQRS

SEQ ID NO: 1468925 - protein, 28 aa, Mycobacterium tuberculosis
MLVSSWQMPGGIYAPMMHPWSTGKDVYF

SEQ ID NO: 1468926 - protein, 24 aa, Mycobacterium tuberculosis
MSEFPTDRGWDLAGLFDPDPDVRH

SEQ ID NO: 1468927 - protein, 18 aa, Mycobacterium tuberculosis
MWAQDAMAMYGYAGSSAT

SEQ ID NO: 1468928 - protein, 24 aa, Mycobacterium tuberculosis
NEHYRLAVDPERGGALSSLVQDGR

SEQ ID NO: 1468929 - protein, 17 aa, Mycobacterium tuberculosis
NEIAKAAGCSRATLYRY

SEQ ID NO: 1468930 - protein, 28 aa, Mycobacterium tuberculosis
NGFLNGEARLPLALPTSATGGIPVTVEV

SEQ ID NO: 1468931 - protein, 17 aa, Mycobacterium tuberculosis
NGLKELWDKLTGWVTGL

SEQ ID NO: 1468932 - protein, 21 aa, Mycobacterium tuberculosis
NMEQAMGIAKGYLANQENVMN

SEQ ID NO: 1468933 - protein, 23 aa, Mycobacterium tuberculosis
NRFPDPKDRCHLATIGVQPLVPD

SEQ ID NO: 1468934 - protein, 36 aa, Mycobacterium tuberculosis
NSGNYSNGFFWRGDYQGLGGFAYQSAVSEIPWSYDR

SEQ ID NO: 1468935 - protein, 25 aa, Mycobacterium tuberculosis
NTPRNFARRGIRCHVLPASTTFEQI

SEQ ID NO: 1468936 - protein, 20 aa, Mycobacterium tuberculosis
NVYVPDELAERARARGLNVS

SEQ ID NO: 1468937 - protein, 23 aa, Mycobacterium tuberculosis
NYAPRPLLDLPWDIQESPAGMAV

SEQ ID NO: 1468938 - protein, 24 aa, Mycobacterium tuberculosis
NYARTRHNLGFVVADLLAARLGAK

SEQ ID NO: 1468939 - protein, 18 aa, Mycobacterium tuberculosis
PAATRPAAQQTPAVPAAA

SEQ ID NO: 1468940 - protein, 26 aa, Mycobacterium tuberculosis
PAAWFPSAEHLASWVRLCPGNHESAG

SEQ ID NO: 1468941 - protein, 25 aa, Mycobacterium tuberculosis
PADVQRLPLNVTWVNLTTGKSGSAT

SEQ ID NO: 1468942 - protein, 23 aa, Mycobacterium tuberculosis
PAQQQCTDWAKALFRAVGPQRTP

SEQ ID NO: 1468943 - protein, 18 aa, Mycobacterium tuberculosis
PCGLAELCDRTDLPRATA

SEQ ID NO: 1468944 - protein, 17 aa, Mycobacterium tuberculosis
PDALSLPDAELRETFRA

SEQ ID NO: 1468945 - protein, 26 aa, Mycobacterium tuberculosis
PDGVLRARKLPDWPTGPLPKVRVAAA

SEQ ID NO: 1468946 - protein, 18 aa, Mycobacterium tuberculosis
PDPGIEALAHTKIASTIS

SEQ ID NO: 1468947 - protein, 17 aa, Mycobacterium tuberculosis
PDPRTAPLVKQAYADIL

SEQ ID NO: 1468948 - protein, 35 aa, Mycobacterium tuberculosis; identical to SEQ ID NO: 211460

SEQ ID NO: 1468949 - protein, 24 aa, Mycobacterium tuberculosis
PGAKFPSGSFYLSISDLQINGPII

SEQ ID NO: 1468950 - protein, 21 aa, Mycobacterium tuberculosis
PGGPLKIGPITGLFNTPIGLT

SEQ ID NO: 1468951 - protein, 22 aa, Mycobacterium tuberculosis
PHAWLGDAFHAWVQQFYGAELL

SEQ ID NO: 1468952 - protein, 19 aa, Mycobacterium tuberculosis
PIDIGLPVSLTIPGFTIPG

SEQ ID NO: 1468953 - protein, 24 aa, Mycobacterium tuberculosis
PIRMGVDVPDRIAGVAYPQGTTAR

SEQ ID NO: 1468954 - protein, 17 aa, Mycobacterium tuberculosis
PKIAALIRHIEDLHARH

SEQ ID NO: 1468955 - protein, 21 aa, Mycobacterium tuberculosis
PKLAKRLGLDRQWLHARSLAF

SEQ ID NO: 1468956 - protein, 19 aa, Mycobacterium tuberculosis
PLLVPLRAIPLLGNPLADL

SEQ ID NO: 1468957 - protein, 25 aa, Mycobacterium tuberculosis
PLRPDRYLRIVAAMRREGMGFTAGF

SEQ ID NO: 1468958 - protein, 18 aa, Mycobacterium tuberculosis
PMHIDAEYNADGSLRKPG

SEQ ID NO: 1468959 - protein, 17 aa, Mycobacterium tuberculosis
PMPPEVADHVAAVTLFG

SEQ ID NO: 1468960 - protein, 18 aa, Mycobacterium tuberculosis
PPFPANLTTLFFGPTGIP

SEQ ID NO: 1468961 - protein, 29 aa, Mycobacterium tuberculosis
PRPFVRLEGPAVFRWAAFKMGDVGRRAMD

SEQ ID NO: 1468962 - protein, 23 aa, Mycobacterium tuberculosis
PRRHPGRRSPLWQQRQRAARLLE

SEQ ID NO: 1468963 - protein, 21 aa, Mycobacterium tuberculosis
PRVAHCIYAGLATDTGSFRWA

SEQ ID NO: 1468964 - protein, 21 aa, Mycobacterium tuberculosis
PVEQRAAVVAVDMQGYSIADT

SEQ ID NO: 1468965 - protein, 20 aa, Mycobacterium tuberculosis
PVLRACGFDTPYPPARLEKL

SEQ ID NO: 1468966 - protein, 38 aa, Mycobacterium tuberculosis
PVLRACGFDTPYPPARLEKLWLPGPDRLLDCVERVLRQ

SEQ ID NO: 1468967 - protein, 19 aa, Mycobacterium tuberculosis
PWDTLADAKALAGAHPDGI

SEQ ID NO: 1468968 - protein, 27 aa, Mycobacterium tuberculosis
QALNARAATFHAEFVSLLNGGAAAYTG

SEQ ID NO: 1468969 - protein, 24 aa, Mycobacterium tuberculosis
QDEVSTAIAALFGSHGQHYQAISA

SEQ ID NO: 1468970 - protein, 19 aa, Mycobacterium tuberculosis
QGDTGITYQAWQAQWNQAM

SEQ ID NO: 1468971 - protein, 23 aa, Mycobacterium tuberculosis
QKAQKQARRWSRDTVATAMRLVA

SEQ ID NO: 1468972 - protein, 18 aa, Mycobacterium tuberculosis
QLAPAVAWVKKRAGRTPR

SEQ ID NO: 1468973 - protein, 27 aa, Mycobacterium tuberculosis
QLGPHMAGGGWAWADFVAEADPSNPDM

SEQ ID NO: 1468974 - protein, 20 aa, Mycobacterium tuberculosis
QLINSIKWARDETGIIPTAG

SEQ ID NO: 1468975 - protein, 24 aa, Mycobacterium tuberculosis
QLTQPVRWDLCTATLREHTVTAIV

SEQ ID NO: 1468976 - protein, 24 aa, Mycobacterium tuberculosis
QNLSDAGVSWKVYRNKTLGPISSV

SEQ ID NO: 1468977 - protein, 22 aa, Mycobacterium tuberculosis
QPYWGRPVPGWGSKRPRLLILG

SEQ ID NO: 1468978 - protein, 18 aa, Mycobacterium tuberculosis
QQRLRRILDTVARQEPGL

SEQ ID NO: 1468979 - protein, 26 aa, Mycobacterium tuberculosis
QRQQTLRASMDWSYALLTDTERILFR

SEQ ID NO: 1468980 - protein, 22 aa, Mycobacterium tuberculosis
QVLWRRGEVYTARVHGSRAVGG

SEQ ID NO: 1468981 - protein, 24 aa, Mycobacterium tuberculosis
RADERLRSGVPLGEVVDYLGIPAS

SEQ ID NO: 1468982 - protein, 17 aa, Mycobacterium tuberculosis
RAETLGDDIAWMRFGKD

SEQ ID NO: 1468983 - protein, 17 aa, Mycobacterium tuberculosis
RAGALAAAIDGTRRPLA

SEQ ID NO: 1468984 - protein, 19 aa, Mycobacterium tuberculosis
RAHAVAVPPMFSDLASAPT

SEQ ID NO: 1468985 - protein, 19 aa, Mycobacterium tuberculosis
RALMHAWVGYLERDVFPGG

SEQ ID NO: 1468986 - protein, 19 aa, Mycobacterium tuberculosis
RALYELGMTGIPIVNVNNN

SEQ ID NO: 1468987 - protein, 20 aa, Mycobacterium tuberculosis
RANCPVDVGKPCPFLIAEGV

SEQ ID NO: 1468988 - protein, 24 aa, Mycobacterium tuberculosis
RAPLAPIRLRIGMHTGEVSSPDEG

SEQ ID NO: 1468989 - protein, 17 aa, Mycobacterium tuberculosis
RARDVGVRIVYVVDTTG

SEQ ID NO: 1468990 - protein, 17 aa, Mycobacterium tuberculosis
RDADRVCFTTGAMRVEP

SEQ ID NO: 1468991 - protein, 19 aa, Mycobacterium tuberculosis
RDHGLRYVVLINGSLVNPS

SEQ ID NO: 1468992 - protein, 22 aa, Mycobacterium tuberculosis
REAKKICMGCEVRHECLEYALA

SEQ ID NO: 1468993 - protein, 18 aa, Mycobacterium tuberculosis
REDARILYHAALAHASNH

SEQ ID NO: 1468994 - protein, 20 aa, Mycobacterium tuberculosis
REGLGPFPTDRGWALRELFD

SEQ ID NO: 1468995 - protein, 20 aa, Mycobacterium tuberculosis
REPIAVAGEQIWRVPPLGHG

SEQ ID NO: 1468996 - protein, 19 aa, Mycobacterium tuberculosis
RGADGRVIVACFASNVDRV

SEQ ID NO: 1468997 - protein, 26 aa, Mycobacterium tuberculosis
RGESMSGRLIGKVALVSGGARGMGAS

SEQ ID NO: 1468998 - protein, 27 aa, Mycobacterium tuberculosis
RGTAYRWFRAGLLSVMARRVGRLILVD

SEQ ID NO: 1468999 - protein, 17 aa, Mycobacterium tuberculosis
RHIRAVVRFGDSVRSAH

SEQ ID NO: 1469000 - protein, 19 aa, Mycobacterium tuberculosis
RIPTWASRVVSGLARDRPV

SEQ ID NO: 1469001 - protein, 17 aa, Mycobacterium tuberculosis
RIVASVFANEPRCRRIM

SEQ ID NO: 1469002 - protein, 19 aa, Mycobacterium tuberculosis
RLDGMPLAIELAAARLRSL

SEQ ID NO: 1469003 - protein, 17 aa, Mycobacterium tuberculosis
RLLELTLHPGVMTGYAH

SEQ ID NO: 1469004 - protein, 19 aa, Mycobacterium tuberculosis
RLLPEGYQVTPGRNRHPGT

SEQ ID NO: 1469005 - protein, 24 aa, Mycobacterium tuberculosis
RLSDGIDIVAGWAEKAGLDVALAR

SEQ ID NO: 1469006 - protein, 19 aa, Mycobacterium tuberculosis
RMVIAPWLLAPGILSDRVR

SEQ ID NO: 1469007 - protein, 17 aa, Mycobacterium tuberculosis
RNFSRFLATKAHDITRV

SEQ ID NO: 1469008 - protein, 18 aa, Mycobacterium tuberculosis
RPATLYRLSVVDVLLGSQ

SEQ ID NO: 1469009 - protein, 25 aa, Mycobacterium tuberculosis
RPDELARYAQRVMDWLHPDGDLTDT

SEQ ID NO: 1469010 - protein, 18 aa, Mycobacterium tuberculosis
RQAGRWSPTALRILGAAA

SEQ ID NO: 1469011 - protein, 18 aa, Mycobacterium tuberculosis
RQDGMLALARLQRKMRLV

SEQ ID NO: 1469012 - protein, 18 aa, Mycobacterium tuberculosis
RQRFGGARLVWSGHWTTF

SEQ ID NO: 1469013 - protein, 18 aa, Mycobacterium tuberculosis
RSPLGPVAARLVSRGGFT

SEQ ID NO: 1469014 - protein, 18 aa, Mycobacterium tuberculosis
RVAIEFDPPLPPEYQQLA

SEQ ID NO: 1469015 - protein, 17 aa, Mycobacterium tuberculosis
RVLGAWPITAAFPGGDE

SEQ ID NO: 1469016 - protein, 19 aa, Mycobacterium tuberculosis
RVSLAHALIGWTRGTGLMG

SEQ ID NO: 1469017 - protein, 20 aa, Mycobacterium tuberculosis
SARLAEFLDHVDVAVSLHGY

SEQ ID NO: 1469018 - protein, 18 aa, Mycobacterium tuberculosis
SAYACGVERLLASYRSIP

SEQ ID NO: 1469019 - protein, 20 aa, Mycobacterium tuberculosis
SCAEGGVLGIICASVASVMG

SEQ ID NO: 1469020 - protein, 17 aa, Mycobacterium tuberculosis
SELKRVRAAGFSDRPFS

SEQ ID NO: 1469021 - protein, 30 aa, Mycobacterium tuberculosis
SGAKTARFVKRYADVGGELRRAAMQYAQEV

SEQ ID NO: 1469022 - protein, 24 aa, Mycobacterium tuberculosis
SGAPGGAGGLLFGNGGAGGPGASG

SEQ ID NO: 1469023 - protein, 22 aa, Mycobacterium tuberculosis
SGSAKWNLLAPYAAKSDGGRNN

SEQ ID NO: 1469024 - protein, 21 aa, Mycobacterium tuberculosis
SLCKPLRQILFRDDYGPIASE

SEQ ID NO: 1469025 - protein, 17 aa, Mycobacterium tuberculosis
SLEKPVPVPGFEVRHFH

SEQ ID NO: 1469026 - protein, 21 aa, Mycobacterium tuberculosis
SPSAWRSVTHRKRGVGVRPSL

SEQ ID NO: 1469027 - protein, 18 aa, Mycobacterium tuberculosis
SQIATLILPADVCWSDGA

SEQ ID NO: 1469028 - protein, 25 aa, Mycobacterium tuberculosis
SRSDPRPALDAIRAAVCNRHGLSVA

SEQ ID NO: 1469029 - protein, 27 aa, Mycobacterium tuberculosis
STFTNGALIFGEFDLPQLVVHPYTLTG

SEQ ID NO: 1469030 - protein, 20 aa, Mycobacterium tuberculosis
STIPAYARSWSAHTRCWFID

SEQ ID NO: 1469031 - protein, 23 aa, Mycobacterium tuberculosis
STTIGAFAIPGGPGYFNSSTAPS

SEQ ID NO: 1469032 - protein, 29 aa, Mycobacterium tuberculosis
STVFPQTFYLSGLFFFGPVNLSASTLTVP

SEQ ID NO: 1469033 - protein, 17 aa, Mycobacterium tuberculosis
SVAGRLAALASRMTIKP

SEQ ID NO: 1469034 - protein, 17 aa, Mycobacterium tuberculosis
SVRWVRYPYLPSHPQYD

SEQ ID NO: 1469035 - protein, 17 aa, Mycobacterium tuberculosis
SVTSGLVGGIWQGPSSV

SEQ ID NO: 1469036 - protein, 24 aa, Mycobacterium tuberculosis
SVWGGFPAAVSWRSTSEQVHADLG

SEQ ID NO: 1469037 - protein, 19 aa, Mycobacterium tuberculosis
SWWLGPKCGRRVGRAIDRC

SEQ ID NO: 1469038 - protein, 18 aa, Mycobacterium tuberculosis
SYLPGCWLDSGPFGCLGS

SEQ ID NO: 1469039 - protein, 25 aa, Mycobacterium tuberculosis
TADQPLDWFCSFSSAAALVGSPGQG

SEQ ID NO: 1469040 - protein, 23 aa, Mycobacterium tuberculosis
TAEPCPMCAAASVLSGVRAIIFG

SEQ ID NO: 1469041 - protein, 17 aa, Mycobacterium tuberculosis
TAERFQQVESWLVAKPN

SEQ ID NO: 1469042 - protein, 17 aa, Mycobacterium tuberculosis
TAPILLGALPFDVSRPA

SEQ ID NO: 1469043 - protein, 17 aa, Mycobacterium tuberculosis
TAPRPATLYRLSVVDVL

SEQ ID NO: 1469044 - protein, 27 aa, Mycobacterium tuberculosis
TDAEPRWPTFGIRLSARPGIPPTRPVQ

SEQ ID NO: 1469045 - protein, 27 aa, Mycobacterium tuberculosis
TEEQKKWAVLAAERGWGSTMVLTEPDA

SEQ ID NO: 1469046 - protein, 19 aa, Mycobacterium tuberculosis
TEFELLAAAARDAFGLDVH

SEQ ID NO: 1469047 - protein, 17 aa, Mycobacterium tuberculosis
TGFGNAGFFNMGIGNAG

SEQ ID NO: 1469048 - protein, 17 aa, Mycobacterium tuberculosis
TGIGAPANVSGMFNIGS

SEQ ID NO: 1469049 - protein, 23 aa, Mycobacterium tuberculosis
TGSVPQRLWAKPAITVIGIDTTS

SEQ ID NO: 1469050 - protein, 21 aa, Mycobacterium tuberculosis
THARTRLIAKMSYTNIGFALA

SEQ ID NO: 1469051 - protein, 21 aa, Mycobacterium tuberculosis
TIPAGTALGAFNLPTLSIPSV

SEQ ID NO: 1469052 - protein, 23 aa, Mycobacterium tuberculosis
TIQHADLLVVRRGEKVVVEVSVV

SEQ ID NO: 1469053 - protein, 24 aa, Mycobacterium tuberculosis
TKDVHIGPSDHVGWLDDRKWAYVR

SEQ ID NO: 1469054 - protein, 17 aa, Mycobacterium tuberculosis
TKHIPAFKLTRSSAAYW

SEQ ID NO: 1469055 - protein, 18 aa, Mycobacterium tuberculosis
TKHIPAFKLTRSSAAYWR

SEQ ID NO: 1469056 - protein, 23 aa, Mycobacterium tuberculosis
TKSICPVCKVVVDAQVNIRHDKV

SEQ ID NO: 1469057 - protein, 18 aa, Mycobacterium tuberculosis
TLPALIDRRGYVLIVSSL

SEQ ID NO: 1469058 - protein, 20 aa, Mycobacterium tuberculosis
TPHAGEFARLAGAPPGDDRV

SEQ ID NO: 1469059 - protein, 17 aa, Mycobacterium tuberculosis
TRRGMVVGSPVDLVDGI

SEQ ID NO: 1469060 - protein, 21 aa, Mycobacterium tuberculosis
TTLIGPIHINTGFSIPVTFSY

SEQ ID NO: 1469061 - protein, 25 aa, Mycobacterium tuberculosis
TTPEFAIPPIGVGGFTLPQITTQEI

SEQ ID NO: 1469062 - protein, 24 aa, Mycobacterium tuberculosis
TTTHLFEAWQRWRVQEGVPEISRK

SEQ ID NO: 1469063 - protein, 17 aa, Mycobacterium tuberculosis
TTVPAAFAHHLPSGYSD

SEQ ID NO: 1469064 - protein, 24 aa, Mycobacterium tuberculosis
TVCILDRPRHAQLIHDVRATGARI

SEQ ID NO: 1469065 - protein, 23 aa, Mycobacterium tuberculosis
TVFRLVAAEALKLTAADAALVAV

SEQ ID NO: 1469066 - protein, 23 aa, Mycobacterium tuberculosis
TVIAGALGNWLMSRGEAVAPTAT

SEQ ID NO: 1469067 - protein, 17 aa, Mycobacterium tuberculosis
TVPFSFKEIDDDGLISY

SEQ ID NO: 1469068 - protein, 23 aa, Mycobacterium tuberculosis
TVYYRVFGGWLRQRRNIRDMTKT

SEQ ID NO: 1469069 - protein, 20 aa, Mycobacterium tuberculosis
VAAEATRVGMPYVNQRWLGG

SEQ ID NO: 1469070 - protein, 18 aa, Mycobacterium tuberculosis
VAAKLQLMADELTGRDSG

SEQ ID NO: 1469071 - protein, 26 aa, Mycobacterium tuberculosis
VAAYQQRFVLALSQAGSTYAVAEAAS

SEQ ID NO: 1469072 - protein, 20 aa, Mycobacterium tuberculosis
VADQPIWAGAVQRLKVGSAK

SEQ ID NO: 1469073 - protein, 22 aa, Mycobacterium tuberculosis
VAMGRAIVRRPRVFCMDEPLSN

SEQ ID NO: 1469074 - protein, 24 aa, Mycobacterium tuberculosis
VARPAPACRIDWEPADRAAHRDGV

SEQ ID NO: 1469075 - protein, 24 aa, Mycobacterium tuberculosis
VAVGDWIAMFSMWPIKSTPGLRCQ

SEQ ID NO: 1469076 - protein, 17 aa, Mycobacterium tuberculosis
VCWNTSFTVGFTGLARI

SEQ ID NO: 1469077 - protein, 17 aa, Mycobacterium tuberculosis
VDAHGAMIRALAGSLEA

SEQ ID NO: 1469078 - protein, 21 aa, Mycobacterium tuberculosis
VDYRLIPKHSLGMALDDCHDA

SEQ ID NO: 1469079 - protein, 19 aa, Mycobacterium tuberculosis
VGDRVGGMSPNGCWATFVT

SEQ ID NO: 1469080 - protein, 19 aa, Mycobacterium tuberculosis
VGTLRHWRHSDIGPASFTL

SEQ ID NO: 1469081 - protein, 22 aa, Mycobacterium tuberculosis
VHWRPREYYPAGTTVDVDAKLY

SEQ ID NO: 1469082 - protein, 19 aa, Mycobacterium tuberculosis
VIAANRSRLVSLALSNLFG

SEQ ID NO: 1469083 - protein, 27 aa, Mycobacterium tuberculosis
VIGDSMVEAAICDGDWVVVRQQNVADN

SEQ ID NO: 1469084 - protein, 22 aa, Mycobacterium tuberculosis
VKEVGCRSAIVIYRLPGALSAV

SEQ ID NO: 1469085 - protein, 25 aa, Mycobacterium tuberculosis
VKGMLTGPVTILAWSFVRDDQPLAD

SEQ ID NO: 1469086 - protein, 17 aa, Mycobacterium tuberculosis
VKWLLRRTAIKNLPEGY

SEQ ID NO: 1469087 - protein, 24 aa, Mycobacterium tuberculosis
VLASTGWHLMMALIARARVAIAQD

SEQ ID NO: 1469088 - protein, 20 aa, Mycobacterium tuberculosis
VLGCGPGRADGVCAGIAFRN

SEQ ID NO: 1469089 - protein, 19 aa, Mycobacterium tuberculosis
VLIEPGVRTGIPLLVDNPK

SEQ ID NO: 1469090 - protein, 20 aa, Mycobacterium tuberculosis
VLRHLAAKRIRVMEQFTVQA

SEQ ID NO: 1469091 - protein, 22 aa, Mycobacterium tuberculosis
VNSPGWRRAMAARKRIDDLIDA

SEQ ID NO: 1469092 - protein, 32 aa, Mycobacterium tuberculosis
VNTTEPVVFISLNGGQMVPVLLDTGSTGLVMD

SEQ ID NO: 1469093 - protein, 24 aa, Mycobacterium tuberculosis
VPESKRFCWNCGRPVGRSDSETKG

SEQ ID NO: 1469094 - protein, 17 aa, Mycobacterium tuberculosis
VPSCAEGGVLGIICASV

SEQ ID NO: 1469095 - protein, 19 aa, Mycobacterium tuberculosis
VPSHGFRGVLVELSKELRP

SEQ ID NO: 1469096 - protein, 22 aa, Mycobacterium tuberculosis
VPTSWRAARATLRLPADTAARV

SEQ ID NO: 1469097 - protein, 20 aa, Mycobacterium tuberculosis
VPVQLVRIGRLYLIGIPGEP

SEQ ID NO: 1469098 - protein, 18 aa, Mycobacterium tuberculosis
VPVVPRREAGWAGPVVPW

SEQ ID NO: 1469099 - protein, 18 aa, Mycobacterium tuberculosis
VQKAMAFAAANNLKVAPR

SEQ ID NO: 1469100 - protein, 17 aa, Mycobacterium tuberculosis
VRHHLLLPITATRRDLN

SEQ ID NO: 1469101 - protein, 17 aa, Mycobacterium tuberculosis
VRIHGGYGYSTEYDVER

SEQ ID NO: 1469102 - protein, 27 aa, Mycobacterium tuberculosis
VRPETAADEIVRWATPVTAFQRTALRD

SEQ ID NO: 1469103 - protein, 19 aa, Mycobacterium tuberculosis
VRRHCRDGSDPVVIAVSTR

SEQ ID NO: 1469104 - protein, 17 aa, Mycobacterium tuberculosis
VSEDKFFIIGRIKDLLI

SEQ ID NO: 1469105 - protein, 19 aa, Mycobacterium tuberculosis
VSVCNAVEFSVHGSQHVAM

SEQ ID NO: 1469106 - protein, 18 aa, Mycobacterium tuberculosis
VTLCKTLGKPVNFVPVID

SEQ ID NO: 1469107 - protein, 19 aa, Mycobacterium tuberculosis
VTPVPGVVVHLPIAQVGPQ

SEQ ID NO: 1469108 - protein, 24 aa, Mycobacterium tuberculosis
VVAAAPYAGWLAAAAARAGGAAVQ

SEQ ID NO: 1469109 - protein, 29 aa, Mycobacterium tuberculosis
VVESWKQFGKSLIHWDEWTTNPNEALGKT

SEQ ID NO: 1469110 - protein, 22 aa, Mycobacterium tuberculosis
VVTQSYCPLALGRLLDNPTVTS

SEQ ID NO: 1469111 - protein, 24 aa, Mycobacterium tuberculosis
VVYVCKACHGVAILADNIEPILYH

SEQ ID NO: 1469112 - protein, 18 aa, Mycobacterium tuberculosis
VWLPTLLAGRVFTHRLGA

SEQ ID NO: 1469113 - protein, 26 aa, Mycobacterium tuberculosis
VWVRTDEQWRWLAHTLTVELLKELLP

SEQ ID NO: 1469114 - protein, 24 aa, Mycobacterium tuberculosis
WADNLRHTVRFSAAVRSALDDGYR

SEQ ID NO: 1469115 - protein, 17 aa, Mycobacterium tuberculosis
WALEHPDRAVAVLAALP

SEQ ID NO: 1469116 - protein, 20 aa, Mycobacterium tuberculosis
WDIEPDLTNAVAFLSAAVVS

SEQ ID NO: 1469117 - protein, 18 aa, Mycobacterium tuberculosis
WDTLADAKALAGAHPDGI

SEQ ID NO: 1469118 - protein, 22 aa, Mycobacterium tuberculosis
WEKTIPNWFFEPDIAADIVGNL

SEQ ID NO: 1469119 - protein, 19 aa, Mycobacterium tuberculosis
WLHRIVVNACLDRLRRAKA

SEQ ID NO: 1469120 - protein, 17 aa, Mycobacterium tuberculosis
WNPQRASSMPVNRYRPF

SEQ ID NO: 1469121 - protein, 19 aa, Mycobacterium tuberculosis
WPAVCSGLRSEARNGRMLP

SEQ ID NO: 1469122 - protein, 23 aa, Mycobacterium tuberculosis
WPNLDYPGLHALSTVPQCVPNAA

SEQ ID NO: 1469123 - protein, 18 aa, Mycobacterium tuberculosis
WVGYLERDVFPGGCFFAA

SEQ ID NO: 1469124 - protein, 18 aa, Mycobacterium tuberculosis
YGSLRAGERVLIHAAAGG

SEQ ID NO: 1469125 - protein, 17 aa, Mycobacterium tuberculosis
YILRRLKTDPAIIDDLP

SEQ ID NO: 1469126 - protein, 19 aa, Mycobacterium tuberculosis
YMKYLRGCEHYFTDEMLDC

SEQ ID NO: 1469127 - protein, 23 aa, Mycobacterium tuberculosis
YRRRAEEAWPKIEIADVDSTGLP

SEQ ID NO: 1469128 - protein, 24 aa, Mycobacterium tuberculosis
YTAELAARLERTWQENWARLGTFN

SEQ ID NO: 1469129 - protein, 22 aa, Mycobacterium tuberculosis
YYQIRGGIPYAIAKSLAAAPFA

SEQ ID NO: 1469130 - protein, 20 aa, Mycobacterium tuberculosis
AAAADGWAEIALRLATQRHD

SEQ ID NO: 1469131 - protein, 24 aa, Mycobacterium tuberculosis
AADQRIRQVAPFLSYGQFTGSAPR

SEQ ID NO: 1469132 - protein, 28 aa, Mycobacterium tuberculosis
AAGKPLLGICGGFQMLGRVIRDPYGIEG

SEQ ID NO: 1469133 - protein, 24 aa, Mycobacterium tuberculosis
AAHRRAHGLPAISLGWGLWDQASA

SEQ ID NO: 1469134 - protein, 17 aa, Mycobacterium tuberculosis
AALDGCFKIHQLNHAHW

SEQ ID NO: 1469135 - protein, 23 aa, Mycobacterium tuberculosis
AANARLALYSGGDYLLRRLTAEP

SEQ ID NO: 1469136 - protein, 23 aa, Mycobacterium tuberculosis
AANASPMQAVLDVVNGPTQLLLG

SEQ ID NO: 1469137 - protein, 18 aa, Mycobacterium tuberculosis
ACRPHSGTDLLAGIGGTP

SEQ ID NO: 1469138 - protein, 21 aa, Mycobacterium tuberculosis
ADARVGRLLFSTQLANAVITR

SEQ ID NO: 1469139 - protein, 24 aa, Mycobacterium tuberculosis
ADEVSVAVAALFGTHAQEYQTVSA

SEQ ID NO: 1469140 - protein, 17 aa, Mycobacterium tuberculosis
ADGIAGAVDAYWNWQSC

SEQ ID NO: 1469141 - protein, 17 aa, Mycobacterium tuberculosis
ADGRCKAFAAAADGTGW

SEQ ID NO: 1469142 - protein, 17 aa, Mycobacterium tuberculosis
ADMAMKVEAARLMVYSA

SEQ ID NO: 1469143 - protein, 21 aa, Mycobacterium tuberculosis
ADVRRELAIRAAVEAATVTDS

SEQ ID NO: 1469144 - protein, 23 aa, Mycobacterium tuberculosis
AEGRGWHNARVIPYGPIELDPSA

SEQ ID NO: 1469145 - protein, 17 aa, Mycobacterium tuberculosis
AELRPGEGRTVYGVIVP

SEQ ID NO: 1469146 - protein, 26 aa, Mycobacterium tuberculosis
AEPSGWAYWVAESLLGPGTQLADLKL

SEQ ID NO: 1469147 - protein, 18 aa, Mycobacterium tuberculosis
AEQRLAVAPGDDGDGLNP

SEQ ID NO: 1469148 - protein, 22 aa, Mycobacterium tuberculosis
AEQVRLPSIYFAHRRKVFQRDG

SEQ ID NO: 1469149 - protein, 18 aa, Mycobacterium tuberculosis
AEVGPRLFMLSSTSSDAL

SEQ ID NO: 1469150 - protein, 17 aa, Mycobacterium tuberculosis
AGGTLFNFGFANDGTLN

SEQ ID NO: 1469151 - protein, 18 aa, Mycobacterium tuberculosis
AGSSGWWNQAHAALAGAG

SEQ ID NO: 1469152 - protein, 18 aa, Mycobacterium tuberculosis
AHALAFAAEGARVVVNDI

SEQ ID NO: 1469153 - protein, 23 aa, Mycobacterium tuberculosis
AKMWKKSMTVRELWVSVTDPDAL

SEQ ID NO: 1469154 - protein, 17 aa, Mycobacterium tuberculosis
ALAEVCRRGWAQSVAER

SEQ ID NO: 1469155 - protein, 21 aa, Mycobacterium tuberculosis
ALDRMKAIVAQAVLDHVTDEE

SEQ ID NO: 1469156 - protein, 23 aa, Mycobacterium tuberculosis
ALKVTHPAAIVWAAQMGTITLHP

SEQ ID NO: 1469157 - protein, 18 aa, Mycobacterium tuberculosis
ALQTHGAIGFTCEHDLSL

SEQ ID NO: 1469158 - protein, 21 aa, Mycobacterium tuberculosis
ALTEARIGVAPAIISLTLLPK

SEQ ID NO: 1469159 - protein, 19 aa, Mycobacterium tuberculosis
ALVRAGFLAGDALRVLAGT

SEQ ID NO: 1469160 - protein, 25 aa, Mycobacterium tuberculosis
AMAAAVAPYLGWLAAAAAQAQRSAT

SEQ ID NO: 1469161 - protein, 23 aa, Mycobacterium tuberculosis
APIPGRLFAGPGLSQPSDVLPAD

SEQ ID NO: 1469162 - protein, 25 aa, Mycobacterium tuberculosis
APRRFIRDLYEAISQLAFLPFPFDS

SEQ ID NO: 1469163 - protein, 25 aa, Mycobacterium tuberculosis
AQIRPGQYVRLHWARPRSRLPGQGV

SEQ ID NO: 1469164 - protein, 32 aa, Mycobacterium tuberculosis
ARAAMIAAVLEKHARLAIAVNDIYLSTVGGMR

SEQ ID NO: 1469165 - protein, 20 aa, Mycobacterium tuberculosis
AREPHSWDLCVGHAGRITAP

SEQ ID NO: 1469166 - protein, 18 aa, Mycobacterium tuberculosis
AREPLYFNGARMVGNYPM

SEQ ID NO: 1469167 - protein, 18 aa, Mycobacterium tuberculosis
ARHIRAVVRFGDSVRSAH

SEQ ID NO: 1469168 - protein, 17 aa, Mycobacterium tuberculosis
ARMLRGHLERMVTSDST

SEQ ID NO: 1469169 - protein, 23 aa, Mycobacterium tuberculosis
ARQRYWGEPFPIVYDSDGRPHAL

SEQ ID NO: 1469170 - protein, 18 aa, Mycobacterium tuberculosis
ARRRGVVINPVLETSEIP

SEQ ID NO: 1469171 - protein, 17 aa, Mycobacterium tuberculosis
ARWDLARIISALGDEVA

SEQ ID NO: 1469172 - protein, 18 aa, Mycobacterium tuberculosis
ASAWVGIGTPDFVEVPID

SEQ ID NO: 1469173 - protein, 19 aa, Mycobacterium tuberculosis
ASIGNTWLADPAPFLQQYL

SEQ ID NO: 1469174 - protein, 17 aa, Mycobacterium tuberculosis
ASSFVALCRAAGVPARI

SEQ ID NO: 1469175 - protein, 33 aa, Mycobacterium tuberculosis; identical to SEQ ID NO: 197261

SEQ ID NO: 1469176 - protein, 18 aa, Mycobacterium tuberculosis
AWGPRAPFEVLLGKPRAG

SEQ ID NO: 1469177 - protein, 21 aa, Mycobacterium tuberculosis
CQDFARLAIACLRANGLAACY

SEQ ID NO: 1469178 - protein, 19 aa, Mycobacterium tuberculosis
CQLLRLGGRWLSVVCCRNG

SEQ ID NO: 1469179 - protein, 21 aa, Mycobacterium tuberculosis
DAERRKALEAGYDLNQVLTTE

SEQ ID NO: 1469180 - protein, 20 aa, Mycobacterium tuberculosis
DASPAYLGFNLFQHAIARAV

SEQ ID NO: 1469181 - protein, 21 aa, Mycobacterium tuberculosis
DATRVQVLWSLADREMSVNEL

SEQ ID NO: 1469182 - protein, 29 aa, Mycobacterium tuberculosis
DDYVYPGHAIWWLARGLEFFQDGEQFGEL

SEQ ID NO: 1469183 - protein, 23 aa, Mycobacterium tuberculosis
DFPILKRIMRGGNPLAYLDSGAT

SEQ ID NO: 1469184 - protein, 17 aa, Mycobacterium tuberculosis
DGCTHCPLRPGCPAHVR

SEQ ID NO: 1469185 - protein, 20 aa, Mycobacterium tuberculosis
DGMFPPMHIDAEYNADGSLR

SEQ ID NO: 1469186 - protein, 22 aa, Mycobacterium tuberculosis
DHLELGESLGLIDMQRGAKVSG

SEQ ID NO: 1469187 - protein, 24 aa, Mycobacterium tuberculosis
DIPLLLEMPMVYTGRALTQATCLF

SEQ ID NO: 1469188 - protein, 22 aa, Mycobacterium tuberculosis
DLADAWARRLHIGRSELLRDAL

SEQ ID NO: 1469189 - protein, 17 aa, Mycobacterium tuberculosis
DLHESWLIDKADEIGIA

SEQ ID NO: 1469190 - protein, 19 aa, Mycobacterium tuberculosis
DLLALGALLHDIGKGRGTD

SEQ ID NO: 1469191 - protein, 23 aa, Mycobacterium tuberculosis
DLLTGWRDAWELGRAARDNSLRL

SEQ ID NO: 1469192 - protein, 20 aa, Mycobacterium tuberculosis
DLMAALGMLEARHIAGDQQL

SEQ ID NO: 1469193 - protein, 22 aa, Mycobacterium tuberculosis
DNLRRGGIQFADTRGYAYDRRD

SEQ ID NO: 1469194 - protein, 23 aa, Mycobacterium tuberculosis
DNQQGFNFAGGWNSGSGNSGLFN

SEQ ID NO: 1469195 - protein, 17 aa, Mycobacterium tuberculosis
DNSYVHNLIHGFILAAA

SEQ ID NO: 1469196 - protein, 19 aa, Mycobacterium tuberculosis
DPDAWARLIDTYEVTALNF

SEQ ID NO: 1469197 - protein, 24 aa, Mycobacterium tuberculosis
DPRPPMVTSGLRIGTPALATRGFG

SEQ ID NO: 1469198 - protein, 21 aa, Mycobacterium tuberculosis
DQRTFGGWLLADLVTVDGSVV

SEQ ID NO: 1469199 - protein, 26 aa, Mycobacterium tuberculosis
DRPVPRLLAMGLLRRIDAETVILPRH

SEQ ID NO: 1469200 - protein, 27 aa, Mycobacterium tuberculosis
DSLVCGRRRLGAIGAEIENAVAHQRAL

SEQ ID NO: 1469201 - protein, 22 aa, Mycobacterium tuberculosis
DTDTRIATAVARTVTARLHAED

SEQ ID NO: 1469202 - protein, 23 aa, Mycobacterium tuberculosis
DVAQLLLRVGIFSWITHAPKLGG

SEQ ID NO: 1469203 - protein, 22 aa, Mycobacterium tuberculosis
DVLNRCRGAAVVTPLLLADAYH

SEQ ID NO: 1469204 - protein, 25 aa, Mycobacterium tuberculosis
EAAHGRRLLRIAASSAFAEHAAPGL

SEQ ID NO: 1469205 - protein, 27 aa, Mycobacterium tuberculosis
EAAKPFVRWLTDLCVQLSEVERQIHEI

SEQ ID NO: 1469206 - protein, 23 aa, Mycobacterium tuberculosis
EAKEVIEAGGLYVLGTERHESRR

SEQ ID NO: 1469207 - protein, 26 aa, Mycobacterium tuberculosis
EALLRRIGLAAAKYWVCKRSTAHAAE

SEQ ID NO: 1469208 - protein, 19 aa, Mycobacterium tuberculosis
EALTAPAPHHTRPTRFVWL

SEQ ID NO: 1469209 - protein, 28 aa, Mycobacterium tuberculosis
EAVGIAAYRCGDWAQALAELRAARRMGS

SEQ ID NO: 1469210 - protein, 19 aa, Mycobacterium tuberculosis
ECLHKAAPIVGLPAATRTT

SEQ ID NO: 1469211 - protein, 26 aa, Mycobacterium tuberculosis
EEKKLFCRMAEVFAGFLSYTDAQIGR

SEQ ID NO: 1469212 - protein, 18 aa, Mycobacterium tuberculosis
EELTRSWRVQWPELPDAM

SEQ ID NO: 1469213 - protein, 23 aa, Mycobacterium tuberculosis
EEYLRELTIWSGRYGSVAGVPAR

SEQ ID NO: 1469214 - protein, 21 aa, Mycobacterium tuberculosis
EFLSAAATDLANLGSTISAAN

SEQ ID NO: 1469215 - protein, 17 aa, Mycobacterium tuberculosis
EHHAVLDSVNWLVEHEG

SEQ ID NO: 1469216 - protein, 18 aa, Mycobacterium tuberculosis
EIFGDLKQRVAALDAAGR

SEQ ID NO: 1469217 - protein, 17 aa, Mycobacterium tuberculosis
EIVRPWADAVWDTGIEF

SEQ ID NO: 1469218 - protein, 19 aa, Mycobacterium tuberculosis
EIVWYPGGHTGFFQSRPVR

SEQ ID NO: 1469219 - protein, 20 aa, Mycobacterium tuberculosis
ELGYKYSHRIPMQMHNKVTI

SEQ ID NO: 1469220 - protein, 23 aa, Mycobacterium tuberculosis
ELLVRGGVVFSGYWRNEQATTEA

SEQ ID NO: 1469221 - protein, 23 aa, Mycobacterium tuberculosis
ELTERPDLFPAWDSMSEAQKRLF

SEQ ID NO: 1469222 - protein, 20 aa, Mycobacterium tuberculosis
EMLGAAATDLASIGSAISTA

SEQ ID NO: 1469223 - protein, 17 aa, Mycobacterium tuberculosis
EPITTWAPKSAGALAYR

SEQ ID NO: 1469224 - protein, 24 aa, Mycobacterium tuberculosis
EPLRLLFKDEVRAVGRELGLPEEI

SEQ ID NO: 1469225 - protein, 17 aa, Mycobacterium tuberculosis
EPRAWETLQRGWNVVGL

SEQ ID NO: 1469226 - protein, 24 aa, Mycobacterium tuberculosis
EQLPAREALAWGLISAVYPDSDFE

SEQ ID NO: 1469227 - protein, 18 aa, Mycobacterium tuberculosis
EQYISVGVGRDYTDVSPL

SEQ ID NO: 1469228 - protein, 25 aa, Mycobacterium tuberculosis
ERDVFPGGCFFAAAAADVDSQPGPV

SEQ ID NO: 1469229 - protein, 19 aa, Mycobacterium tuberculosis
ERGGALIALNHTSYVDWVP

SEQ ID NO: 1469230 - protein, 19 aa, Mycobacterium tuberculosis
ERRRYVEVFAAGQGGGSKG

SEQ ID NO: 1469231 - protein, 19 aa, Mycobacterium tuberculosis
ERVVFVLHEIFGLPYQQIA

SEQ ID NO: 1469232 - protein, 25 aa, Mycobacterium tuberculosis
ESAAAFQGAHARFVAAAAKVNTLLD

SEQ ID NO: 1469233 - protein, 19 aa, Mycobacterium tuberculosis
ESPGTLVMQVCGGPGDSGA

SEQ ID NO: 1469234 - protein, 20 aa, Mycobacterium tuberculosis
ESPRVPGYAPQGGGYAEPAG

SEQ ID NO: 1469235 - protein, 19 aa, Mycobacterium tuberculosis
EVADTYFALMDRLGTDGLL

SEQ ID NO: 1469236 - protein, 18 aa, Mycobacterium tuberculosis
EYGYRFGTAGSRLDDLAA

SEQ ID NO: 1469237 - protein, 29 aa, Mycobacterium tuberculosis
FASTAWTSTWRRWCIPANAATSSTTCAPR

SEQ ID NO: 1469238 - protein, 23 aa, Mycobacterium tuberculosis
FFNNYRPQFYFRTTDVTGVVTLP

SEQ ID NO: 1469239 - protein, 18 aa, Mycobacterium tuberculosis
FLSGGYSLPAIPLGIDVG

SEQ ID NO: 1469240 - protein, 17 aa, Mycobacterium tuberculosis
FMIGRPASDPAYFPCYA

SEQ ID NO: 1469241 - protein, 22 aa, Mycobacterium tuberculosis
FPILKRIMRGGNPLAYLDSGAT

SEQ ID NO: 1469242 - protein, 19 aa, Mycobacterium tuberculosis
FPLPRELVGEGTLFLLKVI

SEQ ID NO: 1469243 - protein, 18 aa, Mycobacterium tuberculosis
FQLLRPVKGEERYFVVTH

SEQ ID NO: 1469244 - protein, 17 aa, Mycobacterium tuberculosis
FRSAAPVWRHDPAPTVL

SEQ ID NO: 1469245 - protein, 18 aa, Mycobacterium tuberculosis
FSARRLDGGFSEWLAADL

SEQ ID NO: 1469246 - protein, 22 aa, Mycobacterium tuberculosis
FTAGHCRGGGAVTSRDYKVIGH

SEQ ID NO: 1469247 - protein, 17 aa, Mycobacterium tuberculosis
FTPRAKKVLELSLREAL

SEQ ID NO: 1469248 - protein, 19 aa, Mycobacterium tuberculosis
FVSAIDVLLGLGWLAPSHV

SEQ ID NO: 1469249 - protein, 19 aa, Mycobacterium tuberculosis
FVTLCKTLGKPVNFVPVID

SEQ ID NO: 1469250 - protein, 19 aa, Mycobacterium tuberculosis
GAAIAGRGWTLVWGGGHVS

SEQ ID NO: 1469251 - protein, 27 aa, Mycobacterium tuberculosis
GADRVGPTILRHWSHPATVLVAQPVCG

SEQ ID NO: 1469252 - protein, 19 aa, Mycobacterium tuberculosis
GAEALLRWEHPTLGTLLPG

SEQ ID NO: 1469253 - protein, 24 aa, Mycobacterium tuberculosis
GAGGAGGFGAVLFGNGGAGGSGAP

SEQ ID NO: 1469254 - protein, 25 aa, Mycobacterium tuberculosis
GAGGAGGNAWLFGNGGAGGLGAAGA

SEQ ID NO: 1469255 - protein, 19 aa, Mycobacterium tuberculosis
GAGLLDYPMHIGARCQSVC

SEQ ID NO: 1469256 - protein, 18 aa, Mycobacterium tuberculosis
GAGPIIVPSIQFPAIPLD

SEQ ID NO: 1469257 - protein, 24 aa, Mycobacterium tuberculosis
GALKFPSLHASPPMLAGKHIWEVS

SEQ ID NO: 1469258 - protein, 21 aa, Mycobacterium tuberculosis
GAVKVCGGAVLGEFATLVNPQ

SEQ ID NO: 1469259 - protein, 24 aa, Mycobacterium tuberculosis
GDAHTWLRDHGVSLDTPARPRPVT

SEQ ID NO: 1469260 - protein, 22 aa, Mycobacterium tuberculosis
GDQTMFRKLFESVLKGHVKVLV

SEQ ID NO: 1469261 - protein, 17 aa, Mycobacterium tuberculosis
GDTEWLPPPHLDHGQPR

SEQ ID NO: 1469262 - protein, 22 aa, Mycobacterium tuberculosis
GENCRRCGAVIRRERFMNRSSF

SEQ ID NO: 1469263 - protein, 23 aa, Mycobacterium tuberculosis
GENCRRCGAVIRRERFMNRSSFY

SEQ ID NO: 1469264 - protein, 20 aa, Mycobacterium tuberculosis
GERARTAIDAALARVGTTQE

SEQ ID NO: 1469265 - protein, 17 aa, Mycobacterium tuberculosis
GETASIFVPSVPNLLQL

SEQ ID NO: 1469266 - protein, 26 aa, Mycobacterium tuberculosis
GEVLERSLVHLGLKHYFLVDFPQEPG

SEQ ID NO: 1469267 - protein, 18 aa, Mycobacterium tuberculosis
GGAAVQAKAVAGAFEAAR

SEQ ID NO: 1469268 - protein, 26 aa, Mycobacterium tuberculosis
GGAGGDGGGALGVLGGMGGDGGDGGE

SEQ ID NO: 1469269 - protein, 23 aa, Mycobacterium tuberculosis
GGAPRLPSSVVSWLPLYHDMGLM

SEQ ID NO: 1469270 - protein, 19 aa, Mycobacterium tuberculosis
GGELARIGVAADIGAAPAP

SEQ ID NO: 1469271 - protein, 20 aa, Mycobacterium tuberculosis
GGFPGTAAGFARRIARNTQL

SEQ ID NO: 1469272 - protein, 26 aa, Mycobacterium tuberculosis
GGGGLSSPVILGIGIGGAGGDGGGAL

SEQ ID NO: 1469273 - protein, 19 aa, Mycobacterium tuberculosis
GGRRSFILVPGIDVPFHSR

SEQ ID NO: 1469274 - protein, 25 aa, Mycobacterium tuberculosis
GGSGGRGGLLVGDGGAGGIGGTGGE

SEQ ID NO: 1469275 - protein, 18 aa, Mycobacterium tuberculosis
GHHSWEDLDDLLLATYSE

SEQ ID NO: 1469276 - protein, 21 aa, Mycobacterium tuberculosis
GHTPGSIALALGGPVTGGVTQ

SEQ ID NO: 1469277 - protein, 18 aa, Mycobacterium tuberculosis
GICNGFQVLCEAGLLPGA

SEQ ID NO: 1469278 - protein, 19 aa, Mycobacterium tuberculosis
GIVEVLRLITDRGDPVIVN

SEQ ID NO: 1469279 - protein, 24 aa, Mycobacterium tuberculosis
GIVYTYARPNWWANANTVRSMIDA

SEQ ID NO: 1469280 - protein, 20 aa, Mycobacterium tuberculosis
GIWLHCLYALSGINLRESVR

SEQ ID NO: 1469281 - protein, 19 aa, Mycobacterium tuberculosis
GKTTALRMINRMVDPTSGT

SEQ ID NO: 1469282 - protein, 21 aa, Mycobacterium tuberculosis
GKTYTRWGAFLDDATGFDAGF

SEQ ID NO: 1469283 - protein, 18 aa, Mycobacterium tuberculosis
GLGLRSAISSGLGSTAPA

SEQ ID NO: 1469284 - protein, 24 aa, Mycobacterium tuberculosis
GLSHPMGPLRLSDLVGLDTLKLIA

SEQ ID NO: 1469285 - protein, 20 aa, Mycobacterium tuberculosis
GLVSMSRPCWTRFLKQVELN

SEQ ID NO: 1469286 - protein, 17 aa, Mycobacterium tuberculosis
GNGLLTLPTSVNVVTSS

SEQ ID NO: 1469287 - protein, 21 aa, Mycobacterium tuberculosis
GNGPLAAFVHALADVGFDVAV

SEQ ID NO: 1469288 - protein, 25 aa, Mycobacterium tuberculosis
GNRFVSRQCRLFACLAQIWEGDANG

SEQ ID NO: 1469289 - protein, 21 aa, Mycobacterium tuberculosis
GPLFMAAAAWEGLAADLRASA

SEQ ID NO: 1469290 - protein, 29 aa, Mycobacterium tuberculosis
GPSASFGTLWIKSPANMLGYWNNPERTAE

SEQ ID NO: 1469291 - protein, 17 aa, Mycobacterium tuberculosis
GQGFLALVDYAHKPEAL

SEQ ID NO: 1469292 - protein, 17 aa, Mycobacterium tuberculosis
GQLSTGWFNSATTSTGW

SEQ ID NO: 1469293 - protein, 18 aa, Mycobacterium tuberculosis
GRKPLRFTSFGDQSTPAL

SEQ ID NO: 1469294 - protein, 17 aa, Mycobacterium tuberculosis
GRRVHKTVHHYLMRFLG

SEQ ID NO: 1469295 - protein, 21 aa, Mycobacterium tuberculosis
GRSRLLPGLPADRIVALGAED

SEQ ID NO: 1469296 - protein, 24 aa, Mycobacterium tuberculosis
GRTTGNSCGVTWGPGESPGTLVMQ

SEQ ID NO: 1469297 - protein, 24 aa, Mycobacterium tuberculosis
GSTGERGLHHLIWEVVDNAVDEAM

SEQ ID NO: 1469298 - protein, 59 aa, Mycobacterium tuberculosis
GTALTRASSTWADSPRAWPIRAPSRLQVWRTRATTARECSIRVIISRVSSTGAPPPKKS

SEQ ID NO: 1469299 - protein, 24 aa, Mycobacterium tuberculosis
GTIEMADWWAYLNGVRKTYPLSYG

SEQ ID NO: 1469300 - protein, 17 aa, Mycobacterium tuberculosis
GVCLGHQAIGVAFGATV

SEQ ID NO: 1469301 - protein, 25 aa, Mycobacterium tuberculosis
GVIANGSFAPSFVGFGGNGGNGVNG

SEQ ID NO: 1469302 - protein, 25 aa, Mycobacterium tuberculosis
GVSQRKAAVVARDLLEKVGMADRER

SEQ ID NO: 1469303 - protein, 24 aa, Mycobacterium tuberculosis
GWDEKWQCDGCSITHQRDDNAAIN

SEQ ID NO: 1469304 - protein, 27 aa, Mycobacterium tuberculosis
HADHCLDLPGLFVWRRYHPSRPSGKAL

SEQ ID NO: 1469305 - protein, 24 aa, Mycobacterium tuberculosis
HDTLPRIAQAVVVAATRNYGVPDN

SEQ ID NO: 1469306 - protein, 21 aa, Mycobacterium tuberculosis
HIPSIPLGFAAIGHIGPISIP

SEQ ID NO: 1469307 - protein, 21 aa, Mycobacterium tuberculosis
HPSRSASMFEYWDAPPTGHPL

SEQ ID NO: 1469308 - protein, 29 aa, Mycobacterium tuberculosis
HSISPWGTWEWIGPPALGAVLPARGMAKL

SEQ ID NO: 1469309 - protein, 21 aa, Mycobacterium tuberculosis
HTGGALPRTRPFRVSYGTTTR

SEQ ID NO: 1469310 - protein, 29 aa, Mycobacterium tuberculosis
HTTALFGHSYGSLLSGIALKDGASSLVDN

SEQ ID NO: 1469311 - protein, 19 aa, Mycobacterium tuberculosis
HTYAFDDTVAWLAVACSKT

SEQ ID NO: 1469312 - protein, 18 aa, Mycobacterium tuberculosis
IAANRVRPVIGTRLPIQQ

SEQ ID NO: 1469313 - protein, 19 aa, Mycobacterium tuberculosis
IADVLRCIDGPLASVRDIG

SEQ ID NO: 1469314 - protein, 17 aa, Mycobacterium tuberculosis
IALGMAAFRPGRPSRTP

SEQ ID NO: 1469315 - protein, 18 aa, Mycobacterium tuberculosis
IASGLPMGGDLEFADELT

SEQ ID NO: 1469316 - protein, 19 aa, Mycobacterium tuberculosis
IEGLPARLRKVTNRWTLRP

SEQ ID NO: 1469317 - protein, 24 aa, Mycobacterium tuberculosis
IFKDTLIMSYEWPEDRQSLSWTLE

SEQ ID NO: 1469318 - protein, 21 aa, Mycobacterium tuberculosis
IGAPANVSGMFNIGSNLAGFF

SEQ ID NO: 1469319 - protein, 28 aa, Mycobacterium tuberculosis
IGRVDRRGRLLWSLPKGHIELGETAEQT

SEQ ID NO: 1469320 - protein, 26 aa, Mycobacterium tuberculosis
IHNTQPWRWRVCPTSLELFSRPDMQL

SEQ ID NO: 1469321 - protein, 17 aa, Mycobacterium tuberculosis
IKRSAAVPDRDGTSHAA

SEQ ID NO: 1469322 - protein, 24 aa, Mycobacterium tuberculosis
IPPPNSALVSWLPFYHDMGLVIGI

SEQ ID NO: 1469323 - protein, 17 aa, Mycobacterium tuberculosis
ISKPVGLGFSKGGGEND

SEQ ID NO: 1469324 - protein, 26 aa, Mycobacterium tuberculosis
ITIGEIPFDLVAHSTLGPVHILIDLP

SEQ ID NO: 1469325 - protein, 17 aa, Mycobacterium tuberculosis
ITKYIPLHTPAVVMSIN

SEQ ID NO: 1469326 - protein, 18 aa, Mycobacterium tuberculosis
IVEIGPFTIPQVDVPAIP

SEQ ID NO: 1469327 - protein, 26 aa, Mycobacterium tuberculosis
IVELLRSRVFFDWFDAMGVDDIPAVF

SEQ ID NO: 1469328 - protein, 17 aa, Mycobacterium tuberculosis
IYVKDGIITWETQQTDY

SEQ ID NO: 1469329 - protein, 19 aa, Mycobacterium tuberculosis
KDLYRGCMRGRTMYVVPFC

SEQ ID NO: 1469330 - protein, 17 aa, Mycobacterium tuberculosis
KETIAYCRIGERSSHTW

SEQ ID NO: 1469331 - protein, 29 aa, Mycobacterium tuberculosis
KFARCSWRAGPCGMPILDDAAAWFIGRTA

SEQ ID NO: 1469332 - protein, 18 aa, Mycobacterium tuberculosis
KGLRLRATDLDWTIGTGP

SEQ ID NO: 1469333 - protein, 18 aa, Mycobacterium tuberculosis
KMMSSMLGGMGIPGIGRK

SEQ ID NO: 1469334 - protein, 19 aa, Mycobacterium tuberculosis
KNPDCAICGDAPTITELVD

SEQ ID NO: 1469335 - protein, 17 aa, Mycobacterium tuberculosis
KPVGLGFSKGGGENDYE

SEQ ID NO: 1469336 - protein, 29 aa, Mycobacterium tuberculosis
KQLGPHMAGGGWAWADFVAEADPSNPDMQ

SEQ ID NO: 1469337 - protein, 20 aa, Mycobacterium tuberculosis
KRSPAGKPDYRWAKEQTEAR

SEQ ID NO: 1469338 - protein, 18 aa, Mycobacterium tuberculosis
KRTGLAVLDCAADVVLTT

SEQ ID NO: 1469339 - protein, 23 aa, Mycobacterium tuberculosis
KSTLLLEVAHRWAQSGRRALYVS

SEQ ID NO: 1469340 - protein, 21 aa, Mycobacterium tuberculosis
KVGNVDALFLFDVLLHQVSPD

SEQ ID NO: 1469341 - protein, 20 aa, Mycobacterium tuberculosis
KYPDRLTVLHWLESLQGLPS

SEQ ID NO: 1469342 - protein, 17 aa, Mycobacterium tuberculosis
LADALGVLPVLATDVLR

SEQ ID NO: 1469343 - protein, 17 aa, Mycobacterium tuberculosis
LAEELTRSWRVQWPELP

SEQ ID NO: 1469344 - protein, 26 aa, Mycobacterium tuberculosis
LAFPSLSSSVPILGPYEDLIANTVAN

SEQ ID NO: 1469345 - protein, 21 aa, Mycobacterium tuberculosis
LAIACLRANGLAACYVSGYLA

SEQ ID NO: 1469346 - protein, 25 aa, Mycobacterium tuberculosis
LAQDCVDRMGFSFLANIGTASVARD

SEQ ID NO: 1469347 - protein, 24 aa, Mycobacterium tuberculosis
LASGELIATVAMPPRVPRAVDADT

SEQ ID NO: 1469348 - protein, 23 aa, Mycobacterium tuberculosis
LAVDPRFAGVTGQYFAGAKAIRS

SEQ ID NO: 1469349 - protein, 26 aa, Mycobacterium tuberculosis
LDIHETMVIPPIVFLPSMTIGGQTYT

SEQ ID NO: 1469350 - protein, 19 aa, Mycobacterium tuberculosis
LDRPFAWALIKLDGADTLL

SEQ ID NO: 1469351 - protein, 31 aa, Mycobacterium tuberculosis; identical to SEQ ID NO: 202160

SEQ ID NO: 1469352 - protein, 36 aa, Mycobacterium tuberculosis; identical to SEQ ID NO: 81820

SEQ ID NO: 1469353 - protein, 17 aa, Mycobacterium tuberculosis
LEDFDVFHPDRMASRIL

SEQ ID NO: 1469354 - protein, 21 aa, Mycobacterium tuberculosis
LEQELACFLGKPAAVLCSTGY

SEQ ID NO: 1469355 - protein, 18 aa, Mycobacterium tuberculosis
LEVLQSWLGADRAATLVV

SEQ ID NO: 1469356 - protein, 18 aa, Mycobacterium tuberculosis
LFNPLPSMVVAHYLGVPE

SEQ ID NO: 1469357 - protein, 30 aa, Mycobacterium tuberculosis; identical to SEQ ID NO: 202313

SEQ ID NO: 1469358 - protein, 18 aa, Mycobacterium tuberculosis
LGLARAYVSGDLQAHGVR

SEQ ID NO: 1469359 - protein, 17 aa, Mycobacterium tuberculosis
LGSMISAANSAAAAQTT

SEQ ID NO: 1469360 - protein, 23 aa, Mycobacterium tuberculosis
LHIVAPVVVGWPVGQLYANMTEW

SEQ ID NO: 1469361 - protein, 19 aa, Mycobacterium tuberculosis
LKEFMVRNTYIYPPKPSMR

SEQ ID NO: 1469362 - protein, 17 aa, Mycobacterium tuberculosis
LKPPRSGLPVIEVLDTE

SEQ ID NO: 1469363 - protein, 18 aa, Mycobacterium tuberculosis
LLAWLRDRLSHFKCPRSI

SEQ ID NO: 1469364 - protein, 26 aa, Mycobacterium tuberculosis
LLHGFPESWYSWRHQIPALAGAGYRV

SEQ ID NO: 1469365 - protein, 17 aa, Mycobacterium tuberculosis
LLRWEHPTLGTLLPGRF

SEQ ID NO: 1469366 - protein, 17 aa, Mycobacterium tuberculosis
LLVRYGIPAVTDRQRSS

SEQ ID NO: 1469367 - protein, 17 aa, Mycobacterium tuberculosis
LMEAAKPFVRWLTDLCV

SEQ ID NO: 1469368 - protein, 27 aa, Mycobacterium tuberculosis
LNELPFNVAGIFTGYIGPIPLSTFVLG

SEQ ID NO: 1469369 - protein, 21 aa, Mycobacterium tuberculosis
LPRAQALAVSLLLLSPAALNT

SEQ ID NO: 1469370 - protein, 17 aa, Mycobacterium tuberculosis
LPRLAARINNERIRLGI

SEQ ID NO: 1469371 - protein, 18 aa, Mycobacterium tuberculosis
LPVGRLRIGDELAEIDSA

SEQ ID NO: 1469372 - protein, 18 aa, Mycobacterium tuberculosis
LQTEEWLGPASTLMVEAV

SEQ ID NO: 1469373 - protein, 17 aa, Mycobacterium tuberculosis
LRISLSVSARLAGIPYI

SEQ ID NO: 1469374 - protein, 17 aa, Mycobacterium tuberculosis
LRPLRVAVDAGNGMAGH

SEQ ID NO: 1469375 - protein, 18 aa, Mycobacterium tuberculosis
LRRLADVVYDPWIDQRPL

SEQ ID NO: 1469376 - protein, 19 aa, Mycobacterium tuberculosis
LRTEMGYPLHGHELSLDIS

SEQ ID NO: 1469377 - protein, 17 aa, Mycobacterium tuberculosis
LSERIIFLGSEVNDEIA

SEQ ID NO: 1469378 - protein, 21 aa, Mycobacterium tuberculosis
LSTSLFAFWAVDAAYSLDGRR

SEQ ID NO: 1469379 - protein, 17 aa, Mycobacterium tuberculosis
LTALGLPTEMDYMGYAD

SEQ ID NO: 1469380 - protein, 20 aa, Mycobacterium tuberculosis
LTDEARMAPDLRGRISMASM

SEQ ID NO: 1469381 - protein, 20 aa, Mycobacterium tuberculosis
LTEARIGVAPAIISLTLLPK

SEQ ID NO: 1469382 - protein, 18 aa, Mycobacterium tuberculosis
LTGRSWRAGLRQRAAVRV

SEQ ID NO: 1469383 - protein, 17 aa, Mycobacterium tuberculosis
LTIANGLSPDRLRKQLD

SEQ ID NO: 1469384 - protein, 19 aa, Mycobacterium tuberculosis
LTIRLLGRTEIRRLAKELD

SEQ ID NO: 1469385 - protein, 17 aa, Mycobacterium tuberculosis
LVACAAVLPQLRDATGE

SEQ ID NO: 1469386 - protein, 18 aa, Mycobacterium tuberculosis
LVRYWRLLRFKLANPHII

SEQ ID NO: 1469387 - protein, 18 aa, Mycobacterium tuberculosis
MAGNFSFGDYFKRGAIEL

SEQ ID NO: 1469388 - protein, 17 aa, Mycobacterium tuberculosis
MFFGAGSGPMLAAAAAW

SEQ ID NO: 1469389 - protein, 21 aa, Mycobacterium tuberculosis
MKVGLRRGKIIVVRPEHDHGL

SEQ ID NO: 1469390 - protein, 18 aa, Mycobacterium tuberculosis
MLGGLPVGQMGARAGGGL

SEQ ID NO: 1469391 - protein, 17 aa, Mycobacterium tuberculosis
MQVCGGPGDSGAPVTVD

SEQ ID NO: 1469392 - protein, 18 aa, Mycobacterium tuberculosis
MRIRCVRANRSHEPPINS

SEQ ID NO: 1469393 - protein, 19 aa, Mycobacterium tuberculosis
MRRRRGLPPIAPHSGLGYA

SEQ ID NO: 1469394 - protein, 21 aa, Mycobacterium tuberculosis
MSSLRSGECDLALAGGVTVMG

SEQ ID NO: 1469395 - protein, 22 aa, Mycobacterium tuberculosis
NALPRRGISALVRRPKRRPLDE

SEQ ID NO: 1469396 - protein, 20 aa, Mycobacterium tuberculosis
NATPRERLLALFDRPNRGDG

SEQ ID NO: 1469397 - protein, 25 aa, Mycobacterium tuberculosis
NELPFNVAGIFTGYIGPIPLSTFVL

SEQ ID NO: 1469398 - protein, 18 aa, Mycobacterium tuberculosis
NIPERGGALIALNHTSYV

SEQ ID NO: 1469399 - protein, 22 aa, Mycobacterium tuberculosis
NLPDMFTRLMLSLAATGIAPGS

SEQ ID NO: 1469400 - protein, 22 aa, Mycobacterium tuberculosis
NLRIARVLYDFVNNEALPGTDI

SEQ ID NO: 1469401 - protein, 35 aa, Mycobacterium tuberculosis; identical to SEQ ID NO: 203638

SEQ ID NO: 1469402 - protein, 20 aa, Mycobacterium tuberculosis
NRAPLPVLLPSMRRGGVAAV

SEQ ID NO: 1469403 - protein, 19 aa, Mycobacterium tuberculosis
NRARYGGRLQGHRYLRGSS

SEQ ID NO: 1469404 - protein, 25 aa, Mycobacterium tuberculosis
NRDGESYNRSWNCGVEGPTDDPDIL

SEQ ID NO: 1469405 - protein, 24 aa, Mycobacterium tuberculosis
NRFVSRQCRLFACLAQIWEGDANG

SEQ ID NO: 1469406 - protein, 21 aa, Mycobacterium tuberculosis
NVIDPLDWVEMFGADALRFTL

SEQ ID NO: 1469407 - protein, 22 aa, Mycobacterium tuberculosis
NVSSVLAWLPLGMSYGVSKAAM

SEQ ID NO: 1469408 - protein, 19 aa, Mycobacterium tuberculosis
PAACGGPFARLTLNSPHNR

SEQ ID NO: 1469409 - protein, 20 aa, Mycobacterium tuberculosis
PAACGGPFARLTLNSPHNRN

SEQ ID NO: 1469410 - protein, 20 aa, Mycobacterium tuberculosis
PADEAPGWELVPGTDIANEH

SEQ ID NO: 1469411 - protein, 26 aa, Mycobacterium tuberculosis
PAMSKFEVLTAMAFAAFADAPVDVAV

SEQ ID NO: 1469412 - protein, 21 aa, Mycobacterium tuberculosis
PASTIKVLLALVALDELDLNS

SEQ ID NO: 1469413 - protein, 24 aa, Mycobacterium tuberculosis
PDGWWRDRHRAMVMLVERLEGWAI

SEQ ID NO: 1469414 - protein, 17 aa, Mycobacterium tuberculosis
PDIPININETLYLGPLV

SEQ ID NO: 1469415 - protein, 22 aa, Mycobacterium tuberculosis
PDPRAADIVETWAHVLDQLERD

SEQ ID NO: 1469416 - protein, 37 aa, Mycobacterium tuberculosis
PEINSLRMYLGAGSAPMLQAAAWDGLAAELGTAASSF

SEQ ID NO: 1469417 - protein, 19 aa, Mycobacterium tuberculosis
PEVLLAWQMNSEPLPRAHG

SEQ ID NO: 1469418 - protein, 24 aa, Mycobacterium tuberculosis
PGAECERLHLPPMCDRDTTHCVSV

SEQ ID NO: 1469419 - protein, 20 aa, Mycobacterium tuberculosis
PGIPESFKVLLKELQSLCLN

SEQ ID NO: 1469420 - protein, 19 aa, Mycobacterium tuberculosis
PGLARAVVNLHRRYRITTA

SEQ ID NO: 1469421 - protein, 19 aa, Mycobacterium tuberculosis
PHALKGRFSGVAMAAVDDD

SEQ ID NO: 1469422 - protein, 23 aa, Mycobacterium tuberculosis
PIEAKVAAVNAVIEQSNAMADHV

SEQ ID NO: 1469423 - protein, 27 aa, Mycobacterium tuberculosis
PIGPESWGFTGWRWFSGTAPRYIRDTG

SEQ ID NO: 1469424 - protein, 17 aa, Mycobacterium tuberculosis
PIQQARGGESLWDENGG

SEQ ID NO: 1469425 - protein, 18 aa, Mycobacterium tuberculosis
PLARCSRSPGLNESSHMS

SEQ ID NO: 1469426 - protein, 17 aa, Mycobacterium tuberculosis
PLFEFAIRAAIAEMDLD

SEQ ID NO: 1469427 - protein, 18 aa, Mycobacterium tuberculosis
PLHQLPQPIAWPGSSDRN

SEQ ID NO: 1469428 - protein, 34 aa, Mycobacterium tuberculosis
PLVILLHGFGSFWWSWRHQLCGLTGARVVAVDLR

SEQ ID NO: 1469429 - protein, 19 aa, Mycobacterium tuberculosis
PMHIDAEYNADGSLRKPGQ

SEQ ID NO: 1469430 - protein, 18 aa, Mycobacterium tuberculosis
PPELYRITYDGSIADEPH

SEQ ID NO: 1469431 - protein, 20 aa, Mycobacterium tuberculosis
PRKLLARFFVWLTVGLYDPP

SEQ ID NO: 1469432 - protein, 20 aa, Mycobacterium tuberculosis
PRPAPSELLVAVHACGVCRT

SEQ ID NO: 1469433 - protein, 22 aa, Mycobacterium tuberculosis
PRRHPGRRSPLWQQRQRAARLL

SEQ ID NO: 1469434 - protein, 21 aa, Mycobacterium tuberculosis
PRYAELIKRTQWWGRQMLIWG

SEQ ID NO: 1469435 - protein, 27 aa, Mycobacterium tuberculosis
PRYRCTTPQCGRAVFNQDLANVDQYLV

SEQ ID NO: 1469436 - protein, 21 aa, Mycobacterium tuberculosis
PSHALGWLPIEEIDAAASDDG

SEQ ID NO: 1469437 - protein, 21 aa, Mycobacterium tuberculosis
PSLHPTVLVGMRNRLRASDPT

SEQ ID NO: 1469438 - protein, 18 aa, Mycobacterium tuberculosis
PTPDAGALFTVARRLLPD

SEQ ID NO: 1469439 - protein, 17 aa, Mycobacterium tuberculosis
PTPGRSRAAHMGRRYGR

SEQ ID NO: 1469440 - protein, 18 aa, Mycobacterium tuberculosis
PTVEHTIEILKGLRDRYE

SEQ ID NO: 1469441 - protein, 19 aa, Mycobacterium tuberculosis
PVLGSEVLAAKAIPERAMR

SEQ ID NO: 1469442 - protein, 23 aa, Mycobacterium tuberculosis
PVPRQRSALRWLRTVNRSPGLVS

SEQ ID NO: 1469443 - protein, 18 aa, Mycobacterium tuberculosis
PVTGVVYVTNSLDDTVSV

SEQ ID NO: 1469444 - protein, 24 aa, Mycobacterium tuberculosis
QANGFDVGRRLGIGSRETYIPALK

SEQ ID NO: 1469445 - protein, 32 aa, Mycobacterium tuberculosis
QDCEVCGYHCWAEFFVAGLGWLPADASCATKY

SEQ ID NO: 1469446 - protein, 32 aa, Mycobacterium tuberculosis
QDSALSPRGYRAMAGIPRLQFAHADLLVRAFG

SEQ ID NO: 1469447 - protein, 23 aa, Mycobacterium tuberculosis
QGPISRRLALTALGFGVLAPNVL

SEQ ID NO: 1469448 - protein, 23 aa, Mycobacterium tuberculosis
QIGCSLRLFVYDCAADRAMTARR

SEQ ID NO: 1469449 - protein, 18 aa, Mycobacterium tuberculosis
QLRDELYVGPTINRTARL

SEQ ID NO: 1469450 - protein, 23 aa, Mycobacterium tuberculosis
QPGKPSWNLEPWRPVVDDSEMLA

SEQ ID NO: 1469451 - protein, 21 aa, Mycobacterium tuberculosis
QQWCDEWRQLIGVAHLLSPSR

SEQ ID NO: 1469452 - protein, 17 aa, Mycobacterium tuberculosis
QRRELLRNMGIEHVYDS

SEQ ID NO: 1469453 - protein, 21 aa, Mycobacterium tuberculosis
QSLTGRPLIGDGANGIDGTGQ

SEQ ID NO: 1469454 - protein, 18 aa, Mycobacterium tuberculosis
QTPPAAVGRRHLLEISAS

SEQ ID NO: 1469455 - protein, 28 aa, Mycobacterium tuberculosis
QVAAYQQRFVLALSQAGSTYAVAEAASA

SEQ ID NO: 1469456 - protein, 21 aa, Mycobacterium tuberculosis
QVLWRRGEVYTARVHGSRAVG

SEQ ID NO: 1469457 - protein, 26 aa, Mycobacterium tuberculosis
RAAAARTGHPWWTLSQLSDESAIELD

SEQ ID NO: 1469458 - protein, 17 aa, Mycobacterium tuberculosis
RADVAVCELVLMELYQL

SEQ ID NO: 1469459 - protein, 20 aa, Mycobacterium tuberculosis
RAHAVAVPPMFSDLASAPTR

SEQ ID NO: 1469460 - protein, 21 aa, Mycobacterium tuberculosis
RAKPAVPFGGAYRLIDFVLSN

SEQ ID NO: 1469461 - protein, 23 aa, Mycobacterium tuberculosis
RARRSLDSAAGWLAPLGGAHLRS

SEQ ID NO: 1469462 - protein, 24 aa, Mycobacterium tuberculosis
RASDAAACALDLQRTSLAPIRLRI

SEQ ID NO: 1469463 - protein, 17 aa, Mycobacterium tuberculosis
RAWGWHRLHDEWAARVV

SEQ ID NO: 1469464 - protein, 35 aa, Mycobacterium tuberculosis
RCSECRHVSAKWVGRCLECGRWGTVDEVAVLSAVG

SEQ ID NO: 1469465 - protein, 21 aa, Mycobacterium tuberculosis
RDELLAGLAGVVAGRPEAGVV

SEQ ID NO: 1469466 - protein, 26 aa, Mycobacterium tuberculosis
RDIKKLPTLRGRTVVTMFYENSTRTR

SEQ ID NO: 1469467 - protein, 17 aa, Mycobacterium tuberculosis
RDRLLIVTLADVASRVE

SEQ ID NO: 1469468 - protein, 17 aa, Mycobacterium tuberculosis
RDWAHAVVSDLILHIDE

SEQ ID NO: 1469469 - protein, 21 aa, Mycobacterium tuberculosis
REGLGPFPTDRGWALRELFDG

SEQ ID NO: 1469470 - protein, 18 aa, Mycobacterium tuberculosis
REHIKEIQAFFKELSAAV

SEQ ID NO: 1469471 - protein, 21 aa, Mycobacterium tuberculosis
REIHLTLIPFALRPTAEVPTT

SEQ ID NO: 1469472 - protein, 23 aa, Mycobacterium tuberculosis
RERLDFSCALFDPDGNLVANAPH

SEQ ID NO: 1469473 - protein, 18 aa, Mycobacterium tuberculosis
RERYSMLAACFEPDVACE

SEQ ID NO: 1469474 - protein, 20 aa, Mycobacterium tuberculosis
REVLNRIACGQSIPAIAAEL

SEQ ID NO: 1469475 - protein, 26 aa, Mycobacterium tuberculosis
RGDVEPCAAVGVELRRRGHAVHMAVP

SEQ ID NO: 1469476 - protein, 31 aa, Mycobacterium tuberculosis; identical to SEQ ID NO: 234131

SEQ ID NO: 1469477 - protein, 20 aa, Mycobacterium tuberculosis
RGSSPFAGKAFRRGAQGPQP

SEQ ID NO: 1469478 - protein, 17 aa, Mycobacterium tuberculosis
RIGRIASPDGVAFASID

SEQ ID NO: 1469479 - protein, 18 aa, Mycobacterium tuberculosis
RKGRYPDRKTARRVAEVV

SEQ ID NO: 1469480 - protein, 17 aa, Mycobacterium tuberculosis
RLSTELSSLAALAYATR

SEQ ID NO: 1469481 - protein, 18 aa, Mycobacterium tuberculosis
RNGIGTGISASDRATTMR

SEQ ID NO: 1469482 - protein, 22 aa, Mycobacterium tuberculosis
RPPRTRSGAALPRSSDPVTDIA

SEQ ID NO: 1469483 - protein, 17 aa, Mycobacterium tuberculosis
RPRAVNVRGADDAALPP

SEQ ID NO: 1469484 - protein, 19 aa, Mycobacterium tuberculosis
RQRFGGARLVWSGHWTTFS

SEQ ID NO: 1469485 - protein, 22 aa, Mycobacterium tuberculosis
RRAELIERFGLDPTKKARTYSK

SEQ ID NO: 1469486 - protein, 18 aa, Mycobacterium tuberculosis
RRALSELLRRGTRNLTGA

SEQ ID NO: 1469487 - protein, 18 aa, Mycobacterium tuberculosis
RRHGRFLSMDEIAAEIGV

SEQ ID NO: 1469488 - protein, 24 aa, Mycobacterium tuberculosis
RRMQGRVGFEVKIHRIGADGAAVL

SEQ ID NO: 1469489 - protein, 25 aa, Mycobacterium tuberculosis
RRRLAPWGARCCWTRRTGSGRCNRL

SEQ ID NO: 1469490 - protein, 17 aa, Mycobacterium tuberculosis
RRVRLWGDQTWRSAPEH

SEQ ID NO: 1469491 - protein, 17 aa, Mycobacterium tuberculosis
RSELARKGIARAKSVVA

SEQ ID NO: 1469492 - protein, 24 aa, Mycobacterium tuberculosis
RSITWDQGIEMARHIDITADLGAP

SEQ ID NO: 1469493 - protein, 28 aa, Mycobacterium tuberculosis
RTVLRLDPRLAPVKAAVLPLSRHADLSP

SEQ ID NO: 1469494 - protein, 23 aa, Mycobacterium tuberculosis
RWLREEHYRRMYLAINRTSHVEA

SEQ ID NO: 1469495 - protein, 18 aa, Mycobacterium tuberculosis
RWSAAVPPLHKGDAVTKL

SEQ ID NO: 1469496 - protein, 21 aa, Mycobacterium tuberculosis
RYMKYLRGCEHYFTDEMLDCS

SEQ ID NO: 1469497 - protein, 25 aa, Mycobacterium tuberculosis
RYQRLLHPWVNMAMDTVVAIEPEIV

SEQ ID NO: 1469498 - protein, 18 aa, Mycobacterium tuberculosis
SAAPVWRHDPAPTVLNAH

SEQ ID NO: 1469499 - protein, 25 aa, Mycobacterium tuberculosis
SAGSSRKAFGGDGGVGGDGASALGT

SEQ ID NO: 1469500 - protein, 20 aa, Mycobacterium tuberculosis
SAHSPYYRLVALRETSPRIH

SEQ ID NO: 1469501 - protein, 24 aa, Mycobacterium tuberculosis
SAPRDLCALWPVPATSTPHPAAPA

SEQ ID NO: 1469502 - protein, 17 aa, Mycobacterium tuberculosis
SCRAAGIDPVRQPIPVV

SEQ ID NO: 1469503 - protein, 28 aa, Mycobacterium tuberculosis
SCRIESFADLGAVWGVEGAYTFRALDKY

SEQ ID NO: 1469504 - protein, 23 aa, Mycobacterium tuberculosis
SDAAWLRAELNNERGYVFDLETD

SEQ ID NO: 1469505 - protein, 25 aa, Mycobacterium tuberculosis
SDGQWRLSPKAMRRLGETALRDVAQ

SEQ ID NO: 1469506 - protein, 23 aa, Mycobacterium tuberculosis
SDGRRFACDYALLAVPYLTLREL

SEQ ID NO: 1469507 - protein, 23 aa, Mycobacterium tuberculosis
SEFPTDRGWDLAGLFDPDPDVRH

SEQ ID NO: 1469508 - protein, 20 aa, Mycobacterium tuberculosis
SELGLSYLLPRAIGSSRAFE

SEQ ID NO: 1469509 - protein, 17 aa, Mycobacterium tuberculosis
SESGGRRYAPFTINIEH

SEQ ID NO: 1469510 - protein, 18 aa, Mycobacterium tuberculosis
SGHGNTGFFNAGSFNTGM

SEQ ID NO: 1469511 - protein, 18 aa, Mycobacterium tuberculosis
SGLLGILGSGSSWLDKLW

SEQ ID NO: 1469512 - protein, 17 aa, Mycobacterium tuberculosis
SGPTTALTDVWRALRAS

SEQ ID NO: 1469513 - protein, 24 aa, Mycobacterium tuberculosis
SLGLEFIGFGGPDVREGLAAHREK

SEQ ID NO: 1469514 - protein, 19 aa, Mycobacterium tuberculosis
SMGRPEYPTPVGSYTVLSK

SEQ ID NO: 1469515 - protein, 17 aa, Mycobacterium tuberculosis
SNFPPKRHKTRVLAAAE

SEQ ID NO: 1469516 - protein, 20 aa, Mycobacterium tuberculosis
SPCGLAELCDRTDLPRATAY

SEQ ID NO: 1469517 - protein, 18 aa, Mycobacterium tuberculosis
SPEALAWPLLAVIDASLD

SEQ ID NO: 1469518 - protein, 20 aa, Mycobacterium tuberculosis
SRDLQPWLAVPDRLLPLPAG

SEQ ID NO: 1469519 - protein, 22 aa, Mycobacterium tuberculosis
SRKSVRPRPHRPAGARAAFKPE

SEQ ID NO: 1469520 - protein, 21 aa, Mycobacterium tuberculosis
SRLALQIGAQIAHEFTYGRWD

SEQ ID NO: 1469521 - protein, 20 aa, Mycobacterium tuberculosis
SRPLWEMYLVEGLEKNRIAL

SEQ ID NO: 1469522 - protein, 18 aa, Mycobacterium tuberculosis
SSGFLNWGAGSASGLLNF

SEQ ID NO: 1469523 - protein, 21 aa, Mycobacterium tuberculosis
STTARSNVRFGYEVTEPGIPY

SEQ ID NO: 1469524 - protein, 22 aa, Mycobacterium tuberculosis
STTIGAFAIPGGPGYFNSSTAP

SEQ ID NO: 1469525 - protein, 17 aa, Mycobacterium tuberculosis
STVSPSFEGIAAVVRVE

SEQ ID NO: 1469526 - protein, 23 aa, Mycobacterium tuberculosis
SVASGRVSYVLGLQGPAVSVDTA

SEQ ID NO: 1469527 - protein, 18 aa, Mycobacterium tuberculosis
SVHRCRLPFCDVTVGLVR

SEQ ID NO: 1469528 - protein, 24 aa, Mycobacterium tuberculosis
SVLTRSCKRWFGTGPAAYRNQARL

SEQ ID NO: 1469529 - protein, 22 aa, Mycobacterium tuberculosis
SVNARIAVNLGAPVLLTVRAKD

SEQ ID NO: 1469530 - protein, 19 aa, Mycobacterium tuberculosis
SVPVGGLLAPLQPVTVTLT

SEQ ID NO: 1469531 - protein, 19 aa, Mycobacterium tuberculosis
SWDHPYRAPPKVWFHDLLH

SEQ ID NO: 1469532 - protein, 17 aa, Mycobacterium tuberculosis
SYFELDGSFPNHEANPL

SEQ ID NO: 1469533 - protein, 22 aa, Mycobacterium tuberculosis
SYRLRAVSAVGLRFPLNGTANG

SEQ ID NO: 1469534 - protein, 24 aa, Mycobacterium tuberculosis
TDAEPRWPTFGIRLSARPGTPPTR

SEQ ID NO: 1469535 - protein, 20 aa, Mycobacterium tuberculosis
TDQLPLVRALVDMAGLPPQA

SEQ ID NO: 1469536 - protein, 23 aa, Mycobacterium tuberculosis
TEPDIGPIIVPSFVLSVPTFAIA

SEQ ID NO: 1469537 - protein, 23 aa, Mycobacterium tuberculosis
TESALRFVGAATFEALSGEPVCT

SEQ ID NO: 1469538 - protein, 17 aa, Mycobacterium tuberculosis
TFGPRTALWLLLAKGGG

SEQ ID NO: 1469539 - protein, 26 aa, Mycobacterium tuberculosis
TGGNGGRAGLLLGVGGMGGNGGATSV

SEQ ID NO: 1469540 - protein, 19 aa, Mycobacterium tuberculosis
TGGVGKTRLAIQIASASEL

SEQ ID NO: 1469541 - protein, 30 aa, Mycobacterium tuberculosis
TGVAYIRWLLRARPADYMLALSVAGGSLPV

SEQ ID NO: 1469542 - protein, 20 aa, Mycobacterium tuberculosis
TKGIPFGSVVTFVVRAGNPK

SEQ ID NO: 1469543 - protein, 20 aa, Mycobacterium tuberculosis
TLASQAAHVVMRFQQGLAEL

SEQ ID NO: 1469544 - protein, 19 aa, Mycobacterium tuberculosis
TLDVCVRDGLMSSRAAEAA

SEQ ID NO: 1469545 - protein, 18 aa, Mycobacterium tuberculosis
TLLSALKNNGSFISFGPI

SEQ ID NO: 1469546 - protein, 17 aa, Mycobacterium tuberculosis
TLTALGAEVRWASCNIF

SEQ ID NO: 1469547 - protein, 24 aa, Mycobacterium tuberculosis
TMFADVRRELAIRAAVEAATVTDS

SEQ ID NO: 1469548 - protein, 19 aa, Mycobacterium tuberculosis
TMTGFGGWNSGTGNIGLFN

SEQ ID NO: 1469549 - protein, 19 aa, Mycobacterium tuberculosis
TNLGRLVLGTPAPLPCTPR

SEQ ID NO: 1469550 - protein, 22 aa, Mycobacterium tuberculosis
TPIPRTVALTVYGDLETSTLRE

SEQ ID NO: 1469551 - protein, 31 aa, Mycobacterium tuberculosis; identical to SEQ ID NO: 234369

SEQ ID NO: 1469552 - protein, 19 aa, Mycobacterium tuberculosis
TPVLHGHVADLFVVPAVAD

SEQ ID NO: 1469553 - protein, 23 aa, Mycobacterium tuberculosis
TREAKKICMGCEVRHECLEYALA

SEQ ID NO: 1469554 - protein, 20 aa, Mycobacterium tuberculosis
TRLAEGLVQAAALMEGHEAD

SEQ ID NO: 1469555 - protein, 29 aa, Mycobacterium tuberculosis
TSGGRGIHVFLRIATDWDFVEVRRAGIAL

SEQ ID NO: 1469556 - protein, 17 aa, Mycobacterium tuberculosis
TSLRGLRHTLKKLSGLR

SEQ ID NO: 1469557 - protein, 33 aa, Mycobacterium tuberculosis; identical to SEQ ID NO: 234379

SEQ ID NO: 1469558 - protein, 19 aa, Mycobacterium tuberculosis
TTALTDVWRALRASMRSVL

SEQ ID NO: 1469559 - protein, 17 aa, Mycobacterium tuberculosis
TVAELKPGSPDGIVDLL

SEQ ID NO: 1469560 - protein, 30 aa, Mycobacterium tuberculosis; identical to SEQ ID NO: 1248704

SEQ ID NO: 1469561 - protein, 24 aa, Mycobacterium tuberculosis
VAAQDLRPGTALTPGDVRLEKRSA

SEQ ID NO: 1469562 - protein, 25 aa, Mycobacterium tuberculosis
VAAYQQRFVLALSQAGSTYAVAEAA

SEQ ID NO: 1469563 - protein, 19 aa, Mycobacterium tuberculosis
VAELHRRASAWFAENGYLH

SEQ ID NO: 1469564 - protein, 24 aa, Mycobacterium tuberculosis
VAELLPQVFRWARTVDPVQPLTSG

SEQ ID NO: 1469565 - protein, 24 aa, Mycobacterium tuberculosis
VAGGAGGSVGLWGSGGAGGDGGAA

SEQ ID NO: 1469566 - protein, 23 aa, Mycobacterium tuberculosis
VAHDWGGPVAFIMMLRHPEKVTG

SEQ ID NO: 1469567 - protein, 17 aa, Mycobacterium tuberculosis
VAPCTELYHDSRADDSV

SEQ ID NO: 1469568 - protein, 18 aa, Mycobacterium tuberculosis
VASDRGAGHLGFAGTARR

SEQ ID NO: 1469569 - protein, 22 aa, Mycobacterium tuberculosis
VASRIRSAGAIFVGPWSPVSLG

SEQ ID NO: 1469570 - protein, 19 aa, Mycobacterium tuberculosis
VDLAFRMVGDIGVAEDMVQ

SEQ ID NO: 1469571 - protein, 17 aa, Mycobacterium tuberculosis
VEYDPAYHELMRTAITH

SEQ ID NO: 1469572 - protein, 20 aa, Mycobacterium tuberculosis
VGAVLCNLATHLDDPADRLN

SEQ ID NO: 1469573 - protein, 26 aa, Mycobacterium tuberculosis
VGHAGRITAPRGWELVRHAGPLPSHP

SEQ ID NO: 1469574 - protein, 24 aa, Mycobacterium tuberculosis
VGLLRAEGRDAGWCPCTCPGGDPH

SEQ ID NO: 1469575 - protein, 17 aa, Mycobacterium tuberculosis
VGNYPMSLVLDGQALNI

SEQ ID NO: 1469576 - protein, 22 aa, Mycobacterium tuberculosis
VGQDIRYGLGAVRNVGANVVGS

SEQ ID NO: 1469577 - protein, 17 aa, Mycobacterium tuberculosis
VGSGAWTAVHHAFTAPK

SEQ ID NO: 1469578 - protein, 23 aa, Mycobacterium tuberculosis
VHRGQARIAYRLAERYQDKLLHV

SEQ ID NO: 1469579 - protein, 19 aa, Mycobacterium tuberculosis
VINAPTLALLNRPLIGNGA

SEQ ID NO: 1469580 - protein, 17 aa, Mycobacterium tuberculosis
VKDRFGVTINDVVVALC

SEQ ID NO: 1469581 - protein, 18 aa, Mycobacterium tuberculosis
VKYKLAILDEYDRADRTE

SEQ ID NO: 1469582 - protein, 19 aa, Mycobacterium tuberculosis
VLAKDCPSFGLGPTEPLLA

SEQ ID NO: 1469583 - protein, 19 aa, Mycobacterium tuberculosis
VLRHLAAKRIRVMEQFTVQ

SEQ ID NO: 1469584 - protein, 23 aa, Mycobacterium tuberculosis
VLRHVTVMLGGDVVRMSAGVRFC

SEQ ID NO: 1469585 - protein, 21 aa, Mycobacterium tuberculosis
VPARVANLVERLRAAEKELER

SEQ ID NO: 1469586 - protein, 21 aa, Mycobacterium tuberculosis
VPDILECLASVMADAGSNREA

SEQ ID NO: 1469587 - protein, 21 aa, Mycobacterium tuberculosis
VPEARVLDTLVHIWVTSIYGE

SEQ ID NO: 1469588 - protein, 18 aa, Mycobacterium tuberculosis
VPIPGFPTTVTVFGTPFM

SEQ ID NO: 1469589 - protein, 23 aa, Mycobacterium tuberculosis
VPPGDGPWRLGLGSAGTFENLRL

SEQ ID NO: 1469590 - protein, 25 aa, Mycobacterium tuberculosis
VPSLPFRLIHIADTYTPIAPADLPG

SEQ ID NO: 1469591 - protein, 23 aa, Mycobacterium tuberculosis
VQDAANLPPDWASVPYGVPFPNN

SEQ ID NO: 1469592 - protein, 22 aa, Mycobacterium tuberculosis
VQGEAAAGVVLLRPASPGTGVI

SEQ ID NO: 1469593 - protein, 23 aa, Mycobacterium tuberculosis
VRAYGDFLSYCLVAEGAVDIAAE

SEQ ID NO: 1469594 - protein, 17 aa, Mycobacterium tuberculosis
VRCLLIYNQQWIGSTTT

SEQ ID NO: 1469595 - protein, 23 aa, Mycobacterium tuberculosis
VRPWADAVWDTGIEFGTVGVGKS

SEQ ID NO: 1469596 - protein, 24 aa, Mycobacterium tuberculosis
VRRNPRGSYQIAVVGLKGGAGKTT

SEQ ID NO: 1469597 - protein, 24 aa, Mycobacterium tuberculosis
VRVHRVPSRMFPKVTTLPLGVPTF

SEQ ID NO: 1469598 - protein, 17 aa, Mycobacterium tuberculosis
VRWIETQDLLFIEEAAG

SEQ ID NO: 1469599 - protein, 18 aa, Mycobacterium tuberculosis
VSASRARAILSSRHIHRV

SEQ ID NO: 1469600 - protein, 18 aa, Mycobacterium tuberculosis
VSYPGSFWPVTGLNSPTV

SEQ ID NO: 1469601 - protein, 21 aa, Mycobacterium tuberculosis
VTAKPKLLGPLGDLFTIMTIP

SEQ ID NO: 1469602 - protein, 18 aa, Mycobacterium tuberculosis
VTFGDVWALLVDGNFGSG

SEQ ID NO: 1469603 - protein, 26 aa, Mycobacterium tuberculosis
VTMPGRWRISQIAVCRKLFNTVDSSS

SEQ ID NO: 1469604 - protein, 20 aa, Mycobacterium tuberculosis
VTMSLRVIQWATGSVGVAAI

SEQ ID NO: 1469605 - protein, 17 aa, Mycobacterium tuberculosis
VVINPVLETSEIPETMP

SEQ ID NO: 1469606 - protein, 19 aa, Mycobacterium tuberculosis
VVTPLRLALERDTRAVDPL

SEQ ID NO: 1469607 - protein, 17 aa, Mycobacterium tuberculosis
VWLAEELTRSWRVQWPE

SEQ ID NO: 1469608 - protein, 19 aa, Mycobacterium tuberculosis
VWRALRASMRSVLEETTLA

SEQ ID NO: 1469609 - protein, 17 aa, Mycobacterium tuberculosis
WKRELVARTSLTENEIG

SEQ ID NO: 1469610 - protein, 18 aa, Mycobacterium tuberculosis
WNGTLCDDRTILLDAVGQ

SEQ ID NO: 1469611 - protein, 22 aa, Mycobacterium tuberculosis
WRSTPAPVRGALVARLGELLTA

SEQ ID NO: 1469612 - protein, 17 aa, Mycobacterium tuberculosis
WVLANRAYTPWYLVRYW

SEQ ID NO: 1469613 - protein, 17 aa, Mycobacterium tuberculosis
WVPPHLDGYKPLFEAVQ

SEQ ID NO: 1469614 - protein, 22 aa, Mycobacterium tuberculosis
YAAGLAVGFWAAPSDLRANWRE

SEQ ID NO: 1469615 - protein, 28 aa, Mycobacterium tuberculosis
YCALACAELLYRAGLPRALYAIVPGPGS

SEQ ID NO: 1469616 - protein, 21 aa, Mycobacterium tuberculosis
YERATAQRFADWLVRVVEAFA

SEQ ID NO: 1469617 - protein, 18 aa, Mycobacterium tuberculosis
YFAELCGVDRQAADEVIE

SEQ ID NO: 1469618 - protein, 25 aa, Mycobacterium tuberculosis
YGRSAACWARRLVFVNGHGGNVGAL

SEQ ID NO: 1469619 - protein, 18 aa, Mycobacterium tuberculosis
YIGPIPLSTFVLGVTLAG

SEQ ID NO: 1469620 - protein, 19 aa, Mycobacterium tuberculosis
YITARFLPDKAIDLVDEAA

SEQ ID NO: 1469621 - protein, 18 aa, Mycobacterium tuberculosis
YLFRCLSCGVHLAYADFA

SEQ ID NO: 1469622 - protein, 20 aa, Mycobacterium tuberculosis
YLPTYREFYELRQMAPGDGE

SEQ ID NO: 1469623 - protein, 19 aa, Mycobacterium tuberculosis
YPGSMCVGFPKVLAAFRPH

SEQ ID NO: 1469624 - protein, 20 aa, Mycobacterium tuberculosis
YRLRAVSAVGLRFPLNGTAN

SEQ ID NO: 1469625 - protein, 28 aa, Mycobacterium tuberculosis
YRLVGWRHGLCGYRRFFSITSLAGLRQE

SEQ ID NO: 1469626 - protein, 19 aa, Mycobacterium tuberculosis
YRSTLRGFFVWAYEMDRVR

SEQ ID NO: 1469627 - protein, 25 aa, Mycobacterium tuberculosis
YVAAHAPYLAWLMRASETSAEAAAR

SEQ ID NO: 1469628 - protein, 18 aa, Mycobacterium tuberculosis
YVHGFLRERMQMLQDEFA

SEQ ID NO: 1469629 - protein, 18 aa, Mycobacterium tuberculosis
AAARARARYACFDHACAD

SEQ ID NO: 1469630 - protein, 21 aa, Mycobacterium tuberculosis
AADAFEAVRIIARASRVDVTL

SEQ ID NO: 1469631 - protein, 17 aa, Mycobacterium tuberculosis
AAENYGSVIARLTGMHW

SEQ ID NO: 1469632 - protein, 17 aa, Mycobacterium tuberculosis
AAGALAAGCEYEIDEAA

SEQ ID NO: 1469633 - protein, 20 aa, Mycobacterium tuberculosis
AAIACGRADVVIPKLERLVA

SEQ ID NO: 1469634 - protein, 20 aa, Mycobacterium tuberculosis
AAPYAAWLAAAAVQAEQTAA

SEQ ID NO: 1469635 - protein, 25 aa, Mycobacterium tuberculosis
AASDVARIGSSIGVANSAAAGSTTS

SEQ ID NO: 1469636 - protein, 21 aa, Mycobacterium tuberculosis
AASGRPGAVLVDIPKDVLQGQ

SEQ ID NO: 1469637 - protein, 22 aa, Mycobacterium tuberculosis
ADENYILLEWGIDRDFEHYRKA

SEQ ID NO: 1469638 - protein, 24 aa, Mycobacterium tuberculosis
ADEVSAAVASLFSGHAQAYQTLGT

SEQ ID NO: 1469639 - protein, 17 aa, Mycobacterium tuberculosis
ADNPRSRVLAFASAGNL

SEQ ID NO: 1469640 - protein, 21 aa, Mycobacterium tuberculosis
ADSVAVCRGVRAVARARLVER

SEQ ID NO: 1469641 - protein, 21 aa, Mycobacterium tuberculosis
AEADARLMAHAVFGLLNSTPH

SEQ ID NO: 1469642 - protein, 23 aa, Mycobacterium tuberculosis
AEAEGADVVQIFLGNPQSWKAPK

SEQ ID NO: 1469643 - protein, 21 aa, Mycobacterium tuberculosis
AEAQGGLLPWAVREYEAQTGR

SEQ ID NO: 1469644 - protein, 20 aa, Mycobacterium tuberculosis
AECLHKAAPIVGLPAATRTT

SEQ ID NO: 1469645 - protein, 26 aa, Mycobacterium tuberculosis
AEDPAREFLPTGGRVLAVFEPAGPGV

SEQ ID NO: 1469646 - protein, 22 aa, Mycobacterium tuberculosis
AEIGRRPVVVLSRDAAIPRLRR

SEQ ID NO: 1469647 - protein, 20 aa, Mycobacterium tuberculosis
AELSRLSSPIGLDLGARTPE

SEQ ID NO: 1469648 - protein, 18 aa, Mycobacterium tuberculosis
AEMLRWCHEAGIELATVY

SEQ ID NO: 1469649 - protein, 21 aa, Mycobacterium tuberculosis
AEMWSQDAMAMYGYAGASAAA

SEQ ID NO: 1469650 - protein, 23 aa, Mycobacterium tuberculosis
AEPNQALGWLPMQDIDAAAEAAA

SEQ ID NO: 1469651 - protein, 21 aa, Mycobacterium tuberculosis
AEVSGPLLRRKFRPSSAAMLP

SEQ ID NO: 1469652 - protein, 18 aa, Mycobacterium tuberculosis
AEVVVCPTAVPPHDPASY

SEQ ID NO: 1469653 - protein, 18 aa, Mycobacterium tuberculosis
AGDLGDWGGPDALADLDP

SEQ ID NO: 1469654 - protein, 19 aa, Mycobacterium tuberculosis
AGDRARLAVTIGSRAHAEL

SEQ ID NO: 1469655 - protein, 20 aa, Mycobacterium tuberculosis
AGGDECGPAILAGRSGPEQA

SEQ ID NO: 1469656 - protein, 25 aa, Mycobacterium tuberculosis
AGGDVSADFGGVGFGGQGGNGGAGG

SEQ ID NO: 1469657 - protein, 17 aa, Mycobacterium tuberculosis
AGGILWGNGGAGGSGAP

SEQ ID NO: 1469658 - protein, 19 aa, Mycobacterium tuberculosis
AGGNAYLFGSGGAGGQGGM

SEQ ID NO: 1469659 - protein, 17 aa, Mycobacterium tuberculosis
AGGYGLDPERIWTTVYF

SEQ ID NO: 1469660 - protein, 25 aa, Mycobacterium tuberculosis
AGIKLCKKRHRLPGLDFVRGDAENL

SEQ ID NO: 1469661 - protein, 18 aa, Mycobacterium tuberculosis
AGIPLLAGAISKAVLPPI

SEQ ID NO: 1469662 - protein, 17 aa, Mycobacterium tuberculosis
AGLAELVNGAGIDDAAV

SEQ ID NO: 1469663 - protein, 17 aa, Mycobacterium tuberculosis
AGLAGLANRIVDAVDSL

SEQ ID NO: 1469664 - protein, 18 aa, Mycobacterium tuberculosis
AGLRQWRSLDWGTVEVFL

SEQ ID NO: 1469665 - protein, 17 aa, Mycobacterium tuberculosis
AGLVCAHTGGALPRTRP

SEQ ID NO: 1469666 - protein, 23 aa, Mycobacterium tuberculosis
AGMPERLRLPTARPYPPVADQRG

SEQ ID NO: 1469667 - protein, 23 aa, Mycobacterium tuberculosis
AGNGGSGGNGFDSFASGGTGGAG

SEQ ID NO: 1469668 - protein, 19 aa, Mycobacterium tuberculosis
AGSEPMSAAAVAWDQLAME

SEQ ID NO: 1469669 - protein, 22 aa, Mycobacterium tuberculosis
AHDWGGPVAFIMMLRHPEKVTG

SEQ ID NO: 1469670 - protein, 23 aa, Mycobacterium tuberculosis
AHEGSLRFGDKVVLGRDNVINTY

SEQ ID NO: 1469671 - protein, 19 aa, Mycobacterium tuberculosis
AHLLLRFDRGNWIAIDNDS

SEQ ID NO: 1469672 - protein, 17 aa, Mycobacterium tuberculosis
AHTRCWFIDADWTPLLA

SEQ ID NO: 1469673 - protein, 24 aa, Mycobacterium tuberculosis
AIHELARGDAYWDTVVEITSIGDQ

SEQ ID NO: 1469674 - protein, 19 aa, Mycobacterium tuberculosis
AKEEVIHLVPDVNKERGPI

SEQ ID NO: 1469675 - protein, 17 aa, Mycobacterium tuberculosis
AKLTEWLKLALDEPHLL

SEQ ID NO: 1469676 - protein, 24 aa, Mycobacterium tuberculosis
AKVGYPIKWRDYSKLAIDRDDLYG

SEQ ID NO: 1469677 - protein, 22 aa, Mycobacterium tuberculosis
ALAEAACRAFDALAARYDVVVA

SEQ ID NO: 1469678 - protein, 24 aa, Mycobacterium tuberculosis
ALARPRTDFHTEILRMQKAINAVA

SEQ ID NO: 1469679 - protein, 22 aa, Mycobacterium tuberculosis
ALEGAGAGIVWAKVNTFGSTAA

SEQ ID NO: 1469680 - protein, 17 aa, Mycobacterium tuberculosis
ALGPQWVLVKGGHLRSS

SEQ ID NO: 1469681 - protein, 17 aa, Mycobacterium tuberculosis
ALGRGDEALQWFLRSAA

SEQ ID NO: 1469682 - protein, 18 aa, Mycobacterium tuberculosis
ALIDRRGYVLIVSSLAAF

SEQ ID NO: 1469683 - protein, 17 aa, Mycobacterium tuberculosis
ALLAKRGFDPVLGARPL

SEQ ID NO: 1469684 - protein, 18 aa, Mycobacterium tuberculosis
ALQAGRIAVPLSVPQGGV

SEQ ID NO: 1469685 - protein, 17 aa, Mycobacterium tuberculosis
ALRDVMSAVEFRDMAET

SEQ ID NO: 1469686 - protein, 17 aa, Mycobacterium tuberculosis
ALSDFVRRCTWLEHHPE

SEQ ID NO: 1469687 - protein, 20 aa, Mycobacterium tuberculosis
ALSTRLEVEIKRDGYEWSQV

SEQ ID NO: 1469688 - protein, 24 aa, Mycobacterium tuberculosis
ALVGAGLDRKDIRTTRVTVAPQYS

SEQ ID NO: 1469689 - protein, 20 aa, Mycobacterium tuberculosis
AMFNELWAGFDPDEVPIGSV

SEQ ID NO: 1469690 - protein, 26 aa, Mycobacterium tuberculosis
AMFPARAFDALAAWVRAAAAKNMVDG

SEQ ID NO: 1469691 - protein, 25 aa, Mycobacterium tuberculosis
AMGPEGRAAIGLGDGVVRISVGLED

SEQ ID NO: 1469692 - protein, 22 aa, Mycobacterium tuberculosis
AMSAPYVEWLERTAAQTKQTAT

SEQ ID NO: 1469693 - protein, 30 aa, Mycobacterium tuberculosis; identical to SEQ ID NO: 196731

SEQ ID NO: 1469694 - protein, 28 aa, Mycobacterium tuberculosis
APLQPFQATAVIPVIGPVTVTLEGTPAG

SEQ ID NO: 1469695 - protein, 17 aa, Mycobacterium tuberculosis
APMRPRVGVHTGDVRLR

SEQ ID NO: 1469696 - protein, 17 aa, Mycobacterium tuberculosis
AQFIRYEKPRSWLNSGG

SEQ ID NO: 1469697 - protein, 17 aa, Mycobacterium tuberculosis
ARAYLDSRVQTIYGGTT

SEQ ID NO: 1469698 - protein, 19 aa, Mycobacterium tuberculosis
ARCNAIAAAVLMPADVVRA

SEQ ID NO: 1469699 - protein, 20 aa, Mycobacterium tuberculosis
ARFGVPVPNMTAWRDGVVGD

SEQ ID NO: 1469700 - protein, 18 aa, Mycobacterium tuberculosis
ARGIYYGRLTEMTTTDFQ

SEQ ID NO: 1469701 - protein, 17 aa, Mycobacterium tuberculosis
ARKGTGHPAGEQPRDGV

SEQ ID NO: 1469702 - protein, 21 aa, Mycobacterium tuberculosis
ARLLRLLGFDTRWSSAADDPT

SEQ ID NO: 1469703 - protein, 19 aa, Mycobacterium tuberculosis
ARQALRLFDDLRLEHGRLD

SEQ ID NO: 1469704 - protein, 18 aa, Mycobacterium tuberculosis
ARVLYDFVNNEALPGTDI

SEQ ID NO: 1469705 - protein, 17 aa, Mycobacterium tuberculosis
ASATFPWYQLGRQAHVQ

SEQ ID NO: 1469706 - protein, 18 aa, Mycobacterium tuberculosis
ASDVARIGSSIGAANAAA

SEQ ID NO: 1469707 - protein, 23 aa, Mycobacterium tuberculosis
ASELRRLRRCIAAAAGADHPLLP

SEQ ID NO: 1469708 - protein, 19 aa, Mycobacterium tuberculosis
ASTKVQSWDIFKCVRQVLD

SEQ ID NO: 1469709 - protein, 28 aa, Mycobacterium tuberculosis
ATGGIPVTVEVPVGGILAPLQPFQATAV

SEQ ID NO: 1469710 - protein, 17 aa, Mycobacterium tuberculosis
ATGPLVFGAGTSDGSHL

SEQ ID NO: 1469711 - protein, 21 aa, Mycobacterium tuberculosis
ATGVGGTVVFRGGQFGGQFRD

SEQ ID NO: 1469712 - protein, 30 aa, Mycobacterium tuberculosis; identical to SEQ ID NO: 197166

SEQ ID NO: 1469713 - protein, 22 aa, Mycobacterium tuberculosis
ATPQPLQWDCFLFGIIQSDDHF

SEQ ID NO: 1469714 - protein, 17 aa, Mycobacterium tuberculosis
ATTSLAEWVTGPDSPNK

SEQ ID NO: 1469715 - protein, 18 aa, Mycobacterium tuberculosis
AVDIRYASADAKFSVREV

SEQ ID NO: 1469716 - protein, 28 aa, Mycobacterium tuberculosis
AVDPAHPFPFVSGLSLNLAVTVRQPEDG

SEQ ID NO: 1469717 - protein, 23 aa, Mycobacterium tuberculosis
AVFDLPKGAPRRFIRDLYEAISQ

SEQ ID NO: 1469718 - protein, 25 aa, Mycobacterium tuberculosis
AVHRRCADVRYLGSWPTGPAAGAQP

SEQ ID NO: 1469719 - protein, 23 aa, Mycobacterium tuberculosis
AVRGWRTGDIRPERYDRLAQLRD

SEQ ID NO: 1469720 - protein, 17 aa, Mycobacterium tuberculosis
AVVPSMRPAPYSVAPGV

SEQ ID NO: 1469721 - protein, 19 aa, Mycobacterium tuberculosis
AWAVLVAYFNRLRCGTGDY

SEQ ID NO: 1469722 - protein, 32 aa, Mycobacterium tuberculosis
CAPSRSLPLLECWTALAALCRDTTKLRLGTSV

SEQ ID NO: 1469723 - protein, 17 aa, Mycobacterium tuberculosis
CAVEGIPVKVALINNGN

SEQ ID NO: 1469724 - protein, 20 aa, Mycobacterium tuberculosis
CKSCEQRDNLSIKFVAHEGE

SEQ ID NO: 1469725 - protein, 26 aa, Mycobacterium tuberculosis
CRIGERSSHTWFVLTHLLGKADVRNY

SEQ ID NO: 1469726 - protein, 17 aa, Mycobacterium tuberculosis
CRSDLGGALVLSEFTGA

SEQ ID NO: 1469727 - protein, 20 aa, Mycobacterium tuberculosis
DAAIPRLRRALVAPCTTTIR

SEQ ID NO: 1469728 - protein, 25 aa, Mycobacterium tuberculosis
DAASARGSLRLSLGHTSVEADVDAA

SEQ ID NO: 1469729 - protein, 20 aa, Mycobacterium tuberculosis
DACGKMYTRRGTFLEHAGDF

SEQ ID NO: 1469730 - protein, 19 aa, Mycobacterium tuberculosis
DAPLIGWGGNGGPGGFAAF

SEQ ID NO: 1469731 - protein, 17 aa, Mycobacterium tuberculosis
DAPRYAELIKRTQWWGR

SEQ ID NO: 1469732 - protein, 17 aa, Mycobacterium tuberculosis
DASALGCLGYVARASGL

SEQ ID NO: 1469733 - protein, 24 aa, Mycobacterium tuberculosis
DAVLPLRWTDGGMSRVRVLRGAPS

SEQ ID NO: 1469734 - protein, 22 aa, Mycobacterium tuberculosis
DAYIDYRALGGIDGRYPKIKQW

SEQ ID NO: 1469735 - protein, 17 aa, Mycobacterium tuberculosis
DDYLRFVRMLLGDGTVD

SEQ ID NO: 1469736 - protein, 22 aa, Mycobacterium tuberculosis
DEAQRCRCRGIDLRLVSHQPIV

SEQ ID NO: 1469737 - protein, 24 aa, Mycobacterium tuberculosis
DEDRELLESFDLSYGEDEGGEEDL

SEQ ID NO: 1469738 - protein, 17 aa, Mycobacterium tuberculosis
DELYVGPTINRTARLRD

SEQ ID NO: 1469739 - protein, 19 aa, Mycobacterium tuberculosis
DGEFDEWQRLYLFTRADTI

SEQ ID NO: 1469740 - protein, 27 aa, Mycobacterium tuberculosis
DGGGAGGNGAWLFGNGGAGGGGGKGGN

SEQ ID NO: 1469741 - protein, 18 aa, Mycobacterium tuberculosis
DGKAGWRVVSVNQNGVDV

SEQ ID NO: 1469742 - protein, 22 aa, Mycobacterium tuberculosis
DGLWLHCLYAISGINLREPLRA

SEQ ID NO: 1469743 - protein, 18 aa, Mycobacterium tuberculosis
DGNGRWATQRGLARTEGH

SEQ ID NO: 1469744 - protein, 21 aa, Mycobacterium tuberculosis
DGPESRFAKTMALVAEHGAAV

SEQ ID NO: 1469745 - protein, 23 aa, Mycobacterium tuberculosis
DGVLRPLPVTTFDVRRAPAALRY

SEQ ID NO: 1469746 - protein, 17 aa, Mycobacterium tuberculosis
DITHYLWTWTDRSAGSL

SEQ ID NO: 1469747 - protein, 20 aa, Mycobacterium tuberculosis
DKHKLALEREMLGLYVSGHP

SEQ ID NO: 1469748 - protein, 20 aa, Mycobacterium tuberculosis
DKRVLRLVNWQRIRHRWNWT

SEQ ID NO: 1469749 - protein, 21 aa, Mycobacterium tuberculosis
DLFPHAVKWRGTTYLEDGLHR

SEQ ID NO: 1469750 - protein, 32 aa, Mycobacterium tuberculosis; identical to SEQ ID NO: 197903

SEQ ID NO: 1469751 - protein, 17 aa, Mycobacterium tuberculosis
DLYRGCMRGRTMYVVPF

SEQ ID NO: 1469752 - protein, 17 aa, Mycobacterium tuberculosis
DNMREYLAAGAKERQRL

SEQ ID NO: 1469753 - protein, 20 aa, Mycobacterium tuberculosis
DPGTALLLCYRQRRWYLEGS

SEQ ID NO: 1469754 - protein, 25 aa, Mycobacterium tuberculosis
DPQQRLLLEVSWEALEHAGIIPESL

SEQ ID NO: 1469755 - protein, 18 aa, Mycobacterium tuberculosis
DPRRQLTVVGAREHNLRG

SEQ ID NO: 1469756 - protein, 19 aa, Mycobacterium tuberculosis
DQAALAWRLATAQRQMREV

SEQ ID NO: 1469757 - protein, 24 aa, Mycobacterium tuberculosis
DVAQLLLRVGIFSWITHAPKLGGH

SEQ ID NO: 1469758 - protein, 25 aa, Mycobacterium tuberculosis
DVIARGGFPDGCFQTLLVSSGAVEA

SEQ ID NO: 1469759 - protein, 22 aa, Mycobacterium tuberculosis
EAARAEGGWLLNKDGYRYLQDY

SEQ ID NO: 1469760 - protein, 19 aa, Mycobacterium tuberculosis
EAGVDCFVAGSAVYGADDP

SEQ ID NO: 1469761 - protein, 17 aa, Mycobacterium tuberculosis
EAIRIATAAKREYEASV

SEQ ID NO: 1469762 - protein, 17 aa, Mycobacterium tuberculosis
EALLPFEDAPLITNPGG

SEQ ID NO: 1469763 - protein, 27 aa, Mycobacterium tuberculosis
EAQRLAEACGLDLVALGKVVRHSDSFT

SEQ ID NO: 1469764 - protein, 22 aa, Mycobacterium tuberculosis
EDAGRCQRGYFIESLGGAQFAV

SEQ ID NO: 1469765 - protein, 23 aa, Mycobacterium tuberculosis
EEADRLAARLARIDDIEGDRDRV

SEQ ID NO: 1469766 - protein, 27 aa, Mycobacterium tuberculosis
EELNEAICPWCIADGSAASRFDATFTD

SEQ ID NO: 1469767 - protein, 26 aa, Mycobacterium tuberculosis
EEPGRWSADRAHRWYQAHGWLVGANY

SEQ ID NO: 1469768 - protein, 17 aa, Mycobacterium tuberculosis
EEVRNCFADMAKVAIAL

SEQ ID NO: 1469769 - protein, 17 aa, Mycobacterium tuberculosis
EGRGWPVLGDKTIVDYL

SEQ ID NO: 1469770 - protein, 21 aa, Mycobacterium tuberculosis
EHKERRLAEIAASGVTRIGGV

SEQ ID NO: 1469771 - protein, 23 aa, Mycobacterium tuberculosis
EHYRLAVDPERGGALSSLVQDGR

SEQ ID NO: 1469772 - protein, 20 aa, Mycobacterium tuberculosis
EIAPPPVIVSVVNWADCLVA

SEQ ID NO: 1469773 - protein, 18 aa, Mycobacterium tuberculosis
EIARWTAAMLASGARLDF

SEQ ID NO: 1469774 - protein, 18 aa, Mycobacterium tuberculosis
ELDARAAVEQHLLEVLGA

SEQ ID NO: 1469775 - protein, 19 aa, Mycobacterium tuberculosis
ELLPADWPGAGLRAAYHDF

SEQ ID NO: 1469776 - protein, 23 aa, Mycobacterium tuberculosis
ELRELRSAGAVFGLLDVDDEFFV

SEQ ID NO: 1469777 - protein, 24 aa, Mycobacterium tuberculosis
ELRELRSAGAVFGLLDVDDEFFVI

SEQ ID NO: 1469778 - protein, 25 aa, Mycobacterium tuberculosis
EPSGWAYWVAESLLGPGTQLADLKL

SEQ ID NO: 1469779 - protein, 17 aa, Mycobacterium tuberculosis
EQFGLELIWGIEDCRNM

SEQ ID NO: 1469780 - protein, 19 aa, Mycobacterium tuberculosis
ESIRKFRILPVDFTEDTGE

SEQ ID NO: 1469781 - protein, 27 aa, Mycobacterium tuberculosis
ETELRELRSAGAVFGLLDVDDEFFVIV

SEQ ID NO: 1469782 - protein, 21 aa, Mycobacterium tuberculosis
EYCVVKSGFGLEVAKTADVAI

SEQ ID NO: 1469783 - protein, 17 aa, Mycobacterium tuberculosis
FAAGVLRAEAVHEPGYY

SEQ ID NO: 1469784 - protein, 17 aa, Mycobacterium tuberculosis
FAGMISVAIDSADGATV

SEQ ID NO: 1469785 - protein, 21 aa, Mycobacterium tuberculosis
FANSDAWFLIRVVTAPDGTAL

SEQ ID NO: 1469786 - protein, 25 aa, Mycobacterium tuberculosis
FDGAIPRRWRSPAPLWGDTSFHSVA

SEQ ID NO: 1469787 - protein, 24 aa, Mycobacterium tuberculosis
FGFEQVCATPAFPHDSRDWAVAGR

SEQ ID NO: 1469788 - protein, 17 aa, Mycobacterium tuberculosis
FGIALGMAAFRPGRPSR

SEQ ID NO: 1469789 - protein, 18 aa, Mycobacterium tuberculosis
FNAEKGFGFIAPEDGSAD

SEQ ID NO: 1469790 - protein, 41 aa, Mycobacterium tuberculosis; identical to SEQ ID NO: 199268

SEQ ID NO: 1469791 - protein, 24 aa, Mycobacterium tuberculosis
FPPGWSRCRAPAGPPVPLIVNSRP

SEQ ID NO: 1469792 - protein, 24 aa, Mycobacterium tuberculosis
FQGCPAEGLVSLAASVQPLRAAAG

SEQ ID NO: 1469793 - protein, 17 aa, Mycobacterium tuberculosis
FQLDIMRVPGIIVARTD

SEQ ID NO: 1469794 - protein, 17 aa, Mycobacterium tuberculosis
FRRVHLSTGDHFDLYDT

SEQ ID NO: 1469795 - protein, 22 aa, Mycobacterium tuberculosis
FSDNLPSCITKYIPLHTPAVVM

SEQ ID NO: 1469796 - protein, 26 aa, Mycobacterium tuberculosis
FSVLPPEINSALMFAGAGPGPMLAAA

SEQ ID NO: 1469797 - protein, 26 aa, Mycobacterium tuberculosis
FTANPKLPGAMLRDLAALRWLDAGES

SEQ ID NO: 1469798 - protein, 18 aa, Mycobacterium tuberculosis
FTSMYRRIVGSAGPITDD

SEQ ID NO: 1469799 - protein, 20 aa, Mycobacterium tuberculosis
FVSAIDVLLGLGWLAPSHVD

SEQ ID NO: 1469800 - protein, 26 aa, Mycobacterium tuberculosis
GADEVSAAVASLFSGHAQAYQTLGTQ

SEQ ID NO: 1469801 - protein, 25 aa, Mycobacterium tuberculosis
GAGGNGGRGGMLIGNGGAGGAGGTG

SEQ ID NO: 1469802 - protein, 18 aa, Mycobacterium tuberculosis
GAGGYPQMLLRVGWAPIN

SEQ ID NO: 1469803 - protein, 21 aa, Mycobacterium tuberculosis
GAIALGHPFGMTGARITTTLL

SEQ ID NO: 1469804 - protein, 18 aa, Mycobacterium tuberculosis
GALRRFLLEHGVLPEAPL

SEQ ID NO: 1469805 - protein, 21 aa, Mycobacterium tuberculosis
GARCATGILDCWLVHDGDHAE

SEQ ID NO: 1469806 - protein, 25 aa, Mycobacterium tuberculosis
GARGPYRLGPEITRMATTVRLGVVT

SEQ ID NO: 1469807 - protein, 19 aa, Mycobacterium tuberculosis
GCFGLKIPSEYGGLNMSQV

SEQ ID NO: 1469808 - protein, 23 aa, Mycobacterium tuberculosis
GDEDKRVAGAIARLGELKARGVD

SEQ ID NO: 1469809 - protein, 17 aa, Mycobacterium tuberculosis
GDFWGGAGSVACQEFIT

SEQ ID NO: 1469810 - protein, 17 aa, Mycobacterium tuberculosis
GDSGGPVYLAPDGGPAQ

SEQ ID NO: 1469811 - protein, 18 aa, Mycobacterium tuberculosis
GEEVPRDGLLRLLVDVQY

SEQ ID NO: 1469812 - protein, 17 aa, Mycobacterium tuberculosis
GEIGVLFHLPRSATVRA

SEQ ID NO: 1469813 - protein, 22 aa, Mycobacterium tuberculosis
GELEAFLRISVEHADAAGGDEC

SEQ ID NO: 1469814 - protein, 24 aa, Mycobacterium tuberculosis
GELKISIPGFEIPQIATTRFLLDV

SEQ ID NO: 1469815 - protein, 18 aa, Mycobacterium tuberculosis
GFERTLLGRALDFWNEEV

SEQ ID NO: 1469816 - protein, 27 aa, Mycobacterium tuberculosis
GFLNGEARLPLALPTSATGGIPVTVEV

SEQ ID NO: 1469817 - protein, 24 aa, Mycobacterium tuberculosis
GFSAAIPPNLPLPAKIVMQVLDPI

SEQ ID NO: 1469818 - protein, 17 aa, Mycobacterium tuberculosis
GFTVFPQGFTVDRIPVD

SEQ ID NO: 1469819 - protein, 19 aa, Mycobacterium tuberculosis
GGAAGLWGSGGSGGTGGQG

SEQ ID NO: 1469820 - protein, 17 aa, Mycobacterium tuberculosis
GGAVIIAGFPFLDLGNV

SEQ ID NO: 1469821 - protein, 24 aa, Mycobacterium tuberculosis
GGCELATACDVCIATDDARFGIPL

SEQ ID NO: 1469822 - protein, 24 aa, Mycobacterium tuberculosis
GGDGGPGGAAFGLGNGGNGGNGGT

SEQ ID NO: 1469823 - protein, 24 aa, Mycobacterium tuberculosis
GGEITARFLISACGILTVPKLPDI

SEQ ID NO: 1469824 - protein, 22 aa, Mycobacterium tuberculosis
GGLGGRAGLIGHGGAGGNGGDG

SEQ ID NO: 1469825 - protein, 17 aa, Mycobacterium tuberculosis
GGMALSGLAGRAAAGST

SEQ ID NO: 1469826 - protein, 24 aa, Mycobacterium tuberculosis
GGNGGDGGLVWGNGGTGGSGGAGG

SEQ ID NO: 1469827 - protein, 20 aa, Mycobacterium tuberculosis
GGNGGLPFIGSTNAGNGGSA

SEQ ID NO: 1469828 - protein, 24 aa, Mycobacterium tuberculosis
GGSGGNAGIARFDSPDPEAEPDVV

SEQ ID NO: 1469829 - protein, 19 aa, Mycobacterium tuberculosis
GGVHKCIGMVFGQLEIKTI

SEQ ID NO: 1469830 - protein, 22 aa, Mycobacterium tuberculosis
GHNPIAIIVPCHRVIGASGKLT

SEQ ID NO: 1469831 - protein, 17 aa, Mycobacterium tuberculosis
GHPLPGESLPGAIRRRL

SEQ ID NO: 1469832 - protein, 23 aa, Mycobacterium tuberculosis
GKLSLPPNWAGASPSLAPTVGSA

SEQ ID NO: 1469833 - protein, 23 aa, Mycobacterium tuberculosis
GKRVHNAIIRRMQRMSFEELRER

SEQ ID NO: 1469834 - protein, 19 aa, Mycobacterium tuberculosis
GKTYTRWGAFLDDATGFDA

SEQ ID NO: 1469835 - protein, 17 aa, Mycobacterium tuberculosis
GLAGVASVGGQPSQATQ

SEQ ID NO: 1469836 - protein, 27 aa, Mycobacterium tuberculosis
GLDFMGCCAFAALADEAQRCRCRGIDL

SEQ ID NO: 1469837 - protein, 17 aa, Mycobacterium tuberculosis
GLGGLLFGQTGTAGVSP

SEQ ID NO: 1469838 - protein, 23 aa, Mycobacterium tuberculosis
GLREPRGPWGPGRPVEAADAFEA

SEQ ID NO: 1469839 - protein, 26 aa, Mycobacterium tuberculosis
GNKGTGLFSGFMSGFGNTGFLQSGFG

SEQ ID NO: 1469840 - protein, 19 aa, Mycobacterium tuberculosis
GNYSNGAFWTGDYQGLLDF

SEQ ID NO: 1469841 - protein, 18 aa, Mycobacterium tuberculosis
GPFWPRNPWTTAYRQERL

SEQ ID NO: 1469842 - protein, 25 aa, Mycobacterium tuberculosis
GPGGHGGSVLSGPVGDSGNGGAGGD

SEQ ID NO: 1469843 - protein, 18 aa, Mycobacterium tuberculosis
GPGGWLLGNGGNGGSGAP

SEQ ID NO: 1469844 - protein, 24 aa, Mycobacterium tuberculosis
GPLRRLSEGIALLITTGFLPQRFR

SEQ ID NO: 1469845 - protein, 26 aa, Mycobacterium tuberculosis
GRGGNGGHGGLWIGNGGDGGAGGVGG

SEQ ID NO: 1469846 - protein, 29 aa, Mycobacterium tuberculosis
GRLFAEGVAVDWSSVFAGLGGRRVELPTY

SEQ ID NO: 1469847 - protein, 17 aa, Mycobacterium tuberculosis
GRLSENCVLNLKNKSHT

SEQ ID NO: 1469848 - protein, 19 aa, Mycobacterium tuberculosis
GRPGPPPARTGADRTSAVL

SEQ ID NO: 1469849 - protein, 24 aa, Mycobacterium tuberculosis
GRRGEPGPPFFAAYGEWMATPPPT

SEQ ID NO: 1469850 - protein, 32 aa, Mycobacterium tuberculosis; identical to SEQ ID NO: 200346

SEQ ID NO: 1469851 - protein, 19 aa, Mycobacterium tuberculosis
GRVIVACFASNVDRVQQII

SEQ ID NO: 1469852 - protein, 21 aa, Mycobacterium tuberculosis
GSAALFAWGLNQLVFLGLRPP

SEQ ID NO: 1469853 - protein, 21 aa, Mycobacterium tuberculosis
GSAGLLINGCKTWISNARRSG

SEQ ID NO: 1469854 - protein, 19 aa, Mycobacterium tuberculosis
GSAMMRRAGYMYGTVLARG

SEQ ID NO: 1469855 - protein, 18 aa, Mycobacterium tuberculosis
GSELMDKWVGSSEKAVRE

SEQ ID NO: 1469856 - protein, 20 aa, Mycobacterium tuberculosis
GSGRPGFYRPPGRPEVIAKL

SEQ ID NO: 1469857 - protein, 20 aa, Mycobacterium tuberculosis
GSIDRLAVWNMVATVDAFLS

SEQ ID NO: 1469858 - protein, 19 aa, Mycobacterium tuberculosis
GSNGGLLMGIMLTGYPEKF

SEQ ID NO: 1469859 - protein, 25 aa, Mycobacterium tuberculosis
GSQGEGGLRIVGISAVGSIDDLSAF

SEQ ID NO: 1469860 - protein, 24 aa, Mycobacterium tuberculosis
GTALPRRHKLVLSRGPYGYHDEFA

SEQ ID NO: 1469861 - protein, 23 aa, Mycobacterium tuberculosis
GTDLPPTPISVIFRSDKSGTSDN

SEQ ID NO: 1469862 - protein, 18 aa, Mycobacterium tuberculosis
GTPFRPLFTVLAAQLGSD

SEQ ID NO: 1469863 - protein, 20 aa, Mycobacterium tuberculosis
GVPEISRKAFGQSLDTHGYP

SEQ ID NO: 1469864 - protein, 19 aa, Mycobacterium tuberculosis
GWLQEEWLHHCGDAAAFLG

SEQ ID NO: 1469865 - protein, 19 aa, Mycobacterium tuberculosis
GWQTYGDVVVRFEQSSNLH

SEQ ID NO: 1469866 - protein, 18 aa, Mycobacterium tuberculosis
GYVLRRLLRRVIRSAKLL

SEQ ID NO: 1469867 - protein, 21 aa, Mycobacterium tuberculosis
HAARRCATRLLDLHVVDGRLR

SEQ ID NO: 1469868 - protein, 17 aa, Mycobacterium tuberculosis
HACGHNIIAASAVGTAL

SEQ ID NO: 1469869 - protein, 19 aa, Mycobacterium tuberculosis
HDAYCLRIAITETMSDLPV

SEQ ID NO: 1469870 - protein, 19 aa, Mycobacterium tuberculosis
HGRVAFVTGAARAQGRSHA

SEQ ID NO: 1469871 - protein, 17 aa, Mycobacterium tuberculosis
HLVHLRETVNLGPIHID

SEQ ID NO: 1469872 - protein, 20 aa, Mycobacterium tuberculosis
HPAGCLVSFATQTSVQPPSF

SEQ ID NO: 1469873 - protein, 25 aa, Mycobacterium tuberculosis
HPGVNELFALLAYGEVAAFYRLTDE

SEQ ID NO: 1469874 - protein, 26 aa, Mycobacterium tuberculosis
HRRFGDIVRLVFALVPFRFRKHPRAR

SEQ ID NO: 1469875 - protein, 18 aa, Mycobacterium tuberculosis
HRSAARWVPPEPPPSKLS

SEQ ID NO: 1469876 - protein, 23 aa, Mycobacterium tuberculosis
HSAACTTMRWPLHDDQLAAADQL

SEQ ID NO: 1469877 - protein, 17 aa, Mycobacterium tuberculosis
HSGDLNTGFGSPVDQPV

SEQ ID NO: 1469878 - protein, 17 aa, Mycobacterium tuberculosis
HTLRADIDYGLYEAKTT

SEQ ID NO: 1469879 - protein, 18 aa, Mycobacterium tuberculosis
HVQDIGWDEKWQCDGCSI

SEQ ID NO: 1469880 - protein, 28 aa, Mycobacterium tuberculosis
IAAQVVPWASLLQRFPGLGAGATGATGG

SEQ ID NO: 1469881 - protein, 18 aa, Mycobacterium tuberculosis
IADLRAAGLQVLATAVDG

SEQ ID NO: 1469882 - protein, 21 aa, Mycobacterium tuberculosis
IANRLCAQILLLAAEDASKDI

SEQ ID NO: 1469883 - protein, 17 aa, Mycobacterium tuberculosis
IASYCLTEPGAGSDAGA

SEQ ID NO: 1469884 - protein, 25 aa, Mycobacterium tuberculosis
ICVIATEFELVMPFVERAQSKGLEV

SEQ ID NO: 1469885 - protein, 25 aa, Mycobacterium tuberculosis
IDEFGFPVAPWMFGAAGREHMKKYG

SEQ ID NO: 1469886 - protein, 24 aa, Mycobacterium tuberculosis
IDNPDRWAPPYAEAGAYNVTFHAE

SEQ ID NO: 1469887 - protein, 21 aa, Mycobacterium tuberculosis
IEAAEALMLAIVGRLSAYVPL

SEQ ID NO: 1469888 - protein, 17 aa, Mycobacterium tuberculosis
IEYLASVVMTRDGVAYP

SEQ ID NO: 1469889 - protein, 17 aa, Mycobacterium tuberculosis
IGATMSAYATAWVGDSP

SEQ ID NO: 1469890 - protein, 25 aa, Mycobacterium tuberculosis
IGGPVKRDAALCLAVLRVGADPEGV

SEQ ID NO: 1469891 - protein, 17 aa, Mycobacterium tuberculosis
IGLLGAVQTGAWQGPSA

SEQ ID NO: 1469892 - protein, 17 aa, Mycobacterium tuberculosis
IGPITGLFNTPIGLTPL

SEQ ID NO: 1469893 - protein, 26 aa, Mycobacterium tuberculosis
IHINTGFSIPVTFSYSTPALTLFPVG

SEQ ID NO: 1469894 - protein, 18 aa, Mycobacterium tuberculosis
IKLHQLGLSLKDSPPSFD

SEQ ID NO: 1469895 - protein, 25 aa, Mycobacterium tuberculosis
ILAQALIKGGLRLVAAGVNPIALGV

SEQ ID NO: 1469896 - protein, 18 aa, Mycobacterium tuberculosis
ILEREVFDVVAARLRADY

SEQ ID NO: 1469897 - protein, 18 aa, Mycobacterium tuberculosis
INSGRMYTGPGPGPMLAA

SEQ ID NO: 1469898 - protein, 17 aa, Mycobacterium tuberculosis
IPHRTVLPLEFARLAGY

SEQ ID NO: 1469899 - protein, 20 aa, Mycobacterium tuberculosis
IPLAIEFAAARVRSMSPLEI

SEQ ID NO: 1469900 - protein, 26 aa, Mycobacterium tuberculosis
IQAQDFFFRKIVRDKGVALAHVSGQI

SEQ ID NO: 1469901 - protein, 17 aa, Mycobacterium tuberculosis
IRIGSPASWTSAVEAQQ

SEQ ID NO: 1469902 - protein, 17 aa, Mycobacterium tuberculosis
IRLRFGLDDGQPRTLDQ

SEQ ID NO: 1469903 - protein, 19 aa, Mycobacterium tuberculosis
ISKPVGLGFSKGGGENDYE

SEQ ID NO: 1469904 - protein, 17 aa, Mycobacterium tuberculosis
ITTPALISGFFNTGSNM

SEQ ID NO: 1469905 - protein, 20 aa, Mycobacterium tuberculosis
IVAIDMRRRRGLPPIAPHSG

SEQ ID NO: 1469906 - protein, 17 aa, Mycobacterium tuberculosis
IVGRLSAYVPLSSLASR

SEQ ID NO: 1469907 - protein, 19 aa, Mycobacterium tuberculosis
KALADFLFDDERAMVRIDM

SEQ ID NO: 1469908 - protein, 22 aa, Mycobacterium tuberculosis
KAQKQARRWSRDTVATAMRLVA

SEQ ID NO: 1469909 - protein, 20 aa, Mycobacterium tuberculosis
KDGKRSLVVAGIKRCETMRF

SEQ ID NO: 1469910 - protein, 18 aa, Mycobacterium tuberculosis
KDLYRGCMRGRTMYVVPF

SEQ ID NO: 1469911 - protein, 33 aa, Mycobacterium tuberculosis
KFARCSWRAGPCGMPILDDAAAWFIGRTASRSD

SEQ ID NO: 1469912 - protein, 19 aa, Mycobacterium tuberculosis
KFCVRNWLSMTRPVDPVSS

SEQ ID NO: 1469913 - protein, 22 aa, Mycobacterium tuberculosis
KFGLTEAIAAYSTRLKITPTRV

SEQ ID NO: 1469914 - protein, 29 aa, Mycobacterium tuberculosis
KGGAGTLLGLTVFGDNGGAGVLGDSTDPD

SEQ ID NO: 1469915 - protein, 30 aa, Mycobacterium tuberculosis
KGSSSEWMADAALRYLDWLSKHSRQILRTA

SEQ ID NO: 1469916 - protein, 20 aa, Mycobacterium tuberculosis
KLDRSRPLWELWVIEGVEGG

SEQ ID NO: 1469917 - protein, 17 aa, Mycobacterium tuberculosis
KLRLEVVNRGFSPGQNH

SEQ ID NO: 1469918 - protein, 24 aa, Mycobacterium tuberculosis
KLVLRRRGGYCFEHNGLMGYVLAE

SEQ ID NO: 1469919 - protein, 24 aa, Mycobacterium tuberculosis
KPTLAGAVPTIWNDVMHYLEKDPD

SEQ ID NO: 1469920 - protein, 19 aa, Mycobacterium tuberculosis
KSLHLILSHFQMPGFQVPE

SEQ ID NO: 1469921 - protein, 30 aa, Mycobacterium tuberculosis; identical to SEQ ID NO: 201883

SEQ ID NO: 1469922 - protein, 18 aa, Mycobacterium tuberculosis
LAERARARGLNVSALTQA

SEQ ID NO: 1469923 - protein, 18 aa, Mycobacterium tuberculosis
LAGGWIPPHVRLPANVTL

SEQ ID NO: 1469924 - protein, 17 aa, Mycobacterium tuberculosis
LAGRSVFEHRAVVVGGD

SEQ ID NO: 1469925 - protein, 18 aa, Mycobacterium tuberculosis
LAHVAGLHHRSVKIADLV

SEQ ID NO: 1469926 - protein, 24 aa, Mycobacterium tuberculosis
LAPMLDAAAAWDGLADELGSAAAS

SEQ ID NO: 1469927 - protein, 24 aa, Mycobacterium tuberculosis
LASGWIPPHIRLPAHITLLEPAPR

SEQ ID NO: 1469928 - protein, 25 aa, Mycobacterium tuberculosis
LATALQSAAPWLAKSGGEFIVAGQS

SEQ ID NO: 1469929 - protein, 18 aa, Mycobacterium tuberculosis
LATESWYLATLRDKPAVA

SEQ ID NO: 1469930 - protein, 17 aa, Mycobacterium tuberculosis
LATMPRGRHVAQTALVR

SEQ ID NO: 1469931 - protein, 19 aa, Mycobacterium tuberculosis
LCARRSPICSGRWKGASMI

SEQ ID NO: 1469932 - protein, 20 aa, Mycobacterium tuberculosis
LDPTMAYTCAYFEREDMTLE

SEQ ID NO: 1469933 - protein, 17 aa, Mycobacterium tuberculosis
LDQALARTAVLGVQTNV

SEQ ID NO: 1469934 - protein, 17 aa, Mycobacterium tuberculosis
LDSDALAAVCPIFRDAE

SEQ ID NO: 1469935 - protein, 26 aa, Mycobacterium tuberculosis
LDTVARQEPGLSWAAGLRDNGQTTLL

SEQ ID NO: 1469936 - protein, 25 aa, Mycobacterium tuberculosis
LDVMMPRLDGLEVCRQLRSTGDDLP

SEQ ID NO: 1469937 - protein, 18 aa, Mycobacterium tuberculosis
LEIALACHHRIAADVKGS

SEQ ID NO: 1469938 - protein, 20 aa, Mycobacterium tuberculosis
LELAWTTGLIRWEDDPQPGW

SEQ ID NO: 1469939 - protein, 25 aa, Mycobacterium tuberculosis
LFDIHELVNIGPFRIEPIDVPAVVL

SEQ ID NO: 1469940 - protein, 19 aa, Mycobacterium tuberculosis
LGAFVKRVSNPVAGHTVWT

SEQ ID NO: 1469941 - protein, 18 aa, Mycobacterium tuberculosis
LGESRTALAAALETQDGP

SEQ ID NO: 1469942 - protein, 17 aa, Mycobacterium tuberculosis
LGEVLRRYPKVVAPELN

SEQ ID NO: 1469943 - protein, 17 aa, Mycobacterium tuberculosis
LGGDMALFAGLGRLLLE

SEQ ID NO: 1469944 - protein, 17 aa, Mycobacterium tuberculosis
LGRPLVGDGADGASGPV

SEQ ID NO: 1469945 - protein, 28 aa, Mycobacterium tuberculosis
LGTQAAAFHERFIQALSTAAGAYGSAEA

SEQ ID NO: 1469946 - protein, 18 aa, Mycobacterium tuberculosis
LHGARYSGWQGLLDAQRA

SEQ ID NO: 1469947 - protein, 17 aa, Mycobacterium tuberculosis
LHLQNGFILPSFPPFST

SEQ ID NO: 1469948 - protein, 17 aa, Mycobacterium tuberculosis
LIAEEALTLMAGAATLV

SEQ ID NO: 1469949 - protein, 17 aa, Mycobacterium tuberculosis
LIGDGRDGWVGGKTPIN

SEQ ID NO: 1469950 - protein, 25 aa, Mycobacterium tuberculosis
LIRTETSTYCPFKGEASYYSVTTDA

SEQ ID NO: 1469951 - protein, 32 aa, Mycobacterium tuberculosis
LKAYPSHELTAVGDWMLLAAIEALIDEQDYLA

SEQ ID NO: 1469952 - protein, 18 aa, Mycobacterium tuberculosis
LKFPSLHDSPPMLAGKSV

SEQ ID NO: 1469953 - protein, 23 aa, Mycobacterium tuberculosis
LLARRMGKTRVIAETGAGQHGVA

SEQ ID NO: 1469954 - protein, 24 aa, Mycobacterium tuberculosis
LLGCGAVLDHFRVAMAAAGTTANV

SEQ ID NO: 1469955 - protein, 20 aa, Mycobacterium tuberculosis
LLHELPRRLGGEHSDSTNTE

SEQ ID NO: 1469956 - protein, 19 aa, Mycobacterium tuberculosis
LLLGRPLIGNGANGAPGTG

SEQ ID NO: 1469957 - protein, 21 aa, Mycobacterium tuberculosis
LLQLKSWRLSTAKEQNVPAYV

SEQ ID NO: 1469958 - protein, 22 aa, Mycobacterium tuberculosis
LLYKEDCRGFGWLPNIQNRAFL

SEQ ID NO: 1469959 - protein, 27 aa, Mycobacterium tuberculosis
LMAGMVSGLDRKNCWTIAEHRGDTTPM

SEQ ID NO: 1469960 - protein, 21 aa, Mycobacterium tuberculosis
LMGAFPMRLILATMLVAGRLL

SEQ ID NO: 1469961 - protein, 19 aa, Mycobacterium tuberculosis
LNASALDLATPGFLSGIGN

SEQ ID NO: 1469962 - protein, 20 aa, Mycobacterium tuberculosis
LNEGLPHWAMTPSIEQAAQL

SEQ ID NO: 1469963 - protein, 24 aa, Mycobacterium tuberculosis
LNHRPEVRGGVLARECAAPLEAFF

SEQ ID NO: 1469964 - protein, 18 aa, Mycobacterium tuberculosis
LNTGFGSPVDQPVMNSGF

SEQ ID NO: 1469965 - protein, 19 aa, Mycobacterium tuberculosis
LNWLLGNGESPQWSADAKF

SEQ ID NO: 1469966 - protein, 25 aa, Mycobacterium tuberculosis
LPEPDLPRWRRAVEVATQRWVASTA

SEQ ID NO: 1469967 - protein, 21 aa, Mycobacterium tuberculosis
LPHQLLRSWYILYFQLPWLPE

SEQ ID NO: 1469968 - protein, 22 aa, Mycobacterium tuberculosis
LPKLPQCIPNVVLGTTDGALPS

SEQ ID NO: 1469969 - protein, 29 aa, Mycobacterium tuberculosis
LPLRWGEYRAGGLARARWGLLEPPEPWLP

SEQ ID NO: 1469970 - protein, 26 aa, Mycobacterium tuberculosis
LPTRAEPDCLLDSLLLEDPGLLADDL

SEQ ID NO: 1469971 - protein, 17 aa, Mycobacterium tuberculosis
LQLNGLLLLSHLEVINA

SEQ ID NO: 1469972 - protein, 19 aa, Mycobacterium tuberculosis
LQRTAPWVESLGLDHVREV

SEQ ID NO: 1469973 - protein, 22 aa, Mycobacterium tuberculosis
LRAAAQHWATWAMQKQELARNL

SEQ ID NO: 1469974 - protein, 19 aa, Mycobacterium tuberculosis
LRAGDYVNMGLARHAGLPT

SEQ ID NO: 1469975 - protein, 19 aa, Mycobacterium tuberculosis
LRATIEAVLAKLAAPGACN

SEQ ID NO: 1469976 - protein, 20 aa, Mycobacterium tuberculosis
LRLFDDLRLEHGRLDQPIPV

SEQ ID NO: 1469977 - protein, 21 aa, Mycobacterium tuberculosis
LRMGHVLSQAILRSARRHEAA

SEQ ID NO: 1469978 - protein, 21 aa, Mycobacterium tuberculosis
LRRWHIDGLLCIGDAAHAMSP

SEQ ID NO: 1469979 - protein, 26 aa, Mycobacterium tuberculosis
LSAHAVAFHEQFVQLMSAGAAQYASA

SEQ ID NO: 1469980 - protein, 28 aa, Mycobacterium tuberculosis
LTADLNFAWPTARIAVIGADGAAQLLMK

SEQ ID NO: 1469981 - protein, 23 aa, Mycobacterium tuberculosis
LVCKFASRNARRFTLTVGLMLPR

SEQ ID NO: 1469982 - protein, 24 aa, Mycobacterium tuberculosis
LVERLEGWAITKARGDDVTVVFER

SEQ ID NO: 1469983 - protein, 22 aa, Mycobacterium tuberculosis
LVHGLPLYHVHGLVLGLLGSLR

SEQ ID NO: 1469984 - protein, 21 aa, Mycobacterium tuberculosis
LVKTFWGWRDQQLPDGTLILT

SEQ ID NO: 1469985 - protein, 20 aa, Mycobacterium tuberculosis
LVLDAGCDWQRARGQLLALP

SEQ ID NO: 1469986 - protein, 22 aa, Mycobacterium tuberculosis
LVRDGRACLVEAHLQRLTQSAR

SEQ ID NO: 1469987 - protein, 17 aa, Mycobacterium tuberculosis
LYIEGRLLGKPASIDEA

SEQ ID NO: 1469988 - protein, 25 aa, Mycobacterium tuberculosis
LYSPQRWKYLTSGLLGLQRGSDAGD

SEQ ID NO: 1469989 - protein, 17 aa, Mycobacterium tuberculosis
LYVGPTINRTARLRDLA

SEQ ID NO: 1469990 - protein, 20 aa, Mycobacterium tuberculosis
MGALHSWCLAAERPELVSAL

SEQ ID NO: 1469991 - protein, 21 aa, Mycobacterium tuberculosis
MGLPPGPRLSGSVQAVLMLRH

SEQ ID NO: 1469992 - protein, 21 aa, Mycobacterium tuberculosis
MGLVEIRPELRAVTVDGDLVG

SEQ ID NO: 1469993 - protein, 17 aa, Mycobacterium tuberculosis
MHCPFCRHPDSRVIDSR

SEQ ID NO: 1469994 - protein, 21 aa, Mycobacterium tuberculosis
MILHEILPIDVSINLEDAVFI

SEQ ID NO: 1469995 - protein, 17 aa, Mycobacterium tuberculosis
MLELAGFYGDRGAAVEP

SEQ ID NO: 1469996 - protein, 20 aa, Mycobacterium tuberculosis
MLSRLGRRGAALDLIEEFED

SEQ ID NO: 1469997 - protein, 21 aa, Mycobacterium tuberculosis
MMDKLRTAGPWESEQTHDSLR

SEQ ID NO: 1469998 - protein, 18 aa, Mycobacterium tuberculosis
MNDVKSWVAFGASPRASL

SEQ ID NO: 1469999 - protein, 22 aa, Mycobacterium tuberculosis
MPEPFAFSMVLPLAVPGHDRGT

SEQ ID NO: 1470000 - protein, 25 aa, Mycobacterium tuberculosis
MSAQAAAFHARFVQALAGAMGAYAA

SEQ ID NO: 1470001 - protein, 21 aa, Mycobacterium tuberculosis
MSLLDRWYAAIGHELHTLGGK

SEQ ID NO: 1470002 - protein, 17 aa, Mycobacterium tuberculosis
MTIPWQIAQKLHAVTAV

SEQ ID NO: 1470003 - protein, 19 aa, Mycobacterium tuberculosis
NAVGSPITTAIAFAESTTA

SEQ ID NO: 1470004 - protein, 25 aa, Mycobacterium tuberculosis
NFTQLLSRGSWWRIHSPPVVAEPPT

SEQ ID NO: 1470005 - protein, 24 aa, Mycobacterium tuberculosis
NGGAGGNGGWLYGNGGLGGNGGAA

SEQ ID NO: 1470006 - protein, 21 aa, Mycobacterium tuberculosis
NKLAAPVGVRSDCLGVDAPLP

SEQ ID NO: 1470007 - protein, 17 aa, Mycobacterium tuberculosis
NMRARMNSALGITEQGF

SEQ ID NO: 1470008 - protein, 18 aa, Mycobacterium tuberculosis
NMRARMNSALGITEQGFN

SEQ ID NO: 1470009 - protein, 26 aa, Mycobacterium tuberculosis
NPASWYRAVVISMRLPQRRHAVNRWS

SEQ ID NO: 1470010 - protein, 25 aa, Mycobacterium tuberculosis
NPVEAFQFYFELLLFDYPTHIVQIV

SEQ ID NO: 1470011 - protein, 37 aa, Mycobacterium tuberculosis
NSGNYSNGFFWRGDYQGLGGFAYQSAVSEIPWSYDRF

SEQ ID NO: 1470012 - protein, 17 aa, Mycobacterium tuberculosis
NTISGWLNASALDLATP

SEQ ID NO: 1470013 - protein, 18 aa, Mycobacterium tuberculosis
NVANGFLNGEARLPLALP

SEQ ID NO: 1470014 - protein, 27 aa, Mycobacterium tuberculosis
NYSLARWRKADAALGRPVVSNQVHFSL

SEQ ID NO: 1470015 - protein, 19 aa, Mycobacterium tuberculosis
PAEALAWMCDRAVDLLLLE

SEQ ID NO: 1470016 - protein, 23 aa, Mycobacterium tuberculosis
PALAKQMLRHFGVLLDNALAAPD

SEQ ID NO: 1470017 - protein, 17 aa, Mycobacterium tuberculosis
PAPPRRKPIQMPGLQDV

SEQ ID NO: 1470018 - protein, 31 aa, Mycobacterium tuberculosis; identical to SEQ ID NO: 211447

SEQ ID NO: 1470019 - protein, 17 aa, Mycobacterium tuberculosis
PDARGIYYGRLTEMTTT

SEQ ID NO: 1470020 - protein, 20 aa, Mycobacterium tuberculosis
PDMTEHGWATDEWPALYRRV

SEQ ID NO: 1470021 - protein, 20 aa, Mycobacterium tuberculosis
PDVMLGIVEVLRLITDRGDP

SEQ ID NO: 1470022 - protein, 19 aa, Mycobacterium tuberculosis
PDYSITGWVILTLIQHGTP

SEQ ID NO: 1470023 - protein, 20 aa, Mycobacterium tuberculosis
PEALDLVYSLGFTLTGLLPC

SEQ ID NO: 1470024 - protein, 29 aa, Mycobacterium tuberculosis
PEDTGLCSARMYFAYGLGNSVWFPLATGG

SEQ ID NO: 1470025 - protein, 24 aa, Mycobacterium tuberculosis
PFEKAVVVPLDPTSTFALITQPDR

SEQ ID NO: 1470026 - protein, 17 aa, Mycobacterium tuberculosis
PGGCTTHSIVMRSKSGT

SEQ ID NO: 1470027 - protein, 20 aa, Mycobacterium tuberculosis
PHALKGRFSGVAMAAVDDDE

SEQ ID NO: 1470028 - protein, 24 aa, Mycobacterium tuberculosis
PIEAKVAAVNAVIEQSNAMADHVG

SEQ ID NO: 1470029 - protein, 18 aa, Mycobacterium tuberculosis
PILDDAAAWFIGRTASRS

SEQ ID NO: 1470030 - protein, 23 aa, Mycobacterium tuberculosis
PLFQRRHLLLSGWIKMQEGQLPS

SEQ ID NO: 1470031 - protein, 25 aa, Mycobacterium tuberculosis
PLPPTVGITLHLPFDGILVPPHPVT

SEQ ID NO: 1470032 - protein, 18 aa, Mycobacterium tuberculosis
PLPTAITPHHLWLRAVAA

SEQ ID NO: 1470033 - protein, 21 aa, Mycobacterium tuberculosis
PLRGLPRPEWVMQLCHPDIRE

SEQ ID NO: 1470034 - protein, 17 aa, Mycobacterium tuberculosis
PLRLGLGGGGTDVEPYS

SEQ ID NO: 1470035 - protein, 18 aa, Mycobacterium tuberculosis
PLTARMVFEHPVLCELAA

SEQ ID NO: 1470036 - protein, 21 aa, Mycobacterium tuberculosis
PLWECRRCALGDVDGTISINV

SEQ ID NO: 1470037 - protein, 19 aa, Mycobacterium tuberculosis
PMDCHLMIDNPDRWAPPYA

SEQ ID NO: 1470038 - protein, 19 aa, Mycobacterium tuberculosis
PMSAAAVAWDQLAMELASA

SEQ ID NO: 1470039 - protein, 18 aa, Mycobacterium tuberculosis
PMWAHPEPLPPVSGLTIA

SEQ ID NO: 1470040 - protein, 28 aa, Mycobacterium tuberculosis
PNRRPTGQRGFFAWFRVGSDVLVRNAFR

SEQ ID NO: 1470041 - protein, 18 aa, Mycobacterium tuberculosis
PPAVAPWPGPTGERADWW

SEQ ID NO: 1470042 - protein, 19 aa, Mycobacterium tuberculosis
PPFPANLTTLFFGPTGIPL

SEQ ID NO: 1470043 - protein, 25 aa, Mycobacterium tuberculosis
PPFPLYMAGARLDSLVPLGPPVMDV

SEQ ID NO: 1470044 - protein, 19 aa, Mycobacterium tuberculosis
PPPYEQRPPVSPGPAAGYG

SEQ ID NO: 1470045 - protein, 23 aa, Mycobacterium tuberculosis
PPVRELMGYRWLRRDEWLHRRFG

SEQ ID NO: 1470046 - protein, 20 aa, Mycobacterium tuberculosis
PRIPDVCDALGVPWLTLMGY

SEQ ID NO: 1470047 - protein, 29 aa, Mycobacterium tuberculosis
PRLLPLPHLRAWDGAPWIWNLATAILPEA

SEQ ID NO: 1470048 - protein, 24 aa, Mycobacterium tuberculosis
PTEEARAAAYTIPSYEDQYYSPDF

SEQ ID NO: 1470049 - protein, 18 aa, Mycobacterium tuberculosis
PTHGPTVVAVAWARHHAG

SEQ ID NO: 1470050 - protein, 17 aa, Mycobacterium tuberculosis
PTPAPGWTIAHQIGHLL

SEQ ID NO: 1470051 - protein, 20 aa, Mycobacterium tuberculosis
PVAEYWPAFGANGKATLTVR

SEQ ID NO: 1470052 - protein, 19 aa, Mycobacterium tuberculosis
PVLPAGRLVNFGTVHRVPA

SEQ ID NO: 1470053 - protein, 21 aa, Mycobacterium tuberculosis
PVLVAFCARSPHGVSAGGSRL

SEQ ID NO: 1470054 - protein, 32 aa, Mycobacterium tuberculosis; identical to SEQ ID NO: 204527

SEQ ID NO: 1470055 - protein, 19 aa, Mycobacterium tuberculosis
PYATGPLVFGAGTSDGSHL

SEQ ID NO: 1470056 - protein, 29 aa, Mycobacterium tuberculosis
PYHAYTIDWLPEGWFIEVSEVAPGCGQPG

SEQ ID NO: 1470057 - protein, 17 aa, Mycobacterium tuberculosis
QELAVNYLAGAPDSVVT

SEQ ID NO: 1470058 - protein, 22 aa, Mycobacterium tuberculosis
QHGVPAKGWLVGEVHNGIAQMF

SEQ ID NO: 1470059 - protein, 20 aa, Mycobacterium tuberculosis
QIDIPGMSLFDVHEIVEIGP

SEQ ID NO: 1470060 - protein, 27 aa, Mycobacterium tuberculosis
QIEQFRLLVLRTAWLIDKHHDYQKVRR

SEQ ID NO: 1470061 - protein, 18 aa, Mycobacterium tuberculosis
QKAKVLAICNTNGSQIPR

SEQ ID NO: 1470062 - protein, 22 aa, Mycobacterium tuberculosis
QLASSLQPIWFGRAHLREGLSW

SEQ ID NO: 1470063 - protein, 24 aa, Mycobacterium tuberculosis
QLRRRLRIGVQLGSRVVLEQGRQP

SEQ ID NO: 1470064 - protein, 25 aa, Mycobacterium tuberculosis
QLVSTAAADAARIGSAINTANTAAA

SEQ ID NO: 1470065 - protein, 23 aa, Mycobacterium tuberculosis
QPPELETRIAILRKKAQMERLAV

SEQ ID NO: 1470066 - protein, 19 aa, Mycobacterium tuberculosis
QPRDVYVIGVLVGDQDRGQ

SEQ ID NO: 1470067 - protein, 23 aa, Mycobacterium tuberculosis
QQGFCGTCKVRVLAGQVDRRGRI

SEQ ID NO: 1470068 - protein, 20 aa, Mycobacterium tuberculosis
QQPKRPALRPTKAAATTAAT

SEQ ID NO: 1470069 - protein, 31 aa, Mycobacterium tuberculosis; identical to SEQ ID NO: 204787

SEQ ID NO: 1470070 - protein, 18 aa, Mycobacterium tuberculosis
QRAAGEMRSRLRALDAAA

SEQ ID NO: 1470071 - protein, 18 aa, Mycobacterium tuberculosis
QRAGALAAAIDGTRRPLA

SEQ ID NO: 1470072 - protein, 26 aa, Mycobacterium tuberculosis
QRTSLAPIRLRIGLHTGEVQLRDELY

SEQ ID NO: 1470073 - protein, 17 aa, Mycobacterium tuberculosis
QRVPDNLAELGRLTQLP

SEQ ID NO: 1470074 - protein, 22 aa, Mycobacterium tuberculosis
QTLLGRPLIGNGADGVAGTGSN

SEQ ID NO: 1470075 - protein, 17 aa, Mycobacterium tuberculosis
QWLGMGMGLHAGYPVFA

SEQ ID NO: 1470076 - protein, 17 aa, Mycobacterium tuberculosis
QYFGSKVLRTVIPRSVK

SEQ ID NO: 1470077 - protein, 23 aa, Mycobacterium tuberculosis
QYPIETLDGITLFGRPTMTTPFI

SEQ ID NO: 1470078 - protein, 19 aa, Mycobacterium tuberculosis
RAAQRRWARLAPAQRAAGL

SEQ ID NO: 1470079 - protein, 25 aa, Mycobacterium tuberculosis
RALESRPGVVLHPGQAVCHFGVSTG

SEQ ID NO: 1470080 - protein, 19 aa, Mycobacterium tuberculosis
RALTTMPIPVIAAVRGLAV

SEQ ID NO: 1470081 - protein, 17 aa, Mycobacterium tuberculosis
RAPGGRRELDEAVGEIA

SEQ ID NO: 1470082 - protein, 18 aa, Mycobacterium tuberculosis
RARSVLAVARRAQELGWH

SEQ ID NO: 1470083 - protein, 17 aa, Mycobacterium tuberculosis
RAVIVTGDFNARYSDDQ

SEQ ID NO: 1470084 - protein, 20 aa, Mycobacterium tuberculosis
RAVIVTGDFNARYSDDQSAL

SEQ ID NO: 1470085 - protein, 19 aa, Mycobacterium tuberculosis
RDDRLRWWAGPWPDDERWW

SEQ ID NO: 1470086 - protein, 21 aa, Mycobacterium tuberculosis
RDLPVNVARQILAPDTLIGRS

SEQ ID NO: 1470087 - protein, 17 aa, Mycobacterium tuberculosis
RDRFEQMLQRAEARLHP

SEQ ID NO: 1470088 - protein, 18 aa, Mycobacterium tuberculosis
RDTTKLRLGTSVLCNSYR

SEQ ID NO: 1470089 - protein, 17 aa, Mycobacterium tuberculosis
REARKGTGHPAGEQPRD

SEQ ID NO: 1470090 - protein, 25 aa, Mycobacterium tuberculosis
REELQPRLPAVMDRLDRAIPRGVGT

SEQ ID NO: 1470091 - protein, 17 aa, Mycobacterium tuberculosis
REFYAYNSRFWENVFTR

SEQ ID NO: 1470092 - protein, 28 aa, Mycobacterium tuberculosis
REHAEARLGYPLDRSHTAAVIWGDQAQG

SEQ ID NO: 1470093 - protein, 20 aa, Mycobacterium tuberculosis
RELQPGKSLIVRYGPGMGQA

SEQ ID NO: 1470094 - protein, 17 aa, Mycobacterium tuberculosis
RELRPLHPYGVSKAATD

SEQ ID NO: 1470095 - protein, 22 aa, Mycobacterium tuberculosis
RELTAELALALGAAAARRLSRS

SEQ ID NO: 1470096 - protein, 19 aa, Mycobacterium tuberculosis
REPIAVAGEQIWRVPPLGH

SEQ ID NO: 1470097 - protein, 29 aa, Mycobacterium tuberculosis
RFDIADMRNWRPGWFPTMHSRCLSNLIHD

SEQ ID NO: 1470098 - protein, 18 aa, Mycobacterium tuberculosis
RFGPYLSSASNPWGDGIN

SEQ ID NO: 1470099 - protein, 22 aa, Mycobacterium tuberculosis
RFTLTVGLMLPRRAFLPPPHVD

SEQ ID NO: 1470100 - protein, 19 aa, Mycobacterium tuberculosis
RFYDSCRVLPQGDEQPTDL

SEQ ID NO: 1470101 - protein, 17 aa, Mycobacterium tuberculosis
RGLRRILTEGGPTLLGT

SEQ ID NO: 1470102 - protein, 21 aa, Mycobacterium tuberculosis
RHLEIRWDGQVALLADLNSTN

SEQ ID NO: 1470103 - protein, 31 aa, Mycobacterium tuberculosis
RHSGWWRAPLRWTLRGSLALRSHLMVRSSLR

SEQ ID NO: 1470104 - protein, 20 aa, Mycobacterium tuberculosis
RIAALKPDLIVAINAGVDAD

SEQ ID NO: 1470105 - protein, 19 aa, Mycobacterium tuberculosis
RIGRQCLNAGLGFGGGCLP

SEQ ID NO: 1470106 - protein, 25 aa, Mycobacterium tuberculosis
RIQRELPDWLSADVAILGEPTAGCI

SEQ ID NO: 1470107 - protein, 18 aa, Mycobacterium tuberculosis
RITACLLANGGIFADGHT

SEQ ID NO: 1470108 - protein, 27 aa, Mycobacterium tuberculosis
RLGCGCGRADCAAGKRPAAPPVVIHLI

SEQ ID NO: 1470109 - protein, 20 aa, Mycobacterium tuberculosis
RLGWVRELGEIIGRDGDPVR

SEQ ID NO: 1470110 - protein, 18 aa, Mycobacterium tuberculosis
RLIEEGFALYGDQPPFDL

SEQ ID NO: 1470111 - protein, 17 aa, Mycobacterium tuberculosis
RLKRGGTNLTQVLKDAE

SEQ ID NO: 1470112 - protein, 18 aa, Mycobacterium tuberculosis
RLLVRLAGVADRDAADAL

SEQ ID NO: 1470113 - protein, 27 aa, Mycobacterium tuberculosis
RNGVAWVIAYRWFRAGLLPVPAQRVGR

SEQ ID NO: 1470114 - protein, 18 aa, Mycobacterium tuberculosis
RNVAVMNAYVSWTRSALS

SEQ ID NO: 1470115 - protein, 24 aa, Mycobacterium tuberculosis
RPDRFKAISQRGTHYKVIEGIEAV

SEQ ID NO: 1470116 - protein, 25 aa, Mycobacterium tuberculosis
RPELKLPDLELIFAPAPFYDEALVP

SEQ ID NO: 1470117 - protein, 19 aa, Mycobacterium tuberculosis
RPPRQVPGASYWYAHTDQW

SEQ ID NO: 1470118 - protein, 19 aa, Mycobacterium tuberculosis
RPQDGAIITGWDYPACEAI

SEQ ID NO: 1470119 - protein, 20 aa, Mycobacterium tuberculosis
RPQVWDVLEEVIAEHPVLLN

SEQ ID NO: 1470120 - protein, 23 aa, Mycobacterium tuberculosis
RPRAGLIGCAFADLAEVMAGVFA

SEQ ID NO: 1470121 - protein, 18 aa, Mycobacterium tuberculosis
RPVPAGDTMVFFGGIEPV

SEQ ID NO: 1470122 - protein, 18 aa, Mycobacterium tuberculosis
RQLILLDAPVVLGWAGFR

SEQ ID NO: 1470123 - protein, 18 aa, Mycobacterium tuberculosis
RQWLVRWAAHPGRATRGF

SEQ ID NO: 1470124 - protein, 17 aa, Mycobacterium tuberculosis
RRASAWFAENGYLHEAV

SEQ ID NO: 1470125 - protein, 20 aa, Mycobacterium tuberculosis
RRDADVIDLLGAVVAVAAHE

SEQ ID NO: 1470126 - protein, 20 aa, Mycobacterium tuberculosis
RRDKRARLLAQGRDPYPVAV

SEQ ID NO: 1470127 - protein, 22 aa, Mycobacterium tuberculosis
RRISHAYLRGREFYAYNSRFWE

SEQ ID NO: 1470128 - protein, 20 aa, Mycobacterium tuberculosis
RRLDGIPLAIEFAAARVRSM

SEQ ID NO: 1470129 - protein, 17 aa, Mycobacterium tuberculosis
RRLGVLIDAVFNHLGPS

SEQ ID NO: 1470130 - protein, 18 aa, Mycobacterium tuberculosis
RRLTEVRKNGVLPYLRPD

SEQ ID NO: 1470131 - protein, 17 aa, Mycobacterium tuberculosis
RRSGLFAVLCKTDPNAT

SEQ ID NO: 1470132 - protein, 17 aa, Mycobacterium tuberculosis
RRTMLSLVKTNVFGQNT

SEQ ID NO: 1470133 - protein, 17 aa, Mycobacterium tuberculosis
RSRANITVCVGGGIGTP

SEQ ID NO: 1470134 - protein, 17 aa, Mycobacterium tuberculosis
RSRLEVVDPSAAAQLAD

SEQ ID NO: 1470135 - protein, 17 aa, Mycobacterium tuberculosis
RSTVAVDLLRNVGLTVQ

SEQ ID NO: 1470136 - protein, 17 aa, Mycobacterium tuberculosis
RSWPGGHARVLGECHPH

SEQ ID NO: 1470137 - protein, 20 aa, Mycobacterium tuberculosis
RSYVLHPYQMVKDLRTEYEV

SEQ ID NO: 1470138 - protein, 20 aa, Mycobacterium tuberculosis
RTEPGRAVFRTEVAGSDGAE

SEQ ID NO: 1470139 - protein, 33 aa, Mycobacterium tuberculosis
RTTIKRWFPGFMTFRFLECGLLTMVSNPLALRS

SEQ ID NO: 1470140 - protein, 23 aa, Mycobacterium tuberculosis
RVNSPGWRRAMAARKRIDDLIDA

SEQ ID NO: 1470141 - protein, 18 aa, Mycobacterium tuberculosis
RWIEAMPQYGPGHADVVA

SEQ ID NO: 1470142 - protein, 20 aa, Mycobacterium tuberculosis
RWVLDADIKACFDRIDHADL

SEQ ID NO: 1470143 - protein, 19 aa, Mycobacterium tuberculosis
SAAATLDWLQAHGHDDQVR

SEQ ID NO: 1470144 - protein, 18 aa, Mycobacterium tuberculosis
SAEVDVWFANKIGGAAWV

SEQ ID NO: 1470145 - protein, 18 aa, Mycobacterium tuberculosis
SALHLARRGIEVEIFTRA

SEQ ID NO: 1470146 - protein, 24 aa, Mycobacterium tuberculosis
SALPPRFQASAAFAANLSTINTLR

SEQ ID NO: 1470147 - protein, 26 aa, Mycobacterium tuberculosis
SAQAAAFHQQFVRALSSAAGSYAAAE

SEQ ID NO: 1470148 - protein, 23 aa, Mycobacterium tuberculosis
SASGRMTTKWGGFVSDVDAFDAD

SEQ ID NO: 1470149 - protein, 18 aa, Mycobacterium tuberculosis
SATLFRAAIQVMRAPAAR

SEQ ID NO: 1470150 - protein, 20 aa, Mycobacterium tuberculosis
SATQAAALVAEFEAVRAAMV

SEQ ID NO: 1470151 - protein, 34 aa, Mycobacterium tuberculosis; identical to SEQ ID NO: 206263

SEQ ID NO: 1470152 - protein, 37 aa, Mycobacterium tuberculosis
SDLSNILLLGPVGDLFPILSIPGAMSQNFTNVVMTVT

SEQ ID NO: 1470153 - protein, 26 aa, Mycobacterium tuberculosis
SEPLPRAHGGPVRVVVPGFIGARSVK

SEQ ID NO: 1470154 - protein, 19 aa, Mycobacterium tuberculosis
SERLLTLGWQQRALPEVGD

SEQ ID NO: 1470155 - protein, 22 aa, Mycobacterium tuberculosis
SESAGFKWLAPYTGSAIAQHWM

SEQ ID NO: 1470156 - protein, 22 aa, Mycobacterium tuberculosis
SFSQFKRSALPNGPKVSHGGAL

SEQ ID NO: 1470157 - protein, 29 aa, Mycobacterium tuberculosis
SGAAGGVGGRGGWLLGNGGTGGAGGAAGA

SEQ ID NO: 1470158 - protein, 24 aa, Mycobacterium tuberculosis
SGQAWRAPKDVVARAYEFGALATA

SEQ ID NO: 1470159 - protein, 22 aa, Mycobacterium tuberculosis
SGSFNNGALWTGDHHGLVGFSY

SEQ ID NO: 1470160 - protein, 18 aa, Mycobacterium tuberculosis
SHEARFVLIGTMNPEEGE

SEQ ID NO: 1470161 - protein, 27 aa, Mycobacterium tuberculosis
SITYNEWSFAVGKQLNMAQIITSAGPD

SEQ ID NO: 1470162 - protein, 17 aa, Mycobacterium tuberculosis
SIWPFDQLSELWKAISP

SEQ ID NO: 1470163 - protein, 18 aa, Mycobacterium tuberculosis
SLIPWYSALQQWLAENLL

SEQ ID NO: 1470164 - protein, 26 aa, Mycobacterium tuberculosis
SLLPSRIVADLGAPVRLARRPFSSYT

SEQ ID NO: 1470165 - protein, 21 aa, Mycobacterium tuberculosis
SLMHCMTVSLALDGAGLGTVW

SEQ ID NO: 1470166 - protein, 17 aa, Mycobacterium tuberculosis
SLQTTRMAFHAIKAGEG

SEQ ID NO: 1470167 - protein, 17 aa, Mycobacterium tuberculosis
SLVTRSRLTDILRAGGR

SEQ ID NO: 1470168 - protein, 18 aa, Mycobacterium tuberculosis
SNTIAPFLGLLGGVAAAD

SEQ ID NO: 1470169 - protein, 18 aa, Mycobacterium tuberculosis
SPTFGRWDSVLLDDQDRR

SEQ ID NO: 1470170 - protein, 20 aa, Mycobacterium tuberculosis
SPYVLPRLVPVAGDSAGGVG

SEQ ID NO: 1470171 - protein, 18 aa, Mycobacterium tuberculosis
SQWERYRRGIYCGTVGLA

SEQ ID NO: 1470172 - protein, 17 aa, Mycobacterium tuberculosis
SRTALAAALETQDGPRL

SEQ ID NO: 1470173 - protein, 19 aa, Mycobacterium tuberculosis
SSALIGYAQGGSGGLGGFG

SEQ ID NO: 1470174 - protein, 22 aa, Mycobacterium tuberculosis
SSDGFAGLGGSGGRGGDAGLIG

SEQ ID NO: 1470175 - protein, 19 aa, Mycobacterium tuberculosis
SSEIMRLLIAREAVDAHLT

SEQ ID NO: 1470176 - protein, 24 aa, Mycobacterium tuberculosis
SSVISGLTGDDWLGPSALSMAAAA

SEQ ID NO: 1470177 - protein, 18 aa, Mycobacterium tuberculosis
STIRKPPIEHAAGPLGST

SEQ ID NO: 1470178 - protein, 22 aa, Mycobacterium tuberculosis
STTMGGFAIPAGPGYFNSSATP

SEQ ID NO: 1470179 - protein, 21 aa, Mycobacterium tuberculosis
SVCYLPLTYDHRLIDGADAGR

SEQ ID NO: 1470180 - protein, 24 aa, Mycobacterium tuberculosis
SVDYRLAPRYRFPTAATDVRAAWD

SEQ ID NO: 1470181 - protein, 20 aa, Mycobacterium tuberculosis
TALVPGRPAPTLVTAAAVEA

SEQ ID NO: 1470182 - protein, 23 aa, Mycobacterium tuberculosis
TATPRAYPFTNLIGPASTNDIVV

SEQ ID NO: 1470183 - protein, 17 aa, Mycobacterium tuberculosis
TAVAAGILRTSAQVVAL

SEQ ID NO: 1470184 - protein, 18 aa, Mycobacterium tuberculosis
TDFFSDTTFRVFQAPYVG

SEQ ID NO: 1470185 - protein, 33 aa, Mycobacterium tuberculosis; identical to SEQ ID NO: 234947

SEQ ID NO: 1470186 - protein, 17 aa, Mycobacterium tuberculosis
TEEFSIRVFPGDHFYLN

SEQ ID NO: 1470187 - protein, 23 aa, Mycobacterium tuberculosis
TEFELLAAAARDAFGLDVHPAVR

SEQ ID NO: 1470188 - protein, 22 aa, Mycobacterium tuberculosis
TESFRLPPSVLTTVYYRVFGGW

SEQ ID NO: 1470189 - protein, 17 aa, Mycobacterium tuberculosis
TGAPLGLDRPWFVEDEE

SEQ ID NO: 1470190 - protein, 27 aa, Mycobacterium tuberculosis
TGGRGPRPSMVPWVISARSAEALTAQA

SEQ ID NO: 1470191 - protein, 17 aa, Mycobacterium tuberculosis
TGINRYRNIAVQPTEEA

SEQ ID NO: 1470192 - protein, 23 aa, Mycobacterium tuberculosis
TGQAGGPGGLLYGNGGNGGSGGV

SEQ ID NO: 1470193 - protein, 18 aa, Mycobacterium tuberculosis
TGRNALALARRGHPVDVV

SEQ ID NO: 1470194 - protein, 19 aa, Mycobacterium tuberculosis
THDAYCLRIAITETMSDLP

SEQ ID NO: 1470195 - protein, 17 aa, Mycobacterium tuberculosis
TKADIGFWCSGSSDYLA

SEQ ID NO: 1470196 - protein, 17 aa, Mycobacterium tuberculosis
TKPLVLILDDFAMREHT

SEQ ID NO: 1470197 - protein, 18 aa, Mycobacterium tuberculosis
TKTRFLVDQIRTIGIVYV

SEQ ID NO: 1470198 - protein, 18 aa, Mycobacterium tuberculosis
TLASLKWVLANRAYTPWY

SEQ ID NO: 1470199 - protein, 24 aa, Mycobacterium tuberculosis
TLDDEVRLALLIMLERLGPAERVV

SEQ ID NO: 1470200 - protein, 17 aa, Mycobacterium tuberculosis
TLFNFGFANDGTLNLGN

SEQ ID NO: 1470201 - protein, 32 aa, Mycobacterium tuberculosis; identical to SEQ ID NO: 207132

SEQ ID NO: 1470202 - protein, 20 aa, Mycobacterium tuberculosis
TLIGPIHINTGFSIPVTFSY

SEQ ID NO: 1470203 - protein, 18 aa, Mycobacterium tuberculosis
TLVGARRGDLEVAAKELD

SEQ ID NO: 1470204 - protein, 24 aa, Mycobacterium tuberculosis
TMGLPATVVDWGLWKSLADVQKDA

SEQ ID NO: 1470205 - protein, 23 aa, Mycobacterium tuberculosis
TMVCAYSRWLLAMLLPSRCAEDL

SEQ ID NO: 1470206 - protein, 22 aa, Mycobacterium tuberculosis
TNKLAAPVGVRSDCLGVDAPLP

SEQ ID NO: 1470207 - protein, 23 aa, Mycobacterium tuberculosis
TNTGAFFIGHSGLLNSGGGQHVG

SEQ ID NO: 1470208 - protein, 20 aa, Mycobacterium tuberculosis
TPALISGFFNTGSNMSGFFG

SEQ ID NO: 1470209 - protein, 28 aa, Mycobacterium tuberculosis
TPAPLPCTPRGIVHLLRRYDISIAGAHV

SEQ ID NO: 1470210 - protein, 19 aa, Mycobacterium tuberculosis
TQFSSNGWATTPITEAGYV

SEQ ID NO: 1470211 - protein, 17 aa, Mycobacterium tuberculosis
TQKALTWAGTCKPGDGL

SEQ ID NO: 1470212 - protein, 24 aa, Mycobacterium tuberculosis
TQTLLGRPLIGNGTNGAPGTGQAG

SEQ ID NO: 1470213 - protein, 19 aa, Mycobacterium tuberculosis
TRLAARVCGYEITPALRGV

SEQ ID NO: 1470214 - protein, 22 aa, Mycobacterium tuberculosis
TSNRAPNNWYGLFPNPVVAESL

SEQ ID NO: 1470215 - protein, 29 aa, Mycobacterium tuberculosis
TSSFYRPTQPGSYPIVLATYEIVCSKYPD

SEQ ID NO: 1470216 - protein, 18 aa, Mycobacterium tuberculosis
TTFTPKHMGVMFGAPGGD

SEQ ID NO: 1470217 - protein, 22 aa, Mycobacterium tuberculosis
TTPELLACLQRLEVERRRQGAA

SEQ ID NO: 1470218 - protein, 26 aa, Mycobacterium tuberculosis
TTRLLLRAVGDWLVRPGAQLQAVGSA

SEQ ID NO: 1470219 - protein, 17 aa, Mycobacterium tuberculosis
TVVLERLVKFNGEQHMP

SEQ ID NO: 1470220 - protein, 22 aa, Mycobacterium tuberculosis
TWFKHAVFYEVLVRAFFDASAD

SEQ ID NO: 1470221 - protein, 18 aa, Mycobacterium tuberculosis
VAAALGISVTDARGLVDR

SEQ ID NO: 1470222 - protein, 17 aa, Mycobacterium tuberculosis
VAAHGAWLTLIRDGQPI

SEQ ID NO: 1470223 - protein, 17 aa, Mycobacterium tuberculosis
VAANRADLVSLVMSNLF

SEQ ID NO: 1470224 - protein, 18 aa, Mycobacterium tuberculosis
VAAQTARFLLDELGSKAP

SEQ ID NO: 1470225 - protein, 23 aa, Mycobacterium tuberculosis
VAGVCIEPTLTLPGLRAAVDGAG

SEQ ID NO: 1470226 - protein, 18 aa, Mycobacterium tuberculosis
VAITLTWSQLYRRTLNVA

SEQ ID NO: 1470227 - protein, 17 aa, Mycobacterium tuberculosis
VARRLALLLTFPRFLPT

SEQ ID NO: 1470228 - protein, 24 aa, Mycobacterium tuberculosis
VAVTRATPRFGFEQVCATPAFPHD

SEQ ID NO: 1470229 - protein, 21 aa, Mycobacterium tuberculosis
VCGVGKPAGKTAFVFAGQGSQ

SEQ ID NO: 1470230 - protein, 17 aa, Mycobacterium tuberculosis
VCYQFGNAKPVYALEGS

SEQ ID NO: 1470231 - protein, 24 aa, Mycobacterium tuberculosis
VDRHLPAFLRFAGREFIGVQGTQL

SEQ ID NO: 1470232 - protein, 19 aa, Mycobacterium tuberculosis
VDVGKPCPFLIAEGVADST

SEQ ID NO: 1470233 - protein, 17 aa, Mycobacterium tuberculosis
VDVLPFQLVTMGQPIAD

SEQ ID NO: 1470234 - protein, 19 aa, Mycobacterium tuberculosis
VEAYVGLDSFRHLAKERAL

SEQ ID NO: 1470235 - protein, 17 aa, Mycobacterium tuberculosis
VEGIPVKVALINNGNLG

SEQ ID NO: 1470236 - protein, 26 aa, Mycobacterium tuberculosis
VELRIPKLRKGSFFPAILEPRRRIDQ

SEQ ID NO: 1470237 - protein, 20 aa, Mycobacterium tuberculosis
VGAGGAGMRAAVEAGPRVRT

SEQ ID NO: 1470238 - protein, 20 aa, Mycobacterium tuberculosis
VGGATHWAWEKVFTKANMLE

SEQ ID NO: 1470239 - protein, 24 aa, Mycobacterium tuberculosis
VGHVFRRAFSWLPAQFASQSDAPV

SEQ ID NO: 1470240 - protein, 17 aa, Mycobacterium tuberculosis
VGLPAIYVPLPIGNGEQ

SEQ ID NO: 1470241 - protein, 25 aa, Mycobacterium tuberculosis
VGMATCKRCGDAVPYIILPNLQTGE

SEQ ID NO: 1470242 - protein, 19 aa, Mycobacterium tuberculosis
VGTALGVALQRADHVVVAC

SEQ ID NO: 1470243 - protein, 27 aa, Mycobacterium tuberculosis
VGVSPSLRFGLAFCEASGPRLVRHTGN

SEQ ID NO: 1470244 - protein, 23 aa, Mycobacterium tuberculosis
VHGVDAKLAVKVNDLMLPVVKGV

SEQ ID NO: 1470245 - protein, 18 aa, Mycobacterium tuberculosis
VINALGALEERFALEHYQ

SEQ ID NO: 1470246 - protein, 19 aa, Mycobacterium tuberculosis
VIVRQMLRRVTIIDSGSTE

SEQ ID NO: 1470247 - protein, 18 aa, Mycobacterium tuberculosis
VIVTGDFNARYSDDQSAL

SEQ ID NO: 1470248 - protein, 24 aa, Mycobacterium tuberculosis
VLLARAPRSAGHWLAVAEAVVRGP

SEQ ID NO: 1470249 - protein, 25 aa, Mycobacterium tuberculosis
VLPFSPRSQYLVGHLAPVKLTGAAL

SEQ ID NO: 1470250 - protein, 17 aa, Mycobacterium tuberculosis
VNLERAAALGSRLGGHI

SEQ ID NO: 1470251 - protein, 30 aa, Mycobacterium tuberculosis; identical to SEQ ID NO: 211986

SEQ ID NO: 1470252 - protein, 17 aa, Mycobacterium tuberculosis
VRDACLLLAGERPYREF

SEQ ID NO: 1470253 - protein, 17 aa, Mycobacterium tuberculosis
VRLLNMVPYFQANPRIT

SEQ ID NO: 1470254 - protein, 17 aa, Mycobacterium tuberculosis
VRNTWELVGGFRASHEE

SEQ ID NO: 1470255 - protein, 33 aa, Mycobacterium tuberculosis; identical to SEQ ID NO: 211997

SEQ ID NO: 1470256 - protein, 18 aa, Mycobacterium tuberculosis
VSDLFDFSLYVDARIEDI

SEQ ID NO: 1470257 - protein, 18 aa, Mycobacterium tuberculosis
VSELWGFGMDRLVGLDRV

SEQ ID NO: 1470258 - protein, 18 aa, Mycobacterium tuberculosis
VSEVDIYDGLTINIGKPT

SEQ ID NO: 1470259 - protein, 17 aa, Mycobacterium tuberculosis
VSGWVRRTEAAADVGAD

SEQ ID NO: 1470260 - protein, 20 aa, Mycobacterium tuberculosis
VSTAIAALFGSHGQHYQAIS

SEQ ID NO: 1470261 - protein, 17 aa, Mycobacterium tuberculosis
VTCTFHGHRRLSPDEVA

SEQ ID NO: 1470262 - protein, 21 aa, Mycobacterium tuberculosis
VTEPLVPRPVHAINCTPAYLF

SEQ ID NO: 1470263 - protein, 21 aa, Mycobacterium tuberculosis
VTSELAGGAWQGPASAAMANA

SEQ ID NO: 1470264 - protein, 17 aa, Mycobacterium tuberculosis
VTVKTTWTGAGGVKGFF

SEQ ID NO: 1470265 - protein, 21 aa, Mycobacterium tuberculosis
VVERFGDLVFDTVITRTVRFP

SEQ ID NO: 1470266 - protein, 23 aa, Mycobacterium tuberculosis
VVGRKAFARFAGYSSAMHAIAGF

SEQ ID NO: 1470267 - protein, 19 aa, Mycobacterium tuberculosis
VVVLPCGAGKTLVGAAAMA

SEQ ID NO: 1470268 - protein, 19 aa, Mycobacterium tuberculosis
VYYPDCADVGIGAAVEIRG

SEQ ID NO: 1470269 - protein, 19 aa, Mycobacterium tuberculosis
WAKTWEFQALLKARPVVGD

SEQ ID NO: 1470270 - protein, 23 aa, Mycobacterium tuberculosis
WDEKWQCDGCSITHQRDDNAAIN

SEQ ID NO: 1470271 - protein, 20 aa, Mycobacterium tuberculosis
WDLRNGVIVRKARAHGLATP

SEQ ID NO: 1470272 - protein, 18 aa, Mycobacterium tuberculosis
WDNSLWCSWGDRETGYTR

SEQ ID NO: 1470273 - protein, 22 aa, Mycobacterium tuberculosis
WDVRCAPAAFRFMSQARHIGKV

SEQ ID NO: 1470274 - protein, 18 aa, Mycobacterium tuberculosis
WDYRARARAARALHGEPV

SEQ ID NO: 1470275 - protein, 35 aa, Mycobacterium tuberculosis
WEPGETRFALVLSRLFWDAAIFHRACEAVMPGGVL

SEQ ID NO: 1470276 - protein, 18 aa, Mycobacterium tuberculosis
WLAEGVADFVARPKTPPP

SEQ ID NO: 1470277 - protein, 19 aa, Mycobacterium tuberculosis
WLCDHFLTISPGEYAKVAG

SEQ ID NO: 1470278 - protein, 18 aa, Mycobacterium tuberculosis
WLLQRRKRAERALTSVVA

SEQ ID NO: 1470279 - protein, 25 aa, Mycobacterium tuberculosis
WPATPARLPFTLGAGAHLQADIALS

SEQ ID NO: 1470280 - protein, 19 aa, Mycobacterium tuberculosis
WPDALRRGGFDAAEPAAWI

SEQ ID NO: 1470281 - protein, 21 aa, Mycobacterium tuberculosis
WPHPPEALAPRYVDALGGIDR

SEQ ID NO: 1470282 - protein, 17 aa, Mycobacterium tuberculosis
WQECSQVGMPRAVVITK

SEQ ID NO: 1470283 - protein, 19 aa, Mycobacterium tuberculosis
WRDRFEQMLQRAEARLHPQ

SEQ ID NO: 1470284 - protein, 19 aa, Mycobacterium tuberculosis
WRRESELFADVAVPDDVDV

SEQ ID NO: 1470285 - protein, 20 aa, Mycobacterium tuberculosis
WSMPLIRPNGRMLAIKGERA

SEQ ID NO: 1470286 - protein, 17 aa, Mycobacterium tuberculosis
WTGDHHGLVGFSYSIEI

SEQ ID NO: 1470287 - protein, 17 aa, Mycobacterium tuberculosis
WTKYGHWLREPVGPIHW

SEQ ID NO: 1470288 - protein, 17 aa, Mycobacterium tuberculosis
WVPEDIFQTALGRAAEP

SEQ ID NO: 1470289 - protein, 18 aa, Mycobacterium tuberculosis
WVTLTGVGGVGKTRLATQ

SEQ ID NO: 1470290 - protein, 17 aa, Mycobacterium tuberculosis
WYAAIGHELHTLGGKPH

SEQ ID NO: 1470291 - protein, 29 aa, Mycobacterium tuberculosis
YADGDIWDWAVDWDTWVSMSALPPPAAKP

SEQ ID NO: 1470292 - protein, 17 aa, Mycobacterium tuberculosis
YATTVFAEMSALATRIG

SEQ ID NO: 1470293 - protein, 23 aa, Mycobacterium tuberculosis
YDDFFKRCFSIMPADGRMTVQSS

SEQ ID NO: 1470294 - protein, 17 aa, Mycobacterium tuberculosis
YDISDDFFALFLDPTWV

SEQ ID NO: 1470295 - protein, 32 aa, Mycobacterium tuberculosis; identical to SEQ ID NO: 208759

SEQ ID NO: 1470296 - protein, 17 aa, Mycobacterium tuberculosis
YGDLFPHAVKWRGTTYL

SEQ ID NO: 1470297 - protein, 17 aa, Mycobacterium tuberculosis
YGTGAFITGSMNNGLLW

SEQ ID NO: 1470298 - protein, 24 aa, Mycobacterium tuberculosis
YLLEPVSVWAPECSEDLLYLSDLD

SEQ ID NO: 1470299 - protein, 22 aa, Mycobacterium tuberculosis
YLLRRLTAEPATPAELRDAVRS

SEQ ID NO: 1470300 - protein, 17 aa, Mycobacterium tuberculosis
YMSKIFNDAWMSSYGFL

SEQ ID NO: 1470301 - protein, 20 aa, Mycobacterium tuberculosis
YPQMLLRVGWAPINADPLPP

SEQ ID NO: 1470302 - protein, 24 aa, Mycobacterium tuberculosis
YSPRLDRLAAEGILFTRAHATAPL

SEQ ID NO: 1470303 - protein, 18 aa, Mycobacterium tuberculosis
AAAAPYVTWMSGTSAQAK

SEQ ID NO: 1470304 - protein, 17 aa, Mycobacterium tuberculosis
AAARATGGFLGGGRVTA

SEQ ID NO: 1470305 - protein, 25 aa, Mycobacterium tuberculosis
AADEVSAGIAALFGAQAQSYQAVSA

SEQ ID NO: 1470306 - protein, 25 aa, Mycobacterium tuberculosis
AADEVSTAVAALFSSHAQAYQAASA

SEQ ID NO: 1470307 - protein, 17 aa, Mycobacterium tuberculosis
AAFQTVFHVHLHVLPRR

SEQ ID NO: 1470308 - protein, 20 aa, Mycobacterium tuberculosis
AAGLTRSFMAFLIDAYTEDE

SEQ ID NO: 1470309 - protein, 19 aa, Mycobacterium tuberculosis
AAHCPAYFQLLVKALVLPG

SEQ ID NO: 1470310 - protein, 24 aa, Mycobacterium tuberculosis
AAHPGRPDVLTAWMDAAVIDENDP

SEQ ID NO: 1470311 - protein, 18 aa, Mycobacterium tuberculosis
AALDFGASFDGVRPHAIR

SEQ ID NO: 1470312 - protein, 23 aa, Mycobacterium tuberculosis
AALESLYEWMWAQDAAAMAGYYV

SEQ ID NO: 1470313 - protein, 24 aa, Mycobacterium tuberculosis
AANASPMQAVLDVVNGPTQLLLGR

SEQ ID NO: 1470314 - protein, 21 aa, Mycobacterium tuberculosis
AAPYAAWLAAAAVQAEQTAAQ

SEQ ID NO: 1470315 - protein, 19 aa, Mycobacterium tuberculosis
AAVCGAGGDCGRCRRTLRA

SEQ ID NO: 1470316 - protein, 18 aa, Mycobacterium tuberculosis
AAVRRLGHAAGLRVTTGR

SEQ ID NO: 1470317 - protein, 17 aa, Mycobacterium tuberculosis
AAYGRYQPLGVILAVMP

SEQ ID NO: 1470318 - protein, 23 aa, Mycobacterium tuberculosis
ADARRLAPGGAIVVGGAAGSSAL

SEQ ID NO: 1470319 - protein, 25 aa, Mycobacterium tuberculosis
ADDVSAAIAALFGAHAQAYQTISAQ

SEQ ID NO: 1470320 - protein, 19 aa, Mycobacterium tuberculosis
ADEAPGWELVPGTDIANEH

SEQ ID NO: 1470321 - protein, 17 aa, Mycobacterium tuberculosis
ADERAAGVLRAHGYPTD

SEQ ID NO: 1470322 - protein, 17 aa, Mycobacterium tuberculosis
ADFDTLVGIATREYPGC

SEQ ID NO: 1470323 - protein, 18 aa, Mycobacterium tuberculosis
ADFVPRVRAGLEALGVGK

SEQ ID NO: 1470324 - protein, 21 aa, Mycobacterium tuberculosis
ADGQTGLFCPLDEQIQQAARH

SEQ ID NO: 1470325 - protein, 26 aa, Mycobacterium tuberculosis
ADIDGLRYLDWLAAYSAVNLGHRNPA

SEQ ID NO: 1470326 - protein, 17 aa, Mycobacterium tuberculosis
ADVSIIFVPPTFAKDAI

SEQ ID NO: 1470327 - protein, 27 aa, Mycobacterium tuberculosis
ADVVIPKLERLVAMHPYRESLWKQLML

SEQ ID NO: 1470328 - protein, 21 aa, Mycobacterium tuberculosis
AEAKLGYPLDRSHTAAIIWYD

SEQ ID NO: 1470329 - protein, 25 aa, Mycobacterium tuberculosis
AEANRWCDSNGFGADDCFAKFISTL

SEQ ID NO: 1470330 - protein, 30 aa, Mycobacterium tuberculosis; identical to SEQ ID NO: 210459

SEQ ID NO: 1470331 - protein, 18 aa, Mycobacterium tuberculosis
AEFTRIAAGISVSKPRIP

SEQ ID NO: 1470332 - protein, 40 aa, Mycobacterium tuberculosis
AELGYKGLLAPLTFICVFGYKAQAAFFKHANIATAEAQIV

SEQ ID NO: 1470333 - protein, 17 aa, Mycobacterium tuberculosis
AEPRYLIGRKILTPPAR

SEQ ID NO: 1470334 - protein, 17 aa, Mycobacterium tuberculosis
AEVDVWFANKIGGAAWV

SEQ ID NO: 1470335 - protein, 28 aa, Mycobacterium tuberculosis
AEVELAWEILDPALEHWAAHGTPDAYEA

SEQ ID NO: 1470336 - protein, 18 aa, Mycobacterium tuberculosis
AFGEMFARQGHLGAMPAT

SEQ ID NO: 1470337 - protein, 20 aa, Mycobacterium tuberculosis
AFGLARARSAEGDRVGAVRT

SEQ ID NO: 1470338 - protein, 18 aa, Mycobacterium tuberculosis
AGADAIYPGYGFLSENPD

SEQ ID NO: 1470339 - protein, 18 aa, Mycobacterium tuberculosis
AGALGARMTGGGFGGAVI

SEQ ID NO: 1470340 - protein, 19 aa, Mycobacterium tuberculosis
AGAPAYYTICELLHRHGFA

SEQ ID NO: 1470341 - protein, 24 aa, Mycobacterium tuberculosis
AGASFLRRDGSVWTTDKDGIIMAL

SEQ ID NO: 1470342 - protein, 24 aa, Mycobacterium tuberculosis
AGDEVSAAIAALFSSHGQQYQAMS

SEQ ID NO: 1470343 - protein, 25 aa, Mycobacterium tuberculosis
AGGDCGRCRRTLRAIIAAARLNPTQ

SEQ ID NO: 1470344 - protein, 27 aa, Mycobacterium tuberculosis
AGGGAGMFSQPGVHGAGGTGGQGGAGG

SEQ ID NO: 1470345 - protein, 19 aa, Mycobacterium tuberculosis
AGGKADIANSLGDNATVTG

SEQ ID NO: 1470346 - protein, 20 aa, Mycobacterium tuberculosis
AGGTGIEFGSVGGAGGAGGN

SEQ ID NO: 1470347 - protein, 25 aa, Mycobacterium tuberculosis
AGRIPVPVPGFGVWALDSLRRANHY

SEQ ID NO: 1470348 - protein, 17 aa, Mycobacterium tuberculosis
AGSDAAWLRAELNNERG

SEQ ID NO: 1470349 - protein, 17 aa, Mycobacterium tuberculosis
AGTGNWGIGNSGAGNFG

SEQ ID NO: 1470350 - protein, 24 aa, Mycobacterium tuberculosis
AGYLAKRRQPLCTTYRGREICGMP

SEQ ID NO: 1470351 - protein, 27 aa, Mycobacterium tuberculosis
AHLEHPKMPLVPLIDGWETVVEMEAAL

SEQ ID NO: 1470352 - protein, 17 aa, Mycobacterium tuberculosis
AHVKRYLPQLTQQHALA

SEQ ID NO: 1470353 - protein, 19 aa, Mycobacterium tuberculosis
AHWARRTGDPLARRVAAQT

SEQ ID NO: 1470354 - protein, 26 aa, Mycobacterium tuberculosis
AHWARRTGDPLARRVAAQTARFLLDE

SEQ ID NO: 1470355 - protein, 24 aa, Mycobacterium tuberculosis
AIAVAKRGATVFALARNGNALDEL

SEQ ID NO: 1470356 - protein, 17 aa, Mycobacterium tuberculosis
AIDDTWLRTGDLGVYLD

SEQ ID NO: 1470357 - protein, 19 aa, Mycobacterium tuberculosis
AIGKAAPVGLFVETFGTET

SEQ ID NO: 1470358 - protein, 17 aa, Mycobacterium tuberculosis
AIGRPRVPVEVNHEPFV

SEQ ID NO: 1470359 - protein, 27 aa, Mycobacterium tuberculosis
AIPKLRQGSYFPDWLLQRRKRAERALT

SEQ ID NO: 1470360 - protein, 19 aa, Mycobacterium tuberculosis
AIRAGDCDLALAGGVCVMG

SEQ ID NO: 1470361 - protein, 23 aa, Mycobacterium tuberculosis
AKFLDKRGPGIQQLACRVSDLDA

SEQ ID NO: 1470362 - protein, 19 aa, Mycobacterium tuberculosis
ALAPLAEFALHTPILGSEG

SEQ ID NO: 1470363 - protein, 22 aa, Mycobacterium tuberculosis
ALDMAYKLVAYDGSGRTKFSSG

SEQ ID NO: 1470364 - protein, 19 aa, Mycobacterium tuberculosis
ALDTAAWCGLAPASATFDR

SEQ ID NO: 1470365 - protein, 38 aa, Mycobacterium tuberculosis; identical to SEQ ID NO: 233171

SEQ ID NO: 1470366 - protein, 25 aa, Mycobacterium tuberculosis
ALESARELDVWLPVHPVTRRRWPNG

SEQ ID NO: 1470367 - protein, 24 aa, Mycobacterium tuberculosis
ALGERLRVLDGWRERGHGDFRDIR

SEQ ID NO: 1470368 - protein, 26 aa, Mycobacterium tuberculosis
ALGRRRPDIAVTILRLANMIGPAMDT

SEQ ID NO: 1470369 - protein, 18 aa, Mycobacterium tuberculosis
ALLAGLGLQCAARVTAVE

SEQ ID NO: 1470370 - protein, 18 aa, Mycobacterium tuberculosis
ALLAKRGFDPVLGARPLR

SEQ ID NO: 1470371 - protein, 17 aa, Mycobacterium tuberculosis
ALLALADAGVRGRVLHA

SEQ ID NO: 1470372 - protein, 17 aa, Mycobacterium tuberculosis
ALLSRRDVVVVASVSCI

SEQ ID NO: 1470373 - protein, 37 aa, Mycobacterium tuberculosis; identical to SEQ ID NO: 196651

SEQ ID NO: 1470374 - protein, 38 aa, Mycobacterium tuberculosis
ALMSGNFSNGILWRGNYEGLFSYSYSLDVPRITILDAH

SEQ ID NO: 1470375 - protein, 17 aa, Mycobacterium tuberculosis
ALVGRVEIIELWPFSQG

SEQ ID NO: 1470376 - protein, 32 aa, Mycobacterium tuberculosis; identical to SEQ ID NO: 196696

SEQ ID NO: 1470377 - protein, 24 aa, Mycobacterium tuberculosis
AMFQMKFYAVALFRSRGVPPTRLR

SEQ ID NO: 1470378 - protein, 19 aa, Mycobacterium tuberculosis
AMPHLSGPLAGVGVGGQAG

SEQ ID NO: 1470379 - protein, 26 aa, Mycobacterium tuberculosis
AMPNRLVRSLQRWRPFGLPPHRWRLA

SEQ ID NO: 1470380 - protein, 20 aa, Mycobacterium tuberculosis
ANAFVLRGGVPVFVDIRPDT

SEQ ID NO: 1470381 - protein, 20 aa, Mycobacterium tuberculosis
ANAGDYGTGAFITGSMNNGL

SEQ ID NO: 1470382 - protein, 20 aa, Mycobacterium tuberculosis
ANFRDVMIALGLYPDPDAVM

SEQ ID NO: 1470383 - protein, 24 aa, Mycobacterium tuberculosis
ANRRRFPVEIIRRSRAAVGSDFII

SEQ ID NO: 1470384 - protein, 21 aa, Mycobacterium tuberculosis
APDRPRIGEILGAFDDKIAAN

SEQ ID NO: 1470385 - protein, 27 aa, Mycobacterium tuberculosis
APGESRLRLLGFERVELEPGQTRRVRI

SEQ ID NO: 1470386 - protein, 17 aa, Mycobacterium tuberculosis
APGTNWKSNPNAMRTIA

SEQ ID NO: 1470387 - protein, 25 aa, Mycobacterium tuberculosis
APLADLRGGAVWDAAAVRRFAETWE

SEQ ID NO: 1470388 - protein, 18 aa, Mycobacterium tuberculosis
APLDAPRPMPPEVADHVA

SEQ ID NO: 1470389 - protein, 17 aa, Mycobacterium tuberculosis
APMANSLPGQWTAHVTL

SEQ ID NO: 1470390 - protein, 18 aa, Mycobacterium tuberculosis
APQHSRRARRGHRYRTDT

SEQ ID NO: 1470391 - protein, 20 aa, Mycobacterium tuberculosis
APVARRLRESFGGSKPAPAK

SEQ ID NO: 1470392 - protein, 23 aa, Mycobacterium tuberculosis
AQAAAFHDRFVQLLNAGGGSYAS

SEQ ID NO: 1470393 - protein, 25 aa, Mycobacterium tuberculosis
AQLSGLRLGKVISISEASGAAPTHE

SEQ ID NO: 1470394 - protein, 20 aa, Mycobacterium tuberculosis
AQNVRLPWRVDKTDYVLHLI

SEQ ID NO: 1470395 - protein, 19 aa, Mycobacterium tuberculosis
AQQIEWSKVHLFWGDERYV

SEQ ID NO: 1470396 - protein, 17 aa, Mycobacterium tuberculosis
AQRRCCAAVHGGRVVWA

SEQ ID NO: 1470397 - protein, 19 aa, Mycobacterium tuberculosis
AQYRIRLGGTWKKPGTSDI

SEQ ID NO: 1470398 - protein, 22 aa, Mycobacterium tuberculosis
ARFTAAGIRKTWVFQAFDDAHE

SEQ ID NO: 1470399 - protein, 17 aa, Mycobacterium tuberculosis
ARGTTSLRRIREIAPPP

SEQ ID NO: 1470400 - protein, 30 aa, Mycobacterium tuberculosis
ARLASLDKFSTAWDYRARARAARALHGEPV

SEQ ID NO: 1470401 - protein, 17 aa, Mycobacterium tuberculosis
ARLRALVLCDFESMTGA

SEQ ID NO: 1470402 - protein, 17 aa, Mycobacterium tuberculosis
ARLVRALGVVDEADLRP

SEQ ID NO: 1470403 - protein, 17 aa, Mycobacterium tuberculosis
ARQHHVFPPGWSRCRAP

SEQ ID NO: 1470404 - protein, 27 aa, Mycobacterium tuberculosis
ARSVTGIAPAGGWTRWSPVKFEVIAKF

SEQ ID NO: 1470405 - protein, 17 aa, Mycobacterium tuberculosis
ASDLANIGSTLGAANAA

SEQ ID NO: 1470406 - protein, 22 aa, Mycobacterium tuberculosis
ASGGRHSVRFAYDSAIVSLIKS

SEQ ID NO: 1470407 - protein, 28 aa, Mycobacterium tuberculosis
ASGLDSRAWRLPWPDGTVVYELDQPKVL

SEQ ID NO: 1470408 - protein, 17 aa, Mycobacterium tuberculosis
ASGRSIGVPGILRMLEM

SEQ ID NO: 1470409 - protein, 18 aa, Mycobacterium tuberculosis
ASVLSRPVAKIMSTTVAT

SEQ ID NO: 1470410 - protein, 20 aa, Mycobacterium tuberculosis
ASWLPASLLTPAMLGAHYRL

SEQ ID NO: 1470411 - protein, 23 aa, Mycobacterium tuberculosis
ATCGGIRVWSLYVPNGRALDDPH

SEQ ID NO: 1470412 - protein, 20 aa, Mycobacterium tuberculosis
ATGRRFEALSALSAGVKEVR

SEQ ID NO: 1470413 - protein, 27 aa, Mycobacterium tuberculosis
ATIRLRKTVLCAAAHGLGRPPADVTAE

SEQ ID NO: 1470414 - protein, 17 aa, Mycobacterium tuberculosis
ATMRALTGRSWRAGLRQ

SEQ ID NO: 1470415 - protein, 18 aa, Mycobacterium tuberculosis
ATPALFFAVGQGYRNFTQ

SEQ ID NO: 1470416 - protein, 20 aa, Mycobacterium tuberculosis
ATPGSWRREPLSGIPAATNT

SEQ ID NO: 1470417 - protein, 25 aa, Mycobacterium tuberculosis
AVAAQLAPWAQAVRALPNPTAPALA

SEQ ID NO: 1470418 - protein, 17 aa, Mycobacterium tuberculosis
AVDLISAVDIRYASADA

SEQ ID NO: 1470419 - protein, 26 aa, Mycobacterium tuberculosis
AVGQRVVLVFLPRCGQCAACATDGRT

SEQ ID NO: 1470420 - protein, 17 aa, Mycobacterium tuberculosis
AVICMLKSRGVHTVIAS

SEQ ID NO: 1470421 - protein, 18 aa, Mycobacterium tuberculosis
AVLECAGVHDILAKSLGS

SEQ ID NO: 1470422 - protein, 23 aa, Mycobacterium tuberculosis
AVLPLRWTDGGMSRVRVLRGAPS

SEQ ID NO: 1470423 - protein, 26 aa, Mycobacterium tuberculosis
AVPYRANMWALRALGVRRVFGPCAVG

SEQ ID NO: 1470424 - protein, 18 aa, Mycobacterium tuberculosis
AVRADKSWVTSAGFADVY

SEQ ID NO: 1470425 - protein, 19 aa, Mycobacterium tuberculosis
AVSADWGLDEILLPSTGPA

SEQ ID NO: 1470426 - protein, 23 aa, Mycobacterium tuberculosis
AVSRAFIAHSVWQRMGDELLAKA

SEQ ID NO: 1470427 - protein, 18 aa, Mycobacterium tuberculosis
AVTLWKQWDRCALHWFPG

SEQ ID NO: 1470428 - protein, 22 aa, Mycobacterium tuberculosis
CAAISAPLRPGSGMPPIGVPVS

SEQ ID NO: 1470429 - protein, 17 aa, Mycobacterium tuberculosis
CERRKLVNFSTVYLDAN

SEQ ID NO: 1470430 - protein, 30 aa, Mycobacterium tuberculosis
CGFDTPYPPARLEKLWLPGPDRLLDCVERV

SEQ ID NO: 1470431 - protein, 19 aa, Mycobacterium tuberculosis
CKNIIALACGMAVGIGLGE

SEQ ID NO: 1470432 - protein, 18 aa, Mycobacterium tuberculosis
CLTQRQVLDQAPDAVDGR

SEQ ID NO: 1470433 - protein, 20 aa, Mycobacterium tuberculosis
CPSFDHAASLGFTLTDQTPA

SEQ ID NO: 1470434 - protein, 17 aa, Mycobacterium tuberculosis
CRRQHTFSSTLTVESPQ

SEQ ID NO: 1470435 - protein, 17 aa, Mycobacterium tuberculosis
CRYCMPEEHYTWLPRQD

SEQ ID NO: 1470436 - protein, 20 aa, Mycobacterium tuberculosis
CTSLNEVICHGIPDSTVITD

SEQ ID NO: 1470437 - protein, 19 aa, Mycobacterium tuberculosis
CVGSLDFTSGEFQYCTAGH

SEQ ID NO: 1470438 - protein, 26 aa, Mycobacterium tuberculosis
DAEPRWPTFGIRLSARPGIPPTRPVQ

SEQ ID NO: 1470439 - protein, 19 aa, Mycobacterium tuberculosis
DAGERWPDAQIVSMRDVAA

SEQ ID NO: 1470440 - protein, 21 aa, Mycobacterium tuberculosis
DAGLLSGAVTMVWQREKLLQV

SEQ ID NO: 1470441 - protein, 19 aa, Mycobacterium tuberculosis
DAMTQGWFTGLIPITVPIA

SEQ ID NO: 1470442 - protein, 20 aa, Mycobacterium tuberculosis
DAPLPAWSHRFLFYDREGVD

SEQ ID NO: 1470443 - protein, 43 aa, Mycobacterium tuberculosis; identical to SEQ ID NO: 197596

SEQ ID NO: 1470444 - protein, 33 aa, Mycobacterium tuberculosis; identical to SEQ ID NO: 197626

SEQ ID NO: 1470445 - protein, 22 aa, Mycobacterium tuberculosis
DDLVRRCRMVMAGESLPQAEPT

SEQ ID NO: 1470446 - protein, 26 aa, Mycobacterium tuberculosis
DDPFWDRLRFPAALDRVQVPVLLVGG

SEQ ID NO: 1470447 - protein, 23 aa, Mycobacterium tuberculosis
DEISVLQASLFTAYGTLYQQVSA

SEQ ID NO: 1470448 - protein, 17 aa, Mycobacterium tuberculosis
DEIWAPVVYGSRHVAAA

SEQ ID NO: 1470449 - protein, 20 aa, Mycobacterium tuberculosis
DEPWCRTLASHLGHFATTDA

SEQ ID NO: 1470450 - protein, 17 aa, Mycobacterium tuberculosis
DERAAGYAGWRKAVQRT

SEQ ID NO: 1470451 - protein, 20 aa, Mycobacterium tuberculosis
DEYLALQCGRSVHTRRAYLG

SEQ ID NO: 1470452 - protein, 26 aa, Mycobacterium tuberculosis
DFCDPEVVEALKFHLRDLAVTFRFGE

SEQ ID NO: 1470453 - protein, 25 aa, Mycobacterium tuberculosis
DGEFQEMFAPGAFRRSIAERGHKLK

SEQ ID NO: 1470454 - protein, 24 aa, Mycobacterium tuberculosis
DGGFDISARMGAAISDAAPQLRDD

SEQ ID NO: 1470455 - protein, 18 aa, Mycobacterium tuberculosis
DGQIGFGSLNSGSGNIGL

SEQ ID NO: 1470456 - protein, 22 aa, Mycobacterium tuberculosis
DHGKAPVRRACYAADRTGHMIL

SEQ ID NO: 1470457 - protein, 18 aa, Mycobacterium tuberculosis
DHPEWVMPTNWAVAVDRP

SEQ ID NO: 1470458 - protein, 19 aa, Mycobacterium tuberculosis
DIALRRPSLDDVFLAMTTD

SEQ ID NO: 1470459 - protein, 17 aa, Mycobacterium tuberculosis
DIDLVFSPFFNALPIRR

SEQ ID NO: 1470460 - protein, 17 aa, Mycobacterium tuberculosis
DILLQGVSICFDQLHEI

SEQ ID NO: 1470461 - protein, 17 aa, Mycobacterium tuberculosis
DILRPVADRLWYPLWDA

SEQ ID NO: 1470462 - protein, 22 aa, Mycobacterium tuberculosis
DIRARGRLIVGLDIGSNLFSFR

SEQ ID NO: 1470463 - protein, 20 aa, Mycobacterium tuberculosis
DKPKPWRVFSAATPAESVSL

SEQ ID NO: 1470464 - protein, 18 aa, Mycobacterium tuberculosis
DKVLRAKVDGAWNLHELT

SEQ ID NO: 1470465 - protein, 20 aa, Mycobacterium tuberculosis
DLASACLYLLEHFDGPTHVN

SEQ ID NO: 1470466 - protein, 24 aa, Mycobacterium tuberculosis
DLLRSPRPRWPPNAAGMQVECTDT

SEQ ID NO: 1470467 - protein, 22 aa, Mycobacterium tuberculosis
DLPLHPGFAASWQRLRTAPATV

SEQ ID NO: 1470468 - protein, 25 aa, Mycobacterium tuberculosis
DLRTRVQTFLARRQLFDPALLAQAR

SEQ ID NO: 1470469 - protein, 18 aa, Mycobacterium tuberculosis
DMHAPILVISQFTLYADT

SEQ ID NO: 1470470 - protein, 25 aa, Mycobacterium tuberculosis
DNQIWQCPVVLLADVRSVGVQGDGR

SEQ ID NO: 1470471 - protein, 22 aa, Mycobacterium tuberculosis
DNQQGFNFAGGWNSGTANIGLF

SEQ ID NO: 1470472 - protein, 17 aa, Mycobacterium tuberculosis
DNWLSSPYSHWAFQHVE

SEQ ID NO: 1470473 - protein, 23 aa, Mycobacterium tuberculosis
DPDPRAADIVETWAHVLDQLERD

SEQ ID NO: 1470474 - protein, 22 aa, Mycobacterium tuberculosis
DPRKWAAICDAARHWALRVETC

SEQ ID NO: 1470475 - protein, 25 aa, Mycobacterium tuberculosis
DPTASRAVSWWSVHEHVAPVLDAAG

SEQ ID NO: 1470476 - protein, 19 aa, Mycobacterium tuberculosis
DQALLPTFRAFDLPRVRRI

SEQ ID NO: 1470477 - protein, 23 aa, Mycobacterium tuberculosis
DQARLLCEKAAWTIDQHGNKEAR

SEQ ID NO: 1470478 - protein, 18 aa, Mycobacterium tuberculosis
DQHAGGPGRVFVYSGQGS

SEQ ID NO: 1470479 - protein, 17 aa, Mycobacterium tuberculosis
DQLACYRPTPSANSIAW

SEQ ID NO: 1470480 - protein, 21 aa, Mycobacterium tuberculosis
DRALLSAYCETWSVYVAAVQR

SEQ ID NO: 1470481 - protein, 19 aa, Mycobacterium tuberculosis
DRDGFVFGEGGALLLIETE

SEQ ID NO: 1470482 - protein, 21 aa, Mycobacterium tuberculosis
DRGAGHLGFAGTARREAVADA

SEQ ID NO: 1470483 - protein, 21 aa, Mycobacterium tuberculosis
DRGMPVLGICNGFQVLCEAGL

SEQ ID NO: 1470484 - protein, 21 aa, Mycobacterium tuberculosis
DRHLLRPLREVMWGHDENLLN

SEQ ID NO: 1470485 - protein, 18 aa, Mycobacterium tuberculosis
DRTGCRDALRRDGADTVV

SEQ ID NO: 1470486 - protein, 17 aa, Mycobacterium tuberculosis
DRTRPCGRWSYARPDAN

SEQ ID NO: 1470487 - protein, 17 aa, Mycobacterium tuberculosis
DRYLSWTRFALSKLPRW

SEQ ID NO: 1470488 - protein, 21 aa, Mycobacterium tuberculosis
DSATEPVHFVQMWVIPDATGI

SEQ ID NO: 1470489 - protein, 18 aa, Mycobacterium tuberculosis
DSTRGVATFLVLRTRRDG

SEQ ID NO: 1470490 - protein, 18 aa, Mycobacterium tuberculosis
DTVARLIGPAALKYLLFS

SEQ ID NO: 1470491 - protein, 17 aa, Mycobacterium tuberculosis
DVCRQWNDAGAFTITGR

SEQ ID NO: 1470492 - protein, 18 aa, Mycobacterium tuberculosis
DVFVPRHRFLSYKAMNDH

SEQ ID NO: 1470493 - protein, 25 aa, Mycobacterium tuberculosis
DYAGGVRAGHRLKFWTPGGSSTPLL

SEQ ID NO: 1470494 - protein, 22 aa, Mycobacterium tuberculosis
DYSDAGLYLWATRGEPCRDSVA

SEQ ID NO: 1470495 - protein, 20 aa, Mycobacterium tuberculosis
EAALRVARDIAAKDTRVIRA

SEQ ID NO: 1470496 - protein, 17 aa, Mycobacterium tuberculosis
EALIRMDLAEMLREEGY

SEQ ID NO: 1470497 - protein, 18 aa, Mycobacterium tuberculosis
EALTMAASDLANIGSTIN

SEQ ID NO: 1470498 - protein, 18 aa, Mycobacterium tuberculosis
EEAARWGLVQKVVAPQDL

SEQ ID NO: 1470499 - protein, 35 aa, Mycobacterium tuberculosis; identical to SEQ ID NO: 198426

SEQ ID NO: 1470500 - protein, 17 aa, Mycobacterium tuberculosis
EFIPRPVKSSFREGLTV

SEQ ID NO: 1470501 - protein, 17 aa, Mycobacterium tuberculosis
EFLTRWATGELDAADVD

SEQ ID NO: 1470502 - protein, 17 aa, Mycobacterium tuberculosis
EGDHLHCTVSVPMVDAA

SEQ ID NO: 1470503 - protein, 21 aa, Mycobacterium tuberculosis
EGLPPGSALLVVKRGPNAGSR

SEQ ID NO: 1470504 - protein, 19 aa, Mycobacterium tuberculosis
EILYGYEWELTKSPAGAWQ

SEQ ID NO: 1470505 - protein, 17 aa, Mycobacterium tuberculosis
EIVDKWRAAGVRMVDER

SEQ ID NO: 1470506 - protein, 33 aa, Mycobacterium tuberculosis; identical to SEQ ID NO: 198544

SEQ ID NO: 1470507 - protein, 20 aa, Mycobacterium tuberculosis
EKAYGAGPCPGHLTDIEHIV

SEQ ID NO: 1470508 - protein, 17 aa, Mycobacterium tuberculosis
EKMEKAVAVARDDLSTI

SEQ ID NO: 1470509 - protein, 20 aa, Mycobacterium tuberculosis
ELAVAASWFGSVTSGLADAA

SEQ ID NO: 1470510 - protein, 17 aa, Mycobacterium tuberculosis
ELGTFLAECPPIAVLTS

SEQ ID NO: 1470511 - protein, 17 aa, Mycobacterium tuberculosis
ELMKLRAATELEVDLHH

SEQ ID NO: 1470512 - protein, 19 aa, Mycobacterium tuberculosis
ELVFPLQVVINLSDPETDY

SEQ ID NO: 1470513 - protein, 23 aa, Mycobacterium tuberculosis
EMRIDPFEMWTQGTNGLGITFYS

SEQ ID NO: 1470514 - protein, 17 aa, Mycobacterium tuberculosis
EPGHAFYMIGVNDHVAN

SEQ ID NO: 1470515 - protein, 22 aa, Mycobacterium tuberculosis
EPMIPIYIFYSMFGFQRTGDSF

SEQ ID NO: 1470516 - protein, 25 aa, Mycobacterium tuberculosis
EQMWAQDVAAMFGYHAGASAAVSAL

SEQ ID NO: 1470517 - protein, 19 aa, Mycobacterium tuberculosis
ETLVRAASDLANIGSTLGA

SEQ ID NO: 1470518 - protein, 18 aa, Mycobacterium tuberculosis
EVLDALQELTRLAVHQKT

SEQ ID NO: 1470519 - protein, 18 aa, Mycobacterium tuberculosis
EVRSRFYARAPELHRSPV

SEQ ID NO: 1470520 - protein, 17 aa, Mycobacterium tuberculosis
EYLDMFYNLGIAGRAMR

SEQ ID NO: 1470521 - protein, 19 aa, Mycobacterium tuberculosis
FAAGALAAGCEYEIDEAAP

SEQ ID NO: 1470522 - protein, 22 aa, Mycobacterium tuberculosis
FAAKARRLFPSGSPFGLGVLLP

SEQ ID NO: 1470523 - protein, 18 aa, Mycobacterium tuberculosis
FAVDPDRSAQFLLVVLTQ

SEQ ID NO: 1470524 - protein, 23 aa, Mycobacterium tuberculosis
FDPELQLWVAACLYKGGVDVYRT

SEQ ID NO: 1470525 - protein, 19 aa, Mycobacterium tuberculosis
FFFLRPKDIAIYVGSGELD

SEQ ID NO: 1470526 - protein, 21 aa, Mycobacterium tuberculosis
FGAQLSAFHAQFVQSLTNGAR

SEQ ID NO: 1470527 - protein, 29 aa, Mycobacterium tuberculosis
FGGAGAGIANFLGFSVLHGGAGGAGGTAT

SEQ ID NO: 1470528 - protein, 18 aa, Mycobacterium tuberculosis
FGGGFQHWGDAMMTDGRW

SEQ ID NO: 1470529 - protein, 25 aa, Mycobacterium tuberculosis
FGLTSGLFPFHFTLNGGIGPISIPT

SEQ ID NO: 1470530 - protein, 17 aa, Mycobacterium tuberculosis
FKPGTLTSLGFSYDVLH

SEQ ID NO: 1470531 - protein, 17 aa, Mycobacterium tuberculosis
FLDRGCKVLCTEPRGEN

SEQ ID NO: 1470532 - protein, 17 aa, Mycobacterium tuberculosis
FLLAFLACFDAGDRVAM

SEQ ID NO: 1470533 - protein, 33 aa, Mycobacterium tuberculosis
FMSGNFSNGLLWRGDHEGLFSLFYSLDVPRITI

SEQ ID NO: 1470534 - protein, 25 aa, Mycobacterium tuberculosis
FMTDAALRYLKWLSKHSKRLWQTAN

SEQ ID NO: 1470535 - protein, 19 aa, Mycobacterium tuberculosis
FNWPALPVAMADTIVPDFP

SEQ ID NO: 1470536 - protein, 21 aa, Mycobacterium tuberculosis
FPHVYCELDFTTPLELAVATI

SEQ ID NO: 1470537 - protein, 22 aa, Mycobacterium tuberculosis
FPQNWWEWRDLIGPLAADGNRV

SEQ ID NO: 1470538 - protein, 17 aa, Mycobacterium tuberculosis
FQEMVNRVGADVPGLPR

SEQ ID NO: 1470539 - protein, 21 aa, Mycobacterium tuberculosis
FRLGSDPGLARFIDQVARRVQ

SEQ ID NO: 1470540 - protein, 17 aa, Mycobacterium tuberculosis
FSGPDFWVTVVGPAQPT

SEQ ID NO: 1470541 - protein, 20 aa, Mycobacterium tuberculosis
FSMASGRVAYAMRLHGPAIT

SEQ ID NO: 1470542 - protein, 26 aa, Mycobacterium tuberculosis
FTAEVDIRPKISLPDLSALTVSVDPI

SEQ ID NO: 1470543 - protein, 17 aa, Mycobacterium tuberculosis
FTESLAFGATRNPWCLN

SEQ ID NO: 1470544 - protein, 18 aa, Mycobacterium tuberculosis
FTGRPGMFVRASGMALPF

SEQ ID NO: 1470545 - protein, 22 aa, Mycobacterium tuberculosis
FTPEELYPLTGVRSLVLNTSVE

SEQ ID NO: 1470546 - protein, 25 aa, Mycobacterium tuberculosis
FVISPYSRGGLMVHDRFDHTSQLQL

SEQ ID NO: 1470547 - protein, 17 aa, Mycobacterium tuberculosis
FVLETGTPKSDRTGTGT

SEQ ID NO: 1470548 - protein, 18 aa, Mycobacterium tuberculosis
FVLPAAVLEKMRFIHTVV

SEQ ID NO: 1470549 - protein, 17 aa, Mycobacterium tuberculosis
FVVKTLVAMLDWGLNPQ

SEQ ID NO: 1470550 - protein, 19 aa, Mycobacterium tuberculosis
FYAAGLFAMNNGVPWSVPR

SEQ ID NO: 1470551 - protein, 20 aa, Mycobacterium tuberculosis
GADAAYVCRGRVCDLPVTSA

SEQ ID NO: 1470552 - protein, 26 aa, Mycobacterium tuberculosis
GADEVSAAIASLFAAHGQAYQAVSAQ

SEQ ID NO: 1470553 - protein, 30 aa, Mycobacterium tuberculosis; identical to SEQ ID NO: 199462

SEQ ID NO: 1470554 - protein, 19 aa, Mycobacterium tuberculosis
GAGNMSGFGNFGAGNSGFF

SEQ ID NO: 1470555 - protein, 17 aa, Mycobacterium tuberculosis
GALLDYLDARGFKTDYT

SEQ ID NO: 1470556 - protein, 23 aa, Mycobacterium tuberculosis
GAPGGPGGLLLGNGGNGGSGAPG

SEQ ID NO: 1470557 - protein, 25 aa, Mycobacterium tuberculosis
GAPMAKRLLDWPGGLTVFDVRVEAM

SEQ ID NO: 1470558 - protein, 17 aa, Mycobacterium tuberculosis
GAPSGAYVRRAGDDVQP

SEQ ID NO: 1470559 - protein, 17 aa, Mycobacterium tuberculosis
GATGLIGSGGFGGAGGA

SEQ ID NO: 1470560 - protein, 17 aa, Mycobacterium tuberculosis
GATRPALQLSRALLGNQ

SEQ ID NO: 1470561 - protein, 19 aa, Mycobacterium tuberculosis
GAVIEMIHLATLYHDDVMD

SEQ ID NO: 1470562 - protein, 23 aa, Mycobacterium tuberculosis
GAVTDVLGAVVKVFVSGVDASDL

SEQ ID NO: 1470563 - protein, 19 aa, Mycobacterium tuberculosis
GAVTMVWQREKLLQVNEIG

SEQ ID NO: 1470564 - protein, 22 aa, Mycobacterium tuberculosis
GDGFVSAPGHGRCEVICFSADH

SEQ ID NO: 1470565 - protein, 23 aa, Mycobacterium tuberculosis
GDGGAGPLLIGNGGVGGLGGAGA

SEQ ID NO: 1470566 - protein, 25 aa, Mycobacterium tuberculosis
GDGGNGATGTWGHNLGAGGTGGNGG

SEQ ID NO: 1470567 - protein, 17 aa, Mycobacterium tuberculosis
GDVGAVVGRYAAGGYEV

SEQ ID NO: 1470568 - protein, 19 aa, Mycobacterium tuberculosis
GEGAIGRWRGGRSELTTEC

SEQ ID NO: 1470569 - protein, 24 aa, Mycobacterium tuberculosis
GELLVRGGVVFSGYWRNEQATTEA

SEQ ID NO: 1470570 - protein, 25 aa, Mycobacterium tuberculosis
GELPTWQWESLISKSTRLVAVNSAS

SEQ ID NO: 1470571 - protein, 21 aa, Mycobacterium tuberculosis
GELVFPLQVVINLSDPETDYT

SEQ ID NO: 1470572 - protein, 17 aa, Mycobacterium tuberculosis
GEQRWLADHVIAGVVLL

SEQ ID NO: 1470573 - protein, 17 aa, Mycobacterium tuberculosis
GFPRLAIARLMTSYFEL

SEQ ID NO: 1470574 - protein, 23 aa, Mycobacterium tuberculosis
GFQTRLAQFVAIAARYHIKPLFV

SEQ ID NO: 1470575 - protein, 24 aa, Mycobacterium tuberculosis
GGAGAIGMHYARYLAEHGARRIVL

SEQ ID NO: 1470576 - protein, 25 aa, Mycobacterium tuberculosis
GGAGGDGGLFFGVGGAGGAGGTGTN

SEQ ID NO: 1470577 - protein, 26 aa, Mycobacterium tuberculosis
GGAGQITGLRSGFGGAGGAGGASDTG

SEQ ID NO: 1470578 - protein, 18 aa, Mycobacterium tuberculosis
GGAVIIAGFPFLDLGNVT

SEQ ID NO: 1470579 - protein, 24 aa, Mycobacterium tuberculosis
GGEGKRLYPLTADRAKPAVPFGGA

SEQ ID NO: 1470580 - protein, 19 aa, Mycobacterium tuberculosis
GGEMGRLWYENGKLLDKKN

SEQ ID NO: 1470581 - protein, 21 aa, Mycobacterium tuberculosis
GGFGTLLLLGHDWAPPPATFH

SEQ ID NO: 1470582 - protein, 23 aa, Mycobacterium tuberculosis
GGGAGMFSQPGVHGAGGTGGQGG

SEQ ID NO: 1470583 - protein, 24 aa, Mycobacterium tuberculosis
GGSGGNGGNAWLTGQGGNGGNAAF

SEQ ID NO: 1470584 - protein, 19 aa, Mycobacterium tuberculosis
GGVGGRGGNGGFSSAGTSG

SEQ ID NO: 1470585 - protein, 18 aa, Mycobacterium tuberculosis
GGVLKPILWGPGKATAVQ

SEQ ID NO: 1470586 - protein, 21 aa, Mycobacterium tuberculosis
GHGNAKRWGWIHADLGDGDVL

SEQ ID NO: 1470587 - protein, 21 aa, Mycobacterium tuberculosis
GIGGAAINILANAGAGGAGGA

SEQ ID NO: 1470588 - protein, 17 aa, Mycobacterium tuberculosis
GKRSYAASVHRATRPGA

SEQ ID NO: 1470589 - protein, 24 aa, Mycobacterium tuberculosis
GKTLARICALNALAAVDSLVDLDA

SEQ ID NO: 1470590 - protein, 18 aa, Mycobacterium tuberculosis
GLFLSLPGVSQWRTLQRV

SEQ ID NO: 1470591 - protein, 26 aa, Mycobacterium tuberculosis
GLGGAGGAGGWLIGQSGSTGGGGAGG

SEQ ID NO: 1470592 - protein, 17 aa, Mycobacterium tuberculosis
GLLAARHGLLGAVVEQP

SEQ ID NO: 1470593 - protein, 18 aa, Mycobacterium tuberculosis
GLNLVGGLRRSMAKAGYC

SEQ ID NO: 1470594 - protein, 18 aa, Mycobacterium tuberculosis
GLPRLAARINNERIRLGI

SEQ ID NO: 1470595 - protein, 19 aa, Mycobacterium tuberculosis
GMSKSGLFRHFGAKEQLQL

SEQ ID NO: 1470596 - protein, 20 aa, Mycobacterium tuberculosis
GMSRLSGYLTPQARATFEAV

SEQ ID NO: 1470597 - protein, 21 aa, Mycobacterium tuberculosis
GNDHWSGFRPDRIKALAGAAL

SEQ ID NO: 1470598 - protein, 17 aa, Mycobacterium tuberculosis
GNIFLITGIGYYPNLGV

SEQ ID NO: 1470599 - protein, 18 aa, Mycobacterium tuberculosis
GNLPIAAIERFCQITDPA

SEQ ID NO: 1470600 - protein, 19 aa, Mycobacterium tuberculosis
GNYSNGLFLSGDYQGLVGL

SEQ ID NO: 1470601 - protein, 17 aa, Mycobacterium tuberculosis
GPAELLSAVGALAEATR

SEQ ID NO: 1470602 - protein, 20 aa, Mycobacterium tuberculosis
GPCPPRQDMAYSIEADIYLA

SEQ ID NO: 1470603 - protein, 21 aa, Mycobacterium tuberculosis
GPERLWDFLTEKKCAITAYPD

SEQ ID NO: 1470604 - protein, 24 aa, Mycobacterium tuberculosis
GPGPMLAAASAWTGLAGDLGSAAA

SEQ ID NO: 1470605 - protein, 24 aa, Mycobacterium tuberculosis
GPIHIGLPLSLTIPGFTIPGGTLI

SEQ ID NO: 1470606 - protein, 17 aa, Mycobacterium tuberculosis
GPLRPWPDDVRRAIREG

SEQ ID NO: 1470607 - protein, 22 aa, Mycobacterium tuberculosis
GPPRELQPIWSKAIQTAPVQDA

SEQ ID NO: 1470608 - protein, 18 aa, Mycobacterium tuberculosis
GPWLRTGDLGVISDGELF

SEQ ID NO: 1470609 - protein, 23 aa, Mycobacterium tuberculosis
GQDAALFPGSWSEWSSDPTRPVG

SEQ ID NO: 1470610 - protein, 24 aa, Mycobacterium tuberculosis
GQDKLRLLLEFANELPALPSHLAE

SEQ ID NO: 1470611 - protein, 18 aa, Mycobacterium tuberculosis
GQGGLGLAGINGGSGGQG

SEQ ID NO: 1470612 - protein, 19 aa, Mycobacterium tuberculosis
GQGLVAFVGVTHGDDLDKA

SEQ ID NO: 1470613 - protein, 18 aa, Mycobacterium tuberculosis
GQLCLPLYGALVTNCGLD

SEQ ID NO: 1470614 - protein, 18 aa, Mycobacterium tuberculosis
GQPVKGRLTVPPSAPTTK

SEQ ID NO: 1470615 - protein, 20 aa, Mycobacterium tuberculosis
GRLLVAAAISFIEDVARTWH

SEQ ID NO: 1470616 - protein, 19 aa, Mycobacterium tuberculosis
GRPPRAIPDPTPRSSHGPA

SEQ ID NO: 1470617 - protein, 18 aa, Mycobacterium tuberculosis
GRRVHRLAVSHAFHSALM

SEQ ID NO: 1470618 - protein, 18 aa, Mycobacterium tuberculosis
GRSRLEVVDPSAAAQLAD

SEQ ID NO: 1470619 - protein, 18 aa, Mycobacterium tuberculosis
GRTPWRDLFGPAVTLADG

SEQ ID NO: 1470620 - protein, 17 aa, Mycobacterium tuberculosis
GRVWPLLQRNKSALADI

SEQ ID NO: 1470621 - protein, 21 aa, Mycobacterium tuberculosis
GSDAWDRLFAGPRPTELHPFV

SEQ ID NO: 1470622 - protein, 25 aa, Mycobacterium tuberculosis
GSDAWDRLFAGPRPTELHPFVELTG

SEQ ID NO: 1470623 - protein, 23 aa, Mycobacterium tuberculosis
GSEADAAVHFVQRHCETGNSVVT

SEQ ID NO: 1470624 - protein, 32 aa, Mycobacterium tuberculosis
GSGGIRGPIGLGFRVPCFVISPYSRGGLMVHD

SEQ ID NO: 1470625 - protein, 19 aa, Mycobacterium tuberculosis
GSQIATLILPADVCWSDGA

SEQ ID NO: 1470626 - protein, 21 aa, Mycobacterium tuberculosis
GSSEIMRLLIAREAVDAHLTA

SEQ ID NO: 1470627 - protein, 20 aa, Mycobacterium tuberculosis
GSVMKRAVERYDVNVVGLTL

SEQ ID NO: 1470628 - protein, 18 aa, Mycobacterium tuberculosis
GSWFPRYARNLGTPEPIL

SEQ ID NO: 1470629 - protein, 33 aa, Mycobacterium tuberculosis
GTAEALRGPLWRWYPGLRAGGKLMHNPHWPANI

SEQ ID NO: 1470630 - protein, 19 aa, Mycobacterium tuberculosis
GTALHPRFGPDSSARHRRS

SEQ ID NO: 1470631 - protein, 19 aa, Mycobacterium tuberculosis
GTAVQFHFIARLVLVLLDE

SEQ ID NO: 1470632 - protein, 17 aa, Mycobacterium tuberculosis
GTIPYQRFRGAEIAGLT

SEQ ID NO: 1470633 - protein, 29 aa, Mycobacterium tuberculosis
GTPEIPAIPPFFPGFPPDYVTVSGQIGPI

SEQ ID NO: 1470634 - protein, 19 aa, Mycobacterium tuberculosis
GVFTDRHALALGPSKALLD

SEQ ID NO: 1470635 - protein, 17 aa, Mycobacterium tuberculosis
GVLPTPAVAYLTGAYDA

SEQ ID NO: 1470636 - protein, 19 aa, Mycobacterium tuberculosis
GVTPVEHGLVLPSGPLIHG

SEQ ID NO: 1470637 - protein, 17 aa, Mycobacterium tuberculosis
GVTYSWETVRRLVQMRT

SEQ ID NO: 1470638 - protein, 20 aa, Mycobacterium tuberculosis
GWAEIALRLATQRHDFYLLD

SEQ ID NO: 1470639 - protein, 19 aa, Mycobacterium tuberculosis
GWAGIKVGVDYEGDHHRTD

SEQ ID NO: 1470640 - protein, 20 aa, Mycobacterium tuberculosis
HAAGRLDEFAHWAKSLTQRT

SEQ ID NO: 1470641 - protein, 17 aa, Mycobacterium tuberculosis
HAAVAPHLGVNAADAVT

SEQ ID NO: 1470642 - protein, 24 aa, Mycobacterium tuberculosis
HCFAGKDRTGFVVALVLEAVGLDR

SEQ ID NO: 1470643 - protein, 23 aa, Mycobacterium tuberculosis
HDEGWLAEHMLILKLISPENKAY

SEQ ID NO: 1470644 - protein, 21 aa, Mycobacterium tuberculosis
HDSGRVLVMIGVRSREPIVEL

SEQ ID NO: 1470645 - protein, 20 aa, Mycobacterium tuberculosis
HEWIRRSGDDTVRVGITDYA

SEQ ID NO: 1470646 - protein, 20 aa, Mycobacterium tuberculosis
HFDTLLVMSVEPGFGGQRFI

SEQ ID NO: 1470647 - protein, 21 aa, Mycobacterium tuberculosis
HGFHLDIWALNYAGPRHEVSG

SEQ ID NO: 1470648 - protein, 17 aa, Mycobacterium tuberculosis
HGLPGLRAIFAELLGIA

SEQ ID NO: 1470649 - protein, 22 aa, Mycobacterium tuberculosis
HGPAPRPTIPMRGGLDSGTLLE

SEQ ID NO: 1470650 - protein, 19 aa, Mycobacterium tuberculosis
HGRTARWIEIAAEWGTRDY

SEQ ID NO: 1470651 - protein, 17 aa, Mycobacterium tuberculosis
HGVDAKLAVKVNDLMLP

SEQ ID NO: 1470652 - protein, 27 aa, Mycobacterium tuberculosis
HIAEELPLLGSCTFKAAGHVIEIRGTS

SEQ ID NO: 1470653 - protein, 21 aa, Mycobacterium tuberculosis
HKTVHHYLMRFLGGELSDEDL

SEQ ID NO: 1470654 - protein, 17 aa, Mycobacterium tuberculosis
HLIGHFVDQARRSGASW

SEQ ID NO: 1470655 - protein, 29 aa, Mycobacterium tuberculosis
HNKTLRADACFVIGFGILRHIRCAGIDEE

SEQ ID NO: 1470656 - protein, 25 aa, Mycobacterium tuberculosis
HRDWLLIELRTDWTVATTRYTAGSL

SEQ ID NO: 1470657 - protein, 18 aa, Mycobacterium tuberculosis
HREQWPVAGRMMGRLGWY

SEQ ID NO: 1470658 - protein, 19 aa, Mycobacterium tuberculosis
HRVGFGSVCEFPGPYPGYS

SEQ ID NO: 1470659 - protein, 33 aa, Mycobacterium tuberculosis; identical to SEQ ID NO: 200891

SEQ ID NO: 1470660 - protein, 23 aa, Mycobacterium tuberculosis
IAENRAELMILIATNLLGQNTPA

SEQ ID NO: 1470661 - protein, 17 aa, Mycobacterium tuberculosis
IAEVKRASPSAGALATI

SEQ ID NO: 1470662 - protein, 17 aa, Mycobacterium tuberculosis
IAGPGVYICDECIDLCN

SEQ ID NO: 1470663 - protein, 17 aa, Mycobacterium tuberculosis
IAGVVLLAGAAFVELAL

SEQ ID NO: 1470664 - protein, 17 aa, Mycobacterium tuberculosis
IARRLMILASEDIGMAD

SEQ ID NO: 1470665 - protein, 25 aa, Mycobacterium tuberculosis
ICPICRKEQLTLVSWVFGEHLGAVS

SEQ ID NO: 1470666 - protein, 19 aa, Mycobacterium tuberculosis
IDAVLEFRVSEEVLLERLK

SEQ ID NO: 1470667 - protein, 20 aa, Mycobacterium tuberculosis
IDHLRHLGRIPATIRYTTQG

SEQ ID NO: 1470668 - protein, 17 aa, Mycobacterium tuberculosis
IDPLSLRGSATGVYTGI

SEQ ID NO: 1470669 - protein, 18 aa, Mycobacterium tuberculosis
IDTTNLTGVMTFGLPLAM

SEQ ID NO: 1470670 - protein, 17 aa, Mycobacterium tuberculosis
IEAFELVVVNLYPFSQT

SEQ ID NO: 1470671 - protein, 19 aa, Mycobacterium tuberculosis
IEVIEFCLGIPHLLKGEYT

SEQ ID NO: 1470672 - protein, 17 aa, Mycobacterium tuberculosis
IFAGAGLGPMLAAASAW

SEQ ID NO: 1470673 - protein, 39 aa, Mycobacterium tuberculosis; identical to SEQ ID NO: 678825

SEQ ID NO: 1470674 - protein, 24 aa, Mycobacterium tuberculosis
IFVTGVMSSGFFNFGTGNSGLLVS

SEQ ID NO: 1470675 - protein, 22 aa, Mycobacterium tuberculosis
IGAPANVSGMFNIGSNLAGFFH

SEQ ID NO: 1470676 - protein, 19 aa, Mycobacterium tuberculosis
IGLLGKFMPNYLFAPDSTL

SEQ ID NO: 1470677 - protein, 26 aa, Mycobacterium tuberculosis
IGREIGCKLVSFGSGAHFCLGAHLAR

SEQ ID NO: 1470678 - protein, 18 aa, Mycobacterium tuberculosis
IGVPDWIVGGLNNVLKPL

SEQ ID NO: 1470679 - protein, 22 aa, Mycobacterium tuberculosis
IHELARGDAYWDTVVEITSIGD

SEQ ID NO: 1470680 - protein, 18 aa, Mycobacterium tuberculosis
IHGGYGYSTEYDVERYFR

SEQ ID NO: 1470681 - protein, 20 aa, Mycobacterium tuberculosis
IKELFSMSATRYYQVLNALV

SEQ ID NO: 1470682 - protein, 23 aa, Mycobacterium tuberculosis
ILSELQPSLVIEFGTRYGGSAVY

SEQ ID NO: 1470683 - protein, 18 aa, Mycobacterium tuberculosis
IPEVLSKVRAVRKMVDAG

SEQ ID NO: 1470684 - protein, 22 aa, Mycobacterium tuberculosis
IPPELRPMVQLDGGRFATSDLN

SEQ ID NO: 1470685 - protein, 20 aa, Mycobacterium tuberculosis
IPVRRSWRLNERHYGALQGL

SEQ ID NO: 1470686 - protein, 18 aa, Mycobacterium tuberculosis
IPVTFSYSTPALTLFPVG

SEQ ID NO: 1470687 - protein, 17 aa, Mycobacterium tuberculosis
IRHLTRLGVDIHFNTRV

SEQ ID NO: 1470688 - protein, 21 aa, Mycobacterium tuberculosis
IRHRWNWTDVRRWLTDPTGRW

SEQ ID NO: 1470689 - protein, 17 aa, Mycobacterium tuberculosis
IRSTGRWRGRPKNQDAY

SEQ ID NO: 1470690 - protein, 20 aa, Mycobacterium tuberculosis
ISDDFFALFLDPTWVYTCAY

SEQ ID NO: 1470691 - protein, 32 aa, Mycobacterium tuberculosis
ITIPQLPLGLALSGATPAFAFPLEITIDRIPV

SEQ ID NO: 1470692 - protein, 25 aa, Mycobacterium tuberculosis
IVIGCGPIGLAVICMLKSRGVHTVI

SEQ ID NO: 1470693 - protein, 27 aa, Mycobacterium tuberculosis
IVIGCGPIGLAVICMLKSRGVHTVIAS

SEQ ID NO: 1470694 - protein, 18 aa, Mycobacterium tuberculosis
IVLQTGARLSRRGRRLGL

SEQ ID NO: 1470695 - protein, 21 aa, Mycobacterium tuberculosis
IYVRKRLRCGNRHPLQRVKRR

SEQ ID NO: 1470696 - protein, 18 aa, Mycobacterium tuberculosis
KASSVMLESFLFYSGFYL

SEQ ID NO: 1470697 - protein, 18 aa, Mycobacterium tuberculosis
KDHIEAIANWDPKAEPSI

SEQ ID NO: 1470698 - protein, 17 aa, Mycobacterium tuberculosis
KDMPTKPAPVLIFVPGG

SEQ ID NO: 1470699 - protein, 26 aa, Mycobacterium tuberculosis
KDVLQGQCTFSWPPRMELPGYKPNTK

SEQ ID NO: 1470700 - protein, 17 aa, Mycobacterium tuberculosis
KDWQVWSGAKVADLVQL

SEQ ID NO: 1470701 - protein, 25 aa, Mycobacterium tuberculosis
KFQHAKCMSMRLAHRLQILLDDECH

SEQ ID NO: 1470702 - protein, 18 aa, Mycobacterium tuberculosis
KFQLVEPVAGMSRAAGIV

SEQ ID NO: 1470703 - protein, 20 aa, Mycobacterium tuberculosis
KGASEGWCPYCGSPYSFLPQ

SEQ ID NO: 1470704 - protein, 26 aa, Mycobacterium tuberculosis
KGGSGGNGGNAWLTGQGGNGGNAAFG

SEQ ID NO: 1470705 - protein, 29 aa, Mycobacterium tuberculosis
KGGTGGAGMNSLDPLLAAQDGGQGGTGGT

SEQ ID NO: 1470706 - protein, 18 aa, Mycobacterium tuberculosis
KGVDAVVVPGGFSYGDYL

SEQ ID NO: 1470707 - protein, 19 aa, Mycobacterium tuberculosis
KLFGPRNQAPLSFPIPGWN

SEQ ID NO: 1470708 - protein, 20 aa, Mycobacterium tuberculosis
KLLIRKAGAASADMAAELAK

SEQ ID NO: 1470709 - protein, 18 aa, Mycobacterium tuberculosis
KLTCRGRDLPTAVSRARR

SEQ ID NO: 1470710 - protein, 19 aa, Mycobacterium tuberculosis
KRAESSALFAMLSGQHAVD

SEQ ID NO: 1470711 - protein, 21 aa, Mycobacterium tuberculosis
KRFGVPVPNLTPWRASVTGDM

SEQ ID NO: 1470712 - protein, 24 aa, Mycobacterium tuberculosis
KRFVKGISAEAVFQKRAPANRPDW

SEQ ID NO: 1470713 - protein, 20 aa, Mycobacterium tuberculosis
KRKVLELAAALSDDFERAGR

SEQ ID NO: 1470714 - protein, 21 aa, Mycobacterium tuberculosis
KRLGRRVTEIALVFRRAPHLP

SEQ ID NO: 1470715 - protein, 20 aa, Mycobacterium tuberculosis
KRPEFGKLTPLYPNQRLRLE

SEQ ID NO: 1470716 - protein, 20 aa, Mycobacterium tuberculosis
KSDVLAGLFAVWHSLDALLD

SEQ ID NO: 1470717 - protein, 23 aa, Mycobacterium tuberculosis
KVISRLLAGPALAFAQAKNAINA

SEQ ID NO: 1470718 - protein, 18 aa, Mycobacterium tuberculosis
KVLASRMVRDYVEHYYAP

SEQ ID NO: 1470719 - protein, 24 aa, Mycobacterium tuberculosis
KVQEVKLGLARPVWIDDRDFDITY

SEQ ID NO: 1470720 - protein, 20 aa, Mycobacterium tuberculosis
KVRLGDHLDFSNGHTSGHTS

SEQ ID NO: 1470721 - protein, 17 aa, Mycobacterium tuberculosis
LAELGWLGLHIDERHGG

SEQ ID NO: 1470722 - protein, 23 aa, Mycobacterium tuberculosis
LAGEPRPRIALAAPTGKAAARLA

SEQ ID NO: 1470723 - protein, 17 aa, Mycobacterium tuberculosis
LALTGKRKPYIYTSTIA

SEQ ID NO: 1470724 - protein, 19 aa, Mycobacterium tuberculosis
LAPLHGWGLDPYLTPGFTE

SEQ ID NO: 1470725 - protein, 19 aa, Mycobacterium tuberculosis
LARHHLHRFLPGASTRRSP

SEQ ID NO: 1470726 - protein, 20 aa, Mycobacterium tuberculosis
LATASRLVARLGPEAVRIIA

SEQ ID NO: 1470727 - protein, 20 aa, Mycobacterium tuberculosis
LAYMDLRPGTAMRDIAVDAV

SEQ ID NO: 1470728 - protein, 21 aa, Mycobacterium tuberculosis
LCGIAAEWTRGAVKTVPPRWL

SEQ ID NO: 1470729 - protein, 20 aa, Mycobacterium tuberculosis
LDAFSFPNISIVLPNIGINL

SEQ ID NO: 1470730 - protein, 18 aa, Mycobacterium tuberculosis
LDALILMNFIQTNSAVYR

SEQ ID NO: 1470731 - protein, 23 aa, Mycobacterium tuberculosis
LDDRFRLLTGGARSTVQRQQTLR

SEQ ID NO: 1470732 - protein, 19 aa, Mycobacterium tuberculosis
LDGLMAFPEYSPAASAATF

SEQ ID NO: 1470733 - protein, 24 aa, Mycobacterium tuberculosis
LDKAKAMGAIALFGESYPDEVRVV

SEQ ID NO: 1470734 - protein, 17 aa, Mycobacterium tuberculosis
LDLKDLRAVITHLTSDE

SEQ ID NO: 1470735 - protein, 21 aa, Mycobacterium tuberculosis
LDMFYNLGIAGRAMRRIGAVE

SEQ ID NO: 1470736 - protein, 27 aa, Mycobacterium tuberculosis
LDSRLRVLARREFAGMISVAIDSADGA

SEQ ID NO: 1470737 - protein, 17 aa, Mycobacterium tuberculosis
LDTAAVCIDTWVPADAL

SEQ ID NO: 1470738 - protein, 24 aa, Mycobacterium tuberculosis
LDVDRDCFARIAPGLPSSVIRIAE

SEQ ID NO: 1470739 - protein, 19 aa, Mycobacterium tuberculosis
LDVRWRLDEPDGHAAYLQG

SEQ ID NO: 1470740 - protein, 21 aa, Mycobacterium tuberculosis
LEFRVLRDRLFDTLAAAGGPE

SEQ ID NO: 1470741 - protein, 21 aa, Mycobacterium tuberculosis
LEGIGSALAAANRAAEAPTTG

SEQ ID NO: 1470742 - protein, 17 aa, Mycobacterium tuberculosis
LEISPSMTMQGERLDAV

SEQ ID NO: 1470743 - protein, 22 aa, Mycobacterium tuberculosis
LERQLKTLPLVERFYQADRSVA

SEQ ID NO: 1470744 - protein, 25 aa, Mycobacterium tuberculosis
LFDEMLIELDIHFRIEDDLYYPALS

SEQ ID NO: 1470745 - protein, 17 aa, Mycobacterium tuberculosis
LFFEWLTDHGFRAFAGH

SEQ ID NO: 1470746 - protein, 18 aa, Mycobacterium tuberculosis
LGADLLAVVARLNRLATQ

SEQ ID NO: 1470747 - protein, 17 aa, Mycobacterium tuberculosis
LGALIANGAAMTRVPAR

SEQ ID NO: 1470748 - protein, 23 aa, Mycobacterium tuberculosis
LGGAGGGGGWLYGDGGAGGHGGQ

SEQ ID NO: 1470749 - protein, 23 aa, Mycobacterium tuberculosis
LGPCPQHRYSFINVRRVASGSNT

SEQ ID NO: 1470750 - protein, 24 aa, Mycobacterium tuberculosis
LGQRALRLPFSRLLATLPISATPD

SEQ ID NO: 1470751 - protein, 27 aa, Mycobacterium tuberculosis
LGSKMNRFFLRGALVARLLSQSAWKQY

SEQ ID NO: 1470752 - protein, 25 aa, Mycobacterium tuberculosis
LGSPGGSMIIQFVVKTLVAMLDWGL

SEQ ID NO: 1470753 - protein, 18 aa, Mycobacterium tuberculosis
LHLDILVDRMRREFKVEA

SEQ ID NO: 1470754 - protein, 19 aa, Mycobacterium tuberculosis
LHPPGIDFGPALLADVQVA

SEQ ID NO: 1470755 - protein, 24 aa, Mycobacterium tuberculosis
LIAQLRPPPTFAEVSFATYRPDPV

SEQ ID NO: 1470756 - protein, 18 aa, Mycobacterium tuberculosis
LKALGWTSEQIVERFGFS

SEQ ID NO: 1470757 - protein, 20 aa, Mycobacterium tuberculosis
LKPAELAGVVSAVVYETRGG

SEQ ID NO: 1470758 - protein, 30 aa, Mycobacterium tuberculosis
LKRLLRSDILPISFGFPFGFSAAIPPNLPL

SEQ ID NO: 1470759 - protein, 19 aa, Mycobacterium tuberculosis
LLAAAARDAFGLDVHPAVR

SEQ ID NO: 1470760 - protein, 18 aa, Mycobacterium tuberculosis
LLAAELWERGRIVRSLGD

SEQ ID NO: 1470761 - protein, 21 aa, Mycobacterium tuberculosis
LLDVKRWVTLTGVGGVGKTRL

SEQ ID NO: 1470762 - protein, 28 aa, Mycobacterium tuberculosis
LLGALPFDVSRPAALMVPDGVLRARKLP

SEQ ID NO: 1470763 - protein, 29 aa, Mycobacterium tuberculosis
LLVAECLRTGAWEGLKPAELAGVVSAVVY

SEQ ID NO: 1470764 - protein, 17 aa, Mycobacterium tuberculosis
LNVGFASLGGFNFGGAT

SEQ ID NO: 1470765 - protein, 30 aa, Mycobacterium tuberculosis
LPAARRAAHRAGHLGAMYPWQSGSDGSEVS

SEQ ID NO: 1470766 - protein, 20 aa, Mycobacterium tuberculosis
LPASQVVRFIVPRYVQDDPS

SEQ ID NO: 1470767 - protein, 24 aa, Mycobacterium tuberculosis
LPDNTPWGGKPVRKLQLPRDAALV

SEQ ID NO: 1470768 - protein, 17 aa, Mycobacterium tuberculosis
LPDVVSRYGGWGDRQIL

SEQ ID NO: 1470769 - protein, 19 aa, Mycobacterium tuberculosis
LPRTMTFKVIKRQLSAEGV

SEQ ID NO: 1470770 - protein, 18 aa, Mycobacterium tuberculosis
LPTPWFTSSDTIVTSMPP

SEQ ID NO: 1470771 - protein, 21 aa, Mycobacterium tuberculosis
LPVPARRVGRVILVDEPAGQP

SEQ ID NO: 1470772 - protein, 17 aa, Mycobacterium tuberculosis
LQCGRSVHTRRAYLGDL

SEQ ID NO: 1470773 - protein, 17 aa, Mycobacterium tuberculosis
LQDPKGQRWVMQTWSQV

SEQ ID NO: 1470774 - protein, 18 aa, Mycobacterium tuberculosis
LQGSLLVRHGHPAVAEAF

SEQ ID NO: 1470775 - protein, 17 aa, Mycobacterium tuberculosis
LQLPAQRTHRIRAANFA

SEQ ID NO: 1470776 - protein, 17 aa, Mycobacterium tuberculosis
LQPFDGYTDPVASEKKL

SEQ ID NO: 1470777 - protein, 21 aa, Mycobacterium tuberculosis
LRAAAQHWATWAMQKQELARN

SEQ ID NO: 1470778 - protein, 17 aa, Mycobacterium tuberculosis
LRAEARAHFGFPDDARV

SEQ ID NO: 1470779 - protein, 26 aa, Mycobacterium tuberculosis
LRDEGITAMHFVPSLLGLFLSLPGVS

SEQ ID NO: 1470780 - protein, 17 aa, Mycobacterium tuberculosis
LRDGHYSGAAALGNAQG

SEQ ID NO: 1470781 - protein, 19 aa, Mycobacterium tuberculosis
LRDRFRCVAPDYLGFGLSE

SEQ ID NO: 1470782 - protein, 17 aa, Mycobacterium tuberculosis
LREFSAKAGRQVFKDYV

SEQ ID NO: 1470783 - protein, 20 aa, Mycobacterium tuberculosis
LREREVMGVLAAGMTADHVL

SEQ ID NO: 1470784 - protein, 20 aa, Mycobacterium tuberculosis
LRPDIAWDKGKALDWIGERL

SEQ ID NO: 1470785 - protein, 19 aa, Mycobacterium tuberculosis
LRRGGFDAAEPAAWIAEGL

SEQ ID NO: 1470786 - protein, 27 aa, Mycobacterium tuberculosis
LRRRWSPDGKPIVGFVGRLAPEKHVDR

SEQ ID NO: 1470787 - protein, 23 aa, Mycobacterium tuberculosis
LRSLERLECLARRLPAAQHTLIN

SEQ ID NO: 1470788 - protein, 21 aa, Mycobacterium tuberculosis
LRSLPGCHLLVRPEVMRRDVD

SEQ ID NO: 1470789 - protein, 17 aa, Mycobacterium tuberculosis
LRYADALIWTPAHLAVD

SEQ ID NO: 1470790 - protein, 23 aa, Mycobacterium tuberculosis
LSADRGFARFRRLRWRHPLDGQT

SEQ ID NO: 1470791 - protein, 17 aa, Mycobacterium tuberculosis
LSLDALILMNFIQTNSA

SEQ ID NO: 1470792 - protein, 17 aa, Mycobacterium tuberculosis
LSVAKGMMLRRDPDREA

SEQ ID NO: 1470793 - protein, 20 aa, Mycobacterium tuberculosis
LTAFAQRSRFAEAFHATGQN

SEQ ID NO: 1470794 - protein, 26 aa, Mycobacterium tuberculosis
LTDMIRFGSLYLRDGVSLAGQQVVPA

SEQ ID NO: 1470795 - protein, 19 aa, Mycobacterium tuberculosis
LTEARIGVAPAIISLTLLP

SEQ ID NO: 1470796 - protein, 23 aa, Mycobacterium tuberculosis
LTFLDREGWDSLTINALATQLGT

SEQ ID NO: 1470797 - protein, 19 aa, Mycobacterium tuberculosis
LTGCMALGITGPILRSTGL

SEQ ID NO: 1470798 - protein, 26 aa, Mycobacterium tuberculosis
LTTLFPPVRPRQWLEIRYLDSVPDEV

SEQ ID NO: 1470799 - protein, 23 aa, Mycobacterium tuberculosis
LTWLLSRWACVFGTPACQGTVAG

SEQ ID NO: 1470800 - protein, 17 aa, Mycobacterium tuberculosis
LTWSRLKVNVAVTQEQA

SEQ ID NO: 1470801 - protein, 24 aa, Mycobacterium tuberculosis
LVAVKRGREAAAWLPNNPETGCKS

SEQ ID NO: 1470802 - protein, 28 aa, Mycobacterium tuberculosis
LVDLILFDWPTHMLQLATWLAENPQLLV

SEQ ID NO: 1470803 - protein, 19 aa, Mycobacterium tuberculosis
LVGARLNWLLGNGESPQWS

SEQ ID NO: 1470804 - protein, 20 aa, Mycobacterium tuberculosis
LVGTCGVGKASVRVFDDYAH

SEQ ID NO: 1470805 - protein, 18 aa, Mycobacterium tuberculosis
LVGWRRHIHRYPELGRQE

SEQ ID NO: 1470806 - protein, 19 aa, Mycobacterium tuberculosis
LVLRTPVRELAGYRSDDPT

SEQ ID NO: 1470807 - protein, 17 aa, Mycobacterium tuberculosis
LVRGRFVLVGVTPAVLA

SEQ ID NO: 1470808 - protein, 20 aa, Mycobacterium tuberculosis
LWKKVAPKLSAGRVQSVATR

SEQ ID NO: 1470809 - protein, 27 aa, Mycobacterium tuberculosis
LWKQWDRCALHWFPGSHLLHVSQLDYL

SEQ ID NO: 1470810 - protein, 19 aa, Mycobacterium tuberculosis
LWQECSQVGMPRAVVITKL

SEQ ID NO: 1470811 - protein, 25 aa, Mycobacterium tuberculosis
LYFRTKRWPDVLAQFPEATQWRHPE

SEQ ID NO: 1470812 - protein, 20 aa, Mycobacterium tuberculosis
LYRNEERNFWAVSRHHDVLQ

SEQ ID NO: 1470813 - protein, 17 aa, Mycobacterium tuberculosis
LYTPCRGQEAAQVGAAA

SEQ ID NO: 1470814 - protein, 17 aa, Mycobacterium tuberculosis
MAALGMLEARHIAGDQQ

SEQ ID NO: 1470815 - protein, 20 aa, Mycobacterium tuberculosis
MGLTIPVLLIRGKLSDVVSS

SEQ ID NO: 1470816 - protein, 24 aa, Mycobacterium tuberculosis
MGPLMRRSGMIFIRRNIGNDPLYK

SEQ ID NO: 1470817 - protein, 23 aa, Mycobacterium tuberculosis
MHGTDAWEPYAAVADSEITRVVL

SEQ ID NO: 1470818 - protein, 24 aa, Mycobacterium tuberculosis
MKEGDDVFVALSWTKHPPPQTYDE

SEQ ID NO: 1470819 - protein, 26 aa, Mycobacterium tuberculosis
MPGAGGNGGNANWFGSGGAGGQGGTG

SEQ ID NO: 1470820 - protein, 17 aa, Mycobacterium tuberculosis
MPGRPRPGYLPRVIDGA

SEQ ID NO: 1470821 - protein, 18 aa, Mycobacterium tuberculosis
MRRGELVMVFPGGAREVN

SEQ ID NO: 1470822 - protein, 21 aa, Mycobacterium tuberculosis
MSDLRFLKFLRESIFPGGELP

SEQ ID NO: 1470823 - protein, 17 aa, Mycobacterium tuberculosis
MTCFLTPNGRPFFCGTY

SEQ ID NO: 1470824 - protein, 21 aa, Mycobacterium tuberculosis
MTWSQLYSRVTAVSAYLISYG

SEQ ID NO: 1470825 - protein, 19 aa, Mycobacterium tuberculosis
MVAAASAWNGLAAELSVAA

SEQ ID NO: 1470826 - protein, 23 aa, Mycobacterium tuberculosis
MVSGLDRKNCWTIAEHRGDTTPM

SEQ ID NO: 1470827 - protein, 17 aa, Mycobacterium tuberculosis
MWLDAVGISEDLHRYLD

SEQ ID NO: 1470828 - protein, 21 aa, Mycobacterium tuberculosis
MWRRESELFADVAVPDDVDVT

SEQ ID NO: 1470829 - protein, 19 aa, Mycobacterium tuberculosis
NAGSNNWGLANLGVGNIGL

SEQ ID NO: 1470830 - protein, 19 aa, Mycobacterium tuberculosis
NAKARLLRDNIVVAENLSI

SEQ ID NO: 1470831 - protein, 23 aa, Mycobacterium tuberculosis
NALPRRGISALVRRPKRRPLDEG

SEQ ID NO: 1470832 - protein, 23 aa, Mycobacterium tuberculosis
NFGAMLRAECARLNRAGLTTCSE

SEQ ID NO: 1470833 - protein, 21 aa, Mycobacterium tuberculosis
NFRDVVAALGMYPGQAPPLGA

SEQ ID NO: 1470834 - protein, 29 aa, Mycobacterium tuberculosis
NGGAGGTAGWFFGFGGNGGAGGIGVAGIN

SEQ ID NO: 1470835 - protein, 22 aa, Mycobacterium tuberculosis
NGGDALGLVGVGGNGGNAGTGF

SEQ ID NO: 1470836 - protein, 19 aa, Mycobacterium tuberculosis
NGLATAYLFRCLSCGVHLA

SEQ ID NO: 1470837 - protein, 19 aa, Mycobacterium tuberculosis
NGQIGFGSFNSGSGNIGLF

SEQ ID NO: 1470838 - protein, 21 aa, Mycobacterium tuberculosis
NGQPVKGRLTVPPSVPVKSAD

SEQ ID NO: 1470839 - protein, 19 aa, Mycobacterium tuberculosis
NHPRAAGGELYRVHRRDLQ

SEQ ID NO: 1470840 - protein, 21 aa, Mycobacterium tuberculosis
NHYPIGWAMAFNTPYKLFKRY

SEQ ID NO: 1470841 - protein, 20 aa, Mycobacterium tuberculosis
NLHLAQCNWLVPSDQLGGLC

SEQ ID NO: 1470842 - protein, 18 aa, Mycobacterium tuberculosis
NLLGSVALVGGARLWTRD

SEQ ID NO: 1470843 - protein, 26 aa, Mycobacterium tuberculosis
NLTGVMTFGLPLAMTLNAVGSPITTA

SEQ ID NO: 1470844 - protein, 18 aa, Mycobacterium tuberculosis
NPVTGWRLVEWDGIRNFT

SEQ ID NO: 1470845 - protein, 17 aa, Mycobacterium tuberculosis
NRLHAQKALLVWLLERS

SEQ ID NO: 1470846 - protein, 20 aa, Mycobacterium tuberculosis
NSFGAFVPKGITLRVYGDAN

SEQ ID NO: 1470847 - protein, 31 aa, Mycobacterium tuberculosis; identical to SEQ ID NO: 203674

SEQ ID NO: 1470848 - protein, 19 aa, Mycobacterium tuberculosis
NSLGGWVAFELERRGRARS

SEQ ID NO: 1470849 - protein, 18 aa, Mycobacterium tuberculosis
NTGTLPFAVTSLVSGLAN

SEQ ID NO: 1470850 - protein, 19 aa, Mycobacterium tuberculosis
NTIGLRLATLGPLENADYI

SEQ ID NO: 1470851 - protein, 23 aa, Mycobacterium tuberculosis
NTIIDKWLPLSWSLNMVNRSMGH

SEQ ID NO: 1470852 - protein, 18 aa, Mycobacterium tuberculosis
NTTGSVVFTSCSGTVALV

SEQ ID NO: 1470853 - protein, 24 aa, Mycobacterium tuberculosis
NTVDWEFAASVGERLARPAPPSTE

SEQ ID NO: 1470854 - protein, 29 aa, Mycobacterium tuberculosis
NVGSGGSGFWNIAGNLGNSGFLNVGPLTS

SEQ ID NO: 1470855 - protein, 18 aa, Mycobacterium tuberculosis
NVLGWRIDHELKHLDEAE

SEQ ID NO: 1470856 - protein, 26 aa, Mycobacterium tuberculosis
NYDDFFKRCFNIMPADGRMTVQSSVS

SEQ ID NO: 1470857 - protein, 17 aa, Mycobacterium tuberculosis
PAARDFVAGVAQSCEEL

SEQ ID NO: 1470858 - protein, 17 aa, Mycobacterium tuberculosis
PADAGMVGPMFDVGFPF

SEQ ID NO: 1470859 - protein, 40 aa, Mycobacterium tuberculosis; identical to SEQ ID NO: 203776

SEQ ID NO: 1470860 - protein, 26 aa, Mycobacterium tuberculosis
PALELMRRVGLRPTKLTNAWVPFVVA

SEQ ID NO: 1470861 - protein, 21 aa, Mycobacterium tuberculosis
PAPCEPACVLGINQDPVTIKQ

SEQ ID NO: 1470862 - protein, 21 aa, Mycobacterium tuberculosis
PAPFLQQYLANQFGYGQLTLT

SEQ ID NO: 1470863 - protein, 23 aa, Mycobacterium tuberculosis
PATRAVVIYLEYLGTTIGDLLGA

SEQ ID NO: 1470864 - protein, 21 aa, Mycobacterium tuberculosis
PDGEPGLLLSRVNRLQPFDGY

SEQ ID NO: 1470865 - protein, 23 aa, Mycobacterium tuberculosis
PDPDIAQLVKWGYAATQLLEGLV

SEQ ID NO: 1470866 - protein, 22 aa, Mycobacterium tuberculosis
PDTAELLRWLDAQTKRNLVITF

SEQ ID NO: 1470867 - protein, 25 aa, Mycobacterium tuberculosis
PEDYELMGVPFAKRGKRIDECIEIV

SEQ ID NO: 1470868 - protein, 21 aa, Mycobacterium tuberculosis
PEGADPFVLLFSESAGRVLVA

SEQ ID NO: 1470869 - protein, 25 aa, Mycobacterium tuberculosis
PEINSGRMFFGAGSGPMLAAAAAWD

SEQ ID NO: 1470870 - protein, 19 aa, Mycobacterium tuberculosis
PEIWARLVRALGVVDEADL

SEQ ID NO: 1470871 - protein, 22 aa, Mycobacterium tuberculosis
PESLRLSRTGVFVGVSSTDYVR

SEQ ID NO: 1470872 - protein, 21 aa, Mycobacterium tuberculosis
PEVIARIAAGVAEGNAKLSRV

SEQ ID NO: 1470873 - protein, 21 aa, Mycobacterium tuberculosis
PFMEFTPGYVLRSLDELPKQG

SEQ ID NO: 1470874 - protein, 18 aa, Mycobacterium tuberculosis
PFTPRAKKVLELSLREAL

SEQ ID NO: 1470875 - protein, 18 aa, Mycobacterium tuberculosis
PGAAQGWHLHHLLTAGQI

SEQ ID NO: 1470876 - protein, 20 aa, Mycobacterium tuberculosis
PGGSTAIRIPATASVGPFDV

SEQ ID NO: 1470877 - protein, 22 aa, Mycobacterium tuberculosis
PGKPSWNLEPWRPVVDDSEMLA

SEQ ID NO: 1470878 - protein, 22 aa, Mycobacterium tuberculosis
PGLELSTGIALAFPRGPFVPAA

SEQ ID NO: 1470879 - protein, 19 aa, Mycobacterium tuberculosis
PGPRAQFLTALAGVMRPGD

SEQ ID NO: 1470880 - protein, 24 aa, Mycobacterium tuberculosis
PGRLSSRFWRLLGASTEKNRSRSL

SEQ ID NO: 1470881 - protein, 17 aa, Mycobacterium tuberculosis
PGTLTSLGFSYDVLHAF

SEQ ID NO: 1470882 - protein, 18 aa, Mycobacterium tuberculosis
PHLVPVVFALGARRPAEA

SEQ ID NO: 1470883 - protein, 18 aa, Mycobacterium tuberculosis
PHPELLRGWDLATTADGL

SEQ ID NO: 1470884 - protein, 19 aa, Mycobacterium tuberculosis
PIARDLASKLIRVVTIAPG

SEQ ID NO: 1470885 - protein, 18 aa, Mycobacterium tuberculosis
PITIFPGGFTIDPLPLSL

SEQ ID NO: 1470886 - protein, 18 aa, Mycobacterium tuberculosis
PLADALGVLPVLATDVLR

SEQ ID NO: 1470887 - protein, 20 aa, Mycobacterium tuberculosis
PLDRVCMIDGLRIIVLDTSV

SEQ ID NO: 1470888 - protein, 24 aa, Mycobacterium tuberculosis
PLGKTLRGYSAWVTGLRRVDAPTR

SEQ ID NO: 1470889 - protein, 18 aa, Mycobacterium tuberculosis
PLRPAGHGLATPRRRPHR

SEQ ID NO: 1470890 - protein, 18 aa, Mycobacterium tuberculosis
PMMARNILESFKLLTNVS

SEQ ID NO: 1470891 - protein, 17 aa, Mycobacterium tuberculosis
PPATVVFARRGKQIARG

SEQ ID NO: 1470892 - protein, 27 aa, Mycobacterium tuberculosis
PPLTMKPDVCWQLPIRRSQEWVTRPDG

SEQ ID NO: 1470893 - protein, 18 aa, Mycobacterium tuberculosis
PPPPADIGRLLLRCHDRP

SEQ ID NO: 1470894 - protein, 18 aa, Mycobacterium tuberculosis
PPRMLVLLHLDESVQRPS

SEQ ID NO: 1470895 - protein, 24 aa, Mycobacterium tuberculosis
PPSPPRPPGAPAPPMPPLPPAPPA

SEQ ID NO: 1470896 - protein, 20 aa, Mycobacterium tuberculosis
PQGIDYVCGFYAAIKAGTVA

SEQ ID NO: 1470897 - protein, 23 aa, Mycobacterium tuberculosis
PQLFKQLLMVAGMERYYQIARCY

SEQ ID NO: 1470898 - protein, 17 aa, Mycobacterium tuberculosis
PQLRWSGFPSETRSFAV

SEQ ID NO: 1470899 - protein, 25 aa, Mycobacterium tuberculosis
PQNLSDAGISWKVYNSKLLGGLNDT

SEQ ID NO: 1470900 - protein, 17 aa, Mycobacterium tuberculosis
PRRRCARVRQHWATPTQ

SEQ ID NO: 1470901 - protein, 30 aa, Mycobacterium tuberculosis
PRSDLARYGIAPAYPWDFIRDVINNTLPQV

SEQ ID NO: 1470902 - protein, 23 aa, Mycobacterium tuberculosis
PRSGLPVIEVLDTELVRGRTAGP

SEQ ID NO: 1470903 - protein, 20 aa, Mycobacterium tuberculosis
PRVAWERELLPGAQVVIAPT

SEQ ID NO: 1470904 - protein, 17 aa, Mycobacterium tuberculosis
PSLDDVFLAMTTDPTES

SEQ ID NO: 1470905 - protein, 19 aa, Mycobacterium tuberculosis
PSLHPTVLVGMRNRLRASD

SEQ ID NO: 1470906 - protein, 24 aa, Mycobacterium tuberculosis
PSLQPETRLAAPLLAKGLPACPGV

SEQ ID NO: 1470907 - protein, 18 aa, Mycobacterium tuberculosis
PSMADAWLGRIACGDRDL

SEQ ID NO: 1470908 - protein, 20 aa, Mycobacterium tuberculosis
PTAAPRWVVDPDFNLDFHVR

SEQ ID NO: 1470909 - protein, 30 aa, Mycobacterium tuberculosis; identical to SEQ ID NO: 204432

SEQ ID NO: 1470910 - protein, 22 aa, Mycobacterium tuberculosis
PTELRTTGWFTGLVPITVPVAS

SEQ ID NO: 1470911 - protein, 17 aa, Mycobacterium tuberculosis
PTVLVGMRNRLRASDPT

SEQ ID NO: 1470912 - protein, 17 aa, Mycobacterium tuberculosis
PVHLITCLAEPDPSWWD

SEQ ID NO: 1470913 - protein, 25 aa, Mycobacterium tuberculosis
PVIGAPWLVAFAERSRFFEVFSSSN

SEQ ID NO: 1470914 - protein, 29 aa, Mycobacterium tuberculosis
PVIGTVMRQGYQLGEQVLRHALVGVVDTV

SEQ ID NO: 1470915 - protein, 24 aa, Mycobacterium tuberculosis
PVPRQRSALRWLRTVNRSPGLVSF

SEQ ID NO: 1470916 - protein, 19 aa, Mycobacterium tuberculosis
PVSMLIPRVVGFRLTGEIQ

SEQ ID NO: 1470917 - protein, 18 aa, Mycobacterium tuberculosis
PVTVCQWGEAAAKDLEGY

SEQ ID NO: 1470918 - protein, 19 aa, Mycobacterium tuberculosis
PVYNPWDQRLCAVPDADMF

SEQ ID NO: 1470919 - protein, 22 aa, Mycobacterium tuberculosis
QAAETFAILNLAGAGDHIVSSP

SEQ ID NO: 1470920 - protein, 21 aa, Mycobacterium tuberculosis
QAATFHAQFVQTLSAGAGAYA

SEQ ID NO: 1470921 - protein, 19 aa, Mycobacterium tuberculosis
QAGQPNSGTEPGFGGDGGL

SEQ ID NO: 1470922 - protein, 23 aa, Mycobacterium tuberculosis
QALLGRPLIGDGADGTAPGQNGG

SEQ ID NO: 1470923 - protein, 19 aa, Mycobacterium tuberculosis
QALYPKLLPIARNWWAKLG

SEQ ID NO: 1470924 - protein, 19 aa, Mycobacterium tuberculosis
QDYLANYHLAWYAVTTRRG

SEQ ID NO: 1470925 - protein, 19 aa, Mycobacterium tuberculosis
QELARRCVLAGKDVIVAGH

SEQ ID NO: 1470926 - protein, 19 aa, Mycobacterium tuberculosis
QGVAIMIWTLMNARNSRDS

SEQ ID NO: 1470927 - protein, 20 aa, Mycobacterium tuberculosis
QGYGSLGLMTSVLMTADGKT

SEQ ID NO: 1470928 - protein, 17 aa, Mycobacterium tuberculosis
QKAMAFAAANNLKVAPR

SEQ ID NO: 1470929 - protein, 28 aa, Mycobacterium tuberculosis
QLAEIVGAYFPRGWQIACHVHGDGGVDT

SEQ ID NO: 1470930 - protein, 31 aa, Mycobacterium tuberculosis; identical to SEQ ID NO: 234073

SEQ ID NO: 1470931 - protein, 17 aa, Mycobacterium tuberculosis
QLPVGMLDGLVAADWPP

SEQ ID NO: 1470932 - protein, 19 aa, Mycobacterium tuberculosis
QMDGSWRVGNRPVRVDHRA

SEQ ID NO: 1470933 - protein, 17 aa, Mycobacterium tuberculosis
QPALPNINLGVGNIGNL

SEQ ID NO: 1470934 - protein, 22 aa, Mycobacterium tuberculosis
QPLDWFCLFSSAAALTGSPGQS

SEQ ID NO: 1470935 - protein, 20 aa, Mycobacterium tuberculosis
QPWFTGRFGTIGLPYLGFTQ

SEQ ID NO: 1470936 - protein, 24 aa, Mycobacterium tuberculosis
QQSWPTVADWVRWISGDGTKPENI

SEQ ID NO: 1470937 - protein, 19 aa, Mycobacterium tuberculosis
QRAGALAAAIDGTRRPLAA

SEQ ID NO: 1470938 - protein, 19 aa, Mycobacterium tuberculosis
QRLAAFVVLKPGVSATPET

SEQ ID NO: 1470939 - protein, 17 aa, Mycobacterium tuberculosis
QRLLVKVPAGWSHTAAA

SEQ ID NO: 1470940 - protein, 19 aa, Mycobacterium tuberculosis
QRTAAGWQPLKTGITTHIG

SEQ ID NO: 1470941 - protein, 24 aa, Mycobacterium tuberculosis
QRVVCGGISIPGRWDTTPEPEITE

SEQ ID NO: 1470942 - protein, 22 aa, Mycobacterium tuberculosis
QSTSWAQRWLAATGSRDYLGAF

SEQ ID NO: 1470943 - protein, 20 aa, Mycobacterium tuberculosis
QVVVCGKPSFYTGRGTFSLR

SEQ ID NO: 1470944 - protein, 25 aa, Mycobacterium tuberculosis
QWKPVGGFPVTFGWIHASRRGHARL

SEQ ID NO: 1470945 - protein, 19 aa, Mycobacterium tuberculosis
RAAALPGVVDIVAASRTVL

SEQ ID NO: 1470946 - protein, 24 aa, Mycobacterium tuberculosis
RAAFEHAGLDWQQYVKFDQRYLRP

SEQ ID NO: 1470947 - protein, 23 aa, Mycobacterium tuberculosis
RAAHRPLEWDLRNGVIVRKARAH

SEQ ID NO: 1470948 - protein, 21 aa, Mycobacterium tuberculosis
RAAMPNICLQMLLRGRNTVGY

SEQ ID NO: 1470949 - protein, 19 aa, Mycobacterium tuberculosis
RADISFGSAVAVIGLGAVG

SEQ ID NO: 1470950 - protein, 25 aa, Mycobacterium tuberculosis
RADMIAVAPSTLWSLTVDPDRPGSL

SEQ ID NO: 1470951 - protein, 20 aa, Mycobacterium tuberculosis
RAEIRALFRSSKVGLIAGCL

SEQ ID NO: 1470952 - protein, 17 aa, Mycobacterium tuberculosis
RAELKDRLKRGGTNLTQ

SEQ ID NO: 1470953 - protein, 20 aa, Mycobacterium tuberculosis
RANITVCVGGGIGTPRRAAE

SEQ ID NO: 1470954 - protein, 17 aa, Mycobacterium tuberculosis
RARVLAITVRRNGTRLD

SEQ ID NO: 1470955 - protein, 19 aa, Mycobacterium tuberculosis
RASGVPIEHIVCVDGAPPG

SEQ ID NO: 1470956 - protein, 17 aa, Mycobacterium tuberculosis
RCATPGPHRAFHIATGG

SEQ ID NO: 1470957 - protein, 24 aa, Mycobacterium tuberculosis
RCATYPVLAVQAWAAFHDMTLRAV

SEQ ID NO: 1470958 - protein, 17 aa, Mycobacterium tuberculosis
RCRACTTTLAGTHADVR

SEQ ID NO: 1470959 - protein, 17 aa, Mycobacterium tuberculosis
RDASGIAQVVFRDPQDT

SEQ ID NO: 1470960 - protein, 19 aa, Mycobacterium tuberculosis
RDGRGCVIVEDMAMASKSA

SEQ ID NO: 1470961 - protein, 18 aa, Mycobacterium tuberculosis
RDVVAGLVSDIAWDTPVS

SEQ ID NO: 1470962 - protein, 19 aa, Mycobacterium tuberculosis
REAYPGDVFYLHSRLLERC

SEQ ID NO: 1470963 - protein, 17 aa, Mycobacterium tuberculosis
RECDAVLYTRAGPEIGV

SEQ ID NO: 1470964 - protein, 29 aa, Mycobacterium tuberculosis
RELALQVAEAFGRYGAYLSQLNVLPIYGG

SEQ ID NO: 1470965 - protein, 18 aa, Mycobacterium tuberculosis
REPVVVVVDGVRVGLTVC

SEQ ID NO: 1470966 - protein, 17 aa, Mycobacterium tuberculosis
RERMQMLQDEFARHGQR

SEQ ID NO: 1470967 - protein, 17 aa, Mycobacterium tuberculosis
RERYSMLAACFEPDVAC

SEQ ID NO: 1470968 - protein, 23 aa, Mycobacterium tuberculosis
RFQSGDGPPIFLLSLKAGGTGLN

SEQ ID NO: 1470969 - protein, 23 aa, Mycobacterium tuberculosis
RFVSRQCRLFACLAQIWEGDANG

SEQ ID NO: 1470970 - protein, 18 aa, Mycobacterium tuberculosis
RGGLTGMLLGSVSNAVLH

SEQ ID NO: 1470971 - protein, 19 aa, Mycobacterium tuberculosis
RGGPPEGWQDSFVSSYATM

SEQ ID NO: 1470972 - protein, 19 aa, Mycobacterium tuberculosis
RGGSSIGVSRVSSWDQLPA

SEQ ID NO: 1470973 - protein, 20 aa, Mycobacterium tuberculosis
RGGSSIGVSRVSSWDQLPAA

SEQ ID NO: 1470974 - protein, 20 aa, Mycobacterium tuberculosis
RGLDALGFAGTIPKSAPGSA

SEQ ID NO: 1470975 - protein, 20 aa, Mycobacterium tuberculosis
RGPGQMLGGLPVGQMGARAG

SEQ ID NO: 1470976 - protein, 19 aa, Mycobacterium tuberculosis
RGPQVPFTDVFLHGLIRDE

SEQ ID NO: 1470977 - protein, 17 aa, Mycobacterium tuberculosis
RGPVPAVSTLVVFGKTA

SEQ ID NO: 1470978 - protein, 20 aa, Mycobacterium tuberculosis
RIGQVGALAVVLGVGAAVTT

SEQ ID NO: 1470979 - protein, 17 aa, Mycobacterium tuberculosis
RIYGPACESVIGLDVIT

SEQ ID NO: 1470980 - protein, 19 aa, Mycobacterium tuberculosis
RKRGHWMWFVFPQLRGLGS

SEQ ID NO: 1470981 - protein, 18 aa, Mycobacterium tuberculosis
RKVKKWLAHGDFDVLHLH

SEQ ID NO: 1470982 - protein, 20 aa, Mycobacterium tuberculosis
RKVVELRPDIAWDKGKALDW

SEQ ID NO: 1470983 - protein, 19 aa, Mycobacterium tuberculosis
RLDIPAATAVRFEPGIPQI

SEQ ID NO: 1470984 - protein, 19 aa, Mycobacterium tuberculosis
RLFAGPRPTELHPFVELTG

SEQ ID NO: 1470985 - protein, 24 aa, Mycobacterium tuberculosis
RLGITTDWKSRWYADKQYAEYVKE

SEQ ID NO: 1470986 - protein, 25 aa, Mycobacterium tuberculosis
RLGVEEELLRLGARSGCAVTIGEMT

SEQ ID NO: 1470987 - protein, 20 aa, Mycobacterium tuberculosis
RLIKRLQAILTDCTAPPASS

SEQ ID NO: 1470988 - protein, 18 aa, Mycobacterium tuberculosis
RLPADHPGVNELFALLAY

SEQ ID NO: 1470989 - protein, 18 aa, Mycobacterium tuberculosis
RLPGLDFVRGDAENLPFD

SEQ ID NO: 1470990 - protein, 17 aa, Mycobacterium tuberculosis
RLPRTPIAEVFAELVDA

SEQ ID NO: 1470991 - protein, 19 aa, Mycobacterium tuberculosis
RLSRRILHQLYLGYPDSAA

SEQ ID NO: 1470992 - protein, 21 aa, Mycobacterium tuberculosis
RMALPPCHAFFQFYVADGRLS

SEQ ID NO: 1470993 - protein, 23 aa, Mycobacterium tuberculosis
RMLAEHRLPGLLVTAGAGKQYAV

SEQ ID NO: 1470994 - protein, 18 aa, Mycobacterium tuberculosis
RMRTTLGVRHWQLEGRIG

SEQ ID NO: 1470995 - protein, 17 aa, Mycobacterium tuberculosis
RPELRAVTVDGDLVGAG

SEQ ID NO: 1470996 - protein, 17 aa, Mycobacterium tuberculosis
RPGTAMRDIAVDAVFVG

SEQ ID NO: 1470997 - protein, 18 aa, Mycobacterium tuberculosis
RPHPRTGIIEGGPNTNVL

SEQ ID NO: 1470998 - protein, 19 aa, Mycobacterium tuberculosis
RPHYIKTLRIWGDTLQSNK

SEQ ID NO: 1470999 - protein, 17 aa, Mycobacterium tuberculosis
RPVKSSFREGLTVLEYF

SEQ ID NO: 1471000 - protein, 18 aa, Mycobacterium tuberculosis
RPVKSSFREGLTVLEYFI

SEQ ID NO: 1471001 - protein, 17 aa, Mycobacterium tuberculosis
RQAAVAAGIGWDVPALT

SEQ ID NO: 1471002 - protein, 19 aa, Mycobacterium tuberculosis
RQLADALGATVLLKGNVTV

SEQ ID NO: 1471003 - protein, 20 aa, Mycobacterium tuberculosis
RQQKGHVFEGGLWSGGAANA

SEQ ID NO: 1471004 - protein, 27 aa, Mycobacterium tuberculosis
RQRENLSWSAPRLHLVDLQYSDVRLDK

SEQ ID NO: 1471005 - protein, 25 aa, Mycobacterium tuberculosis
RRAAELGVTCSIFVDQIHYWGDVIV

SEQ ID NO: 1471006 - protein, 26 aa, Mycobacterium tuberculosis
RRDAIRHAVAWARPGDVVLIAGKGHE

SEQ ID NO: 1471007 - protein, 17 aa, Mycobacterium tuberculosis
RRDGTARAWACDPPLDV

SEQ ID NO: 1471008 - protein, 20 aa, Mycobacterium tuberculosis
RRDRGWLAWCARFDRGHRGD

SEQ ID NO: 1471009 - protein, 23 aa, Mycobacterium tuberculosis
RRKDQAWEFVKFATGPVGQALIG

SEQ ID NO: 1471010 - protein, 27 aa, Mycobacterium tuberculosis
RRLAIPELPDAVFIESLRQLIAVDKAW

SEQ ID NO: 1471011 - protein, 21 aa, Mycobacterium tuberculosis
RRTGDPLARRVAAQTARFLLD

SEQ ID NO: 1471012 - protein, 24 aa, Mycobacterium tuberculosis
RRTLVFPPGMYWRTPDMLSGAPAL

SEQ ID NO: 1471013 - protein, 20 aa, Mycobacterium tuberculosis
RRYVAECLAVARAEGARLDD

SEQ ID NO: 1471014 - protein, 19 aa, Mycobacterium tuberculosis
RSAIARFTAAGIRKTWVFQ

SEQ ID NO: 1471015 - protein, 17 aa, Mycobacterium tuberculosis
RSALMTRIAGAGAMASV

SEQ ID NO: 1471016 - protein, 18 aa, Mycobacterium tuberculosis
RSAPRRRRFMTGSSNCLT

SEQ ID NO: 1471017 - protein, 17 aa, Mycobacterium tuberculosis
RSGECDLALAGGVTVMA

SEQ ID NO: 1471018 - protein, 25 aa, Mycobacterium tuberculosis
RSLAYDRAWWFARFVAAAYGTAKLR

SEQ ID NO: 1471019 - protein, 17 aa, Mycobacterium tuberculosis
RSPLGPVAARLVSRGGF

SEQ ID NO: 1471020 - protein, 17 aa, Mycobacterium tuberculosis
RTAQRRCCAAVHGGRVV

SEQ ID NO: 1471021 - protein, 18 aa, Mycobacterium tuberculosis
RTAVERFGGLDVMVNNAG

SEQ ID NO: 1471022 - protein, 19 aa, Mycobacterium tuberculosis
RTFTVKYKLAILDEYDRAD

SEQ ID NO: 1471023 - protein, 19 aa, Mycobacterium tuberculosis
RVAAQTARFLLDELGSKAP

SEQ ID NO: 1471024 - protein, 24 aa, Mycobacterium tuberculosis
RVAGILAAAGWPLAGVDVGESESG

SEQ ID NO: 1471025 - protein, 25 aa, Mycobacterium tuberculosis
RVAQTRAAPHLARITCPALVLNAEA

SEQ ID NO: 1471026 - protein, 19 aa, Mycobacterium tuberculosis
RVCVARGTTSLRRIREIAP

SEQ ID NO: 1471027 - protein, 18 aa, Mycobacterium tuberculosis
RVTTKLDGLMAFPEYSPA

SEQ ID NO: 1471028 - protein, 25 aa, Mycobacterium tuberculosis
RVWVNCYHLYPAHAAFGGYKQSGIG

SEQ ID NO: 1471029 - protein, 19 aa, Mycobacterium tuberculosis
RWDKPFLAIFGYRDPILGQ

SEQ ID NO: 1471030 - protein, 21 aa, Mycobacterium tuberculosis
RWVLTKGKLPTSLWIEIVTTA

SEQ ID NO: 1471031 - protein, 18 aa, Mycobacterium tuberculosis
RYAQRVMDWLHPDGDLTD

SEQ ID NO: 1471032 - protein, 18 aa, Mycobacterium tuberculosis
RYRAGPGPVAPRLLPLPH

SEQ ID NO: 1471033 - protein, 19 aa, Mycobacterium tuberculosis
SAAYGRYQPLGVILAVMPW

SEQ ID NO: 1471034 - protein, 18 aa, Mycobacterium tuberculosis
SAKAGRQVFKDYVAFPAL

SEQ ID NO: 1471035 - protein, 17 aa, Mycobacterium tuberculosis
SAQAATFHAQFVQTLSA

SEQ ID NO: 1471036 - protein, 20 aa, Mycobacterium tuberculosis
SDIALAGGVYVMLEPRRFAS

SEQ ID NO: 1471037 - protein, 17 aa, Mycobacterium tuberculosis
SDISKPVGLGFSKGGGE

SEQ ID NO: 1471038 - protein, 19 aa, Mycobacterium tuberculosis
SDLMEVWRAPIIDDTVLRL

SEQ ID NO: 1471039 - protein, 18 aa, Mycobacterium tuberculosis
SDMRSGRMSDDDWTRLAR

SEQ ID NO: 1471040 - protein, 18 aa, Mycobacterium tuberculosis
SEGAGVLVVERLVDARRL

SEQ ID NO: 1471041 - protein, 21 aa, Mycobacterium tuberculosis
SEKHFRRARGRKVELVLSDGS

SEQ ID NO: 1471042 - protein, 21 aa, Mycobacterium tuberculosis
SFGSYHLVDGFILNNQLSDFS

SEQ ID NO: 1471043 - protein, 25 aa, Mycobacterium tuberculosis
SGAGGAGGNAWLIGDGGAGGNGGDI

SEQ ID NO: 1471044 - protein, 19 aa, Mycobacterium tuberculosis
SGENVFFCATGVTDGDLLK

SEQ ID NO: 1471045 - protein, 23 aa, Mycobacterium tuberculosis
SGGGARWLIPRLDLPAKKRDAIV

SEQ ID NO: 1471046 - protein, 19 aa, Mycobacterium tuberculosis
SGHGNTGFFNAGSFNTGML

SEQ ID NO: 1471047 - protein, 17 aa, Mycobacterium tuberculosis
SGTQVPLQASAVGYNTP

SEQ ID NO: 1471048 - protein, 21 aa, Mycobacterium tuberculosis
SHLRVRSLAIQRLAGRCHHRS

SEQ ID NO: 1471049 - protein, 26 aa, Mycobacterium tuberculosis
SIAGQRAHFGPITIPNITVVGPTTTV

SEQ ID NO: 1471050 - protein, 24 aa, Mycobacterium tuberculosis
SIDARLADRLAVNRGLAPVADVRA

SEQ ID NO: 1471051 - protein, 33 aa, Mycobacterium tuberculosis; identical to SEQ ID NO: 206452

SEQ ID NO: 1471052 - protein, 19 aa, Mycobacterium tuberculosis
SIGVPGILRMLEMVHNEHG

SEQ ID NO: 1471053 - protein, 18 aa, Mycobacterium tuberculosis
SIRVFPGDHFYLNDNLPE

SEQ ID NO: 1471054 - protein, 17 aa, Mycobacterium tuberculosis
SKIRGREPIRIHPDDAA

SEQ ID NO: 1471055 - protein, 26 aa, Mycobacterium tuberculosis
SLALDGAGLGTVWGRQLATSMLADAG

SEQ ID NO: 1471056 - protein, 35 aa, Mycobacterium tuberculosis; identical to SEQ ID NO: 206494

SEQ ID NO: 1471057 - protein, 20 aa, Mycobacterium tuberculosis
SLKSPVRHFVLFSSVSGLLG

SEQ ID NO: 1471058 - protein, 18 aa, Mycobacterium tuberculosis
SMGSARPGDFGAPTAVAP

SEQ ID NO: 1471059 - protein, 18 aa, Mycobacterium tuberculosis
SPVRIIGYANAYDFFNMW

SEQ ID NO: 1471060 - protein, 18 aa, Mycobacterium tuberculosis
SRAHPRAAFFGRSGLRRN

SEQ ID NO: 1471061 - protein, 17 aa, Mycobacterium tuberculosis
SSALFAMLSGQHAVDTL

SEQ ID NO: 1471062 - protein, 17 aa, Mycobacterium tuberculosis
SSARRLAIPELPDAVFI

SEQ ID NO: 1471063 - protein, 25 aa, Mycobacterium tuberculosis
SSITMAAAVAPYVAWISVTAGQAEQ

SEQ ID NO: 1471064 - protein, 22 aa, Mycobacterium tuberculosis
SSPDEIAHILVLHSEFDGGFTS

SEQ ID NO: 1471065 - protein, 19 aa, Mycobacterium tuberculosis
STASHHRRALGIQRLLAAR

SEQ ID NO: 1471066 - protein, 24 aa, Mycobacterium tuberculosis
SVLGRSWPVVCDELLGHYEAVRGR

SEQ ID NO: 1471067 - protein, 20 aa, Mycobacterium tuberculosis
SVRSAHCAGASRFIEVGPGG

SEQ ID NO: 1471068 - protein, 20 aa, Mycobacterium tuberculosis
TAAALWLVAPCTELYHDSRA

SEQ ID NO: 1471069 - protein, 26 aa, Mycobacterium tuberculosis
TADLNFAWPTARIAVIGADGAAQLLM

SEQ ID NO: 1471070 - protein, 30 aa, Mycobacterium tuberculosis; identical to SEQ ID NO: 206819

SEQ ID NO: 1471071 - protein, 21 aa, Mycobacterium tuberculosis
TAELLRLALTGKRKPYIYTST

SEQ ID NO: 1471072 - protein, 18 aa, Mycobacterium tuberculosis
TAGLPFLIHAVSARAQAP

SEQ ID NO: 1471073 - protein, 25 aa, Mycobacterium tuberculosis
TAKGLEFPVVFVTGWEDGMFPHMRA

SEQ ID NO: 1471074 - protein, 22 aa, Mycobacterium tuberculosis
TALTDATRDFAIGLAGIPPSLQ

SEQ ID NO: 1471075 - protein, 27 aa, Mycobacterium tuberculosis
TAPAGFRAAGVAAGIKASGALDLALVF

SEQ ID NO: 1471076 - protein, 19 aa, Mycobacterium tuberculosis
TAQVLLAVLAAMYASYHGA

SEQ ID NO: 1471077 - protein, 27 aa, Mycobacterium tuberculosis
TATPLRPGIWRAYADHRMAMAGAIIGL

SEQ ID NO: 1471078 - protein, 22 aa, Mycobacterium tuberculosis
TAVAGYGARFAGVAYPGETLTV

SEQ ID NO: 1471079 - protein, 19 aa, Mycobacterium tuberculosis
TCDRSRLTADGIWLHCLYA

SEQ ID NO: 1471080 - protein, 18 aa, Mycobacterium tuberculosis
TDAELGWIATAFDPNVLT

SEQ ID NO: 1471081 - protein, 25 aa, Mycobacterium tuberculosis
TDEMKRQALAWAMSVAGKRANALLA

SEQ ID NO: 1471082 - protein, 23 aa, Mycobacterium tuberculosis
TECEAWVARGLRFTGPGWVPGYA

SEQ ID NO: 1471083 - protein, 25 aa, Mycobacterium tuberculosis
TEIDNWRWAGVPIFVRAGKELPAKV

SEQ ID NO: 1471084 - protein, 26 aa, Mycobacterium tuberculosis
TEVLDWSGAPFAKWFVGGELNVAYNC

SEQ ID NO: 1471085 - protein, 18 aa, Mycobacterium tuberculosis
TFDRPALGPSAFNTIIDK

SEQ ID NO: 1471086 - protein, 17 aa, Mycobacterium tuberculosis
TFKAAGHVIEIRGTSVL

SEQ ID NO: 1471087 - protein, 25 aa, Mycobacterium tuberculosis
TGGAGGRGGLLIGDGGAGGAGGVGG

SEQ ID NO: 1471088 - protein, 22 aa, Mycobacterium tuberculosis
TGRPTGEWSAAVSRLAAAEAAV

SEQ ID NO: 1471089 - protein, 18 aa, Mycobacterium tuberculosis
TGWRLHGRTARWIEIAAE

SEQ ID NO: 1471090 - protein, 24 aa, Mycobacterium tuberculosis
TLAHPDRRLAVVFGAGGDRDPGKR

SEQ ID NO: 1471091 - protein, 22 aa, Mycobacterium tuberculosis
TLDSCVRDGLMSSRAAETAETL

SEQ ID NO: 1471092 - protein, 19 aa, Mycobacterium tuberculosis
TPHAGEFARLAGAPPGDDR

SEQ ID NO: 1471093 - protein, 22 aa, Mycobacterium tuberculosis
TPSSKLGGLWKTVSPHRSPISN

SEQ ID NO: 1471094 - protein, 17 aa, Mycobacterium tuberculosis
TPTGRAALLARLDEAIT

SEQ ID NO: 1471095 - protein, 17 aa, Mycobacterium tuberculosis
TQGIDMVARIGIPDRPA

SEQ ID NO: 1471096 - protein, 18 aa, Mycobacterium tuberculosis
TRAALPAIRPVNHLVVDG

SEQ ID NO: 1471097 - protein, 20 aa, Mycobacterium tuberculosis
TRDETIAAIAARAADLDVLG

SEQ ID NO: 1471098 - protein, 22 aa, Mycobacterium tuberculosis
TRDSSIWIGPRVVIPSLALRAR

SEQ ID NO: 1471099 - protein, 23 aa, Mycobacterium tuberculosis
TRFRSDALQIIAFGRYARTVTAA

SEQ ID NO: 1471100 - protein, 18 aa, Mycobacterium tuberculosis
TRLAWSVLNWNSDAIALY

SEQ ID NO: 1471101 - protein, 21 aa, Mycobacterium tuberculosis
TRLRWAQRTVELPAGRYQTIM

SEQ ID NO: 1471102 - protein, 24 aa, Mycobacterium tuberculosis
TRPPRPGRRLPVYPAAADVDPPGP

SEQ ID NO: 1471103 - protein, 19 aa, Mycobacterium tuberculosis
TRRGNWWYYARTFEGKQYG

SEQ ID NO: 1471104 - protein, 18 aa, Mycobacterium tuberculosis
TRRVPLGLIAGARSGDKG

SEQ ID NO: 1471105 - protein, 23 aa, Mycobacterium tuberculosis
TRVPGIGKRGAERMVLELRDKVG

SEQ ID NO: 1471106 - protein, 17 aa, Mycobacterium tuberculosis
TRVPQGWSFAQAAAVPV

SEQ ID NO: 1471107 - protein, 17 aa, Mycobacterium tuberculosis
TSIAERVRALLGTPSVD

SEQ ID NO: 1471108 - protein, 17 aa, Mycobacterium tuberculosis
TSPLAFLQRPARWLHSL

SEQ ID NO: 1471109 - protein, 25 aa, Mycobacterium tuberculosis
TSTSSIPFDAHGGNGGAGGDAGHGG

SEQ ID NO: 1471110 - protein, 18 aa, Mycobacterium tuberculosis
TTIAFSIDTTNLTGVMTF

SEQ ID NO: 1471111 - protein, 20 aa, Mycobacterium tuberculosis
TTRMRVELGYQPKWTTVEAF

SEQ ID NO: 1471112 - protein, 17 aa, Mycobacterium tuberculosis
TTWYDGVRFEEVSVGYP

SEQ ID NO: 1471113 - protein, 25 aa, Mycobacterium tuberculosis
TVANLASIGNTWLADPAPFLQQYLA

SEQ ID NO: 1471114 - protein, 24 aa, Mycobacterium tuberculosis
TVFDGGWILPGLVDAHCHVGLGKH

SEQ ID NO: 1471115 - protein, 21 aa, Mycobacterium tuberculosis
TWNTLYRKWLTVLGPAPAPPT

SEQ ID NO: 1471116 - protein, 19 aa, Mycobacterium tuberculosis
TWTGAGGVKGFFEKTFAPL

SEQ ID NO: 1471117 - protein, 18 aa, Mycobacterium tuberculosis
VAALCGSPSQARKHADAG

SEQ ID NO: 1471118 - protein, 25 aa, Mycobacterium tuberculosis
VAALQRSDLLIALGTRFDDRVTGKL

SEQ ID NO: 1471119 - protein, 20 aa, Mycobacterium tuberculosis
VAAPRPVRRSTFYRNVEGWL

SEQ ID NO: 1471120 - protein, 24 aa, Mycobacterium tuberculosis
VAAYQQRFVLALSQAGSTYAVAEA

SEQ ID NO: 1471121 - protein, 22 aa, Mycobacterium tuberculosis
VADFGCGSGRAVKLMAQAFGAS

SEQ ID NO: 1471122 - protein, 22 aa, Mycobacterium tuberculosis
VAEPGWTMFMISHFHYDPVWWN

SEQ ID NO: 1471123 - protein, 24 aa, Mycobacterium tuberculosis
VAGSRIDPVLARSWLLVNGAHGDR

SEQ ID NO: 1471124 - protein, 17 aa, Mycobacterium tuberculosis
VAIKRPIFVTGLVRTGT

SEQ ID NO: 1471125 - protein, 22 aa, Mycobacterium tuberculosis
VANDGFTFFPGGLTFPRASAGV

SEQ ID NO: 1471126 - protein, 30 aa, Mycobacterium tuberculosis; identical to SEQ ID NO: 207543

SEQ ID NO: 1471127 - protein, 17 aa, Mycobacterium tuberculosis
VAVEGRGGGKADLAQGS

SEQ ID NO: 1471128 - protein, 19 aa, Mycobacterium tuberculosis
VDAISGWWNTGAATEADGS

SEQ ID NO: 1471129 - protein, 23 aa, Mycobacterium tuberculosis
VDARTALDPSAPVIRTDLEGKSD

SEQ ID NO: 1471130 - protein, 18 aa, Mycobacterium tuberculosis
VDLLPGLLSQALDELLEA

SEQ ID NO: 1471131 - protein, 26 aa, Mycobacterium tuberculosis
VDSCRECNSCTRGIEQYCKPGANFTY

SEQ ID NO: 1471132 - protein, 17 aa, Mycobacterium tuberculosis
VEAVLRLLAGVLGNPAS

SEQ ID NO: 1471133 - protein, 19 aa, Mycobacterium tuberculosis
VEGGWKINGQKVWTSGAQY

SEQ ID NO: 1471134 - protein, 25 aa, Mycobacterium tuberculosis
VEGMLALTGYYAWHKICVERAILPG

SEQ ID NO: 1471135 - protein, 21 aa, Mycobacterium tuberculosis
VEHGLVLPSGPLIHGGTGGYG

SEQ ID NO: 1471136 - protein, 18 aa, Mycobacterium tuberculosis
VELRNRLTAVTAVTLPAT

SEQ ID NO: 1471137 - protein, 27 aa, Mycobacterium tuberculosis
VEPAIQPKLTFTWRIMPQNLSDAGISW

SEQ ID NO: 1471138 - protein, 26 aa, Mycobacterium tuberculosis
VEPLRPGPPPTVWSRRWRQRWAPPTS

SEQ ID NO: 1471139 - protein, 24 aa, Mycobacterium tuberculosis
VEPSDFRLWVCLHEVTHRVQFTAN

SEQ ID NO: 1471140 - protein, 21 aa, Mycobacterium tuberculosis
VEVCRTCSWNHLVKSYVLGAA

SEQ ID NO: 1471141 - protein, 21 aa, Mycobacterium tuberculosis
VGETAEFLRWTAGQAPDASGY

SEQ ID NO: 1471142 - protein, 32 aa, Mycobacterium tuberculosis; identical to SEQ ID NO: 207757

SEQ ID NO: 1471143 - protein, 19 aa, Mycobacterium tuberculosis
VGLFPRPLPREAAITQVAD

SEQ ID NO: 1471144 - protein, 18 aa, Mycobacterium tuberculosis
VGLMEFQSMYTALIMGEP

SEQ ID NO: 1471145 - protein, 23 aa, Mycobacterium tuberculosis
VGSFKKGPFRIAMAAKIPIVPIV

SEQ ID NO: 1471146 - protein, 18 aa, Mycobacterium tuberculosis
VGVCAEYDALPGIGHACG

SEQ ID NO: 1471147 - protein, 23 aa, Mycobacterium tuberculosis
VHGRPRRAGVSSFGISGTNAHVI

SEQ ID NO: 1471148 - protein, 25 aa, Mycobacterium tuberculosis
VHPTSRFRELICSRAVDIAIGPASE

SEQ ID NO: 1471149 - protein, 18 aa, Mycobacterium tuberculosis
VHRLPAWSRNLTAKIKKR

SEQ ID NO: 1471150 - protein, 39 aa, Mycobacterium tuberculosis; identical to SEQ ID NO: 207884

SEQ ID NO: 1471151 - protein, 20 aa, Mycobacterium tuberculosis
VLCAFGTALHPRFGPDSSAR

SEQ ID NO: 1471152 - protein, 19 aa, Mycobacterium tuberculosis
VLIAGSWFPRYARNLGTPE

SEQ ID NO: 1471153 - protein, 17 aa, Mycobacterium tuberculosis
VLMPELGESVTEGTVIR

SEQ ID NO: 1471154 - protein, 24 aa, Mycobacterium tuberculosis
VMARLRSPLLAVVKDGSLLGVVTA

SEQ ID NO: 1471155 - protein, 17 aa, Mycobacterium tuberculosis
VMSDWGGTPSWECALAG

SEQ ID NO: 1471156 - protein, 29 aa, Mycobacterium tuberculosis
VNAPAQALLGRPLIGNGANGADGTGAPGG

SEQ ID NO: 1471157 - protein, 21 aa, Mycobacterium tuberculosis
VNAWVSFYAAGLFAMNNGVPW

SEQ ID NO: 1471158 - protein, 28 aa, Mycobacterium tuberculosis
VNGPTQLLLGRPLIGDGANGGPGQNGGD

SEQ ID NO: 1471159 - protein, 18 aa, Mycobacterium tuberculosis
VNWQRIRHRWNWTDVRRW

SEQ ID NO: 1471160 - protein, 17 aa, Mycobacterium tuberculosis
VPARRVGRVILVDEPAG

SEQ ID NO: 1471161 - protein, 28 aa, Mycobacterium tuberculosis
VPFPKECPAPGVMQGCLESTSGLIMGID

SEQ ID NO: 1471162 - protein, 24 aa, Mycobacterium tuberculosis
VPIPRAGGLGAPRIRDVELVQMVA

SEQ ID NO: 1471163 - protein, 27 aa, Mycobacterium tuberculosis
VPQLGKGGGRLPITLWIVDTNASTPAP

SEQ ID NO: 1471164 - protein, 18 aa, Mycobacterium tuberculosis
VRLAREGADIVALDICAP

SEQ ID NO: 1471165 - protein, 18 aa, Mycobacterium tuberculosis
VRMAVLFHVLVGAQDAGK

SEQ ID NO: 1471166 - protein, 22 aa, Mycobacterium tuberculosis
VRQALRMRPDRIVVGEVRGAEV

SEQ ID NO: 1471167 - protein, 20 aa, Mycobacterium tuberculosis
VRSDGGWGVLQPVSATFNPP

SEQ ID NO: 1471168 - protein, 18 aa, Mycobacterium tuberculosis
VSAIDVLLGLGWLAPSHV

SEQ ID NO: 1471169 - protein, 25 aa, Mycobacterium tuberculosis
VSGAAGNLARLGSMISAANSAAAAQ

SEQ ID NO: 1471170 - protein, 25 aa, Mycobacterium tuberculosis
VSGHAYAGELLFLYNGVRPRNVMPV

SEQ ID NO: 1471171 - protein, 20 aa, Mycobacterium tuberculosis
VSRHGCVNATLPIFADISAV

SEQ ID NO: 1471172 - protein, 35 aa, Mycobacterium tuberculosis; identical to SEQ ID NO: 208227

SEQ ID NO: 1471173 - protein, 22 aa, Mycobacterium tuberculosis
VSWSNPNDWWLVRLLGSITPTE

SEQ ID NO: 1471174 - protein, 17 aa, Mycobacterium tuberculosis
VSYVLGLQGPAVSVDTA

SEQ ID NO: 1471175 - protein, 19 aa, Mycobacterium tuberculosis
VTADVTLTRAWCLRELGDD

SEQ ID NO: 1471176 - protein, 17 aa, Mycobacterium tuberculosis
VTLCKTLGKPVNFVPVI

SEQ ID NO: 1471177 - protein, 18 aa, Mycobacterium tuberculosis
VTPSPPVTHCTTVASHTA

SEQ ID NO: 1471178 - protein, 20 aa, Mycobacterium tuberculosis
VTSAGLVFQGWFHKAPYYPH

SEQ ID NO: 1471179 - protein, 27 aa, Mycobacterium tuberculosis
VVGRAARLGHRLTIAMTRWQALVNWSG

SEQ ID NO: 1471180 - protein, 21 aa, Mycobacterium tuberculosis
VVRYCRARVGTVERSGLSADD

SEQ ID NO: 1471181 - protein, 20 aa, Mycobacterium tuberculosis
VVSAGFMRILGPQFLSRFYG

SEQ ID NO: 1471182 - protein, 22 aa, Mycobacterium tuberculosis
VVSALRVPGRHPAVAAWADSVQ

SEQ ID NO: 1471183 - protein, 17 aa, Mycobacterium tuberculosis
VVTTHLQSQWSLVCVLQ

SEQ ID NO: 1471184 - protein, 24 aa, Mycobacterium tuberculosis
VWHRRVPDRYPEVIVQAVSADDIV

SEQ ID NO: 1471185 - protein, 22 aa, Mycobacterium tuberculosis
VWSRRWRQRWAPPTSVAASADH

SEQ ID NO: 1471186 - protein, 24 aa, Mycobacterium tuberculosis
VYGTLPWHPDLWLDSEDALDLQGR

SEQ ID NO: 1471187 - protein, 18 aa, Mycobacterium tuberculosis
VYLDKRLKPSLRQRVIAA

SEQ ID NO: 1471188 - protein, 25 aa, Mycobacterium tuberculosis
WKAGPALACGNAFVLKPSERDPSVP

SEQ ID NO: 1471189 - protein, 21 aa, Mycobacterium tuberculosis
WKDTAAPLWTFPRVAWERELL

SEQ ID NO: 1471190 - protein, 18 aa, Mycobacterium tuberculosis
WLPGPDRLLDCVERVLRQ

SEQ ID NO: 1471191 - protein, 19 aa, Mycobacterium tuberculosis
WLVAFAERSRFFEVFSSSN

SEQ ID NO: 1471192 - protein, 20 aa, Mycobacterium tuberculosis
WPATPARLPFTLGAGAHLQA

SEQ ID NO: 1471193 - protein, 18 aa, Mycobacterium tuberculosis
WPGGLTVFDVRVEAMAPF

SEQ ID NO: 1471194 - protein, 25 aa, Mycobacterium tuberculosis
WRRGTLPPGRLGVRRAKEIRNRARD

SEQ ID NO: 1471195 - protein, 18 aa, Mycobacterium tuberculosis
WSAAVSRLAAAEAAVADC

SEQ ID NO: 1471196 - protein, 17 aa, Mycobacterium tuberculosis
WSAVFAGSGGRRVQLPT

SEQ ID NO: 1471197 - protein, 19 aa, Mycobacterium tuberculosis
WSLAGRSVFEHRAVVVGGD

SEQ ID NO: 1471198 - protein, 19 aa, Mycobacterium tuberculosis
WSTSIAERVRALLGTPSVD

SEQ ID NO: 1471199 - protein, 17 aa, Mycobacterium tuberculosis
WTDVRRWLTDPTGRWHP

SEQ ID NO: 1471200 - protein, 17 aa, Mycobacterium tuberculosis
WTFPRVAWERELLPGAQ

SEQ ID NO: 1471201 - protein, 17 aa, Mycobacterium tuberculosis
WTGAGGVKGFFEKTFAP

SEQ ID NO: 1471202 - protein, 19 aa, Mycobacterium tuberculosis
YADGRLRIGALTAATSAGS

SEQ ID NO: 1471203 - protein, 17 aa, Mycobacterium tuberculosis
YAFSAGGPVLWPDLEAI

SEQ ID NO: 1471204 - protein, 17 aa, Mycobacterium tuberculosis
YAPALRSEALRERLAAG

SEQ ID NO: 1471205 - protein, 20 aa, Mycobacterium tuberculosis
YDGAVAWLVGEEGRGVPTII

SEQ ID NO: 1471206 - protein, 17 aa, Mycobacterium tuberculosis
YFASIGISLDSRLRVLA

SEQ ID NO: 1471207 - protein, 31 aa, Mycobacterium tuberculosis
YFKAARRGLVPGLPRLLRVVGHYYKPGFHPS

SEQ ID NO: 1471208 - protein, 23 aa, Mycobacterium tuberculosis
YGSASILPITWAYIRMMGAEGLR

SEQ ID NO: 1471209 - protein, 18 aa, Mycobacterium tuberculosis
YLATGMARFLTSIAQQLT

SEQ ID NO: 1471210 - protein, 18 aa, Mycobacterium tuberculosis
YLCALPEPARAVVDYLAI

SEQ ID NO: 1471211 - protein, 17 aa, Mycobacterium tuberculosis
YNASALDLVTPAFASGL

SEQ ID NO: 1471212 - protein, 18 aa, Mycobacterium tuberculosis
YPDIKVRALLSGPGVMQQ

SEQ ID NO: 1471213 - protein, 18 aa, Mycobacterium tuberculosis
YPVEGGGNQDWWPNRLNL

SEQ ID NO: 1471214 - protein, 17 aa, Mycobacterium tuberculosis
YQIYRLDAVPNTAKLPY

SEQ ID NO: 1471215 - protein, 17 aa, Mycobacterium tuberculosis
YRLHPVVLDAALQSVGA

SEQ ID NO: 1471216 - protein, 18 aa, Mycobacterium tuberculosis
YRRCRRALRQIGVLERPV

SEQ ID NO: 1471217 - protein, 19 aa, Mycobacterium tuberculosis
YRRMWVLRLLDMALEQLRI

SEQ ID NO: 1471218 - protein, 17 aa, Mycobacterium tuberculosis
YWGIIKADIGIRDGRIV

SEQ ID NO: 1471219 - protein, 22 aa, Mycobacterium tuberculosis
AAAAPYAGWLAAAAARAAGASA

SEQ ID NO: 1471220 - protein, 32 aa, Mycobacterium tuberculosis; identical to SEQ ID NO: 195712

SEQ ID NO: 1471221 - protein, 32 aa, Mycobacterium tuberculosis; identical to SEQ ID NO: 195714

SEQ ID NO: 1471222 - protein, 19 aa, Mycobacterium tuberculosis
AAADRLCYSYFRSYGLDVT

SEQ ID NO: 1471223 - protein, 17 aa, Mycobacterium tuberculosis
AAAEALAPFGSPLASLA

SEQ ID NO: 1471224 - protein, 24 aa, Mycobacterium tuberculosis
AAAFVRGRRAEVFGISRAGDGDGA

SEQ ID NO: 1471225 - protein, 17 aa, Mycobacterium tuberculosis
AAAHPSLPRGALLQIAV

SEQ ID NO: 1471226 - protein, 18 aa, Mycobacterium tuberculosis
AAAHVAGALCLPDAAMLV

SEQ ID NO: 1471227 - protein, 21 aa, Mycobacterium tuberculosis
AAAPYAGWLSAAAARAAGAAA

SEQ ID NO: 1471228 - protein, 24 aa, Mycobacterium tuberculosis
AAASCGLGHRKGRIAPGYDADLLA

SEQ ID NO: 1471229 - protein, 46 aa, Mycobacterium tuberculosis; identical to SEQ ID NO: 195752

SEQ ID NO: 1471230 - protein, 25 aa, Mycobacterium tuberculosis
AADEVSAAMAALFSGHAQAYQALSA

SEQ ID NO: 1471231 - protein, 30 aa, Mycobacterium tuberculosis; identical to SEQ ID NO: 195754

SEQ ID NO: 1471232 - protein, 23 aa, Mycobacterium tuberculosis
AADEVSLLLATQFRTHAATYQTA

SEQ ID NO: 1471233 - protein, 20 aa, Mycobacterium tuberculosis
AADFRGWCGEAGFRSFEVIP

SEQ ID NO: 1471234 - protein, 24 aa, Mycobacterium tuberculosis
AAEPWEVAATIAFLASDYSSYLTG

SEQ ID NO: 1471235 - protein, 29 aa, Mycobacterium tuberculosis
AAGGNGGNGGWLFGAGGTGGIGGTGAPGA

SEQ ID NO: 1471236 - protein, 17 aa, Mycobacterium tuberculosis
AALARELVRAGTTFPTD

SEQ ID NO: 1471237 - protein, 21 aa, Mycobacterium tuberculosis
AALARRNSDVFQRMQEALNIS

SEQ ID NO: 1471238 - protein, 22 aa, Mycobacterium tuberculosis
AALELIDWPVALVIATGHILAN

SEQ ID NO: 1471239 - protein, 26 aa, Mycobacterium tuberculosis
AANRARLAAAIGLPGNRVVWMNQVHG

SEQ ID NO: 1471240 - protein, 24 aa, Mycobacterium tuberculosis
AAPDRKRLTLAHELGHLVLHSTNP

SEQ ID NO: 1471241 - protein, 20 aa, Mycobacterium tuberculosis
AAQAGRLGRYVRARPALDVV

SEQ ID NO: 1471242 - protein, 25 aa, Mycobacterium tuberculosis
AARIELRTGGAYRWTVTPGHSAAGT

SEQ ID NO: 1471243 - protein, 18 aa, Mycobacterium tuberculosis
AASCGLGHRKGRIAPGYD

SEQ ID NO: 1471244 - protein, 19 aa, Mycobacterium tuberculosis
AASPFGIDIGIGGAGGHGG

SEQ ID NO: 1471245 - protein, 17 aa, Mycobacterium tuberculosis
AASRLRYARAMRERLPK

SEQ ID NO: 1471246 - protein, 22 aa, Mycobacterium tuberculosis
AATEAHYAEMWAQDAAAMYGYA

SEQ ID NO: 1471247 - protein, 18 aa, Mycobacterium tuberculosis
AATLGPWTLVLDECHHLL

SEQ ID NO: 1471248 - protein, 18 aa, Mycobacterium tuberculosis
AAVEQHLLEVLGASVDVV

SEQ ID NO: 1471249 - protein, 19 aa, Mycobacterium tuberculosis
AAVSFGFGPLLLAGSDPLL

SEQ ID NO: 1471250 - protein, 19 aa, Mycobacterium tuberculosis
AAVVGRLRAVVCAPACAVD

SEQ ID NO: 1471251 - protein, 30 aa, Mycobacterium tuberculosis; identical to SEQ ID NO: 195925

SEQ ID NO: 1471252 - protein, 17 aa, Mycobacterium tuberculosis
ADALFRAIIETLDKHRN

SEQ ID NO: 1471253 - protein, 18 aa, Mycobacterium tuberculosis
ADGSRIVVRGELFTAFVP

SEQ ID NO: 1471254 - protein, 18 aa, Mycobacterium tuberculosis
ADSLGPVRVVVNCAGTGN

SEQ ID NO: 1471255 - protein, 18 aa, Mycobacterium tuberculosis
ADSLSFVLDDAVLTADTV

SEQ ID NO: 1471256 - protein, 17 aa, Mycobacterium tuberculosis
ADTDALIRFGVEAYEGA

SEQ ID NO: 1471257 - protein, 17 aa, Mycobacterium tuberculosis
AEGLDVADGARLVDSIE

SEQ ID NO: 1471258 - protein, 17 aa, Mycobacterium tuberculosis
AEIAPQWHLRMQAAVQR

SEQ ID NO: 1471259 - protein, 23 aa, Mycobacterium tuberculosis
AEIGRRPVVVLSRDAAIPRLRRA

SEQ ID NO: 1471260 - protein, 19 aa, Mycobacterium tuberculosis
AEIRALFRSSKVGLIAGCL

SEQ ID NO: 1471261 - protein, 17 aa, Mycobacterium tuberculosis
AEIYRRSFAVIRAEADL

SEQ ID NO: 1471262 - protein, 26 aa, Mycobacterium tuberculosis
AEKCREYRITLVFVEVREGQSTRHGV

SEQ ID NO: 1471263 - protein, 22 aa, Mycobacterium tuberculosis
AELGLPVVVRPSFTMGGLGSGI

SEQ ID NO: 1471264 - protein, 17 aa, Mycobacterium tuberculosis
AELPALFSQLVAGPIRR

SEQ ID NO: 1471265 - protein, 17 aa, Mycobacterium tuberculosis
AELRAKHGLIPEDEALR

SEQ ID NO: 1471266 - protein, 27 aa, Mycobacterium tuberculosis
AELVIPVCTRLGLSPPDVRTLSKLVRH

SEQ ID NO: 1471267 - protein, 22 aa, Mycobacterium tuberculosis
AEMHARISGLADYFALDELDAI

SEQ ID NO: 1471268 - protein, 18 aa, Mycobacterium tuberculosis
AEMIRACRPITVPLTQAQ

SEQ ID NO: 1471269 - protein, 17 aa, Mycobacterium tuberculosis
AEMWAQDAAAMYGYAGS

SEQ ID NO: 1471270 - protein, 21 aa, Mycobacterium tuberculosis
AEMWAQDAMAMYGYAGSSATA

SEQ ID NO: 1471271 - protein, 20 aa, Mycobacterium tuberculosis
AEPGWTMFMISHFHYDPVWW

SEQ ID NO: 1471272 - protein, 20 aa, Mycobacterium tuberculosis
AEPTAWLFGPEAHGLSAEIA

SEQ ID NO: 1471273 - protein, 21 aa, Mycobacterium tuberculosis
AEPYLPLRAVRHLEKGRVVIF

SEQ ID NO: 1471274 - protein, 18 aa, Mycobacterium tuberculosis
AERIRRVAERIVATKKHG

SEQ ID NO: 1471275 - protein, 24 aa, Mycobacterium tuberculosis
AFDFPRSMTEPGLVRIRKPSISQA

SEQ ID NO: 1471276 - protein, 22 aa, Mycobacterium tuberculosis
AFPEQWSGNFLFYNKQLFDDAG

SEQ ID NO: 1471277 - protein, 26 aa, Mycobacterium tuberculosis
AFTAWPEVRSQLAMTWGTETFIVPKM

SEQ ID NO: 1471278 - protein, 25 aa, Mycobacterium tuberculosis
AGAARRCPDRPGLIDELGTLTWRQL

SEQ ID NO: 1471279 - protein, 18 aa, Mycobacterium tuberculosis
AGALAYRALARELIDRFG

SEQ ID NO: 1471280 - protein, 24 aa, Mycobacterium tuberculosis
AGDARPPFWQNLAELGWLGLHIDE

SEQ ID NO: 1471281 - protein, 31 aa, Mycobacterium tuberculosis
AGDPNNLLWRAFRPGTHVPIIDYTVPAPAES

SEQ ID NO: 1471282 - protein, 25 aa, Mycobacterium tuberculosis
AGGAGGKAGLLFGSGGAGGSGGAAG

SEQ ID NO: 1471283 - protein, 25 aa, Mycobacterium tuberculosis
AGGAGGKAGLLFGSGGAGGSGGAGG

SEQ ID NO: 1471284 - protein, 25 aa, Mycobacterium tuberculosis
AGGAGGNGGWLYGNGGPGGAAGLGT

SEQ ID NO: 1471285 - protein, 24 aa, Mycobacterium tuberculosis
AGGDGGAGGILFGAGGAGGAGGAV

SEQ ID NO: 1471286 - protein, 25 aa, Mycobacterium tuberculosis
AGGDGGRGGLLYGDGGAGGAGGNGS

SEQ ID NO: 1471287 - protein, 18 aa, Mycobacterium tuberculosis
AGGLLIGNGGAGGVGGTA

SEQ ID NO: 1471288 - protein, 19 aa, Mycobacterium tuberculosis
AGGNARLIGDGGRGGNGGE

SEQ ID NO: 1471289 - protein, 28 aa, Mycobacterium tuberculosis
AGHSFVIFLREGFPINILNPVQAVPEVC

SEQ ID NO: 1471290 - protein, 19 aa, Mycobacterium tuberculosis
AGLFSIPNPFAVTYYLIKG

SEQ ID NO: 1471291 - protein, 18 aa, Mycobacterium tuberculosis
AGLKAIYLSGWQVAGDAN

SEQ ID NO: 1471292 - protein, 23 aa, Mycobacterium tuberculosis
AGLLPVPARKAGRLILVDDQPAD

SEQ ID NO: 1471293 - protein, 19 aa, Mycobacterium tuberculosis
AGLLRPPAAQRLVSALRSR

SEQ ID NO: 1471294 - protein, 17 aa, Mycobacterium tuberculosis
AGMEVCCGGILGMGETL

SEQ ID NO: 1471295 - protein, 23 aa, Mycobacterium tuberculosis
AGPAYNTGSAWGYTPKGATGVPT

SEQ ID NO: 1471296 - protein, 17 aa, Mycobacterium tuberculosis
AGRSLPEYRALRERYSM

SEQ ID NO: 1471297 - protein, 17 aa, Mycobacterium tuberculosis
AGRVWVNCYHLYPAHAA

SEQ ID NO: 1471298 - protein, 30 aa, Mycobacterium tuberculosis
AGSDPDWDARVALHRARRPPTWLTVETADV

SEQ ID NO: 1471299 - protein, 22 aa, Mycobacterium tuberculosis
AGSNALGLFLGLGGSGGQGGDS

SEQ ID NO: 1471300 - protein, 30 aa, Mycobacterium tuberculosis; identical to SEQ ID NO: 196404

SEQ ID NO: 1471301 - protein, 19 aa, Mycobacterium tuberculosis
AGVGCTRLAIHAVTANGEE

SEQ ID NO: 1471302 - protein, 21 aa, Mycobacterium tuberculosis
AGYEKWRIRFASTAWTSTWRR

SEQ ID NO: 1471303 - protein, 20 aa, Mycobacterium tuberculosis
AHAAIKRFLTVSTPGSHLIL

SEQ ID NO: 1471304 - protein, 23 aa, Mycobacterium tuberculosis
AHRRAHGLPAISLGWGLWDQASA

SEQ ID NO: 1471305 - protein, 23 aa, Mycobacterium tuberculosis
AIAELRHLNPLNIVNLGNVGSYN

SEQ ID NO: 1471306 - protein, 27 aa, Mycobacterium tuberculosis
AIPGDLGDRFGFCIPDLAVWDNPSAND

SEQ ID NO: 1471307 - protein, 17 aa, Mycobacterium tuberculosis
AIRARRSLDSAAGWLAP

SEQ ID NO: 1471308 - protein, 19 aa, Mycobacterium tuberculosis
AKAALRYADALIWTPAHLA

SEQ ID NO: 1471309 - protein, 22 aa, Mycobacterium tuberculosis
AKARGANILARIMGASITSDGF

SEQ ID NO: 1471310 - protein, 17 aa, Mycobacterium tuberculosis
AKFASAVSKNPFVGEPI

SEQ ID NO: 1471311 - protein, 18 aa, Mycobacterium tuberculosis
AKQPKFEFNHVINNDDVA

SEQ ID NO: 1471312 - protein, 30 aa, Mycobacterium tuberculosis; identical to SEQ ID NO: 196561

SEQ ID NO: 1471313 - protein, 38 aa, Mycobacterium tuberculosis
ALAIPEIALTFGVDIPIHIPINIDAGVVTLQGFSIVAA

SEQ ID NO: 1471314 - protein, 19 aa, Mycobacterium tuberculosis
ALAKLRLPSPSGRAGIAVH

SEQ ID NO: 1471315 - protein, 18 aa, Mycobacterium tuberculosis
ALARAGFHTLKLQTFLTA

SEQ ID NO: 1471316 - protein, 20 aa, Mycobacterium tuberculosis
ALARRVSPTPVRLADERLTT

SEQ ID NO: 1471317 - protein, 17 aa, Mycobacterium tuberculosis
ALATLVVNAIRKTLKAV

SEQ ID NO: 1471318 - protein, 17 aa, Mycobacterium tuberculosis
ALDHPLLVERPEPKRAG

SEQ ID NO: 1471319 - protein, 18 aa, Mycobacterium tuberculosis
ALELTWRSLGEIGNLSSA

SEQ ID NO: 1471320 - protein, 18 aa, Mycobacterium tuberculosis
ALGRRRPDIAVTILRLAN

SEQ ID NO: 1471321 - protein, 18 aa, Mycobacterium tuberculosis
ALIEIRLCNERATPMPIP

SEQ ID NO: 1471322 - protein, 18 aa, Mycobacterium tuberculosis
ALIGYAQKRRDIVAITAA

SEQ ID NO: 1471323 - protein, 19 aa, Mycobacterium tuberculosis
ALIRFGVEAYEGADLREGV

SEQ ID NO: 1471324 - protein, 19 aa, Mycobacterium tuberculosis
ALRAKQCWTEPRAWETLQR

SEQ ID NO: 1471325 - protein, 20 aa, Mycobacterium tuberculosis
ALTRAAAFIHHLPVDQVFTL

SEQ ID NO: 1471326 - protein, 27 aa, Mycobacterium tuberculosis
ALYMDRYPLVSAISRPLIVKHLVAAAR

SEQ ID NO: 1471327 - protein, 22 aa, Mycobacterium tuberculosis
AMGFSAALDGCFKIHQLNHAHW

SEQ ID NO: 1471328 - protein, 24 aa, Mycobacterium tuberculosis
AMNLAVVLRATWAVARVLTDRGLA

SEQ ID NO: 1471329 - protein, 24 aa, Mycobacterium tuberculosis
AMVTAAQPYLAWLTYTAEAAAHAG

SEQ ID NO: 1471330 - protein, 23 aa, Mycobacterium tuberculosis
ANAQRGLSEAVVRDISAKKNEPD

SEQ ID NO: 1471331 - protein, 26 aa, Mycobacterium tuberculosis
ANGGAGGAGGWLFGNGGAGGNGGIGG

SEQ ID NO: 1471332 - protein, 27 aa, Mycobacterium tuberculosis
ANGGAGGNGGWLYGNGGLGGNGGAATQ

SEQ ID NO: 1471333 - protein, 18 aa, Mycobacterium tuberculosis
ANSLLLRRLQAERPGDAV

SEQ ID NO: 1471334 - protein, 17 aa, Mycobacterium tuberculosis
APAPPWAKMPIGEPPPA

SEQ ID NO: 1471335 - protein, 20 aa, Mycobacterium tuberculosis
APDASGYWPAPAVANYALSG

SEQ ID NO: 1471336 - protein, 19 aa, Mycobacterium tuberculosis
APDGGFGGNGGKGGQGGIG

SEQ ID NO: 1471337 - protein, 17 aa, Mycobacterium tuberculosis
APERLATRLQRYRRIGL

SEQ ID NO: 1471338 - protein, 26 aa, Mycobacterium tuberculosis
APGGIGVNTGTGWAYGGNGGNGGDGG

SEQ ID NO: 1471339 - protein, 20 aa, Mycobacterium tuberculosis
APGLLSWRDIARVMSENPAC

SEQ ID NO: 1471340 - protein, 34 aa, Mycobacterium tuberculosis; identical to SEQ ID NO: 196803

SEQ ID NO: 1471341 - protein, 18 aa, Mycobacterium tuberculosis
APTTGLLAAGADEVSAAI

SEQ ID NO: 1471342 - protein, 18 aa, Mycobacterium tuberculosis
APVIEKAYGAGPCSGHLT

SEQ ID NO: 1471343 - protein, 19 aa, Mycobacterium tuberculosis
APVVVGWPVGQLYANMTEW

SEQ ID NO: 1471344 - protein, 19 aa, Mycobacterium tuberculosis
APYAAWLAAAAVQAEQTAA

SEQ ID NO: 1471345 - protein, 23 aa, Mycobacterium tuberculosis
AQAAAFHQQFVRALSSAAGSYAA

SEQ ID NO: 1471346 - protein, 20 aa, Mycobacterium tuberculosis
AQARRIAEEIGYPVLVRPSY

SEQ ID NO: 1471347 - protein, 18 aa, Mycobacterium tuberculosis
AQFIRYEKPRSWLNSGGL

SEQ ID NO: 1471348 - protein, 17 aa, Mycobacterium tuberculosis
AQLCGYGPIPAAVARTM

SEQ ID NO: 1471349 - protein, 19 aa, Mycobacterium tuberculosis
AQMLAELVELFKTEALHRL

SEQ ID NO: 1471350 - protein, 20 aa, Mycobacterium tuberculosis
AQRALHRVVTLLAAGRPVLT

SEQ ID NO: 1471351 - protein, 18 aa, Mycobacterium tuberculosis
AQRPAVFIFNHRNQVDPV

SEQ ID NO: 1471352 - protein, 24 aa, Mycobacterium tuberculosis
AQTLLGRPLIGNGADGAPGTGQPG

SEQ ID NO: 1471353 - protein, 18 aa, Mycobacterium tuberculosis
AQTLPPGRGLLVGADGDV

SEQ ID NO: 1471354 - protein, 20 aa, Mycobacterium tuberculosis
ARAAPLVAILWGRDASTLKP

SEQ ID NO: 1471355 - protein, 18 aa, Mycobacterium tuberculosis
ARCARGWHDQGRHVWGWR

SEQ ID NO: 1471356 - protein, 17 aa, Mycobacterium tuberculosis
ARDGRWRAGIAVRGADD

SEQ ID NO: 1471357 - protein, 21 aa, Mycobacterium tuberculosis
ARGVPVAAPWDARRARELDDV

SEQ ID NO: 1471358 - protein, 17 aa, Mycobacterium tuberculosis
ARIKFPTPAACGRTPLV

SEQ ID NO: 1471359 - protein, 20 aa, Mycobacterium tuberculosis
ARISVRSVLHRHYLDVLRPL

SEQ ID NO: 1471360 - protein, 17 aa, Mycobacterium tuberculosis
ARKVAAWGADAMIVQGG

SEQ ID NO: 1471361 - protein, 17 aa, Mycobacterium tuberculosis
ARLAVTIGSRAHAELAL

SEQ ID NO: 1471362 - protein, 19 aa, Mycobacterium tuberculosis
ARLRVILRRAGKGNKEPRN

SEQ ID NO: 1471363 - protein, 18 aa, Mycobacterium tuberculosis
ARLSDGVLGVRAEYLAAA

SEQ ID NO: 1471364 - protein, 23 aa, Mycobacterium tuberculosis
ARPAPACRIDWEPADRAAHRDGV

SEQ ID NO: 1471365 - protein, 19 aa, Mycobacterium tuberculosis
ARPGARRSREDFEICATAQ

SEQ ID NO: 1471366 - protein, 17 aa, Mycobacterium tuberculosis
ARPVARRLFAVRAVVGL

SEQ ID NO: 1471367 - protein, 17 aa, Mycobacterium tuberculosis
ARQAGAVGLVVTTDWTF

SEQ ID NO: 1471368 - protein, 26 aa, Mycobacterium tuberculosis
ARRAILRYPKWRVAEIDGELETVALD

SEQ ID NO: 1471369 - protein, 20 aa, Mycobacterium tuberculosis
ARSGGTLVGYAGISRLGRTP

SEQ ID NO: 1471370 - protein, 17 aa, Mycobacterium tuberculosis
ARTVIDFAARRVNPPVY

SEQ ID NO: 1471371 - protein, 23 aa, Mycobacterium tuberculosis
ARVICRRSKLMTRIAGAGAMGSV

SEQ ID NO: 1471372 - protein, 17 aa, Mycobacterium tuberculosis
ARYVPQRVVEHLPERVI

SEQ ID NO: 1471373 - protein, 24 aa, Mycobacterium tuberculosis
ASASRWRIVSRYLPVGVAPEQGLQ

SEQ ID NO: 1471374 - protein, 19 aa, Mycobacterium tuberculosis
ASDDLLLVGGMRVRQRDKL

SEQ ID NO: 1471375 - protein, 22 aa, Mycobacterium tuberculosis
ASGELIATVAMPPRVPRAVDAD

SEQ ID NO: 1471376 - protein, 23 aa, Mycobacterium tuberculosis
ASGFYAKWLPKLVFGEGQLPTTY

SEQ ID NO: 1471377 - protein, 28 aa, Mycobacterium tuberculosis
ASGGKGGTGGWLWGSGGAGGAGGSGGGS

SEQ ID NO: 1471378 - protein, 18 aa, Mycobacterium tuberculosis
ASIARKLGALTVGVVTRP

SEQ ID NO: 1471379 - protein, 24 aa, Mycobacterium tuberculosis
ASIQRTGRCVVMHEGPRSLGYGAG

SEQ ID NO: 1471380 - protein, 17 aa, Mycobacterium tuberculosis
ASLERLVSLPAARAAEA

SEQ ID NO: 1471381 - protein, 24 aa, Mycobacterium tuberculosis
ASLPDAMGALLARSIVGIVEQVEQ

SEQ ID NO: 1471382 - protein, 18 aa, Mycobacterium tuberculosis
ASRYPYSRDGVIAVPAQA

SEQ ID NO: 1471383 - protein, 24 aa, Mycobacterium tuberculosis
ASVDCFRSQSGMKVMGFAVKTVDD

SEQ ID NO: 1471384 - protein, 18 aa, Mycobacterium tuberculosis
ATASRLVARLGPEAVRII

SEQ ID NO: 1471385 - protein, 20 aa, Mycobacterium tuberculosis
ATEDAWRRVFEFFGQHLRAG

SEQ ID NO: 1471386 - protein, 26 aa, Mycobacterium tuberculosis
ATLHHRASALIGRLMRELTADWDYSV

SEQ ID NO: 1471387 - protein, 19 aa, Mycobacterium tuberculosis
ATLVRAVCDGRRLVTLDGP

SEQ ID NO: 1471388 - protein, 18 aa, Mycobacterium tuberculosis
ATRPEVRGGLGGFAGLFT

SEQ ID NO: 1471389 - protein, 19 aa, Mycobacterium tuberculosis
ATSGRCFSAAPNFAFELAV

SEQ ID NO: 1471390 - protein, 23 aa, Mycobacterium tuberculosis
ATVSVAAWGIRLAREAERKAGES

SEQ ID NO: 1471391 - protein, 23 aa, Mycobacterium tuberculosis
AVAARLWPTTALIVDHGLQPGSA

SEQ ID NO: 1471392 - protein, 23 aa, Mycobacterium tuberculosis
AVADCGRLLAGRLHRAVDGASQL

SEQ ID NO: 1471393 - protein, 22 aa, Mycobacterium tuberculosis
AVASRVGAPLGHDYAVISLSDR

SEQ ID NO: 1471394 - protein, 17 aa, Mycobacterium tuberculosis
AVDIRYASADAKFSVRE

SEQ ID NO: 1471395 - protein, 18 aa, Mycobacterium tuberculosis
AVLTDWAAPVIEKAYGAG

SEQ ID NO: 1471396 - protein, 30 aa, Mycobacterium tuberculosis
AVNAPIQAVTGRPLIGNGANGAPGSGAPGG

SEQ ID NO: 1471397 - protein, 20 aa, Mycobacterium tuberculosis
AVPDHSFFGLLWADVKFEWH

SEQ ID NO: 1471398 - protein, 21 aa, Mycobacterium tuberculosis
AVPGGTAFPHCSGVLVAGDES

SEQ ID NO: 1471399 - protein, 18 aa, Mycobacterium tuberculosis
AVQLAVLVDRGHRELPLR

SEQ ID NO: 1471400 - protein, 20 aa, Mycobacterium tuberculosis
AVQRLRKERSIGLSEAVNEL

SEQ ID NO: 1471401 - protein, 21 aa, Mycobacterium tuberculosis
AVRGWRTGDIRPERYDRLAQL

SEQ ID NO: 1471402 - protein, 25 aa, Mycobacterium tuberculosis
AVSLRLHPDIRLFTAIPEQRSSTAE

SEQ ID NO: 1471403 - protein, 21 aa, Mycobacterium tuberculosis
AVTIPGFAINPFGLNVPLSGG

SEQ ID NO: 1471404 - protein, 23 aa, Mycobacterium tuberculosis
AVTSFRVGRHRAEVVAVADGITY

SEQ ID NO: 1471405 - protein, 22 aa, Mycobacterium tuberculosis
AWEARVRKRFAFLTDLDADEQR

SEQ ID NO: 1471406 - protein, 18 aa, Mycobacterium tuberculosis
AWEGLTFAEAAERDPELH

SEQ ID NO: 1471407 - protein, 19 aa, Mycobacterium tuberculosis
AYAPLPWLPDNIYREVVSR

SEQ ID NO: 1471408 - protein, 17 aa, Mycobacterium tuberculosis
CAARIVGGRCLMPASSA

SEQ ID NO: 1471409 - protein, 29 aa, Mycobacterium tuberculosis
CAELLDWPAKLRLLDGFRQRENLSWSAPR

SEQ ID NO: 1471410 - protein, 20 aa, Mycobacterium tuberculosis
CAITAYPDRGFTNAGTFAES

SEQ ID NO: 1471411 - protein, 19 aa, Mycobacterium tuberculosis
CARSRILVQRSVYDRFMEL

SEQ ID NO: 1471412 - protein, 22 aa, Mycobacterium tuberculosis
CDPELLTLWISRRVNTEALPGR

SEQ ID NO: 1471413 - protein, 20 aa, Mycobacterium tuberculosis
CGLAPSSIYWHFGSKEGVLA

SEQ ID NO: 1471414 - protein, 20 aa, Mycobacterium tuberculosis
CGLGHRKGRIAPGYDADLLA

SEQ ID NO: 1471415 - protein, 26 aa, Mycobacterium tuberculosis
CHGLQCGFCTPGMLITARALLDRNPD

SEQ ID NO: 1471416 - protein, 27 aa, Mycobacterium tuberculosis
CQEVLKQAAAFHGEFTRALAAAGAAYA

SEQ ID NO: 1471417 - protein, 18 aa, Mycobacterium tuberculosis
CRPPHCVASVSPARPSAG

SEQ ID NO: 1471418 - protein, 21 aa, Mycobacterium tuberculosis
CSHNAHMYYVLLAPSADREEV

SEQ ID NO: 1471419 - protein, 20 aa, Mycobacterium tuberculosis
CVNATLPIFADISAVQPNKD

SEQ ID NO: 1471420 - protein, 17 aa, Mycobacterium tuberculosis
DAAAIPEAHWRLGDACE

SEQ ID NO: 1471421 - protein, 20 aa, Mycobacterium tuberculosis
DAARPWLTRLCDERTVVAVL

SEQ ID NO: 1471422 - protein, 21 aa, Mycobacterium tuberculosis
DAELFPGSWSEWSSDPTRPVG

SEQ ID NO: 1471423 - protein, 22 aa, Mycobacterium tuberculosis
DAFAGAPIRVGAFLAEDHALRL

SEQ ID NO: 1471424 - protein, 17 aa, Mycobacterium tuberculosis
DAFVYPETMPAWFTEAD

SEQ ID NO: 1471425 - protein, 17 aa, Mycobacterium tuberculosis
DAGVPARRRGRGVASEV

SEQ ID NO: 1471426 - protein, 21 aa, Mycobacterium tuberculosis
DAIEDLHIWTAESVRADRLDF

SEQ ID NO: 1471427 - protein, 18 aa, Mycobacterium tuberculosis
DALEHFIDLVARVEAAAT

SEQ ID NO: 1471428 - protein, 22 aa, Mycobacterium tuberculosis
DALRPMMRLVVTNGTAKEIAGC

SEQ ID NO: 1471429 - protein, 17 aa, Mycobacterium tuberculosis
DAMMTDGRWDPGKDFAM

SEQ ID NO: 1471430 - protein, 20 aa, Mycobacterium tuberculosis
DAPCCVQIVPVAPLAFSSQI

SEQ ID NO: 1471431 - protein, 19 aa, Mycobacterium tuberculosis
DAPVLRRAQTRFANAPIRW

SEQ ID NO: 1471432 - protein, 26 aa, Mycobacterium tuberculosis
DARAYRLNWPAGTVVYEIDQPSVLEY

SEQ ID NO: 1471433 - protein, 17 aa, Mycobacterium tuberculosis
DAVAAFVESGRTVVLGL

SEQ ID NO: 1471434 - protein, 21 aa, Mycobacterium tuberculosis
DAWEDFLFWLAADRKTARRIT

SEQ ID NO: 1471435 - protein, 17 aa, Mycobacterium tuberculosis
DAWLGRIACGDRDLASL

SEQ ID NO: 1471436 - protein, 19 aa, Mycobacterium tuberculosis
DAYYEHGVQVWDCAAGALI

SEQ ID NO: 1471437 - protein, 17 aa, Mycobacterium tuberculosis
DDARPVLERASARETAA

SEQ ID NO: 1471438 - protein, 24 aa, Mycobacterium tuberculosis
DDGFVRVIYRWSRTGDLAAALAAA

SEQ ID NO: 1471439 - protein, 17 aa, Mycobacterium tuberculosis
DDIADWVEGARCAGMRA

SEQ ID NO: 1471440 - protein, 19 aa, Mycobacterium tuberculosis
DDTLPMLTGIRVEILGETV

SEQ ID NO: 1471441 - protein, 19 aa, Mycobacterium tuberculosis
DEGFARPGARRSREDFEIC

SEQ ID NO: 1471442 - protein, 21 aa, Mycobacterium tuberculosis
DEIRWDIRPSPHLGTLEVRIC

SEQ ID NO: 1471443 - protein, 17 aa, Mycobacterium tuberculosis
DELAAGPASRVAILLPA

SEQ ID NO: 1471444 - protein, 26 aa, Mycobacterium tuberculosis
DEPLVRRLWVLKVWGDVVDDRRGTRP

SEQ ID NO: 1471445 - protein, 27 aa, Mycobacterium tuberculosis
DEQRRWAAEGVQRGWQATMVLTEPDAG

SEQ ID NO: 1471446 - protein, 22 aa, Mycobacterium tuberculosis
DEVSAAIAALFSAHGQAYQAAS

SEQ ID NO: 1471447 - protein, 23 aa, Mycobacterium tuberculosis
DEVSAAIASLFAAHGQAYQAVSA

SEQ ID NO: 1471448 - protein, 22 aa, Mycobacterium tuberculosis
DEVSTAIAALFGSHGQHYQAIS

SEQ ID NO: 1471449 - protein, 21 aa, Mycobacterium tuberculosis
DEVYGIMLMHGWAVQHVECER

SEQ ID NO: 1471450 - protein, 19 aa, Mycobacterium tuberculosis
DFGGEVERGLSMVDGVLLL

SEQ ID NO: 1471451 - protein, 20 aa, Mycobacterium tuberculosis
DFLGPINWMRPLRAIAARHE

SEQ ID NO: 1471452 - protein, 17 aa, Mycobacterium tuberculosis
DGDYRFGQQIVVSHDGG

SEQ ID NO: 1471453 - protein, 24 aa, Mycobacterium tuberculosis
DGEPFVLHPGEFVLGSTLELFTLP

SEQ ID NO: 1471454 - protein, 19 aa, Mycobacterium tuberculosis
DGGFQLGRLAAILRDKRIP

SEQ ID NO: 1471455 - protein, 20 aa, Mycobacterium tuberculosis
DGGLPAWRSAGGSIETGQVS

SEQ ID NO: 1471456 - protein, 26 aa, Mycobacterium tuberculosis
DGGPSQGGGNPGFGGDGGTGGPGGVG

SEQ ID NO: 1471457 - protein, 18 aa, Mycobacterium tuberculosis
DGHYRIGLRPSGNGPTAI

SEQ ID NO: 1471458 - protein, 20 aa, Mycobacterium tuberculosis
DGIDPLRDVVMLGATNRPDL

SEQ ID NO: 1471459 - protein, 24 aa, Mycobacterium tuberculosis
DGLACVVLRVARFFVEGDDMPDLY

SEQ ID NO: 1471460 - protein, 22 aa, Mycobacterium tuberculosis
DGMAGWYFTKWQRVLNDGLDAV

SEQ ID NO: 1471461 - protein, 18 aa, Mycobacterium tuberculosis
DGMTYVGLVPFRMSSTKL

SEQ ID NO: 1471462 - protein, 18 aa, Mycobacterium tuberculosis
DGPPGVKGDGGNGGNGGN

SEQ ID NO: 1471463 - protein, 17 aa, Mycobacterium tuberculosis
DGSDFVFMDSQDYEQHP

SEQ ID NO: 1471464 - protein, 30 aa, Mycobacterium tuberculosis
DGVVWWQVVLQLPLLPGWPSSPSSPSAPPP

SEQ ID NO: 1471465 - protein, 20 aa, Mycobacterium tuberculosis
DIARGSLRLWSLAGGMPLHR

SEQ ID NO: 1471466 - protein, 24 aa, Mycobacterium tuberculosis
DIDHSAPWPLGPTHPSNLKCACRK

SEQ ID NO: 1471467 - protein, 21 aa, Mycobacterium tuberculosis
DIGGGFGNKVPIYPGYVCAIV

SEQ ID NO: 1471468 - protein, 18 aa, Mycobacterium tuberculosis
DIGRGRNGVLYAGEVNWD

SEQ ID NO: 1471469 - protein, 24 aa, Mycobacterium tuberculosis
DLIDPALLRPGRLERLVFVEPPDA

SEQ ID NO: 1471470 - protein, 18 aa, Mycobacterium tuberculosis
DLLVVRRGEKVVVEVSVV

SEQ ID NO: 1471471 - protein, 20 aa, Mycobacterium tuberculosis
DLMTAAATNLAEIGSAISTA

SEQ ID NO: 1471472 - protein, 18 aa, Mycobacterium tuberculosis
DLYWAARGAGPGFFGVVT

SEQ ID NO: 1471473 - protein, 17 aa, Mycobacterium tuberculosis
DMRSGRMSDDDWTRLAR

SEQ ID NO: 1471474 - protein, 24 aa, Mycobacterium tuberculosis
DMTKGYCPGGRWGFGDLAVCDGEK

SEQ ID NO: 1471475 - protein, 24 aa, Mycobacterium tuberculosis
DMTRRLAREEAMLVGGSCGMAVVA

SEQ ID NO: 1471476 - protein, 17 aa, Mycobacterium tuberculosis
DNLERVWAPKATGALRM

SEQ ID NO: 1471477 - protein, 27 aa, Mycobacterium tuberculosis
DPKTAVLNWKGDQVIVFVELSGSGARY

SEQ ID NO: 1471478 - protein, 18 aa, Mycobacterium tuberculosis
DPQRAGLVRSHFGARRKA

SEQ ID NO: 1471479 - protein, 24 aa, Mycobacterium tuberculosis
DPRMKANVGIRRRLAPLLDNDRNQ

SEQ ID NO: 1471480 - protein, 17 aa, Mycobacterium tuberculosis
DPSRLHPLATMERTFIA

SEQ ID NO: 1471481 - protein, 17 aa, Mycobacterium tuberculosis
DPSRRTSCLSGLGYPAS

SEQ ID NO: 1471482 - protein, 25 aa, Mycobacterium tuberculosis
DPVMCFSGPMIFGAGVLGGAQADLL

SEQ ID NO: 1471483 - protein, 21 aa, Mycobacterium tuberculosis
DPWLPSLGNPLTFLSPANIAF

SEQ ID NO: 1471484 - protein, 17 aa, Mycobacterium tuberculosis
DQHVWCFLGDGEMDEPE

SEQ ID NO: 1471485 - protein, 17 aa, Mycobacterium tuberculosis
DRFWLAVGRTRSNAYLL

SEQ ID NO: 1471486 - protein, 26 aa, Mycobacterium tuberculosis
DRGFYAGAVGWCDGRGDGHWVVSIRC

SEQ ID NO: 1471487 - protein, 26 aa, Mycobacterium tuberculosis
DRICIPVPFYHCFGMVMGNLAATSHG

SEQ ID NO: 1471488 - protein, 22 aa, Mycobacterium tuberculosis
DRIRYHGGEFIDLIVGGSTYDL

SEQ ID NO: 1471489 - protein, 28 aa, Mycobacterium tuberculosis
DRLARRAWQRFQAIEARGGFVEAHDFLA

SEQ ID NO: 1471490 - protein, 19 aa, Mycobacterium tuberculosis
DRNGALRMVRGVKNRFGAA

SEQ ID NO: 1471491 - protein, 23 aa, Mycobacterium tuberculosis
DRPAFKTCVAHGIVLGFDGQKMS

SEQ ID NO: 1471492 - protein, 34 aa, Mycobacterium tuberculosis
DRSAERCGSPAWDLPTVFGPIAITYNIKGVSTLN

SEQ ID NO: 1471493 - protein, 21 aa, Mycobacterium tuberculosis
DRVAAAAAFHPGGLVANSPDS

SEQ ID NO: 1471494 - protein, 17 aa, Mycobacterium tuberculosis
DSAGDLGDWGGPDALAD

SEQ ID NO: 1471495 - protein, 17 aa, Mycobacterium tuberculosis
DSFEWLIGSPRWRESAA

SEQ ID NO: 1471496 - protein, 19 aa, Mycobacterium tuberculosis
DSITLFPGGLAFPENPVVS

SEQ ID NO: 1471497 - protein, 28 aa, Mycobacterium tuberculosis
DSLLPLPNIPLLEYAARFITPVHPGYTA

SEQ ID NO: 1471498 - protein, 21 aa, Mycobacterium tuberculosis
DSLRIFPATHYVAGPERMAHA

SEQ ID NO: 1471499 - protein, 17 aa, Mycobacterium tuberculosis
DSVAWLAQRGILVAPGD

SEQ ID NO: 1471500 - protein, 25 aa, Mycobacterium tuberculosis
DSVPDEVWPAVVFTLVTLLDDPVAA

SEQ ID NO: 1471501 - protein, 26 aa, Mycobacterium tuberculosis
DTAYFGNAFPPNYLVNSHTSAEQVGE

SEQ ID NO: 1471502 - protein, 17 aa, Mycobacterium tuberculosis
DTLADAKALAGAHPDGI

SEQ ID NO: 1471503 - protein, 20 aa, Mycobacterium tuberculosis
DTPLPRVSIFLSILDAHVQR

SEQ ID NO: 1471504 - protein, 25 aa, Mycobacterium tuberculosis
DTSASVTCGIGFADLSSFTALTQAL

SEQ ID NO: 1471505 - protein, 17 aa, Mycobacterium tuberculosis
DTVVFPALRDVMSAVEF

SEQ ID NO: 1471506 - protein, 23 aa, Mycobacterium tuberculosis
DTWLRERPREMARTVFIELLAWQ

SEQ ID NO: 1471507 - protein, 20 aa, Mycobacterium tuberculosis
DTYGFPIELTLEMAAETGLQ

SEQ ID NO: 1471508 - protein, 18 aa, Mycobacterium tuberculosis
DVALLRLSFGRFGDEPAL

SEQ ID NO: 1471509 - protein, 24 aa, Mycobacterium tuberculosis
DVRANRLPKVSWLVPNILQSEHPA

SEQ ID NO: 1471510 - protein, 22 aa, Mycobacterium tuberculosis
DVSAAIAALFATHGQAYQELSA

SEQ ID NO: 1471511 - protein, 24 aa, Mycobacterium tuberculosis
DVVHYGNGVSIVYADVPTTVDFGG

SEQ ID NO: 1471512 - protein, 18 aa, Mycobacterium tuberculosis
DVVNKVWFLDAVRGQVDV

SEQ ID NO: 1471513 - protein, 22 aa, Mycobacterium tuberculosis
EAANAGPNMLAAVNAPAQALLG

SEQ ID NO: 1471514 - protein, 20 aa, Mycobacterium tuberculosis
EAGLHLVGVFTFPGHSYAPG

SEQ ID NO: 1471515 - protein, 17 aa, Mycobacterium tuberculosis
EAGSPVWHQLTTRDYRS

SEQ ID NO: 1471516 - protein, 26 aa, Mycobacterium tuberculosis
EANIAPWLRAAHRYGAKVKWAEVDIE

SEQ ID NO: 1471517 - protein, 20 aa, Mycobacterium tuberculosis
EAPPVPVAYSVNWDAIAQCE

SEQ ID NO: 1471518 - protein, 18 aa, Mycobacterium tuberculosis
EATFFNFEFPRNGFQLRR

SEQ ID NO: 1471519 - protein, 22 aa, Mycobacterium tuberculosis
EATSAAPLQDLLGVVNAPAQAL

SEQ ID NO: 1471520 - protein, 19 aa, Mycobacterium tuberculosis
EAVMNRFSPQQAQLTLIDP

SEQ ID NO: 1471521 - protein, 17 aa, Mycobacterium tuberculosis
EAVNLALRTLLGEADTA

SEQ ID NO: 1471522 - protein, 19 aa, Mycobacterium tuberculosis
ECRSMFDAAVKSYQSGDLA

SEQ ID NO: 1471523 - protein, 18 aa, Mycobacterium tuberculosis
EDHLDWHATMAEYTAAKA

SEQ ID NO: 1471524 - protein, 18 aa, Mycobacterium tuberculosis
EDPDTVLLGTDFGGDSLT

SEQ ID NO: 1471525 - protein, 22 aa, Mycobacterium tuberculosis
EDRYLEVWNLVFMQNERGEGTT

SEQ ID NO: 1471526 - protein, 21 aa, Mycobacterium tuberculosis
EDVPGFCKSATLAEIKATDYA

SEQ ID NO: 1471527 - protein, 22 aa, Mycobacterium tuberculosis
EEADRLAARLARIDDIEGDRDR

SEQ ID NO: 1471528 - protein, 18 aa, Mycobacterium tuberculosis
EEGLEGAGLSELGAAEAA

SEQ ID NO: 1471529 - protein, 21 aa, Mycobacterium tuberculosis
EELLRGADMVFVTAGEGGGTG

SEQ ID NO: 1471530 - protein, 23 aa, Mycobacterium tuberculosis
EESRGRLSAVVQRELADEAYHGG

SEQ ID NO: 1471531 - protein, 17 aa, Mycobacterium tuberculosis
EFFATIRAAGYTRVSLG

SEQ ID NO: 1471532 - protein, 26 aa, Mycobacterium tuberculosis
EFISWEPFTRMAFRFNECSTRAVGAF

SEQ ID NO: 1471533 - protein, 38 aa, Mycobacterium tuberculosis; identical to SEQ ID NO: 233359

SEQ ID NO: 1471534 - protein, 18 aa, Mycobacterium tuberculosis
EFSRACESLYHFAWDEFC

SEQ ID NO: 1471535 - protein, 19 aa, Mycobacterium tuberculosis
EFVAPVVAYLCTEECADNA

SEQ ID NO: 1471536 - protein, 25 aa, Mycobacterium tuberculosis
EGPLPQTRFVLRKALAAHLPVILVV

SEQ ID NO: 1471537 - protein, 18 aa, Mycobacterium tuberculosis
EGRLRRFDCSQMTDGGAG

SEQ ID NO: 1471538 - protein, 17 aa, Mycobacterium tuberculosis
EGVLASAARLVLGQLGL

SEQ ID NO: 1471539 - protein, 20 aa, Mycobacterium tuberculosis
EHDPRLAAAERSELDALITC

SEQ ID NO: 1471540 - protein, 22 aa, Mycobacterium tuberculosis
EHKERRLAEIAASGVTRIGGVI

SEQ ID NO: 1471541 - protein, 23 aa, Mycobacterium tuberculosis
EHPFPVWTERGGPATIVPMFLLY

SEQ ID NO: 1471542 - protein, 22 aa, Mycobacterium tuberculosis
EIEPRSGRHLGNFPQAFTHLAL

SEQ ID NO: 1471543 - protein, 17 aa, Mycobacterium tuberculosis
EIRAHALAIGDDLVGRG

SEQ ID NO: 1471544 - protein, 24 aa, Mycobacterium tuberculosis
ELAELRLALMHGRLSADDKDAAMA

SEQ ID NO: 1471545 - protein, 17 aa, Mycobacterium tuberculosis
ELIARIRAVLRRGGDDD

SEQ ID NO: 1471546 - protein, 18 aa, Mycobacterium tuberculosis
ELLQRPGQRLAYNGRLLE

SEQ ID NO: 1471547 - protein, 22 aa, Mycobacterium tuberculosis
ELPGEPPRLFVVTRSAASVLPS

SEQ ID NO: 1471548 - protein, 21 aa, Mycobacterium tuberculosis
ELTPYRGAWCGNDVWRGALPP

SEQ ID NO: 1471549 - protein, 17 aa, Mycobacterium tuberculosis
ENIREVHRADLIGQHIG

SEQ ID NO: 1471550 - protein, 17 aa, Mycobacterium tuberculosis
EPGHGLALAALGLDPIV

SEQ ID NO: 1471551 - protein, 24 aa, Mycobacterium tuberculosis
EPHYGPPPLLLRMVEAGQLGKKSG

SEQ ID NO: 1471552 - protein, 19 aa, Mycobacterium tuberculosis
EPPTRPAPQHSRRARRGHR

SEQ ID NO: 1471553 - protein, 19 aa, Mycobacterium tuberculosis
EPRFIKLTGELASEQTLSF

SEQ ID NO: 1471554 - protein, 20 aa, Mycobacterium tuberculosis
EQALRFGADLRMEDVESVSL

SEQ ID NO: 1471555 - protein, 19 aa, Mycobacterium tuberculosis
EQANINWGKAGRMRWKGKR

SEQ ID NO: 1471556 - protein, 19 aa, Mycobacterium tuberculosis
EQQRLRRILDTVARQEPGL

SEQ ID NO: 1471557 - protein, 24 aa, Mycobacterium tuberculosis
EQQWLPRIAAHLGVASPVPVGLGS

SEQ ID NO: 1471558 - protein, 17 aa, Mycobacterium tuberculosis
EQWLKTTGLNTLRPDFE

SEQ ID NO: 1471559 - protein, 23 aa, Mycobacterium tuberculosis
ERALAQRPAWLAAAEALTTEGAD

SEQ ID NO: 1471560 - protein, 17 aa, Mycobacterium tuberculosis
ERARQAGAVGLVVTTDW

SEQ ID NO: 1471561 - protein, 18 aa, Mycobacterium tuberculosis
ERFRRGRDRIPLTGRIAV

SEQ ID NO: 1471562 - protein, 19 aa, Mycobacterium tuberculosis
ERPEPKRAGVLVVSSDRGL

SEQ ID NO: 1471563 - protein, 17 aa, Mycobacterium tuberculosis
ERVGKRGLGFGAEVRSK

SEQ ID NO: 1471564 - protein, 17 aa, Mycobacterium tuberculosis
ESEINGLITSWRGPSST

SEQ ID NO: 1471565 - protein, 20 aa, Mycobacterium tuberculosis
ESELRAAVNAARAAGDTWAA

SEQ ID NO: 1471566 - protein, 18 aa, Mycobacterium tuberculosis
ESLASRWLADRIAADSTV

SEQ ID NO: 1471567 - protein, 19 aa, Mycobacterium tuberculosis
ESLTEVWRTDGYCHCMFTA

SEQ ID NO: 1471568 - protein, 19 aa, Mycobacterium tuberculosis
ESPDAYDLELMWDANDDNQ

SEQ ID NO: 1471569 - protein, 19 aa, Mycobacterium tuberculosis
ETAELLYGTALLAEGGALE

SEQ ID NO: 1471570 - protein, 17 aa, Mycobacterium tuberculosis
ETLAFFAGIGIPIAEIW

SEQ ID NO: 1471571 - protein, 24 aa, Mycobacterium tuberculosis
ETLIQCGWFQIRISASDVVAASTR

SEQ ID NO: 1471572 - protein, 18 aa, Mycobacterium tuberculosis
ETTPGGGVTIVIPGHENV

SEQ ID NO: 1471573 - protein, 32 aa, Mycobacterium tuberculosis; identical to SEQ ID NO: 198861

SEQ ID NO: 1471574 - protein, 21 aa, Mycobacterium tuberculosis
EVEPRMLLVHFLRDQLRLTGT

SEQ ID NO: 1471575 - protein, 17 aa, Mycobacterium tuberculosis
EVGGRVTSPPQPPVAAL

SEQ ID NO: 1471576 - protein, 17 aa, Mycobacterium tuberculosis
EVRAVPAAAQASVLVLP

SEQ ID NO: 1471577 - protein, 19 aa, Mycobacterium tuberculosis
EVRHVPPGDMPGGTAAADA

SEQ ID NO: 1471578 - protein, 23 aa, Mycobacterium tuberculosis
EVRRARKSIAQFKLREGMPVGVR

SEQ ID NO: 1471579 - protein, 27 aa, Mycobacterium tuberculosis
EVSAAVSRLFGAYGQQFQALNARAATF

SEQ ID NO: 1471580 - protein, 27 aa, Mycobacterium tuberculosis
EVVQRPAGRARSRWFSDYLRTVTQRDV

SEQ ID NO: 1471581 - protein, 17 aa, Mycobacterium tuberculosis
EVVSYPATIGVLSGSLG

SEQ ID NO: 1471582 - protein, 21 aa, Mycobacterium tuberculosis
EVYELRGSELIRIEAPTDASV

SEQ ID NO: 1471583 - protein, 17 aa, Mycobacterium tuberculosis
FAAVALASIRELGLNPQ

SEQ ID NO: 1471584 - protein, 18 aa, Mycobacterium tuberculosis
FADRALVMYAGRVVESAG

SEQ ID NO: 1471585 - protein, 27 aa, Mycobacterium tuberculosis
FAGFGGSAGGGGWVGAVNFGPISVQGF

SEQ ID NO: 1471586 - protein, 24 aa, Mycobacterium tuberculosis
FAKLREPLEVPGLLDVQTDSFEWL

SEQ ID NO: 1471587 - protein, 20 aa, Mycobacterium tuberculosis
FAPRELVELAVAAEAHGMDS

SEQ ID NO: 1471588 - protein, 17 aa, Mycobacterium tuberculosis
FASEVAMEIALNAVRIH

SEQ ID NO: 1471589 - protein, 20 aa, Mycobacterium tuberculosis
FDASAAVAQLAPWQQVLRNL

SEQ ID NO: 1471590 - protein, 17 aa, Mycobacterium tuberculosis
FDAWRFENRCELLAFRH

SEQ ID NO: 1471591 - protein, 20 aa, Mycobacterium tuberculosis
FDGDGMIHVVGFRDGKAFYR

SEQ ID NO: 1471592 - protein, 18 aa, Mycobacterium tuberculosis
FDLDDTWIGGSSAFMTDA

SEQ ID NO: 1471593 - protein, 18 aa, Mycobacterium tuberculosis
FDTELGPVVANFLLADEI

SEQ ID NO: 1471594 - protein, 17 aa, Mycobacterium tuberculosis
FDTRRGMVVGSPVDLVD

SEQ ID NO: 1471595 - protein, 19 aa, Mycobacterium tuberculosis
FEALSALSAGVKEVRAVIE

SEQ ID NO: 1471596 - protein, 26 aa, Mycobacterium tuberculosis
FEDLVIRLLEAMGYGRAGAVERTSAS

SEQ ID NO: 1471597 - protein, 25 aa, Mycobacterium tuberculosis
FEVEGGIIRVAEGWAHGPQVDKGVK

SEQ ID NO: 1471598 - protein, 22 aa, Mycobacterium tuberculosis
FEWLIGSPRWRESAAERGDVNP

SEQ ID NO: 1471599 - protein, 18 aa, Mycobacterium tuberculosis
FFRISPREATAMDPQQRV

SEQ ID NO: 1471600 - protein, 26 aa, Mycobacterium tuberculosis
FGAGGIGGAGGPGFNGGAGGAGGRSG

SEQ ID NO: 1471601 - protein, 19 aa, Mycobacterium tuberculosis
FGGSGARLMTTVLHHMPDK

SEQ ID NO: 1471602 - protein, 23 aa, Mycobacterium tuberculosis
FGLEIPGNIYTRIGNPTTDVVEQ

SEQ ID NO: 1471603 - protein, 27 aa, Mycobacterium tuberculosis
FGNKGTGLFSGFMSGFGNTGFLQSGFG

SEQ ID NO: 1471604 - protein, 24 aa, Mycobacterium tuberculosis
FGRRVAVVACEFDFLGGSIGVAAA

SEQ ID NO: 1471605 - protein, 17 aa, Mycobacterium tuberculosis
FGSVRVVEPAEWTRSNR

SEQ ID NO: 1471606 - protein, 19 aa, Mycobacterium tuberculosis
FHGFRQGRNPFWDRLSRAM

SEQ ID NO: 1471607 - protein, 28 aa, Mycobacterium tuberculosis
FINLELIDSPTLPTCERIAVLSQSGVNL

SEQ ID NO: 1471608 - protein, 20 aa, Mycobacterium tuberculosis
FITGRIKELLVVDGANHYPE

SEQ ID NO: 1471609 - protein, 20 aa, Mycobacterium tuberculosis
FKTHGCQPWQNTGSEGAAPA

SEQ ID NO: 1471610 - protein, 23 aa, Mycobacterium tuberculosis
FLARLCKTAIWIDHGVIRLAGGI

SEQ ID NO: 1471611 - protein, 18 aa, Mycobacterium tuberculosis
FLCACGPAYLPERDQRMG

SEQ ID NO: 1471612 - protein, 18 aa, Mycobacterium tuberculosis
FLDRGLRDTGRCRVPLIL

SEQ ID NO: 1471613 - protein, 26 aa, Mycobacterium tuberculosis
FLTACQRRYGSVFTLHVAGFGHMVYL

SEQ ID NO: 1471614 - protein, 20 aa, Mycobacterium tuberculosis
FNGAGARVPGMIRLVRHSIA

SEQ ID NO: 1471615 - protein, 17 aa, Mycobacterium tuberculosis
FNRPLRPLAPVAHLDFD

SEQ ID NO: 1471616 - protein, 17 aa, Mycobacterium tuberculosis
FPARAFDALDALVASAA

SEQ ID NO: 1471617 - protein, 19 aa, Mycobacterium tuberculosis
FPDRPALELDGWAYARPLA

SEQ ID NO: 1471618 - protein, 21 aa, Mycobacterium tuberculosis
FPGGLTIPAMNPLSINLSGGT

SEQ ID NO: 1471619 - protein, 20 aa, Mycobacterium tuberculosis
FPILKRIMRGGNPLAYLDSG

SEQ ID NO: 1471620 - protein, 19 aa, Mycobacterium tuberculosis
FRPEFFAAMRELCDEFDAL

SEQ ID NO: 1471621 - protein, 20 aa, Mycobacterium tuberculosis
FRPVALESLSHFPVTVAAHR

SEQ ID NO: 1471622 - protein, 17 aa, Mycobacterium tuberculosis
FRQSACPLFNPNSAIAL

SEQ ID NO: 1471623 - protein, 17 aa, Mycobacterium tuberculosis
FSPGKGLGVIPREGYFQ

SEQ ID NO: 1471624 - protein, 25 aa, Mycobacterium tuberculosis
FSTLLGVPMESMIGLLAVAALDDLD

SEQ ID NO: 1471625 - protein, 19 aa, Mycobacterium tuberculosis
FSTLLSNAGTIFWNGPMGV

SEQ ID NO: 1471626 - protein, 23 aa, Mycobacterium tuberculosis
FTGAFGPVVVPPIPVPAINAHLT

SEQ ID NO: 1471627 - protein, 19 aa, Mycobacterium tuberculosis
FTLYHLPVALQLPPGATGV

SEQ ID NO: 1471628 - protein, 17 aa, Mycobacterium tuberculosis
FTRRSHAWLEQQTGCRK

SEQ ID NO: 1471629 - protein, 23 aa, Mycobacterium tuberculosis
FTSEVRGVFTYRVNKAGLITNMR

SEQ ID NO: 1471630 - protein, 23 aa, Mycobacterium tuberculosis
FVAEAIAVLGARVAGSSLAGFAT

SEQ ID NO: 1471631 - protein, 18 aa, Mycobacterium tuberculosis
FYFLTGRGALLQLGLLQL

SEQ ID NO: 1471632 - protein, 22 aa, Mycobacterium tuberculosis
FYLQYFGCRPYFAERVGGFTMR

SEQ ID NO: 1471633 - protein, 19 aa, Mycobacterium tuberculosis
GACDSTLLIAERVQSYADV

SEQ ID NO: 1471634 - protein, 25 aa, Mycobacterium tuberculosis
GADEISAAIAALFGAHGRAYQAASA

SEQ ID NO: 1471635 - protein, 25 aa, Mycobacterium tuberculosis
GADEVSAAIAALFSGHAQAYQALSA

SEQ ID NO: 1471636 - protein, 26 aa, Mycobacterium tuberculosis
GADEVSVAISALFGSHAQGYQTLSAQ

SEQ ID NO: 1471637 - protein, 24 aa, Mycobacterium tuberculosis
GAGCGGSARFGLGGDRKRGGAGCG

SEQ ID NO: 1471638 - protein, 21 aa, Mycobacterium tuberculosis
GAGGDGFGFVGAGGNGGNAGT

SEQ ID NO: 1471639 - protein, 21 aa, Mycobacterium tuberculosis
GAGGPAGLIGVGGAGGAGGDS

SEQ ID NO: 1471640 - protein, 23 aa, Mycobacterium tuberculosis
GAGGRAGGGVGGIGGAGGAGGNG

SEQ ID NO: 1471641 - protein, 17 aa, Mycobacterium tuberculosis
GAGGSARGLIFALGGAG

SEQ ID NO: 1471642 - protein, 20 aa, Mycobacterium tuberculosis
GAGGSGRTDLGGAGGAGGKA

SEQ ID NO: 1471643 - protein, 26 aa, Mycobacterium tuberculosis
GAGISRPTFYFYFPSKEAVLLTLLDR

SEQ ID NO: 1471644 - protein, 17 aa, Mycobacterium tuberculosis
GAIAFSSVLSYPVVAEQ

SEQ ID NO: 1471645 - protein, 30 aa, Mycobacterium tuberculosis; identical to SEQ ID NO: 199503

SEQ ID NO: 1471646 - protein, 17 aa, Mycobacterium tuberculosis
GALAGAMRPPAPPAAPP

SEQ ID NO: 1471647 - protein, 18 aa, Mycobacterium tuberculosis
GALKPARLLVSGSAALPV

SEQ ID NO: 1471648 - protein, 18 aa, Mycobacterium tuberculosis
GANGISAFMVHKDDEGFT

SEQ ID NO: 1471649 - protein, 19 aa, Mycobacterium tuberculosis
GARGYAHIGVIQALRERGY

SEQ ID NO: 1471650 - protein, 18 aa, Mycobacterium tuberculosis
GCDHEIRSGTAHVVVWPT

SEQ ID NO: 1471651 - protein, 21 aa, Mycobacterium tuberculosis
GCGDGAFRLGTMPIEVESSVA

SEQ ID NO: 1471652 - protein, 24 aa, Mycobacterium tuberculosis
GCGIKASMGMGAIRVQPLAPREKC

SEQ ID NO: 1471653 - protein, 17 aa, Mycobacterium tuberculosis
GCRVHPLGEMRYLPVAS

SEQ ID NO: 1471654 - protein, 17 aa, Mycobacterium tuberculosis
GCYVGASALEYGPALTE

SEQ ID NO: 1471655 - protein, 19 aa, Mycobacterium tuberculosis
GDDDRLHGMLTDRDIVIKG

SEQ ID NO: 1471656 - protein, 23 aa, Mycobacterium tuberculosis
GDEVSAAIAALFSSHGQQYQAMS

SEQ ID NO: 1471657 - protein, 19 aa, Mycobacterium tuberculosis
GDGQIGIGGLNSGSGNIGF

SEQ ID NO: 1471658 - protein, 21 aa, Mycobacterium tuberculosis
GDGWVHFDAPAGMLIPDSVAT

SEQ ID NO: 1471659 - protein, 24 aa, Mycobacterium tuberculosis
GDHRMLPRATFCQPNVASFGLTEQ

SEQ ID NO: 1471660 - protein, 19 aa, Mycobacterium tuberculosis
GDLRSLFAFLADRGSSLDA

SEQ ID NO: 1471661 - protein, 22 aa, Mycobacterium tuberculosis
GDSRRANLWAADRYNRAIARGH

SEQ ID NO: 1471662 - protein, 23 aa, Mycobacterium tuberculosis
GDSSSWKGWGHVRWFIEEVPAGA

SEQ ID NO: 1471663 - protein, 17 aa, Mycobacterium tuberculosis
GEFIDLIVGGSTYDLAA

SEQ ID NO: 1471664 - protein, 18 aa, Mycobacterium tuberculosis
GEHPMFKAMAAGLSSLAG

SEQ ID NO: 1471665 - protein, 22 aa, Mycobacterium tuberculosis
GEIEWAKASLIGPEEYVTAVAA

SEQ ID NO: 1471666 - protein, 17 aa, Mycobacterium tuberculosis
GELARIGVAADIGAAPA

SEQ ID NO: 1471667 - protein, 27 aa, Mycobacterium tuberculosis
GELFIMGRIKDLLIVDGRNHYPDDIEA

SEQ ID NO: 1471668 - protein, 18 aa, Mycobacterium tuberculosis
GELREIFSAVQIIADTER

SEQ ID NO: 1471669 - protein, 43 aa, Mycobacterium tuberculosis
GEPGKPVRLPIPWRDVGGYRPTGRSIAACRRGEPRGLHEFAAA

SEQ ID NO: 1471670 - protein, 20 aa, Mycobacterium tuberculosis
GEPHAISAMHGRGVADLLDG

SEQ ID NO: 1471671 - protein, 17 aa, Mycobacterium tuberculosis
GERLDAKALVAFTQSGD

SEQ ID NO: 1471672 - protein, 19 aa, Mycobacterium tuberculosis
GFDRLRLIQRITDRLPAKA

SEQ ID NO: 1471673 - protein, 24 aa, Mycobacterium tuberculosis
GFDSADLSLPWGQDALIAAVASAN

SEQ ID NO: 1471674 - protein, 20 aa, Mycobacterium tuberculosis
GFERSKYASGEFFDKYTDQI

SEQ ID NO: 1471675 - protein, 18 aa, Mycobacterium tuberculosis
GGAAGFAGGVGGAGGEGL

SEQ ID NO: 1471676 - protein, 17 aa, Mycobacterium tuberculosis
GGADLAAIAGFCAQAAV

SEQ ID NO: 1471677 - protein, 34 aa, Mycobacterium tuberculosis; identical to SEQ ID NO: 199788

SEQ ID NO: 1471678 - protein, 22 aa, Mycobacterium tuberculosis
GGAGGNALMFGIGGNGGAGGAA

SEQ ID NO: 1471679 - protein, 21 aa, Mycobacterium tuberculosis
GGAGSIGFNASAPGAAGSPGG

SEQ ID NO: 1471680 - protein, 22 aa, Mycobacterium tuberculosis
GGEITARFLISACGILTVPKLP

SEQ ID NO: 1471681 - protein, 17 aa, Mycobacterium tuberculosis
GGFGILGAVAHSPKRLE

SEQ ID NO: 1471682 - protein, 24 aa, Mycobacterium tuberculosis
GGLFASGGSGGFGGFASTGTGGAG

SEQ ID NO: 1471683 - protein, 24 aa, Mycobacterium tuberculosis
GGLGGGGGSLFGNGGAGGVGATGG

SEQ ID NO: 1471684 - protein, 18 aa, Mycobacterium tuberculosis
GGLSGVLRVPPRPYVMPH

SEQ ID NO: 1471685 - protein, 23 aa, Mycobacterium tuberculosis
GGNGGAGGMLLGDGGAGGQGGPA

SEQ ID NO: 1471686 - protein, 28 aa, Mycobacterium tuberculosis
GGNGSKGLPGLGRLGNPGLDGGTGGNGG

SEQ ID NO: 1471687 - protein, 17 aa, Mycobacterium tuberculosis
GGPRKVSPLAVQMIMPN

SEQ ID NO: 1471688 - protein, 18 aa, Mycobacterium tuberculosis
GGSGTPIPSARYVELANA

SEQ ID NO: 1471689 - protein, 17 aa, Mycobacterium tuberculosis
GGTAGFLTGFRRAGRRH

SEQ ID NO: 1471690 - protein, 22 aa, Mycobacterium tuberculosis
GGTGGDALGLIGAGIGGVGGVG

SEQ ID NO: 1471691 - protein, 27 aa, Mycobacterium tuberculosis
GGTGGKGGDGFGVFGKGGAGGTGGRGG

SEQ ID NO: 1471692 - protein, 17 aa, Mycobacterium tuberculosis
GGVTIVIPGHENVTLPH

SEQ ID NO: 1471693 - protein, 17 aa, Mycobacterium tuberculosis
GGVTLGLLSAWRGPNGQ

SEQ ID NO: 1471694 - protein, 23 aa, Mycobacterium tuberculosis
GIAFLRAPCRVVYVIDEPDVRGF

SEQ ID NO: 1471695 - protein, 20 aa, Mycobacterium tuberculosis
GIDNARRAELIERFGLDPTK

SEQ ID NO: 1471696 - protein, 17 aa, Mycobacterium tuberculosis
GIELPRRIFAHGFLHNR

SEQ ID NO: 1471697 - protein, 19 aa, Mycobacterium tuberculosis
GIGRRLLRELLDFARGGVV

SEQ ID NO: 1471698 - protein, 18 aa, Mycobacterium tuberculosis
GIGSALAAANRAAEAPTT

SEQ ID NO: 1471699 - protein, 23 aa, Mycobacterium tuberculosis
GKARWYRNRWVRTPAVCAALGEP

SEQ ID NO: 1471700 - protein, 23 aa, Mycobacterium tuberculosis
GKHLRVGVTSIYWYFRKKDDLLN

SEQ ID NO: 1471701 - protein, 22 aa, Mycobacterium tuberculosis
GKLSLPPNWAGASPSLAPTVGS

SEQ ID NO: 1471702 - protein, 17 aa, Mycobacterium tuberculosis
GKSRLALQIGAQIAHEF

SEQ ID NO: 1471703 - protein, 24 aa, Mycobacterium tuberculosis
GKSTLLLEVAHRWAQSGRRALYVS

SEQ ID NO: 1471704 - protein, 18 aa, Mycobacterium tuberculosis
GKTLAAAKAEALKCAKGF

SEQ ID NO: 1471705 - protein, 22 aa, Mycobacterium tuberculosis
GLADRRLYLAANRCLAIAARRV

SEQ ID NO: 1471706 - protein, 20 aa, Mycobacterium tuberculosis
GLAVRPGYVLSDGFRVPGLP

SEQ ID NO: 1471707 - protein, 18 aa, Mycobacterium tuberculosis
GLDHCFGPVMLHRVEATV

SEQ ID NO: 1471708 - protein, 26 aa, Mycobacterium tuberculosis
GLDTRAYRLPWPPGTVVYEIDQPAVI

SEQ ID NO: 1471709 - protein, 20 aa, Mycobacterium tuberculosis
GLETLSLRIERHVANAQRVA

SEQ ID NO: 1471710 - protein, 17 aa, Mycobacterium tuberculosis
GLFAGITARYLALVATT

SEQ ID NO: 1471711 - protein, 30 aa, Mycobacterium tuberculosis
GLGGGSFGLPGLNGSCGDGGDGGNGAPGGV

SEQ ID NO: 1471712 - protein, 20 aa, Mycobacterium tuberculosis
GLGSVPSRILCAGKLRQSIQ

SEQ ID NO: 1471713 - protein, 28 aa, Mycobacterium tuberculosis
GLLNRLSAFKVPHRFAVVDRLPRTPNGK

SEQ ID NO: 1471714 - protein, 22 aa, Mycobacterium tuberculosis
GLLPPTFSLVGFARRDWSTQDF

SEQ ID NO: 1471715 - protein, 18 aa, Mycobacterium tuberculosis
GLMGRRIAGVLASAGLDV

SEQ ID NO: 1471716 - protein, 29 aa, Mycobacterium tuberculosis
GLPGNPGAVPGRAGGAGGLGGSGSDTSEG

SEQ ID NO: 1471717 - protein, 24 aa, Mycobacterium tuberculosis
GLPYLGLEHRAAWVEAEADGTITS

SEQ ID NO: 1471718 - protein, 17 aa, Mycobacterium tuberculosis
GLVGFSYSIEITGSTLV

SEQ ID NO: 1471719 - protein, 23 aa, Mycobacterium tuberculosis
GMRARSALTTALLRSRTNGPCRA

SEQ ID NO: 1471720 - protein, 19 aa, Mycobacterium tuberculosis
GNADFRYNTVITEETCAGR

SEQ ID NO: 1471721 - protein, 33 aa, Mycobacterium tuberculosis; identical to SEQ ID NO: 209467

SEQ ID NO: 1471722 - protein, 25 aa, Mycobacterium tuberculosis
GNGGRGADATGFGQTGASGGRGGDG

SEQ ID NO: 1471723 - protein, 25 aa, Mycobacterium tuberculosis
GNGGSGGSLFGFGGAGGTGGSSGIG

SEQ ID NO: 1471724 - protein, 17 aa, Mycobacterium tuberculosis
GNGGWLWGNGGNGGSGA

SEQ ID NO: 1471725 - protein, 18 aa, Mycobacterium tuberculosis
GNGLNLVGVPGTAGGGAD

SEQ ID NO: 1471726 - protein, 19 aa, Mycobacterium tuberculosis
GNIFLITGIGYYPSLGVKD

SEQ ID NO: 1471727 - protein, 29 aa, Mycobacterium tuberculosis
GNLMLYSRLRLATAASWSIRYVVERRAIG

SEQ ID NO: 1471728 - protein, 17 aa, Mycobacterium tuberculosis
GNLVLMVQPPRGFGENP

SEQ ID NO: 1471729 - protein, 19 aa, Mycobacterium tuberculosis
GNTGFFDAGNYNFGSLNAG

SEQ ID NO: 1471730 - protein, 35 aa, Mycobacterium tuberculosis; identical to SEQ ID NO: 200154

SEQ ID NO: 1471731 - protein, 21 aa, Mycobacterium tuberculosis
GPHALKGRFSGVAMAAVDDDE

SEQ ID NO: 1471732 - protein, 25 aa, Mycobacterium tuberculosis
GPIHIGLPLSLTIPGFTIPGGTLIP

SEQ ID NO: 1471733 - protein, 24 aa, Mycobacterium tuberculosis
GPMDRFHRRLLWPIRTSAGEVVGF

SEQ ID NO: 1471734 - protein, 27 aa, Mycobacterium tuberculosis
GPSGVAVSPVTGLVFVTNFDSNTVSVI

SEQ ID NO: 1471735 - protein, 19 aa, Mycobacterium tuberculosis
GPVVGVWRRAPLQALARLH

SEQ ID NO: 1471736 - protein, 21 aa, Mycobacterium tuberculosis
GQAALSQNFIGAGGTAGAGGT

SEQ ID NO: 1471737 - protein, 17 aa, Mycobacterium tuberculosis
GQAGGNGGWLWGNGGNG

SEQ ID NO: 1471738 - protein, 18 aa, Mycobacterium tuberculosis
GQFGKWLQGARDWSISRN

SEQ ID NO: 1471739 - protein, 18 aa, Mycobacterium tuberculosis
GQGGLLRGIPLARAGRRT

SEQ ID NO: 1471740 - protein, 24 aa, Mycobacterium tuberculosis
GQPRVNPLYFLRDGGRVIVAASKG

SEQ ID NO: 1471741 - protein, 20 aa, Mycobacterium tuberculosis
GQPVKGRLTVPPSVPVKSAD

SEQ ID NO: 1471742 - protein, 23 aa, Mycobacterium tuberculosis
GQRRFWFMWDDLVRGAIGAIVLV

SEQ ID NO: 1471743 - protein, 19 aa, Mycobacterium tuberculosis
GRAIVRRPRVFCMDEPLSN

SEQ ID NO: 1471744 - protein, 20 aa, Mycobacterium tuberculosis
GRDDLALRIAVQPGGCAGLR

SEQ ID NO: 1471745 - protein, 24 aa, Mycobacterium tuberculosis
GRFPYRNDGALGWVGTSPVGRFPA

SEQ ID NO: 1471746 - protein, 21 aa, Mycobacterium tuberculosis
GRKRPGSGPLMIGSIKPNIGH

SEQ ID NO: 1471747 - protein, 17 aa, Mycobacterium tuberculosis
GRMKDLIIQDGVNHYHD

SEQ ID NO: 1471748 - protein, 23 aa, Mycobacterium tuberculosis
GRPVVDPRARIVILVDDGIATGA

SEQ ID NO: 1471749 - protein, 24 aa, Mycobacterium tuberculosis
GRTERFWVGLSVYRPGGTAEPAPT

SEQ ID NO: 1471750 - protein, 19 aa, Mycobacterium tuberculosis
GSAGLFYGSGGAGGNGGYS

SEQ ID NO: 1471751 - protein, 20 aa, Mycobacterium tuberculosis
GSAIAQHWMYEGKHVLIIFD

SEQ ID NO: 1471752 - protein, 18 aa, Mycobacterium tuberculosis
GSALLWGDGGAGGAGGVG

SEQ ID NO: 1471753 - protein, 25 aa, Mycobacterium tuberculosis
GSGGVGGVFGNGGFGGAGGLGAAGG

SEQ ID NO: 1471754 - protein, 17 aa, Mycobacterium tuberculosis
GSKDTWVLAPRASAAAR

SEQ ID NO: 1471755 - protein, 19 aa, Mycobacterium tuberculosis
GSPIPVGLDPTGVAVNPVT

SEQ ID NO: 1471756 - protein, 26 aa, Mycobacterium tuberculosis
GSSGTVFALDLSWGGAGGNGGAATTG

SEQ ID NO: 1471757 - protein, 59 aa, Mycobacterium tuberculosis
GTALTRASSTWADSPRAWPIRAPSRLQVWRTRATTARECSIRVIISRVSSTGAPPKKSR

SEQ ID NO: 1471758 - protein, 59 aa, Mycobacterium tuberculosis
GTALTRASSTWADSPRAWPIRAPSRLQVWRTRATTARECSIRVIISRVSSTGAPPQKKV

SEQ ID NO: 1471759 - protein, 24 aa, Mycobacterium tuberculosis
GTASSPFGIAIAIGGAGAQGGAGT

SEQ ID NO: 1471760 - protein, 20 aa, Mycobacterium tuberculosis
GTCPLWNVYETFANPGKILV

SEQ ID NO: 1471761 - protein, 26 aa, Mycobacterium tuberculosis
GTGADGGAGGWLFGNGGNGGHGATGA

SEQ ID NO: 1471762 - protein, 26 aa, Mycobacterium tuberculosis
GTGEAGGPGGWLLGNGGNGGSGAPGQ

SEQ ID NO: 1471763 - protein, 30 aa, Mycobacterium tuberculosis; identical to SEQ ID NO: 200474

SEQ ID NO: 1471764 - protein, 17 aa, Mycobacterium tuberculosis
GTGMPAAPMVPPTGSPG

SEQ ID NO: 1471765 - protein, 26 aa, Mycobacterium tuberculosis
GTGQPGGPGGLLWGNGGNGGSGVAGV

SEQ ID NO: 1471766 - protein, 25 aa, Mycobacterium tuberculosis
GTLDGRFRVPFVMRAEEKLLSYNRN

SEQ ID NO: 1471767 - protein, 19 aa, Mycobacterium tuberculosis
GTPLRSRVGHSYIKALMAE

SEQ ID NO: 1471768 - protein, 18 aa, Mycobacterium tuberculosis
GTQLSGILNRGAGISGVY

SEQ ID NO: 1471769 - protein, 27 aa, Mycobacterium tuberculosis
GVGGAGGAGWLVGNGGAGGFGGVGTTV

SEQ ID NO: 1471770 - protein, 20 aa, Mycobacterium tuberculosis
GVGGHGGTAILFGDGGAGGA

SEQ ID NO: 1471771 - protein, 26 aa, Mycobacterium tuberculosis
GVGYWRRAGLTASRFVACPFGGSGAR

SEQ ID NO: 1471772 - protein, 17 aa, Mycobacterium tuberculosis
GVISAPLTPPVKASAYR

SEQ ID NO: 1471773 - protein, 19 aa, Mycobacterium tuberculosis
GVPDLRRLFPTGFDEQRRA

SEQ ID NO: 1471774 - protein, 19 aa, Mycobacterium tuberculosis
GVPPTRLRLIYLADGQLLD

SEQ ID NO: 1471775 - protein, 20 aa, Mycobacterium tuberculosis
GWCGEAGFRSFEVIPLAGGS

SEQ ID NO: 1471776 - protein, 19 aa, Mycobacterium tuberculosis
GWVKLVGDWIDRQIGDLAP

SEQ ID NO: 1471777 - protein, 18 aa, Mycobacterium tuberculosis
GYAHVTGRVGVCMATSGP

SEQ ID NO: 1471778 - protein, 21 aa, Mycobacterium tuberculosis
GYEIRSAAVAGNIPCITTVQG

SEQ ID NO: 1471779 - protein, 17 aa, Mycobacterium tuberculosis
HAAAKVNGRHLVLPLQQ

SEQ ID NO: 1471780 - protein, 19 aa, Mycobacterium tuberculosis
HAEPGAWLLISTCDATDLV

SEQ ID NO: 1471781 - protein, 25 aa, Mycobacterium tuberculosis
HAGPGGYCGYLLYNLTTSGFRPATF

SEQ ID NO: 1471782 - protein, 20 aa, Mycobacterium tuberculosis
HAWGGPPIGAMVFRDPSVMN

SEQ ID NO: 1471783 - protein, 18 aa, Mycobacterium tuberculosis
HDAYCLRIAITETMSDLP

SEQ ID NO: 1471784 - protein, 23 aa, Mycobacterium tuberculosis
HDETRKSFSIAGTRVVDAIKLSV

SEQ ID NO: 1471785 - protein, 24 aa, Mycobacterium tuberculosis
HDEVSTAIAALFGSHGQHYQAISA

SEQ ID NO: 1471786 - protein, 25 aa, Mycobacterium tuberculosis
HEDDWLAPGGFNFDAWRFENRCELL

SEQ ID NO: 1471787 - protein, 20 aa, Mycobacterium tuberculosis
HEDLKRFFDGFPRNAHPMPV

SEQ ID NO: 1471788 - protein, 20 aa, Mycobacterium tuberculosis
HERSAFRLSPPVLSGAMGPF

SEQ ID NO: 1471789 - protein, 19 aa, Mycobacterium tuberculosis
HFFRSVLRWLQVGYPEGVP

SEQ ID NO: 1471790 - protein, 24 aa, Mycobacterium tuberculosis
HFTGAFGPVVVPPIPVPAINAHLT

SEQ ID NO: 1471791 - protein, 25 aa, Mycobacterium tuberculosis
HGARLRPGATVSLPCAPFLHLFVAY

SEQ ID NO: 1471792 - protein, 20 aa, Mycobacterium tuberculosis
HGKLAYHAVTYGWLLSGLAR

SEQ ID NO: 1471793 - protein, 25 aa, Mycobacterium tuberculosis
HGLRLRLSPDLTNLIERYLANDVTT

SEQ ID NO: 1471794 - protein, 17 aa, Mycobacterium tuberculosis
HGMLTDRDIVIKGLAAG

SEQ ID NO: 1471795 - protein, 22 aa, Mycobacterium tuberculosis
HHTRLRKIISRGFTPRAVGRLH

SEQ ID NO: 1471796 - protein, 18 aa, Mycobacterium tuberculosis
HILDGFAGTGTFITRLLQ

SEQ ID NO: 1471797 - protein, 18 aa, Mycobacterium tuberculosis
HIVAPVVVGWPVGQLYAN

SEQ ID NO: 1471798 - protein, 23 aa, Mycobacterium tuberculosis
HKLVPRKEFRGVAQARLTEVGLW

SEQ ID NO: 1471799 - protein, 19 aa, Mycobacterium tuberculosis
HKTRIRGASFVDRDGNELF

SEQ ID NO: 1471800 - protein, 20 aa, Mycobacterium tuberculosis
HMGRRYGRRLTVMADRPNVG

SEQ ID NO: 1471801 - protein, 18 aa, Mycobacterium tuberculosis
HNLAALGMEADLCRADVL

SEQ ID NO: 1471802 - protein, 20 aa, Mycobacterium tuberculosis
HPDEACGVLAGPEGSDRPER

SEQ ID NO: 1471803 - protein, 27 aa, Mycobacterium tuberculosis
HPIEPGRPCWLVGLLFPSADGCAGHSD

SEQ ID NO: 1471804 - protein, 20 aa, Mycobacterium tuberculosis
HPIQGIGAGFVPPVLDQDLV

SEQ ID NO: 1471805 - protein, 30 aa, Mycobacterium tuberculosis
HPRAAFFGRSGLRRNIRWDPLDSVYFAGYA

SEQ ID NO: 1471806 - protein, 20 aa, Mycobacterium tuberculosis
HRALMAAGVGCTRLAIHAVT

SEQ ID NO: 1471807 - protein, 20 aa, Mycobacterium tuberculosis
HRIHAAIHFDDLQWERRYNR

SEQ ID NO: 1471808 - protein, 18 aa, Mycobacterium tuberculosis
HRLDSGTWGVMGIGMGYA

SEQ ID NO: 1471809 - protein, 18 aa, Mycobacterium tuberculosis
HRRIMSLVAIGAAVENVK

SEQ ID NO: 1471810 - protein, 24 aa, Mycobacterium tuberculosis
HSDPEFAAAAGFPRPILHGLCTYG

SEQ ID NO: 1471811 - protein, 24 aa, Mycobacterium tuberculosis
HVATVRRFIERFAPYNLSPTAIRP

SEQ ID NO: 1471812 - protein, 18 aa, Mycobacterium tuberculosis
HVDLYFEAAVAGAIPVIR

SEQ ID NO: 1471813 - protein, 22 aa, Mycobacterium tuberculosis
HVKEVRLSTRLTESPACLITDA

SEQ ID NO: 1471814 - protein, 18 aa, Mycobacterium tuberculosis
HWGDAMMTDGRWDPGKDF

SEQ ID NO: 1471815 - protein, 17 aa, Mycobacterium tuberculosis
IAADLAVRLHDWRQRTA

SEQ ID NO: 1471816 - protein, 22 aa, Mycobacterium tuberculosis
IAENRAELMILIATNLLGQNTP

SEQ ID NO: 1471817 - protein, 25 aa, Mycobacterium tuberculosis
IAEVSARAGVEVTVFEPAEALITAG

SEQ ID NO: 1471818 - protein, 19 aa, Mycobacterium tuberculosis
IAGITYRQLDYWARTSLVV

SEQ ID NO: 1471819 - protein, 22 aa, Mycobacterium tuberculosis
IAIDRLPAAIITRLTQTNDPLG

SEQ ID NO: 1471820 - protein, 21 aa, Mycobacterium tuberculosis
IATWQRIAAALKRDPYGRTAR

SEQ ID NO: 1471821 - protein, 17 aa, Mycobacterium tuberculosis
IAVDICEQIASVPYPLS

SEQ ID NO: 1471822 - protein, 23 aa, Mycobacterium tuberculosis
IDALRPMMRLVVTNGTAKEIAGC

SEQ ID NO: 1471823 - protein, 18 aa, Mycobacterium tuberculosis
IDDFAEWLQRFEASLGAL

SEQ ID NO: 1471824 - protein, 25 aa, Mycobacterium tuberculosis
IDEIKPARLYARFPAGFAGMPALLD

SEQ ID NO: 1471825 - protein, 17 aa, Mycobacterium tuberculosis
IDFLAYVYEETRHKVVP

SEQ ID NO: 1471826 - protein, 25 aa, Mycobacterium tuberculosis
IDGSRAATHAALWAVDEAVNRDIPL

SEQ ID NO: 1471827 - protein, 17 aa, Mycobacterium tuberculosis
IDIGLPVSLTIPGFTIP

SEQ ID NO: 1471828 - protein, 23 aa, Mycobacterium tuberculosis
IDRAREAGRIAAREALPQIMELV

SEQ ID NO: 1471829 - protein, 26 aa, Mycobacterium tuberculosis
IDRCWAPKVHGAWNIHRATAAQPLEW

SEQ ID NO: 1471830 - protein, 24 aa, Mycobacterium tuberculosis
IDYPEPDRAAAIVRRTVPGATAPL

SEQ ID NO: 1471831 - protein, 19 aa, Mycobacterium tuberculosis
IEGPAGWGEFGAFVEYQSA

SEQ ID NO: 1471832 - protein, 17 aa, Mycobacterium tuberculosis
IEPALVIMLDEYPGRSM

SEQ ID NO: 1471833 - protein, 25 aa, Mycobacterium tuberculosis
IETLIQCGWFQIRISASDVVAASTR

SEQ ID NO: 1471834 - protein, 17 aa, Mycobacterium tuberculosis
IGAHRVLVLAGRIHAYE

SEQ ID NO: 1471835 - protein, 19 aa, Mycobacterium tuberculosis
IGFYSSFMVADKVQLLTRK

SEQ ID NO: 1471836 - protein, 24 aa, Mycobacterium tuberculosis
IGGAGGGGGWLHGDGGAGGHGGQG

SEQ ID NO: 1471837 - protein, 18 aa, Mycobacterium tuberculosis
IGGLNSGSGNIGFGNSGT

SEQ ID NO: 1471838 - protein, 17 aa, Mycobacterium tuberculosis
IGRRLAKALGVGLLDTD

SEQ ID NO: 1471839 - protein, 18 aa, Mycobacterium tuberculosis
IISCGAVLDHLRIAMTAA

SEQ ID NO: 1471840 - protein, 17 aa, Mycobacterium tuberculosis
IKELLVVDGANHYPEDI

SEQ ID NO: 1471841 - protein, 22 aa, Mycobacterium tuberculosis
ILCDPWVNPAYFASWFPFPDNS

SEQ ID NO: 1471842 - protein, 17 aa, Mycobacterium tuberculosis
ILFLEWTANSAVSRVDD

SEQ ID NO: 1471843 - protein, 27 aa, Mycobacterium tuberculosis
INAPAAALSGRPFIGNGTNGAPGTGEA

SEQ ID NO: 1471844 - protein, 17 aa, Mycobacterium tuberculosis
INIDAGVVTLQGFSIVA

SEQ ID NO: 1471845 - protein, 26 aa, Mycobacterium tuberculosis
INMFEFARPVLEACGQRWPKMRISGP

SEQ ID NO: 1471846 - protein, 17 aa, Mycobacterium tuberculosis
IPPNLPLPAKIVMQVLD

SEQ ID NO: 1471847 - protein, 21 aa, Mycobacterium tuberculosis
IPVTVEVPVGGILAPLQPFQA

SEQ ID NO: 1471848 - protein, 17 aa, Mycobacterium tuberculosis
IPYQRFRGAEIAGLTAG

SEQ ID NO: 1471849 - protein, 19 aa, Mycobacterium tuberculosis
IQHADLLVVRRGEKVVVEV

SEQ ID NO: 1471850 - protein, 17 aa, Mycobacterium tuberculosis
IQREHLLQAIKDVGFDL

SEQ ID NO: 1471851 - protein, 19 aa, Mycobacterium tuberculosis
IRLGGTWKKPGTSDIEIVC

SEQ ID NO: 1471852 - protein, 17 aa, Mycobacterium tuberculosis
ISDGELFIMGRIKDLLI

SEQ ID NO: 1471853 - protein, 20 aa, Mycobacterium tuberculosis
ISGGLMRLGSAVAPLLQVGG

SEQ ID NO: 1471854 - protein, 21 aa, Mycobacterium tuberculosis
ISGLTGDDWLGPSALSMAAAA

SEQ ID NO: 1471855 - protein, 33 aa, Mycobacterium tuberculosis
ISGSYSNGFLWSGNYQGLIGLHAALAIPEIALT

SEQ ID NO: 1471856 - protein, 19 aa, Mycobacterium tuberculosis
ISHVVFKPGTIEQIRSVIR

SEQ ID NO: 1471857 - protein, 23 aa, Mycobacterium tuberculosis
ITRASARLAPAFTDTWVATTDND

SEQ ID NO: 1471858 - protein, 30 aa, Mycobacterium tuberculosis
IVDAVARQEPRISWAAGLRDDGTTTLLVTD

SEQ ID NO: 1471859 - protein, 22 aa, Mycobacterium tuberculosis
IVDEPFLAPARIDLTALRAHAV

SEQ ID NO: 1471860 - protein, 33 aa, Mycobacterium tuberculosis; identical to SEQ ID NO: 201489

SEQ ID NO: 1471861 - protein, 23 aa, Mycobacterium tuberculosis
IVSPRTGSLLDHAQRVAEGRLLD

SEQ ID NO: 1471862 - protein, 19 aa, Mycobacterium tuberculosis
IWPIAAARFVDNVVAVDSA

SEQ ID NO: 1471863 - protein, 18 aa, Mycobacterium tuberculosis
KAAIAVSRRVRTRWINFA

SEQ ID NO: 1471864 - protein, 20 aa, Mycobacterium tuberculosis
KALRSGGVVVVFPGGDYDAY

SEQ ID NO: 1471865 - protein, 21 aa, Mycobacterium tuberculosis
KANPAVRVRIGGRWRSGTAYL

SEQ ID NO: 1471866 - protein, 27 aa, Mycobacterium tuberculosis
KAVAGIRLALSLGFRVRVAATVASPAP

SEQ ID NO: 1471867 - protein, 20 aa, Mycobacterium tuberculosis
KAYGAGPCSGHLTDIEHIVL

SEQ ID NO: 1471868 - protein, 19 aa, Mycobacterium tuberculosis
KDGYGRNFLLPRGLAIVAS

SEQ ID NO: 1471869 - protein, 17 aa, Mycobacterium tuberculosis
KDLRIAVDGGFLSVTEE

SEQ ID NO: 1471870 - protein, 17 aa, Mycobacterium tuberculosis
KEGGYGCTLHRDYDGEF

SEQ ID NO: 1471871 - protein, 20 aa, Mycobacterium tuberculosis
KELERVRMASARAAATNAAA

SEQ ID NO: 1471872 - protein, 23 aa, Mycobacterium tuberculosis
KEVKGFAGFPIGGRFLRAGNPAL

SEQ ID NO: 1471873 - protein, 24 aa, Mycobacterium tuberculosis
KGGAGTLLGLTVFGDNGGAGVLGD

SEQ ID NO: 1471874 - protein, 17 aa, Mycobacterium tuberculosis
KGGENIIGDGGGGNGGA

SEQ ID NO: 1471875 - protein, 17 aa, Mycobacterium tuberculosis
KHARRCVFWEVDPAILG

SEQ ID NO: 1471876 - protein, 20 aa, Mycobacterium tuberculosis
KKFYTSLFGWGYDDNPVPGG

SEQ ID NO: 1471877 - protein, 24 aa, Mycobacterium tuberculosis
KPGLRRLAPLAFVRFRIDGKDWPA

SEQ ID NO: 1471878 - protein, 23 aa, Mycobacterium tuberculosis
KRLASPAQRIMLFANDRGCTKPG

SEQ ID NO: 1471879 - protein, 18 aa, Mycobacterium tuberculosis
KRLHRVLGPLAHVNLIPL

SEQ ID NO: 1471880 - protein, 33 aa, Mycobacterium tuberculosis; identical to SEQ ID NO: 201763

SEQ ID NO: 1471881 - protein, 17 aa, Mycobacterium tuberculosis
KSPRLVKPEMLASARFR

SEQ ID NO: 1471882 - protein, 19 aa, Mycobacterium tuberculosis
KSTTLRILLGLVKADGGSV

SEQ ID NO: 1471883 - protein, 24 aa, Mycobacterium tuberculosis
KTVDDYRLAHKIGLDAVLVDSPLA

SEQ ID NO: 1471884 - protein, 17 aa, Mycobacterium tuberculosis
KVEAPGGEAARQITSVL

SEQ ID NO: 1471885 - protein, 22 aa, Mycobacterium tuberculosis
KVGLGSVRFLMSVGALIIGWLL

SEQ ID NO: 1471886 - protein, 25 aa, Mycobacterium tuberculosis
KVIRALFRPPARRGGCVHPPGRRSR

SEQ ID NO: 1471887 - protein, 17 aa, Mycobacterium tuberculosis
KVLEDLGWYVADNLPPQ

SEQ ID NO: 1471888 - protein, 30 aa, Mycobacterium tuberculosis
KVSHPIVFGHAVRIFYKDAFAKHQELFDDL

SEQ ID NO: 1471889 - protein, 20 aa, Mycobacterium tuberculosis
KWTKRKGRIYSDDRIGVALD

SEQ ID NO: 1471890 - protein, 17 aa, Mycobacterium tuberculosis
LAAAKIVFAHKGFHATT

SEQ ID NO: 1471891 - protein, 19 aa, Mycobacterium tuberculosis
LAARCSFEQVAFLLWRGEL

SEQ ID NO: 1471892 - protein, 24 aa, Mycobacterium tuberculosis
LADHARLDFLAGLRVVPAELGGAA

SEQ ID NO: 1471893 - protein, 24 aa, Mycobacterium tuberculosis
LADHVVNGVVLFPGAGFVELVIRA

SEQ ID NO: 1471894 - protein, 23 aa, Mycobacterium tuberculosis
LADVVGCSMRLPFLYAPLPYGGT

SEQ ID NO: 1471895 - protein, 17 aa, Mycobacterium tuberculosis
LADWDFNIRCFSNPALV

SEQ ID NO: 1471896 - protein, 28 aa, Mycobacterium tuberculosis
LAFFAGIGIPIAEIWGMSELSCVATASH

SEQ ID NO: 1471897 - protein, 21 aa, Mycobacterium tuberculosis
LAKTIKGYALGKHFEGRNATH

SEQ ID NO: 1471898 - protein, 26 aa, Mycobacterium tuberculosis
LALTRFHIFSHSWGGMLAQQYVLDKA

SEQ ID NO: 1471899 - protein, 17 aa, Mycobacterium tuberculosis
LAPENPYPAALGDCYSA

SEQ ID NO: 1471900 - protein, 17 aa, Mycobacterium tuberculosis
LAPRFGVGIVATTGAHF

SEQ ID NO: 1471901 - protein, 27 aa, Mycobacterium tuberculosis
LAQLWPPHVPAMLVAGCDPRPNAEPLP

SEQ ID NO: 1471902 - protein, 18 aa, Mycobacterium tuberculosis
LAQRCFELLTPALTRYYP

SEQ ID NO: 1471903 - protein, 17 aa, Mycobacterium tuberculosis
LARAAGLAIGDRGGVLT

SEQ ID NO: 1471904 - protein, 26 aa, Mycobacterium tuberculosis
LATAETWPNPWPMYRALRDHDPVHHV

SEQ ID NO: 1471905 - protein, 27 aa, Mycobacterium tuberculosis
LATARAYRAAAEFVPRIGALIDTVHRH

SEQ ID NO: 1471906 - protein, 22 aa, Mycobacterium tuberculosis
LATQVACRVLRDGGTAADAVVA

SEQ ID NO: 1471907 - protein, 20 aa, Mycobacterium tuberculosis
LATTKFRLERAINEAESAGG

SEQ ID NO: 1471908 - protein, 25 aa, Mycobacterium tuberculosis
LAYDPREGWPPALQGNWRSDSANHA

SEQ ID NO: 1471909 - protein, 17 aa, Mycobacterium tuberculosis
LDAGLVLTSIGYRGKPI

SEQ ID NO: 1471910 - protein, 18 aa, Mycobacterium tuberculosis
LDGGFGPVVLPPIPVPAV

SEQ ID NO: 1471911 - protein, 24 aa, Mycobacterium tuberculosis
LDKSRPLWEMYLVEGLEKNRIALY

SEQ ID NO: 1471912 - protein, 17 aa, Mycobacterium tuberculosis
LDLERAMELCAPDECVE

SEQ ID NO: 1471913 - protein, 19 aa, Mycobacterium tuberculosis
LDLYSCAVYAGQLIIEHHG

SEQ ID NO: 1471914 - protein, 17 aa, Mycobacterium tuberculosis
LDQEGRDDLALRIAVQP

SEQ ID NO: 1471915 - protein, 24 aa, Mycobacterium tuberculosis
LDRLLAQKLPDGWDADLPHWEPGS

SEQ ID NO: 1471916 - protein, 18 aa, Mycobacterium tuberculosis
LDVDARFYFVHSYAAQRW

SEQ ID NO: 1471917 - protein, 19 aa, Mycobacterium tuberculosis
LDVLERMGLLAAAQEHKTR

SEQ ID NO: 1471918 - protein, 24 aa, Mycobacterium tuberculosis
LEDGTTWRVEIERAHMEEDTGKLT

SEQ ID NO: 1471919 - protein, 19 aa, Mycobacterium tuberculosis
LEGLPGLRLIGLDRDPTAL

SEQ ID NO: 1471920 - protein, 18 aa, Mycobacterium tuberculosis
LEILAQLLVLATGTRITY

SEQ ID NO: 1471921 - protein, 23 aa, Mycobacterium tuberculosis
LEPRRFASGSALGMLSATGRCHA

SEQ ID NO: 1471922 - protein, 17 aa, Mycobacterium tuberculosis
LEPVSVWAPECSEDLLY

SEQ ID NO: 1471923 - protein, 19 aa, Mycobacterium tuberculosis
LETLAAHWRVPQQRPHDAF

SEQ ID NO: 1471924 - protein, 26 aa, Mycobacterium tuberculosis
LFDRIAGHRRFRFYLNVEIGKHLGHA

SEQ ID NO: 1471925 - protein, 17 aa, Mycobacterium tuberculosis
LFQSLWRLDFVAVALPA

SEQ ID NO: 1471926 - protein, 23 aa, Mycobacterium tuberculosis
LGCELRHAHRLVYSEGLDLSGDP

SEQ ID NO: 1471927 - protein, 17 aa, Mycobacterium tuberculosis
LGDRVVVMYGGIAQQIG

SEQ ID NO: 1471928 - protein, 18 aa, Mycobacterium tuberculosis
LGFVEAQGGGTILLARGD

SEQ ID NO: 1471929 - protein, 17 aa, Mycobacterium tuberculosis
LGHPFGGSGARLMTTVL

SEQ ID NO: 1471930 - protein, 17 aa, Mycobacterium tuberculosis
LGIPVTPGYFNLTGGPS

SEQ ID NO: 1471931 - protein, 18 aa, Mycobacterium tuberculosis
LGLDSVRFVLLMKQLGVN

SEQ ID NO: 1471932 - protein, 17 aa, Mycobacterium tuberculosis
LHHCGDAAAFLGPVGAS

SEQ ID NO: 1471933 - protein, 17 aa, Mycobacterium tuberculosis
LIARLAARPLDKSRPLW

SEQ ID NO: 1471934 - protein, 23 aa, Mycobacterium tuberculosis
LIDPALLRPGRLERLVFVEPPDA

SEQ ID NO: 1471935 - protein, 17 aa, Mycobacterium tuberculosis
LIERDAWLRCMHTAVAS

SEQ ID NO: 1471936 - protein, 18 aa, Mycobacterium tuberculosis
LIERIQGGWLEFDAAIAT

SEQ ID NO: 1471937 - protein, 24 aa, Mycobacterium tuberculosis
LIYPREALWRPPVLTMSAVEGRGL

SEQ ID NO: 1471938 - protein, 18 aa, Mycobacterium tuberculosis
LKAEKVLQAIGFAPNVEG

SEQ ID NO: 1471939 - protein, 19 aa, Mycobacterium tuberculosis
LKLIRARFGVPVPNLTAWR

SEQ ID NO: 1471940 - protein, 20 aa, Mycobacterium tuberculosis
LKLRVEVFVVEQACPYPELD

SEQ ID NO: 1471941 - protein, 20 aa, Mycobacterium tuberculosis
LLAHCYRMTGSLHDAEDLVQ

SEQ ID NO: 1471942 - protein, 17 aa, Mycobacterium tuberculosis
LLAKGYEVHGLIRRAST

SEQ ID NO: 1471943 - protein, 18 aa, Mycobacterium tuberculosis
LLALGALLHDIGKGRGTD

SEQ ID NO: 1471944 - protein, 22 aa, Mycobacterium tuberculosis
LLAVRRIAERPGLTVGLEPLLD

SEQ ID NO: 1471945 - protein, 17 aa, Mycobacterium tuberculosis
LLDPGLRESVRHGVTTV

SEQ ID NO: 1471946 - protein, 28 aa, Mycobacterium tuberculosis
LLEALPERERTVLVLRFFDSMTQTQIAE

SEQ ID NO: 1471947 - protein, 23 aa, Mycobacterium tuberculosis
LLECGLLRGWLIPPADIKAARDV

SEQ ID NO: 1471948 - protein, 19 aa, Mycobacterium tuberculosis
LLERSGLVALRNVIDQQFA

SEQ ID NO: 1471949 - protein, 17 aa, Mycobacterium tuberculosis
LLGKKCYSLRIASAMAH

SEQ ID NO: 1471950 - protein, 17 aa, Mycobacterium tuberculosis
LLLDLQEQFGLSYLFVS

SEQ ID NO: 1471951 - protein, 26 aa, Mycobacterium tuberculosis
LLLILRRPRAGLSYEALLETVEQRLP

SEQ ID NO: 1471952 - protein, 17 aa, Mycobacterium tuberculosis
LLNAALEAGETVLLEGS

SEQ ID NO: 1471953 - protein, 19 aa, Mycobacterium tuberculosis
LLPDELYTAVGASIGDAWA

SEQ ID NO: 1471954 - protein, 18 aa, Mycobacterium tuberculosis
LLPREKRAALSAVYALGR

SEQ ID NO: 1471955 - protein, 23 aa, Mycobacterium tuberculosis
LLQPGVLSLAWGSVVRQLAAGLG

SEQ ID NO: 1471956 - protein, 20 aa, Mycobacterium tuberculosis
LLRLLHPVIPFLTEALWLAL

SEQ ID NO: 1471957 - protein, 19 aa, Mycobacterium tuberculosis
LLTSLPFAPGYGVEIGLLI

SEQ ID NO: 1471958 - protein, 17 aa, Mycobacterium tuberculosis
LNAAVRRIDRHGAGVTV

SEQ ID NO: 1471959 - protein, 18 aa, Mycobacterium tuberculosis
LNAGLGFGGGCLPKDIRA

SEQ ID NO: 1471960 - protein, 19 aa, Mycobacterium tuberculosis
LNTAVWSGGSFIYVPPGVH

SEQ ID NO: 1471961 - protein, 17 aa, Mycobacterium tuberculosis
LNWAEAGSGEHARLHRF

SEQ ID NO: 1471962 - protein, 17 aa, Mycobacterium tuberculosis
LPADVCWSDGAHAAAGV

SEQ ID NO: 1471963 - protein, 26 aa, Mycobacterium tuberculosis
LPAFALPLRLPAGLAAGPAAVVTALT

SEQ ID NO: 1471964 - protein, 17 aa, Mycobacterium tuberculosis
LPAKLAIPMRVIASVGA

SEQ ID NO: 1471965 - protein, 18 aa, Mycobacterium tuberculosis
LPALFSQLVAGPIRRIID

SEQ ID NO: 1471966 - protein, 19 aa, Mycobacterium tuberculosis
LPDECWHLVIVAHHIVIDG

SEQ ID NO: 1471967 - protein, 17 aa, Mycobacterium tuberculosis
LPEHAIVQFVKAICSPM

SEQ ID NO: 1471968 - protein, 23 aa, Mycobacterium tuberculosis
LPGSARTTYPCHVEVGPQDSESG

SEQ ID NO: 1471969 - protein, 18 aa, Mycobacterium tuberculosis
LPKSIIIAGAGAIGMEFG

SEQ ID NO: 1471970 - protein, 25 aa, Mycobacterium tuberculosis
LPLYHDMGLILGICAPLVARRRAVL

SEQ ID NO: 1471971 - protein, 17 aa, Mycobacterium tuberculosis
LPPAKRLPDGLASYVSV

SEQ ID NO: 1471972 - protein, 21 aa, Mycobacterium tuberculosis
LPPEGASAIVFRDTAHAAELA

SEQ ID NO: 1471973 - protein, 25 aa, Mycobacterium tuberculosis
LPPLSGGMVGFFAYDMVRRLERLPE

SEQ ID NO: 1471974 - protein, 20 aa, Mycobacterium tuberculosis
LPRRGISALVRRPKRRPLDE

SEQ ID NO: 1471975 - protein, 17 aa, Mycobacterium tuberculosis
LPVLDTRAADTILGYDE

SEQ ID NO: 1471976 - protein, 17 aa, Mycobacterium tuberculosis
LPVSLSVQVRGELAAEE

SEQ ID NO: 1471977 - protein, 25 aa, Mycobacterium tuberculosis
LQADRAVVVAARLDRAALAGAGAAL

SEQ ID NO: 1471978 - protein, 17 aa, Mycobacterium tuberculosis
LQDLLGVVNAPAQALLG

SEQ ID NO: 1471979 - protein, 18 aa, Mycobacterium tuberculosis
LQLGYWGAQPPQNHAELV

SEQ ID NO: 1471980 - protein, 18 aa, Mycobacterium tuberculosis
LQLLIIISAGRTIANDIS

SEQ ID NO: 1471981 - protein, 21 aa, Mycobacterium tuberculosis
LQPLFDVINAPTLALLNRPLI

SEQ ID NO: 1471982 - protein, 19 aa, Mycobacterium tuberculosis
LQSRPEDRRAFIEEAAGVL

SEQ ID NO: 1471983 - protein, 17 aa, Mycobacterium tuberculosis
LQTHGAIGFTCEHDLSL

SEQ ID NO: 1471984 - protein, 17 aa, Mycobacterium tuberculosis
LRAAGRVAGLIGTIGIR

SEQ ID NO: 1471985 - protein, 17 aa, Mycobacterium tuberculosis
LRAGLRERLGVTVAVVI

SEQ ID NO: 1471986 - protein, 17 aa, Mycobacterium tuberculosis
LRAKHGLIPEDEALRAI

SEQ ID NO: 1471987 - protein, 30 aa, Mycobacterium tuberculosis; identical to SEQ ID NO: 202839

SEQ ID NO: 1471988 - protein, 17 aa, Mycobacterium tuberculosis
LRDHAGWPLYPIRPDRS

SEQ ID NO: 1471989 - protein, 31 aa, Mycobacterium tuberculosis; identical to SEQ ID NO: 202857

SEQ ID NO: 1471990 - protein, 17 aa, Mycobacterium tuberculosis
LRESFGGSKPAPAKGTA

SEQ ID NO: 1471991 - protein, 21 aa, Mycobacterium tuberculosis
LRHGLRFLTACQRRYGSVFTL

SEQ ID NO: 1471992 - protein, 20 aa, Mycobacterium tuberculosis
LRIHCDGATDFARIPGSGID

SEQ ID NO: 1471993 - protein, 18 aa, Mycobacterium tuberculosis
LRISLSVSARLAGIPYIA

SEQ ID NO: 1471994 - protein, 26 aa, Mycobacterium tuberculosis
LRKADELGCRSLALVAFGTGVGGFPL

SEQ ID NO: 1471995 - protein, 17 aa, Mycobacterium tuberculosis
LRLIQRITDRLPAKAPL

SEQ ID NO: 1471996 - protein, 17 aa, Mycobacterium tuberculosis
LRPIAHIRANAVDVSDD

SEQ ID NO: 1471997 - protein, 18 aa, Mycobacterium tuberculosis
LRQISFRLAADDDQFMTL

SEQ ID NO: 1471998 - protein, 19 aa, Mycobacterium tuberculosis
LRRLFPTGFDEQRRAAEIA

SEQ ID NO: 1471999 - protein, 19 aa, Mycobacterium tuberculosis
LRRRCLYHWIDYPEPDRAA

SEQ ID NO: 1472000 - protein, 24 aa, Mycobacterium tuberculosis
LRRVIRSAKLLGIDAAIVGDLMAT

SEQ ID NO: 1472001 - protein, 25 aa, Mycobacterium tuberculosis
LRRWWPRRYRRSSVYWTLMALDQRF

SEQ ID NO: 1472002 - protein, 18 aa, Mycobacterium tuberculosis
LRSLGATLKASNAAAAVP

SEQ ID NO: 1472003 - protein, 17 aa, Mycobacterium tuberculosis
LRSYRGDMINGFAPDAA

SEQ ID NO: 1472004 - protein, 22 aa, Mycobacterium tuberculosis
LRVQVGHGLVVDFVRSCGMTAI

SEQ ID NO: 1472005 - protein, 20 aa, Mycobacterium tuberculosis
LRWTAGQAPDASGYWPAPAV

SEQ ID NO: 1472006 - protein, 20 aa, Mycobacterium tuberculosis
LSAQCPVAIVRPHRVPIGRD

SEQ ID NO: 1472007 - protein, 20 aa, Mycobacterium tuberculosis
LSFSLPRNGIVGVIGPNGVG

SEQ ID NO: 1472008 - protein, 21 aa, Mycobacterium tuberculosis
LSGLDLRPATSRAQCLRMVAD

SEQ ID NO: 1472009 - protein, 26 aa, Mycobacterium tuberculosis
LSPSLRRPQPLFSLVNFFDAQVGPLS

SEQ ID NO: 1472010 - protein, 19 aa, Mycobacterium tuberculosis
LSRELPKSIIIAGAGAIGM

SEQ ID NO: 1472011 - protein, 18 aa, Mycobacterium tuberculosis
LSVSLKFQGFEVYTATNG

SEQ ID NO: 1472012 - protein, 23 aa, Mycobacterium tuberculosis
LSWRRVRTGDLGLAVWGGREEYR

SEQ ID NO: 1472013 - protein, 18 aa, Mycobacterium tuberculosis
LTEAIPVQIIWGTKDVVL

SEQ ID NO: 1472014 - protein, 17 aa, Mycobacterium tuberculosis
LTGVPAYLGAQIAGVRA

SEQ ID NO: 1472015 - protein, 17 aa, Mycobacterium tuberculosis
LTHDDFRNAWFVDASGR

SEQ ID NO: 1472016 - protein, 18 aa, Mycobacterium tuberculosis
LTIPAGITIGGFSLPAIH

SEQ ID NO: 1472017 - protein, 17 aa, Mycobacterium tuberculosis
LTKAGELGFSCYVHPEI

SEQ ID NO: 1472018 - protein, 17 aa, Mycobacterium tuberculosis
LTVGEAVRWSPTVRVPG

SEQ ID NO: 1472019 - protein, 23 aa, Mycobacterium tuberculosis
LTVPEKPRGIVVFAHGSGSSRHS

SEQ ID NO: 1472020 - protein, 24 aa, Mycobacterium tuberculosis
LTWLLSRWACVFGTPACQGTVAGR

SEQ ID NO: 1472021 - protein, 23 aa, Mycobacterium tuberculosis
LVAIWRRGSELFAEVVAPGEAGV

SEQ ID NO: 1472022 - protein, 17 aa, Mycobacterium tuberculosis
LVDCRRLQDSFAAVDFF

SEQ ID NO: 1472023 - protein, 19 aa, Mycobacterium tuberculosis
LVGVFTFPGHSYAPGKPGE

SEQ ID NO: 1472024 - protein, 21 aa, Mycobacterium tuberculosis
LVKLTCRGRDLPTAVSRARRA

SEQ ID NO: 1472025 - protein, 20 aa, Mycobacterium tuberculosis
LVMSRDCWDAVGGMDLSTFG

SEQ ID NO: 1472026 - protein, 20 aa, Mycobacterium tuberculosis
LVNLPNWLSLTFRINGGAWF

SEQ ID NO: 1472027 - protein, 18 aa, Mycobacterium tuberculosis
LWFEEFQIGTTYLHRPGR

SEQ ID NO: 1472028 - protein, 24 aa, Mycobacterium tuberculosis
LWPPHVPAMLVAGCDPRPNAEPLP

SEQ ID NO: 1472029 - protein, 17 aa, Mycobacterium tuberculosis
LYGLLAVNSIWFNHESP

SEQ ID NO: 1472030 - protein, 17 aa, Mycobacterium tuberculosis
MAGNFSFGDYFKRGAIE

SEQ ID NO: 1472031 - protein, 24 aa, Mycobacterium tuberculosis
MAPGARPGPVPKPGIRTPRVGNNP

SEQ ID NO: 1472032 - protein, 19 aa, Mycobacterium tuberculosis
MAVPVGWAATVVGEGGFSV

SEQ ID NO: 1472033 - protein, 17 aa, Mycobacterium tuberculosis
MFGGTPAVEEWEIAAMH

SEQ ID NO: 1472034 - protein, 20 aa, Mycobacterium tuberculosis
MGRIAAQLADLVVVTDDNPR

SEQ ID NO: 1472035 - protein, 17 aa, Mycobacterium tuberculosis
MGTWKFFRASVDGRPVF

SEQ ID NO: 1472036 - protein, 24 aa, Mycobacterium tuberculosis
MIGKPGAGVCPVRGHSNVQGDRTM

SEQ ID NO: 1472037 - protein, 26 aa, Mycobacterium tuberculosis
MMTDGRWDPGKDFAMVTARETGPTQK

SEQ ID NO: 1472038 - protein, 19 aa, Mycobacterium tuberculosis
MNNGVPWSVPRMNPTHLNF

SEQ ID NO: 1472039 - protein, 20 aa, Mycobacterium tuberculosis
MPEDLIKFGLIPEFIGRLPV

SEQ ID NO: 1472040 - protein, 18 aa, Mycobacterium tuberculosis
MPRKPGGDLARLPSRVWR

SEQ ID NO: 1472041 - protein, 18 aa, Mycobacterium tuberculosis
MRALDWFEVQSIRGHLVD

SEQ ID NO: 1472042 - protein, 24 aa, Mycobacterium tuberculosis
MRDRGRLPGLSKRLGVLTRTNSES

SEQ ID NO: 1472043 - protein, 17 aa, Mycobacterium tuberculosis
MREQAARIGRATLTRYA

SEQ ID NO: 1472044 - protein, 17 aa, Mycobacterium tuberculosis
MRGAGGSDLDTTRLMPA

SEQ ID NO: 1472045 - protein, 17 aa, Mycobacterium tuberculosis
MRLGSAVAPLLQVGGTP

SEQ ID NO: 1472046 - protein, 23 aa, Mycobacterium tuberculosis
MRLRPQSAMSFRELLTATRDIAS

SEQ ID NO: 1472047 - protein, 21 aa, Mycobacterium tuberculosis
MRWKGKRPSVRGVVMNPVDHP

SEQ ID NO: 1472048 - protein, 28 aa, Mycobacterium tuberculosis
MSAELGKARLVGAMSVPPTWEGSVPARM

SEQ ID NO: 1472049 - protein, 30 aa, Mycobacterium tuberculosis
MTGDYSNGLLWRGGYEGLVGVRVGPTISQF

SEQ ID NO: 1472050 - protein, 17 aa, Mycobacterium tuberculosis
NDARFLVYPAMKALTLD

SEQ ID NO: 1472051 - protein, 23 aa, Mycobacterium tuberculosis
NDGNEVWVLPGGLTRVALVEGSR

SEQ ID NO: 1472052 - protein, 19 aa, Mycobacterium tuberculosis
NDHWSGFRPDRIKALAGAA

SEQ ID NO: 1472053 - protein, 21 aa, Mycobacterium tuberculosis
NELCFVSGVLPTAPVSAVADP

SEQ ID NO: 1472054 - protein, 26 aa, Mycobacterium tuberculosis
NELPFNVAGIFTGYIGPIPLSTFVLG

SEQ ID NO: 1472055 - protein, 24 aa, Mycobacterium tuberculosis
NERYKLVWKNRLGFARLAIQHGYP

SEQ ID NO: 1472056 - protein, 25 aa, Mycobacterium tuberculosis
NGAAALPTVEVVAAAADEVSTQIAA

SEQ ID NO: 1472057 - protein, 25 aa, Mycobacterium tuberculosis
NGGAGGAGGWLFGNGGAGGVGGAGG

SEQ ID NO: 1472058 - protein, 23 aa, Mycobacterium tuberculosis
NGGAGGTGGWLFGNGGAGGNSGG

SEQ ID NO: 1472059 - protein, 26 aa, Mycobacterium tuberculosis
NGIWYTARLRPGPLRPAERRTAVVEY

SEQ ID NO: 1472060 - protein, 21 aa, Mycobacterium tuberculosis
NGVARVIAYRWLRVGRLPVPA

SEQ ID NO: 1472061 - protein, 20 aa, Mycobacterium tuberculosis
NHLKRSYGWNRTELTGITGA

SEQ ID NO: 1472062 - protein, 19 aa, Mycobacterium tuberculosis
NHTGGWRVDPLRGLSRPDF

SEQ ID NO: 1472063 - protein, 20 aa, Mycobacterium tuberculosis
NIGNPAPFGFEAPDVIMRDI

SEQ ID NO: 1472064 - protein, 18 aa, Mycobacterium tuberculosis
NILCLDVRRGIEQTRAHE

SEQ ID NO: 1472065 - protein, 17 aa, Mycobacterium tuberculosis
NLEDAGVSWKVYQNKGL

SEQ ID NO: 1472066 - protein, 18 aa, Mycobacterium tuberculosis
NNKIAFDRIDERLVVVGL

SEQ ID NO: 1472067 - protein, 19 aa, Mycobacterium tuberculosis
NPATWSGAGVVASHMTATE

SEQ ID NO: 1472068 - protein, 25 aa, Mycobacterium tuberculosis
NPVNWPRVLTVWRANLIGSSGKGGE

SEQ ID NO: 1472069 - protein, 20 aa, Mycobacterium tuberculosis
NPVTGEVYVTNFAGDTVSVI

SEQ ID NO: 1472070 - protein, 21 aa, Mycobacterium tuberculosis
NQFPYQSKTGWVYDSGDYETT

SEQ ID NO: 1472071 - protein, 18 aa, Mycobacterium tuberculosis
NRIVKSLARAVSAGKVTE

SEQ ID NO: 1472072 - protein, 23 aa, Mycobacterium tuberculosis
NRPGYLRFDFNWQGPLTDDQRTQ

SEQ ID NO: 1472073 - protein, 17 aa, Mycobacterium tuberculosis
NRTGVFWIQDRLTIGQL

SEQ ID NO: 1472074 - protein, 25 aa, Mycobacterium tuberculosis
NSGRMYCGPGSGPMLAAAAAWDGVA

SEQ ID NO: 1472075 - protein, 24 aa, Mycobacterium tuberculosis
NTATRRLCEWAGCKFLGEHATTNR

SEQ ID NO: 1472076 - protein, 23 aa, Mycobacterium tuberculosis
NTLSRFCNRFAPYNFREDMIRPS

SEQ ID NO: 1472077 - protein, 23 aa, Mycobacterium tuberculosis
NTTFPVGPFFGLGVVNISGIEIK

SEQ ID NO: 1472078 - protein, 18 aa, Mycobacterium tuberculosis
NWLSLTFRINGGAWFNVD

SEQ ID NO: 1472079 - protein, 17 aa, Mycobacterium tuberculosis
PACFEPTLDYVVVKAPR

SEQ ID NO: 1472080 - protein, 26 aa, Mycobacterium tuberculosis
PAGGAGGAAGLWGHGGAGGAGGSASG

SEQ ID NO: 1472081 - protein, 17 aa, Mycobacterium tuberculosis
PAKVIAMCNQKGGVGKT

SEQ ID NO: 1472082 - protein, 25 aa, Mycobacterium tuberculosis
PALELMRRVSLRPTKLTNAWVPFVV

SEQ ID NO: 1472083 - protein, 23 aa, Mycobacterium tuberculosis
PAPRKPIPLLMWPDRIKGRIRRR

SEQ ID NO: 1472084 - protein, 18 aa, Mycobacterium tuberculosis
PAQRVCAVDGAIHVMTTV

SEQ ID NO: 1472085 - protein, 20 aa, Mycobacterium tuberculosis
PASGAAHLLAQWTGAHNDGP

SEQ ID NO: 1472086 - protein, 17 aa, Mycobacterium tuberculosis
PAVSFLLISSGSAEVSH

SEQ ID NO: 1472087 - protein, 21 aa, Mycobacterium tuberculosis
PDEIEAAIGLAERDQDIKVIV

SEQ ID NO: 1472088 - protein, 17 aa, Mycobacterium tuberculosis
PDGKYLYIADYSGTITR

SEQ ID NO: 1472089 - protein, 28 aa, Mycobacterium tuberculosis
PDGSWGAEFPFCYEDRLLSTLAAMISLT

SEQ ID NO: 1472090 - protein, 19 aa, Mycobacterium tuberculosis
PDHPAFHWYAERIGEQRAV

SEQ ID NO: 1472091 - protein, 38 aa, Mycobacterium tuberculosis; identical to SEQ ID NO: 203867

SEQ ID NO: 1472092 - protein, 17 aa, Mycobacterium tuberculosis
PDIKLLQPVPAGDPSKG

SEQ ID NO: 1472093 - protein, 17 aa, Mycobacterium tuberculosis
PDLITWWCERDGVHPDK

SEQ ID NO: 1472094 - protein, 17 aa, Mycobacterium tuberculosis
PDQFLGAHVRRVTGRKN

SEQ ID NO: 1472095 - protein, 18 aa, Mycobacterium tuberculosis
PEAGEPVGTPGRRQHHQP

SEQ ID NO: 1472096 - protein, 20 aa, Mycobacterium tuberculosis
PEALADMVAIGQRIARAARA

SEQ ID NO: 1472097 - protein, 17 aa, Mycobacterium tuberculosis
PEALGGLGGAASSQLLP

SEQ ID NO: 1472098 - protein, 18 aa, Mycobacterium tuberculosis
PEEAIGLPETFVRDVYGK

SEQ ID NO: 1472099 - protein, 25 aa, Mycobacterium tuberculosis
PEHFAEELVRIIGVLRGMQLKKVPS

SEQ ID NO: 1472100 - protein, 17 aa, Mycobacterium tuberculosis
PEHPDHVMYVWVDALTN

SEQ ID NO: 1472101 - protein, 19 aa, Mycobacterium tuberculosis
PEPHPVLPTTPWQHTQHWI

SEQ ID NO: 1472102 - protein, 20 aa, Mycobacterium tuberculosis
PGAAGGDAGLLFGSGGAGGA

SEQ ID NO: 1472103 - protein, 21 aa, Mycobacterium tuberculosis
PGAYVAGWIKRGPTGFIGTNK

SEQ ID NO: 1472104 - protein, 22 aa, Mycobacterium tuberculosis
PGCGHWPGAVIRLEAPVIPHMG

SEQ ID NO: 1472105 - protein, 17 aa, Mycobacterium tuberculosis
PGGGVTIVIPGHENVTL

SEQ ID NO: 1472106 - protein, 17 aa, Mycobacterium tuberculosis
PGGTGVGGIGGLLLGLD

SEQ ID NO: 1472107 - protein, 23 aa, Mycobacterium tuberculosis
PGIPFGAAVGSGFARLNFATTRA

SEQ ID NO: 1472108 - protein, 18 aa, Mycobacterium tuberculosis
PGMGHAIELRVYRFGGSL

SEQ ID NO: 1472109 - protein, 18 aa, Mycobacterium tuberculosis
PGMRAKLFDAARLAASAI

SEQ ID NO: 1472110 - protein, 18 aa, Mycobacterium tuberculosis
PGQPGGRGGAAGLIGNGG

SEQ ID NO: 1472111 - protein, 22 aa, Mycobacterium tuberculosis
PGRREGWDYPDMARESGTKALR

SEQ ID NO: 1472112 - protein, 30 aa, Mycobacterium tuberculosis; identical to SEQ ID NO: 211473

SEQ ID NO: 1472113 - protein, 22 aa, Mycobacterium tuberculosis
PGSLAAKWLVTRVPVAGLAEKC

SEQ ID NO: 1472114 - protein, 18 aa, Mycobacterium tuberculosis
PGVSLGVRPDPVRPVRSA

SEQ ID NO: 1472115 - protein, 17 aa, Mycobacterium tuberculosis
PHDWIVWHFTHADNLPG

SEQ ID NO: 1472116 - protein, 17 aa, Mycobacterium tuberculosis
PHVQLWPHRHGTDAMFA

SEQ ID NO: 1472117 - protein, 22 aa, Mycobacterium tuberculosis
PISEADLLWDLASRLEGRMAAI

SEQ ID NO: 1472118 - protein, 19 aa, Mycobacterium tuberculosis
PITAVSLAWLPAGDYERAL

SEQ ID NO: 1472119 - protein, 18 aa, Mycobacterium tuberculosis
PKRRPVPLRLRDWREVYE

SEQ ID NO: 1472120 - protein, 19 aa, Mycobacterium tuberculosis
PKTPEWAAALSGLAAGDLR

SEQ ID NO: 1472121 - protein, 19 aa, Mycobacterium tuberculosis
PLDRVCMIDGLRIIVLDTS

SEQ ID NO: 1472122 - protein, 17 aa, Mycobacterium tuberculosis
PLEWSSFLPPQCTDPDV

SEQ ID NO: 1472123 - protein, 17 aa, Mycobacterium tuberculosis
PLLAQGIRHGFRAPTEL

SEQ ID NO: 1472124 - protein, 22 aa, Mycobacterium tuberculosis
PLPTEKNVYCVIRSPHKYKDSR

SEQ ID NO: 1472125 - protein, 23 aa, Mycobacterium tuberculosis
PLRLLFKDEVRAVGRELGLPEEI

SEQ ID NO: 1472126 - protein, 25 aa, Mycobacterium tuberculosis
PLYYLEMPPALFAPIVENLANVRLL

SEQ ID NO: 1472127 - protein, 19 aa, Mycobacterium tuberculosis
PMGMMPMPMGMGGAGAGMP

SEQ ID NO: 1472128 - protein, 20 aa, Mycobacterium tuberculosis
PMVAATMWDRYRQAVAGRIA

SEQ ID NO: 1472129 - protein, 23 aa, Mycobacterium tuberculosis
PNIKTDAMFPARAFDALDALVAS

SEQ ID NO: 1472130 - protein, 20 aa, Mycobacterium tuberculosis
PNRDPITGVHFVFVSNSSPW

SEQ ID NO: 1472131 - protein, 20 aa, Mycobacterium tuberculosis
PNSGTEPGFGGDGGLGGAGA

SEQ ID NO: 1472132 - protein, 18 aa, Mycobacterium tuberculosis
PPDKIWTLIADVRNTGRF

SEQ ID NO: 1472133 - protein, 25 aa, Mycobacterium tuberculosis
PPEFADRVADAWIKAQAYRLQTFGT

SEQ ID NO: 1472134 - protein, 17 aa, Mycobacterium tuberculosis
PPFPANLTTLFFGPTGI

SEQ ID NO: 1472135 - protein, 25 aa, Mycobacterium tuberculosis
PPGAKFPSGSFYLSISDLQINGPII

SEQ ID NO: 1472136 - protein, 25 aa, Mycobacterium tuberculosis
PPPHLDHGQPWTCEIHYTCACCCLP

SEQ ID NO: 1472137 - protein, 24 aa, Mycobacterium tuberculosis
PQLGKGGGRLPITLWIVDTNASTP

SEQ ID NO: 1472138 - protein, 22 aa, Mycobacterium tuberculosis
PQVHTLLDFHFRPHLTAASGKH

SEQ ID NO: 1472139 - protein, 18 aa, Mycobacterium tuberculosis
PRGLSAVPLEPGQQTVGF

SEQ ID NO: 1472140 - protein, 21 aa, Mycobacterium tuberculosis
PRKWARNLIREMSADRLYERL

SEQ ID NO: 1472141 - protein, 27 aa, Mycobacterium tuberculosis
PRLLMVGDAFSPRYGDRVVRLLESKIF

SEQ ID NO: 1472142 - protein, 28 aa, Mycobacterium tuberculosis
PRRGHRVLTRCQMSFVVTIPEALAAVAT

SEQ ID NO: 1472143 - protein, 20 aa, Mycobacterium tuberculosis
PRVAWWALCTDFDVPRSMGR

SEQ ID NO: 1472144 - protein, 19 aa, Mycobacterium tuberculosis
PRVNCPTHGPTVVAVAWAR

SEQ ID NO: 1472145 - protein, 18 aa, Mycobacterium tuberculosis
PSAPARLVVLASGTGSLL

SEQ ID NO: 1472146 - protein, 23 aa, Mycobacterium tuberculosis
PSGEGLHVGHPLGYIATDVYARY

SEQ ID NO: 1472147 - protein, 17 aa, Mycobacterium tuberculosis
PSGFVKLVADAKHGELL

SEQ ID NO: 1472148 - protein, 17 aa, Mycobacterium tuberculosis
PSGTSWAQLGLASLAGG

SEQ ID NO: 1472149 - protein, 27 aa, Mycobacterium tuberculosis
PSLRLYERLWRPASFHLASRITTRTER

SEQ ID NO: 1472150 - protein, 25 aa, Mycobacterium tuberculosis
PSPHLGTLEVRICDGVSNLRELGAL

SEQ ID NO: 1472151 - protein, 17 aa, Mycobacterium tuberculosis
PSQIPVVRKAYRPSHEK

SEQ ID NO: 1472152 - protein, 18 aa, Mycobacterium tuberculosis
PTDICEPVAVVGIGCRFP

SEQ ID NO: 1472153 - protein, 21 aa, Mycobacterium tuberculosis
PTLAAAAAWDGLAAELGQAAN

SEQ ID NO: 1472154 - protein, 18 aa, Mycobacterium tuberculosis
PTLKGEFAHTLNLTDVHI

SEQ ID NO: 1472155 - protein, 21 aa, Mycobacterium tuberculosis
PTLPLPTPVGMEIMPPQPPLP

SEQ ID NO: 1472156 - protein, 19 aa, Mycobacterium tuberculosis
PTQPRSITLTFIRNAQSQA

SEQ ID NO: 1472157 - protein, 18 aa, Mycobacterium tuberculosis
PTSGLLAAAGDEVSAAIA

SEQ ID NO: 1472158 - protein, 17 aa, Mycobacterium tuberculosis
PTTAFRLGEKVDDPLAM

SEQ ID NO: 1472159 - protein, 17 aa, Mycobacterium tuberculosis
PVARRLFAVRAVVGLSL

SEQ ID NO: 1472160 - protein, 18 aa, Mycobacterium tuberculosis
PVAVLAPRSPADCFETAL

SEQ ID NO: 1472161 - protein, 18 aa, Mycobacterium tuberculosis
PVGEVRSRFYARAPELHR

SEQ ID NO: 1472162 - protein, 17 aa, Mycobacterium tuberculosis
PVIDMWAPFVPSAEVID

SEQ ID NO: 1472163 - protein, 19 aa, Mycobacterium tuberculosis
PVLPDPVGLLRCAGGADLA

SEQ ID NO: 1472164 - protein, 17 aa, Mycobacterium tuberculosis
PVMRALIVVAGLRMSRT

SEQ ID NO: 1472165 - protein, 17 aa, Mycobacterium tuberculosis
PVPREVLVPCLPSNAEE

SEQ ID NO: 1472166 - protein, 51 aa, Mycobacterium tuberculosis; identical to SEQ ID NO: 1382986

SEQ ID NO: 1472167 - protein, 20 aa, Mycobacterium tuberculosis
PVTIPGFAINPFGLDVPLSG

SEQ ID NO: 1472168 - protein, 17 aa, Mycobacterium tuberculosis
PWPEDYELMGVPFAKRG

SEQ ID NO: 1472169 - protein, 20 aa, Mycobacterium tuberculosis
QAAAIHEMFVNTLQMSSGSY

SEQ ID NO: 1472170 - protein, 21 aa, Mycobacterium tuberculosis
QAAAIHEMFVNTLVASSGSYA

SEQ ID NO: 1472171 - protein, 22 aa, Mycobacterium tuberculosis
QALLGRPLIGNGADGAPGTGQA

SEQ ID NO: 1472172 - protein, 34 aa, Mycobacterium tuberculosis; identical to SEQ ID NO: 204600

SEQ ID NO: 1472173 - protein, 19 aa, Mycobacterium tuberculosis
QARGKGGLVRVSWAEASEM

SEQ ID NO: 1472174 - protein, 23 aa, Mycobacterium tuberculosis
QATTRAGPYVPLTMGYYTRQDIP

SEQ ID NO: 1472175 - protein, 19 aa, Mycobacterium tuberculosis
QAWWSRPLEKVYAAVFIDA

SEQ ID NO: 1472176 - protein, 17 aa, Mycobacterium tuberculosis
QCLNAGLGFGGGCLPKD

SEQ ID NO: 1472177 - protein, 30 aa, Mycobacterium tuberculosis; identical to SEQ ID NO: 204617

SEQ ID NO: 1472178 - protein, 23 aa, Mycobacterium tuberculosis
QEAYRISISELDWMTPQTRQRAL

SEQ ID NO: 1472179 - protein, 17 aa, Mycobacterium tuberculosis
QEGRDDLALRIAVQPGG

SEQ ID NO: 1472180 - protein, 20 aa, Mycobacterium tuberculosis
QEIMTELEIAPTRRLRGLGD

SEQ ID NO: 1472181 - protein, 17 aa, Mycobacterium tuberculosis
QEPDDVASWGRVDLGAA

SEQ ID NO: 1472182 - protein, 17 aa, Mycobacterium tuberculosis
QEYQRLSAQAAGFHAQF

SEQ ID NO: 1472183 - protein, 26 aa, Mycobacterium tuberculosis
QFSMCINCMLCYSACPVYALDPDFLG

SEQ ID NO: 1472184 - protein, 17 aa, Mycobacterium tuberculosis
QFVRALNAGAGSYASAE

SEQ ID NO: 1472185 - protein, 20 aa, Mycobacterium tuberculosis
QFWRSGGRTRTRFGHVEDIP

SEQ ID NO: 1472186 - protein, 20 aa, Mycobacterium tuberculosis
QFWSQIHGFVMLELAGFYGD

SEQ ID NO: 1472187 - protein, 31 aa, Mycobacterium tuberculosis; identical to SEQ ID NO: 204666

SEQ ID NO: 1472188 - protein, 17 aa, Mycobacterium tuberculosis
QGLRVTAVRSRLMAPLS

SEQ ID NO: 1472189 - protein, 19 aa, Mycobacterium tuberculosis
QGLTAMWRRESELFADVAV

SEQ ID NO: 1472190 - protein, 18 aa, Mycobacterium tuberculosis
QGRFYAMRTLRKYVEADL

SEQ ID NO: 1472191 - protein, 17 aa, Mycobacterium tuberculosis
QGTYLAWLDCRELGFDD

SEQ ID NO: 1472192 - protein, 17 aa, Mycobacterium tuberculosis
QGVRLGRGRGFYDRSLR

SEQ ID NO: 1472193 - protein, 19 aa, Mycobacterium tuberculosis
QHPELWPNTVEEILRLDSP

SEQ ID NO: 1472194 - protein, 18 aa, Mycobacterium tuberculosis
QIDIPGMSLFDVHEIVEI

SEQ ID NO: 1472195 - protein, 24 aa, Mycobacterium tuberculosis
QLAERRGEAWFDPDGLILAFGDSP

SEQ ID NO: 1472196 - protein, 17 aa, Mycobacterium tuberculosis
QLAPAVAWVKKRAGRTP

SEQ ID NO: 1472197 - protein, 23 aa, Mycobacterium tuberculosis
QLIWREYRPGWTRYGDGSVAQVK

SEQ ID NO: 1472198 - protein, 23 aa, Mycobacterium tuberculosis
QLPDDRLEELLALAHEVRMRWCG

SEQ ID NO: 1472199 - protein, 23 aa, Mycobacterium tuberculosis
QLRHEFGDAVAIIGRPAYTPAGL

SEQ ID NO: 1472200 - protein, 18 aa, Mycobacterium tuberculosis
QPLFDVINAPTLALLNRP

SEQ ID NO: 1472201 - protein, 18 aa, Mycobacterium tuberculosis
QQLGIDFAGVVTAVGPDV

SEQ ID NO: 1472202 - protein, 19 aa, Mycobacterium tuberculosis
QQLTLPFGAPHTMLNVAVG

SEQ ID NO: 1472203 - protein, 21 aa, Mycobacterium tuberculosis
QQQRLCIARAIAVQPDVLLMD

SEQ ID NO: 1472204 - protein, 20 aa, Mycobacterium tuberculosis
QQVAPWWRRRPHRSLTSLGQ

SEQ ID NO: 1472205 - protein, 22 aa, Mycobacterium tuberculosis
QRAWLNLVQPLTIVEGFALLSV

SEQ ID NO: 1472206 - protein, 19 aa, Mycobacterium tuberculosis
QRIAAFGAYVVAYDPYVSP

SEQ ID NO: 1472207 - protein, 18 aa, Mycobacterium tuberculosis
QRNGFDCPGCAWPEEPGG

SEQ ID NO: 1472208 - protein, 17 aa, Mycobacterium tuberculosis
QRPELVLDRVRAFLAAG

SEQ ID NO: 1472209 - protein, 20 aa, Mycobacterium tuberculosis
QRPGQRLAYNGRLLELPDIK

SEQ ID NO: 1472210 - protein, 23 aa, Mycobacterium tuberculosis
QRRFEWLLSVLRLADRLIPHRAW

SEQ ID NO: 1472211 - protein, 17 aa, Mycobacterium tuberculosis
QRSAAVIARNIEALGLS

SEQ ID NO: 1472212 - protein, 23 aa, Mycobacterium tuberculosis
QRWLADHVIAGVVLLAGAAFVEL

SEQ ID NO: 1472213 - protein, 17 aa, Mycobacterium tuberculosis
QRYRDRYIFAGLQPGQR

SEQ ID NO: 1472214 - protein, 25 aa, Mycobacterium tuberculosis
QSARAGDPFQHWIGRRFDAVATDKP

SEQ ID NO: 1472215 - protein, 20 aa, Mycobacterium tuberculosis
QSLTGRPLIGDGANGIDGTG

SEQ ID NO: 1472216 - protein, 17 aa, Mycobacterium tuberculosis
QTDQRWAELVYDGLWYS

SEQ ID NO: 1472217 - protein, 24 aa, Mycobacterium tuberculosis
QTLLGRPLIGNGADGGPGQNGGPG

SEQ ID NO: 1472218 - protein, 20 aa, Mycobacterium tuberculosis
QYLRVRFVYQSGREDAVKTF

SEQ ID NO: 1472219 - protein, 18 aa, Mycobacterium tuberculosis
RACTPVWSGVGLHRPAEF

SEQ ID NO: 1472220 - protein, 18 aa, Mycobacterium tuberculosis
RAGARILLAPDGPDLRVQ

SEQ ID NO: 1472221 - protein, 28 aa, Mycobacterium tuberculosis
RAGGVLRRSIKFPTFMAGIDAVRRVAER

SEQ ID NO: 1472222 - protein, 17 aa, Mycobacterium tuberculosis
RAGYMYGTVLARGLRGH

SEQ ID NO: 1472223 - protein, 17 aa, Mycobacterium tuberculosis
RAHGIAFETSWLDPFTE

SEQ ID NO: 1472224 - protein, 23 aa, Mycobacterium tuberculosis
RALKEASYRLGARTLYHQFGAPL

SEQ ID NO: 1472225 - protein, 19 aa, Mycobacterium tuberculosis
RALPDRQRHASLLPLLHNY

SEQ ID NO: 1472226 - protein, 20 aa, Mycobacterium tuberculosis
RALTTMPIPVIAAVRGLAVG

SEQ ID NO: 1472227 - protein, 17 aa, Mycobacterium tuberculosis
RAPRGVLAIAYRCPNGE

SEQ ID NO: 1472228 - protein, 23 aa, Mycobacterium tuberculosis
RARFGVPVPNLTAWRDATVGDMT

SEQ ID NO: 1472229 - protein, 18 aa, Mycobacterium tuberculosis
RASGLEVRDEFVVGSLAG

SEQ ID NO: 1472230 - protein, 17 aa, Mycobacterium tuberculosis
RASIEAVFASWNSPRAV

SEQ ID NO: 1472231 - protein, 18 aa, Mycobacterium tuberculosis
RASKATVYRRWPSKAELV

SEQ ID NO: 1472232 - protein, 17 aa, Mycobacterium tuberculosis
RATIEAVLAKLAAPGAC

SEQ ID NO: 1472233 - protein, 17 aa, Mycobacterium tuberculosis
RCAPAALRYLSQARHTG

SEQ ID NO: 1472234 - protein, 21 aa, Mycobacterium tuberculosis
RDALRCFASLFGDEALDPLDY

SEQ ID NO: 1472235 - protein, 21 aa, Mycobacterium tuberculosis
RDLRLRVLSWGAAPAPDALLR

SEQ ID NO: 1472236 - protein, 17 aa, Mycobacterium tuberculosis
RDMAGRFEVHAQTVEDE

SEQ ID NO: 1472237 - protein, 17 aa, Mycobacterium tuberculosis
RDMVHPLIARPLPAETG

SEQ ID NO: 1472238 - protein, 23 aa, Mycobacterium tuberculosis
RDPGIPVVIGRNVSGPVSGPNED

SEQ ID NO: 1472239 - protein, 22 aa, Mycobacterium tuberculosis
RDRTCVVPGCGATRGLHAHHIR

SEQ ID NO: 1472240 - protein, 21 aa, Mycobacterium tuberculosis
RDVDWWLTFSSAAALLGTPGQ

SEQ ID NO: 1472241 - protein, 21 aa, Mycobacterium tuberculosis
RDVPYDVLASFRYLAQGHHRA

SEQ ID NO: 1472242 - protein, 18 aa, Mycobacterium tuberculosis
REAKKICMGCEVRHECLE

SEQ ID NO: 1472243 - protein, 20 aa, Mycobacterium tuberculosis
REFGVTTGRRRRCGWFDAVI

SEQ ID NO: 1472244 - protein, 18 aa, Mycobacterium tuberculosis
REGIACAVLRRPDHRDTY

SEQ ID NO: 1472245 - protein, 22 aa, Mycobacterium tuberculosis
REIPANRPGRAVSMEKHHLMIG

SEQ ID NO: 1472246 - protein, 21 aa, Mycobacterium tuberculosis
RELKKLVPITTFLRRSPYLAA

SEQ ID NO: 1472247 - protein, 26 aa, Mycobacterium tuberculosis
REPVRSLVWIRGCLHQIPPAELVETL

SEQ ID NO: 1472248 - protein, 17 aa, Mycobacterium tuberculosis
REREANLIPGGKSLSGG

SEQ ID NO: 1472249 - protein, 21 aa, Mycobacterium tuberculosis
RERGWPQFADRLLELAREAEP

SEQ ID NO: 1472250 - protein, 24 aa, Mycobacterium tuberculosis
RERLDFSCALFDPDGNLVANAPHI

SEQ ID NO: 1472251 - protein, 19 aa, Mycobacterium tuberculosis
RERYSMLAACFEPDVACEI

SEQ ID NO: 1472252 - protein, 18 aa, Mycobacterium tuberculosis
RESIKATLTFRDPKELRF

SEQ ID NO: 1472253 - protein, 26 aa, Mycobacterium tuberculosis
REVPADLRQDWPAALRDAGFDPTART

SEQ ID NO: 1472254 - protein, 20 aa, Mycobacterium tuberculosis
RFAECPTFPAPPPREILDAA

SEQ ID NO: 1472255 - protein, 24 aa, Mycobacterium tuberculosis
RFLMSVGALIIGWLLQRQAAVAVA

SEQ ID NO: 1472256 - protein, 18 aa, Mycobacterium tuberculosis
RFVFANADAFSWSQTFES

SEQ ID NO: 1472257 - protein, 17 aa, Mycobacterium tuberculosis
RGARKRPTSGWGALTPT

SEQ ID NO: 1472258 - protein, 20 aa, Mycobacterium tuberculosis
RGDVALLRLSFGRFGDEPAL

SEQ ID NO: 1472259 - protein, 29 aa, Mycobacterium tuberculosis
RGEIARRVFATCRRLGLGTVAVYTDPDAA

SEQ ID NO: 1472260 - protein, 18 aa, Mycobacterium tuberculosis
RGGKLSLRVIALVNGTVI

SEQ ID NO: 1472261 - protein, 24 aa, Mycobacterium tuberculosis
RGLLPPTFSLVGFARRDWSTQDFG

SEQ ID NO: 1472262 - protein, 17 aa, Mycobacterium tuberculosis
RGLPLLDLKDLRAVITH

SEQ ID NO: 1472263 - protein, 19 aa, Mycobacterium tuberculosis
RGPHRVLRGDLAFAGLPGV

SEQ ID NO: 1472264 - protein, 18 aa, Mycobacterium tuberculosis
RGQGFLALVDYAHKPEAL

SEQ ID NO: 1472265 - protein, 21 aa, Mycobacterium tuberculosis
RGREICGMPSSGGVAVAATLG

SEQ ID NO: 1472266 - protein, 20 aa, Mycobacterium tuberculosis
RGVEAAERLATRRRQLLSAG

SEQ ID NO: 1472267 - protein, 17 aa, Mycobacterium tuberculosis
RHFSALRPIGGGRFTVI

SEQ ID NO: 1472268 - protein, 17 aa, Mycobacterium tuberculosis
RHGARRMVIAPWLLAPG

SEQ ID NO: 1472269 - protein, 22 aa, Mycobacterium tuberculosis
RHGRPLLRHRVELGAGSLADDV

SEQ ID NO: 1472270 - protein, 19 aa, Mycobacterium tuberculosis
RHRAVLRAADRLELAEGLR

SEQ ID NO: 1472271 - protein, 25 aa, Mycobacterium tuberculosis
RIEAHALGMVFGRKRPGSGPLMIGS

SEQ ID NO: 1472272 - protein, 21 aa, Mycobacterium tuberculosis
RILRVRGRGVPKRSGGSGDLL

SEQ ID NO: 1472273 - protein, 17 aa, Mycobacterium tuberculosis
RIMRGGNPLAYLDSGAT

SEQ ID NO: 1472274 - protein, 17 aa, Mycobacterium tuberculosis
RIRVDGVAYDREEQTEG

SEQ ID NO: 1472275 - protein, 17 aa, Mycobacterium tuberculosis
RKASLPFTARRTLFNNT

SEQ ID NO: 1472276 - protein, 18 aa, Mycobacterium tuberculosis
RKGFEFEELEAAGLSRQG

SEQ ID NO: 1472277 - protein, 24 aa, Mycobacterium tuberculosis
RKLDRKATLAFAFSHRSYLDGMLL

SEQ ID NO: 1472278 - protein, 17 aa, Mycobacterium tuberculosis
RKNHKVFRRRRFFEGEP

SEQ ID NO: 1472279 - protein, 18 aa, Mycobacterium tuberculosis
RLAAHLRFLGQVDDAGKA

SEQ ID NO: 1472280 - protein, 18 aa, Mycobacterium tuberculosis
RLAEIRKALGHARQADVA

SEQ ID NO: 1472281 - protein, 21 aa, Mycobacterium tuberculosis
RLALDLRWEAAAGLTVHAPSL

SEQ ID NO: 1472282 - protein, 23 aa, Mycobacterium tuberculosis
RLARHRPEIPIGVNIGKTKKTPA

SEQ ID NO: 1472283 - protein, 17 aa, Mycobacterium tuberculosis
RLASVLRRCTVLDAHLR

SEQ ID NO: 1472284 - protein, 22 aa, Mycobacterium tuberculosis
RLDRPGWFYPPTVITDISKDMA

SEQ ID NO: 1472285 - protein, 24 aa, Mycobacterium tuberculosis
RLDSKRSAVDLALRRLVGEPLGRD

SEQ ID NO: 1472286 - protein, 18 aa, Mycobacterium tuberculosis
RLEAEGHRILKLNIGNPA

SEQ ID NO: 1472287 - protein, 17 aa, Mycobacterium tuberculosis
RLLAEPTAWLFGPEAHG

SEQ ID NO: 1472288 - protein, 25 aa, Mycobacterium tuberculosis
RLLFKRNICHQAIFYRRGLFGTIGP

SEQ ID NO: 1472289 - protein, 21 aa, Mycobacterium tuberculosis
RLLRSGGVIVVHRAALGGRAG

SEQ ID NO: 1472290 - protein, 27 aa, Mycobacterium tuberculosis
RLPEIPQLRWRVTGAPLGLDRPWFVED

SEQ ID NO: 1472291 - protein, 23 aa, Mycobacterium tuberculosis
RLPQKVGIGLARRMSLTGDYLSA

SEQ ID NO: 1472292 - protein, 22 aa, Mycobacterium tuberculosis
RLPRIDCRGGVQARRTAPDTVH

SEQ ID NO: 1472293 - protein, 20 aa, Mycobacterium tuberculosis
RLRQAGTFADAALRRVLEVI

SEQ ID NO: 1472294 - protein, 24 aa, Mycobacterium tuberculosis
RLTKPPLLVPVLRAGLGMVDEAHA

SEQ ID NO: 1472295 - protein, 17 aa, Mycobacterium tuberculosis
RLTKVLGLPGPHRRTQR

SEQ ID NO: 1472296 - protein, 18 aa, Mycobacterium tuberculosis
RLVAHPTESFGLRITDPS

SEQ ID NO: 1472297 - protein, 18 aa, Mycobacterium tuberculosis
RMRPGLDVRVAFCELNSP

SEQ ID NO: 1472298 - protein, 18 aa, Mycobacterium tuberculosis
RMWAASGVDYPTLLATMI

SEQ ID NO: 1472299 - protein, 17 aa, Mycobacterium tuberculosis
RNGALRMVRGVKNRFGA

SEQ ID NO: 1472300 - protein, 17 aa, Mycobacterium tuberculosis
RNLPTPSGNTFEWDPNS

SEQ ID NO: 1472301 - protein, 17 aa, Mycobacterium tuberculosis
RNPEVFVNARVDTYWLR

SEQ ID NO: 1472302 - protein, 22 aa, Mycobacterium tuberculosis
RNRISGTLGVRFARSGETAVTL

SEQ ID NO: 1472303 - protein, 22 aa, Mycobacterium tuberculosis
RPDETVPCLTQRQVLDQAPDAV

SEQ ID NO: 1472304 - protein, 21 aa, Mycobacterium tuberculosis
RPDIMIVVGGVIPPGDFDELY

SEQ ID NO: 1472305 - protein, 18 aa, Mycobacterium tuberculosis
RPFHIDWDLAAAEKGGYE

SEQ ID NO: 1472306 - protein, 18 aa, Mycobacterium tuberculosis
RPLMSDAMLRVFFEAYEI

SEQ ID NO: 1472307 - protein, 17 aa, Mycobacterium tuberculosis
RPLRPLAPVAHLDFDEP

SEQ ID NO: 1472308 - protein, 17 aa, Mycobacterium tuberculosis
RPMLPLWPPSRVPSPPV

SEQ ID NO: 1472309 - protein, 29 aa, Mycobacterium tuberculosis
RPNPSRLCDWCPHQQRCPAFGGTPPPYPG

SEQ ID NO: 1472310 - protein, 19 aa, Mycobacterium tuberculosis
RPSAVWTTWLPVAETPHTR

SEQ ID NO: 1472311 - protein, 20 aa, Mycobacterium tuberculosis
RPTGAFMFLGPTGVGKTELA

SEQ ID NO: 1472312 - protein, 19 aa, Mycobacterium tuberculosis
RQAMLPGHAVVLHPGPMVR

SEQ ID NO: 1472313 - protein, 19 aa, Mycobacterium tuberculosis
RQRHWVEPNHTVWAQAPGA

SEQ ID NO: 1472314 - protein, 20 aa, Mycobacterium tuberculosis
RRAGGCWRTAQNAVGPLWSI

SEQ ID NO: 1472315 - protein, 21 aa, Mycobacterium tuberculosis
RRASGRRKAWLRQAINHLEKL

SEQ ID NO: 1472316 - protein, 27 aa, Mycobacterium tuberculosis
RRDAIRHAVAWARPGDVVLIAGKGHET

SEQ ID NO: 1472317 - protein, 20 aa, Mycobacterium tuberculosis
RRESRFPISEIIAQTPPIPD

SEQ ID NO: 1472318 - protein, 24 aa, Mycobacterium tuberculosis
RRFLPRCAAGAISAFLLTEPDVGS

SEQ ID NO: 1472319 - protein, 21 aa, Mycobacterium tuberculosis
RRFNFPDGETHTWAYWRAPLQ

SEQ ID NO: 1472320 - protein, 17 aa, Mycobacterium tuberculosis
RRGELVMVFPGGAREVN

SEQ ID NO: 1472321 - protein, 19 aa, Mycobacterium tuberculosis
RRLGLKRLLRSDILPISFG

SEQ ID NO: 1472322 - protein, 17 aa, Mycobacterium tuberculosis
RRLKTQWRKLAAATPSR

SEQ ID NO: 1472323 - protein, 18 aa, Mycobacterium tuberculosis
RRLVGLFCQQGHFDRSKA

SEQ ID NO: 1472324 - protein, 17 aa, Mycobacterium tuberculosis
RRPLLVLQVGDRVTHDK

SEQ ID NO: 1472325 - protein, 19 aa, Mycobacterium tuberculosis
RRRRELLRRNNLDGTLQEI

SEQ ID NO: 1472326 - protein, 20 aa, Mycobacterium tuberculosis
RRVFAPKVTGSWRLHVATAA

SEQ ID NO: 1472327 - protein, 22 aa, Mycobacterium tuberculosis
RRVRARLARRMTAQRSTTNPVL

SEQ ID NO: 1472328 - protein, 18 aa, Mycobacterium tuberculosis
RRYYRVSGADAYTMRRDS

SEQ ID NO: 1472329 - protein, 18 aa, Mycobacterium tuberculosis
RSALRWLRTVNRSPGLVS

SEQ ID NO: 1472330 - protein, 17 aa, Mycobacterium tuberculosis
RSGAGLFGSIAQLVKVL

SEQ ID NO: 1472331 - protein, 19 aa, Mycobacterium tuberculosis
RSSEMIICGGVNIAPDEVD

SEQ ID NO: 1472332 - protein, 20 aa, Mycobacterium tuberculosis
RTAQWVLPWPNPRYSKLARV

SEQ ID NO: 1472333 - protein, 28 aa, Mycobacterium tuberculosis
RTHLQFRRFAACPICHLHLRSFANRHQE

SEQ ID NO: 1472334 - protein, 17 aa, Mycobacterium tuberculosis
RTPWRLNQNYLRDIRLI

SEQ ID NO: 1472335 - protein, 21 aa, Mycobacterium tuberculosis
RTRHECTGLSSPIDALDGVST

SEQ ID NO: 1472336 - protein, 20 aa, Mycobacterium tuberculosis
RTYQPRIVFVDAYNKPIDMG

SEQ ID NO: 1472337 - protein, 18 aa, Mycobacterium tuberculosis
RVIVACFASNVDRVQQII

SEQ ID NO: 1472338 - protein, 19 aa, Mycobacterium tuberculosis
RVLAFFVSACSAPGHIRYK

SEQ ID NO: 1472339 - protein, 25 aa, Mycobacterium tuberculosis
RVLPLLGGLAVMFGDLPPLPTTARF

SEQ ID NO: 1472340 - protein, 28 aa, Mycobacterium tuberculosis
RVLSRDGVFPLAAFRKIVDINLVGTFNV

SEQ ID NO: 1472341 - protein, 25 aa, Mycobacterium tuberculosis
RVLVWDGEGAIGRWRGGRSELTTEC

SEQ ID NO: 1472342 - protein, 19 aa, Mycobacterium tuberculosis
RVRESDVYTPTLFLTARDS

SEQ ID NO: 1472343 - protein, 19 aa, Mycobacterium tuberculosis
RVSRAMFNELWAGFDPDEV

SEQ ID NO: 1472344 - protein, 25 aa, Mycobacterium tuberculosis
RVVAKIYCGLGLLKRENIREVHRAD

SEQ ID NO: 1472345 - protein, 22 aa, Mycobacterium tuberculosis
RVVERFGDLVFDTVITRTVRFP

SEQ ID NO: 1472346 - protein, 21 aa, Mycobacterium tuberculosis
RVVVMPWDRHIAAGTEISLDL

SEQ ID NO: 1472347 - protein, 18 aa, Mycobacterium tuberculosis
RVWAPKATGALRMHEATA

SEQ ID NO: 1472348 - protein, 19 aa, Mycobacterium tuberculosis
RWARERAQRAVSGMASVAI

SEQ ID NO: 1472349 - protein, 19 aa, Mycobacterium tuberculosis
RWMQLLATSGRCFSAAPNF

SEQ ID NO: 1472350 - protein, 25 aa, Mycobacterium tuberculosis
RWPSKAELVLAAFIEGIRQVAVPPN

SEQ ID NO: 1472351 - protein, 23 aa, Mycobacterium tuberculosis
RWSAVLVGPWWPAPSAALRAAAQ

SEQ ID NO: 1472352 - protein, 20 aa, Mycobacterium tuberculosis
RWVVDPDFNLDFHVRRVRVS

SEQ ID NO: 1472353 - protein, 20 aa, Mycobacterium tuberculosis
RYDVTFSLGDGLRPGSIADA

SEQ ID NO: 1472354 - protein, 19 aa, Mycobacterium tuberculosis
RYGRRRHVRSLGSQVIDVR

SEQ ID NO: 1472355 - protein, 20 aa, Mycobacterium tuberculosis
RYIILKGRNSEHLFVAAESL

SEQ ID NO: 1472356 - protein, 20 aa, Mycobacterium tuberculosis
RYRCYTDRLTRLSCGYSATS

SEQ ID NO: 1472357 - protein, 17 aa, Mycobacterium tuberculosis
SAAPLEGVLDVINAPAL

SEQ ID NO: 1472358 - protein, 18 aa, Mycobacterium tuberculosis
SAAYRYPGSMCVGFPKVL

SEQ ID NO: 1472359 - protein, 26 aa, Mycobacterium tuberculosis
SAEGRVAALRRCVPMVGQIKDPTLRD

SEQ ID NO: 1472360 - protein, 24 aa, Mycobacterium tuberculosis
SAERFVLGVGFGWNVEELADHGVP

SEQ ID NO: 1472361 - protein, 19 aa, Mycobacterium tuberculosis
SAEYLRLLRRHNVAAALSG

SEQ ID NO: 1472362 - protein, 22 aa, Mycobacterium tuberculosis
SAGRGGDAGFFYGNGGAGGSGA

SEQ ID NO: 1472363 - protein, 20 aa, Mycobacterium tuberculosis
SAHSPYYRLVALRLATVGLR

SEQ ID NO: 1472364 - protein, 24 aa, Mycobacterium tuberculosis
SAQAALFHEQFVRALTAGAGSYAA

SEQ ID NO: 1472365 - protein, 17 aa, Mycobacterium tuberculosis
SARMGRFGDVDRLAERA

SEQ ID NO: 1472366 - protein, 20 aa, Mycobacterium tuberculosis
SARPYAFEITRMLTTLAAEA

SEQ ID NO: 1472367 - protein, 20 aa, Mycobacterium tuberculosis
SAVRARIAPVGPSAVSIELA

SEQ ID NO: 1472368 - protein, 24 aa, Mycobacterium tuberculosis
SDAAQWLATHGWQVHSVSNREEMA

SEQ ID NO: 1472369 - protein, 20 aa, Mycobacterium tuberculosis
SDDEFGFFVVMLAVAGNETT

SEQ ID NO: 1472370 - protein, 21 aa, Mycobacterium tuberculosis
SDGEIAEAAWFTRDEVRAALA

SEQ ID NO: 1472371 - protein, 21 aa, Mycobacterium tuberculosis
SDGFAGLGGSGGRGGDAGLIG

SEQ ID NO: 1472372 - protein, 22 aa, Mycobacterium tuberculosis
SDKVVRFILGLVQRYGPGLFGA

SEQ ID NO: 1472373 - protein, 21 aa, Mycobacterium tuberculosis
SDLLVIFGITGDLARKMTFRA

SEQ ID NO: 1472374 - protein, 18 aa, Mycobacterium tuberculosis
SEIRPELRRLDLGKLLEL

SEQ ID NO: 1472375 - protein, 34 aa, Mycobacterium tuberculosis; identical to SEQ ID NO: 206357

SEQ ID NO: 1472376 - protein, 27 aa, Mycobacterium tuberculosis
SFVALCRAAGVPARIAFQTIDAPDKEF

SEQ ID NO: 1472377 - protein, 17 aa, Mycobacterium tuberculosis
SGALLNICVSYRITGDI

SEQ ID NO: 1472378 - protein, 25 aa, Mycobacterium tuberculosis
SGDPYRLAAQLGMPPWRVQKAQKQA

SEQ ID NO: 1472379 - protein, 27 aa, Mycobacterium tuberculosis
SGGAGGAGGFGFLGGDGGAGGNAGLLL

SEQ ID NO: 1472380 - protein, 19 aa, Mycobacterium tuberculosis
SGGRPAALYRFTDSQLRVT

SEQ ID NO: 1472381 - protein, 29 aa, Mycobacterium tuberculosis
SGLDARAYRLAWPVGSIVYEVDMPEVIEF

SEQ ID NO: 1472382 - protein, 20 aa, Mycobacterium tuberculosis
SGLTGDDWLGPSALSMAAAA

SEQ ID NO: 1472383 - protein, 24 aa, Mycobacterium tuberculosis
SGMPRLYREAPLMGIWEGSGNVSA

SEQ ID NO: 1472384 - protein, 17 aa, Mycobacterium tuberculosis
SGPAADDMAVAWAASAA

SEQ ID NO: 1472385 - protein, 18 aa, Mycobacterium tuberculosis
SGPARWFLDHARVALSSG

SEQ ID NO: 1472386 - protein, 22 aa, Mycobacterium tuberculosis
SGPPGAAALAFPSLSSSVPILG

SEQ ID NO: 1472387 - protein, 27 aa, Mycobacterium tuberculosis
SGQPGQFGSPGADGRGGAGGAGGGGGA

SEQ ID NO: 1472388 - protein, 17 aa, Mycobacterium tuberculosis
SGTAVFEIFFRKLPPGR

SEQ ID NO: 1472389 - protein, 26 aa, Mycobacterium tuberculosis
SGTPRASGPAGMTGMPMVPPGALGAG

SEQ ID NO: 1472390 - protein, 17 aa, Mycobacterium tuberculosis
SIMPGKVNPVLPEAVTQ

SEQ ID NO: 1472391 - protein, 25 aa, Mycobacterium tuberculosis
SIPEIDIHTLVAFACRELLLSEDVR

SEQ ID NO: 1472392 - protein, 23 aa, Mycobacterium tuberculosis
SIPLIKIPAAPGFGNSTTSPSSG

SEQ ID NO: 1472393 - protein, 22 aa, Mycobacterium tuberculosis
SIRTILRALAIHRRPSANSKLG

SEQ ID NO: 1472394 - protein, 24 aa, Mycobacterium tuberculosis
SISPITVRIDPVFDLGPITVQDIT

SEQ ID NO: 1472395 - protein, 20 aa, Mycobacterium tuberculosis
SKAARKVWDTADKFTRDTLG

SEQ ID NO: 1472396 - protein, 19 aa, Mycobacterium tuberculosis
SKELWRRMSAAGDIYLDNY

SEQ ID NO: 1472397 - protein, 20 aa, Mycobacterium tuberculosis
SKSPRCTWPAHIVDVKRAIA

SEQ ID NO: 1472398 - protein, 19 aa, Mycobacterium tuberculosis
SKTGREFGVTTGRRRRCGW

SEQ ID NO: 1472399 - protein, 19 aa, Mycobacterium tuberculosis
SLATDSWLSAASFQETTRV

SEQ ID NO: 1472400 - protein, 39 aa, Mycobacterium tuberculosis; identical to SEQ ID NO: 234270

SEQ ID NO: 1472401 - protein, 21 aa, Mycobacterium tuberculosis
SMGALHSWCLAAERPELVSAL

SEQ ID NO: 1472402 - protein, 22 aa, Mycobacterium tuberculosis
SMILHEILPIDVSINLEDAVFI

SEQ ID NO: 1472403 - protein, 18 aa, Mycobacterium tuberculosis
SMKMEIPVLAEAAGTVSK

SEQ ID NO: 1472404 - protein, 18 aa, Mycobacterium tuberculosis
SPAACRRIAIAAHDGLAR

SEQ ID NO: 1472405 - protein, 19 aa, Mycobacterium tuberculosis
SPCGLAELCDRTDLPRATA

SEQ ID NO: 1472406 - protein, 18 aa, Mycobacterium tuberculosis
SPGLELYSPAQLGLDHGH

SEQ ID NO: 1472407 - protein, 28 aa, Mycobacterium tuberculosis
SPVAGTVRFNWDPLRWFEEDEPIHGHPR

SEQ ID NO: 1472408 - protein, 19 aa, Mycobacterium tuberculosis
SREIEVLEFVPAADVDPMM

SEQ ID NO: 1472409 - protein, 19 aa, Mycobacterium tuberculosis
SRGAPWRRVESRAVDGVSF

SEQ ID NO: 1472410 - protein, 18 aa, Mycobacterium tuberculosis
SRVRLCPTPGHLHFFAVD

SEQ ID NO: 1472411 - protein, 18 aa, Mycobacterium tuberculosis
SSGIQGNMGPPGTQGADG

SEQ ID NO: 1472412 - protein, 24 aa, Mycobacterium tuberculosis
SSLYPDSLHIMGWDVGSHGLRLRL

SEQ ID NO: 1472413 - protein, 18 aa, Mycobacterium tuberculosis
SSVISGLTGDDWLGPSAL

SEQ ID NO: 1472414 - protein, 22 aa, Mycobacterium tuberculosis
SSWCAGRRALAEAACRAFDALA

SEQ ID NO: 1472415 - protein, 30 aa, Mycobacterium tuberculosis; identical to SEQ ID NO: 234295

SEQ ID NO: 1472416 - protein, 17 aa, Mycobacterium tuberculosis
STGAVALFSARAASDDG

SEQ ID NO: 1472417 - protein, 17 aa, Mycobacterium tuberculosis
STGFARDLADYIQEQGW

SEQ ID NO: 1472418 - protein, 17 aa, Mycobacterium tuberculosis
STIGRRLAKALGVGLLD

SEQ ID NO: 1472419 - protein, 24 aa, Mycobacterium tuberculosis
STVGRRILQRGLWFEEFQIGTTYL

SEQ ID NO: 1472420 - protein, 34 aa, Mycobacterium tuberculosis
SVADWLTDHGWRARSQRAPDEMRRVGRWVEGVPM

SEQ ID NO: 1472421 - protein, 18 aa, Mycobacterium tuberculosis
SVGSPWLADTWRDRFEQM

SEQ ID NO: 1472422 - protein, 21 aa, Mycobacterium tuberculosis
SVHVRGSVVLDRLSRKSQSAG

SEQ ID NO: 1472423 - protein, 23 aa, Mycobacterium tuberculosis
SVSDALDILRWAPQAASGPVAKV

SEQ ID NO: 1472424 - protein, 26 aa, Mycobacterium tuberculosis
SVSSSLVRRAGCPVAVIHSDDAVIPD

SEQ ID NO: 1472425 - protein, 18 aa, Mycobacterium tuberculosis
SWDLRKFLWAPRLGCYGI

SEQ ID NO: 1472426 - protein, 23 aa, Mycobacterium tuberculosis
SYLPSELVAAFLWAQFEEAERIT

SEQ ID NO: 1472427 - protein, 17 aa, Mycobacterium tuberculosis
SYLVSLLPSRIVADLGA

SEQ ID NO: 1472428 - protein, 17 aa, Mycobacterium tuberculosis
TAIVARVPVRAFINPAN

SEQ ID NO: 1472429 - protein, 24 aa, Mycobacterium tuberculosis
TAPGHMLGGLPLGHSVNAGSGINN

SEQ ID NO: 1472430 - protein, 19 aa, Mycobacterium tuberculosis
TAPQCTHYPLAEAADAIRA

SEQ ID NO: 1472431 - protein, 19 aa, Mycobacterium tuberculosis
TARMVRSRLDAELVGNVSI

SEQ ID NO: 1472432 - protein, 25 aa, Mycobacterium tuberculosis
TASDFWGGAGSAACQGFITQLGRNF

SEQ ID NO: 1472433 - protein, 17 aa, Mycobacterium tuberculosis
TASHHRRALGIQRLLAA

SEQ ID NO: 1472434 - protein, 33 aa, Mycobacterium tuberculosis; identical to SEQ ID NO: 210177

SEQ ID NO: 1472435 - protein, 29 aa, Mycobacterium tuberculosis
TATFHEDPVAGVWAVGGVGGDGGSGGSSL

SEQ ID NO: 1472436 - protein, 26 aa, Mycobacterium tuberculosis
TATPLRPGIWRAYADHRMAMAGAIIG

SEQ ID NO: 1472437 - protein, 19 aa, Mycobacterium tuberculosis
TAWLAEGMLIYLPPDPRTR

SEQ ID NO: 1472438 - protein, 24 aa, Mycobacterium tuberculosis
TCDRSRLTADGLWLHCLYAISGIN

SEQ ID NO: 1472439 - protein, 38 aa, Mycobacterium tuberculosis; identical to SEQ ID NO: 211836

SEQ ID NO: 1472440 - protein, 17 aa, Mycobacterium tuberculosis
TDAVEFGAAKGFAVTEL

SEQ ID NO: 1472441 - protein, 20 aa, Mycobacterium tuberculosis
TDEIKRRILAMAQPDADGNR

SEQ ID NO: 1472442 - protein, 22 aa, Mycobacterium tuberculosis
TEALVGRKLIGDGAHGAPGTGQ

SEQ ID NO: 1472443 - protein, 20 aa, Mycobacterium tuberculosis
TEFNSQFSAAVRKIYDSGHN

SEQ ID NO: 1472444 - protein, 17 aa, Mycobacterium tuberculosis
TEHFLRSVFRDAPHEEP

SEQ ID NO: 1472445 - protein, 25 aa, Mycobacterium tuberculosis
TEIDNLRAAFAWSRENDHITEALQL

SEQ ID NO: 1472446 - protein, 19 aa, Mycobacterium tuberculosis
TFIEVCYLLIYGELPDTDQ

SEQ ID NO: 1472447 - protein, 25 aa, Mycobacterium tuberculosis
TFLRAIGAIPRFSARSSARTWLLAI

SEQ ID NO: 1472448 - protein, 29 aa, Mycobacterium tuberculosis
TFPEFPLPLGDPSVRCGGDLLSMMLMDEQ

SEQ ID NO: 1472449 - protein, 17 aa, Mycobacterium tuberculosis
TFTPKHMGVMFGAPGGD

SEQ ID NO: 1472450 - protein, 19 aa, Mycobacterium tuberculosis
TGCAEMFRIGYIDVNQFTC

SEQ ID NO: 1472451 - protein, 17 aa, Mycobacterium tuberculosis
TGFNWPAPDHLRLVTLP

SEQ ID NO: 1472452 - protein, 20 aa, Mycobacterium tuberculosis
TGHGFLDWPAGAREATTARL

SEQ ID NO: 1472453 - protein, 24 aa, Mycobacterium tuberculosis
TGIGAPANVSGMFNIGSNLAGFFH

SEQ ID NO: 1472454 - protein, 25 aa, Mycobacterium tuberculosis
TGIIGWPALVMLFAGPRVGEPGKPV

SEQ ID NO: 1472455 - protein, 19 aa, Mycobacterium tuberculosis
TGSWLRRDRRTFTATQLVL

SEQ ID NO: 1472456 - protein, 22 aa, Mycobacterium tuberculosis
TGVLHWNRRVQAWLAEETGQPP

SEQ ID NO: 1472457 - protein, 18 aa, Mycobacterium tuberculosis
THLGLPADFLLDADGTVA

SEQ ID NO: 1472458 - protein, 19 aa, Mycobacterium tuberculosis
TIHGARAYAAFCEFADTTP

SEQ ID NO: 1472459 - protein, 17 aa, Mycobacterium tuberculosis
TIIPDFIGHTFAVHDGR

SEQ ID NO: 1472460 - protein, 21 aa, Mycobacterium tuberculosis
TILLECTMAGMATCTLTHLIE

SEQ ID NO: 1472461 - protein, 21 aa, Mycobacterium tuberculosis
TIPQFRTLVILSNHGPINLAT

SEQ ID NO: 1472462 - protein, 26 aa, Mycobacterium tuberculosis
TKGFKFSTYATWWIRQAITRGMADQS

SEQ ID NO: 1472463 - protein, 17 aa, Mycobacterium tuberculosis
TKHSRQILETAYVIDFL

SEQ ID NO: 1472464 - protein, 23 aa, Mycobacterium tuberculosis
TKIRLLTRIAFGFRSPEALIALA

SEQ ID NO: 1472465 - protein, 19 aa, Mycobacterium tuberculosis
TKKHWRAPSKLAYIDAGLI

SEQ ID NO: 1472466 - protein, 26 aa, Mycobacterium tuberculosis
TKSGAWCVAADFSVGMLAAGAARKVP

SEQ ID NO: 1472467 - protein, 25 aa, Mycobacterium tuberculosis
TLAPHLVKPLPFLFPLTKRWWERPY

SEQ ID NO: 1472468 - protein, 19 aa, Mycobacterium tuberculosis
TLASQAAHVVMRFQQGLAE

SEQ ID NO: 1472469 - protein, 18 aa, Mycobacterium tuberculosis
TLDVCVRDGLMSSRAAEA

SEQ ID NO: 1472470 - protein, 23 aa, Mycobacterium tuberculosis
TLGLVEVLCIRRRIRTGDQPLAL

SEQ ID NO: 1472471 - protein, 25 aa, Mycobacterium tuberculosis
TLGSYRWLRPSGRRTAKEIAAEFST

SEQ ID NO: 1472472 - protein, 24 aa, Mycobacterium tuberculosis
TLIPRARAKISIRVAPGGDATAHL

SEQ ID NO: 1472473 - protein, 19 aa, Mycobacterium tuberculosis
TLLGRPLIGNGADGGPGQN

SEQ ID NO: 1472474 - protein, 20 aa, Mycobacterium tuberculosis
TLRRWRYGRRRHVRSLGSQV

SEQ ID NO: 1472475 - protein, 27 aa, Mycobacterium tuberculosis
TMADPGSVSYLFSRKGVVTLEKNGLTE

SEQ ID NO: 1472476 - protein, 19 aa, Mycobacterium tuberculosis
TMAGMATCTLTHLIESSDS

SEQ ID NO: 1472477 - protein, 19 aa, Mycobacterium tuberculosis
TMCAGLFAGVGRKFSDEEL

SEQ ID NO: 1472478 - protein, 20 aa, Mycobacterium tuberculosis
TNFRWGGAFDLDRLLFKRNI

SEQ ID NO: 1472479 - protein, 17 aa, Mycobacterium tuberculosis
TPCRGQEAAQVGAAACL

SEQ ID NO: 1472480 - protein, 23 aa, Mycobacterium tuberculosis
TPEFAIPPIGVGGFTLPQITTQE

SEQ ID NO: 1472481 - protein, 21 aa, Mycobacterium tuberculosis
TPETLLGCPGEIDIGHRTIPN

SEQ ID NO: 1472482 - protein, 18 aa, Mycobacterium tuberculosis
TPIPKVYLCSAATPPGAG

SEQ ID NO: 1472483 - protein, 19 aa, Mycobacterium tuberculosis
TPLRTVVRANLKSIYQHAI

SEQ ID NO: 1472484 - protein, 23 aa, Mycobacterium tuberculosis
TPVRKACTVLAVLAATLLLGACG

SEQ ID NO: 1472485 - protein, 17 aa, Mycobacterium tuberculosis
TRIGTVLGILKAYTTRV

SEQ ID NO: 1472486 - protein, 18 aa, Mycobacterium tuberculosis
TRNYRELYGLLAVNSIWF

SEQ ID NO: 1472487 - protein, 21 aa, Mycobacterium tuberculosis
TRPGATLLLSCFSNAMPPDEE

SEQ ID NO: 1472488 - protein, 18 aa, Mycobacterium tuberculosis
TSGSRGFHVYARIAPCWS

SEQ ID NO: 1472489 - protein, 19 aa, Mycobacterium tuberculosis
TSSKVMCWVALDRGAKLAE

SEQ ID NO: 1472490 - protein, 21 aa, Mycobacterium tuberculosis
TSTLRLAPALGASRTVAVVST

SEQ ID NO: 1472491 - protein, 19 aa, Mycobacterium tuberculosis
TTCEIRLALLEADVSLPVV

SEQ ID NO: 1472492 - protein, 19 aa, Mycobacterium tuberculosis
TTEEFSIRVFPGDHFYLND

SEQ ID NO: 1472493 - protein, 17 aa, Mycobacterium tuberculosis
TVEHTIEILKGLRDRYE

SEQ ID NO: 1472494 - protein, 19 aa, Mycobacterium tuberculosis
TWAAIGVALGITRQAAFQR

SEQ ID NO: 1472495 - protein, 17 aa, Mycobacterium tuberculosis
TYGFTGIDTSQCTGDTV

SEQ ID NO: 1472496 - protein, 20 aa, Mycobacterium tuberculosis
TYLYRDGSDFVFMDSQDYEQ

SEQ ID NO: 1472497 - protein, 22 aa, Mycobacterium tuberculosis
TYMGINCWKSVSDMWNYQEILS

SEQ ID NO: 1472498 - protein, 22 aa, Mycobacterium tuberculosis
TYMRAIWTGSIAFGLVNVPVKV

SEQ ID NO: 1472499 - protein, 24 aa, Mycobacterium tuberculosis
TYREVRAGHQVRWTILLDGAVRIS

SEQ ID NO: 1472500 - protein, 24 aa, Mycobacterium tuberculosis
VAAGARFSGGVFACAALAERELTN

SEQ ID NO: 1472501 - protein, 23 aa, Mycobacterium tuberculosis
VAALQRRGHLAAVDLDRIFDAAR

SEQ ID NO: 1472502 - protein, 20 aa, Mycobacterium tuberculosis
VAARRAGVPITELTETLPSG

SEQ ID NO: 1472503 - protein, 17 aa, Mycobacterium tuberculosis
VADRLWYPLWDANIRLD

SEQ ID NO: 1472504 - protein, 24 aa, Mycobacterium tuberculosis
VAEALRAGGFKHRAKVEICWVASD

SEQ ID NO: 1472505 - protein, 22 aa, Mycobacterium tuberculosis
VAELFPKVVEAYRELVDDGPGL

SEQ ID NO: 1472506 - protein, 24 aa, Mycobacterium tuberculosis
VAELGLPVVVRPSFTMGGLGSGIA

SEQ ID NO: 1472507 - protein, 17 aa, Mycobacterium tuberculosis
VAELHQLGLGKWLADHI

SEQ ID NO: 1472508 - protein, 17 aa, Mycobacterium tuberculosis
VAGCAAMDGTVLVNLIN

SEQ ID NO: 1472509 - protein, 26 aa, Mycobacterium tuberculosis
VANARVRWDLPAAVVERRIRAVTPNP

SEQ ID NO: 1472510 - protein, 17 aa, Mycobacterium tuberculosis
VAPMLGHDVSIAAVNGP

SEQ ID NO: 1472511 - protein, 17 aa, Mycobacterium tuberculosis
VAQRYSLGMTEQLITEA

SEQ ID NO: 1472512 - protein, 19 aa, Mycobacterium tuberculosis
VARRLAREEGLLVGISSGA

SEQ ID NO: 1472513 - protein, 20 aa, Mycobacterium tuberculosis
VASCGSDFGAVVDVIDTRTH

SEQ ID NO: 1472514 - protein, 18 aa, Mycobacterium tuberculosis
VATSFSARLFNLLITNAP

SEQ ID NO: 1472515 - protein, 28 aa, Mycobacterium tuberculosis
VCVHDPLIMRRALEYATGLGVLIAQHAE

SEQ ID NO: 1472516 - protein, 29 aa, Mycobacterium tuberculosis
VDAVARQEPRISWAAGLRDDGTTTLLVTD

SEQ ID NO: 1472517 - protein, 17 aa, Mycobacterium tuberculosis
VDGLPVFGAFWDREAEL

SEQ ID NO: 1472518 - protein, 21 aa, Mycobacterium tuberculosis
VDGLWLAGSHGFELVAPDGSH

SEQ ID NO: 1472519 - protein, 18 aa, Mycobacterium tuberculosis
VDGPLRFELIDIATATSC

SEQ ID NO: 1472520 - protein, 19 aa, Mycobacterium tuberculosis
VDGRLICLVRAESDEDARR

SEQ ID NO: 1472521 - protein, 17 aa, Mycobacterium tuberculosis
VDPAAALKAELRSKPGD

SEQ ID NO: 1472522 - protein, 24 aa, Mycobacterium tuberculosis
VDPVCPGQTGATLPAGTTGPEPVG

SEQ ID NO: 1472523 - protein, 18 aa, Mycobacterium tuberculosis
VDVPLKFHHPMWREHCQV

SEQ ID NO: 1472524 - protein, 33 aa, Mycobacterium tuberculosis; identical to SEQ ID NO: 207653

SEQ ID NO: 1472525 - protein, 18 aa, Mycobacterium tuberculosis
VEPGHAFYMIGVNDHVAN

SEQ ID NO: 1472526 - protein, 22 aa, Mycobacterium tuberculosis
VEVCRTCSWNHLVKSYVLGAAR

SEQ ID NO: 1472527 - protein, 17 aa, Mycobacterium tuberculosis
VFGDNGGAGVLGDSTDP

SEQ ID NO: 1472528 - protein, 17 aa, Mycobacterium tuberculosis
VFVARAGGGIVEDVDGN

SEQ ID NO: 1472529 - protein, 23 aa, Mycobacterium tuberculosis
VGAAGGLAGQIGNGGSGGSGGAG

SEQ ID NO: 1472530 - protein, 17 aa, Mycobacterium tuberculosis
VGAFLAEDHALRLLNLR

SEQ ID NO: 1472531 - protein, 25 aa, Mycobacterium tuberculosis
VGALRDGGCNDVILVLGAVEVSAPA

SEQ ID NO: 1472532 - protein, 24 aa, Mycobacterium tuberculosis
VGGAGGQGGLLFGDGGNGGAGGAG

SEQ ID NO: 1472533 - protein, 18 aa, Mycobacterium tuberculosis
VGGHPAKRTFQALRIAVN

SEQ ID NO: 1472534 - protein, 20 aa, Mycobacterium tuberculosis
VGGIGGLLLGLDGANAPAST

SEQ ID NO: 1472535 - protein, 26 aa, Mycobacterium tuberculosis
VGGMSPNGCWATFVTCDARLATRLPE

SEQ ID NO: 1472536 - protein, 17 aa, Mycobacterium tuberculosis
VGIAPSITTASLRAVVS

SEQ ID NO: 1472537 - protein, 17 aa, Mycobacterium tuberculosis
VGIVEVDGFPVFDVPPD

SEQ ID NO: 1472538 - protein, 17 aa, Mycobacterium tuberculosis
VGLALRGFVPVPEIQFD

SEQ ID NO: 1472539 - protein, 18 aa, Mycobacterium tuberculosis
VGNVRFAGAPVVAHSAVQ

SEQ ID NO: 1472540 - protein, 17 aa, Mycobacterium tuberculosis
VGRHLLEVNPCFDRLAR

SEQ ID NO: 1472541 - protein, 23 aa, Mycobacterium tuberculosis
VGRIARVLGPRGLMPNPKTGTVT

SEQ ID NO: 1472542 - protein, 18 aa, Mycobacterium tuberculosis
VGSAENFSVVEALADSLG

SEQ ID NO: 1472543 - protein, 21 aa, Mycobacterium tuberculosis
VGSGGAGGSRGVLFGTPGANG

SEQ ID NO: 1472544 - protein, 21 aa, Mycobacterium tuberculosis
VGSLRSGECDLALAGGVTVNA

SEQ ID NO: 1472545 - protein, 20 aa, Mycobacterium tuberculosis
VGVSFGGLVTRSFSPRWRGL

SEQ ID NO: 1472546 - protein, 18 aa, Mycobacterium tuberculosis
VIADRTRRPPAFPEDIWV

SEQ ID NO: 1472547 - protein, 18 aa, Mycobacterium tuberculosis
VIPKRIRERLGLRGNDQV

SEQ ID NO: 1472548 - protein, 25 aa, Mycobacterium tuberculosis
VIRALFRPPARRGGCVHPPGRRSRP

SEQ ID NO: 1472549 - protein, 22 aa, Mycobacterium tuberculosis
VKDAPIRDWVKLAVTRARISGM

SEQ ID NO: 1472550 - protein, 17 aa, Mycobacterium tuberculosis
VKDIFFLVCDGLKGLPD

SEQ ID NO: 1472551 - protein, 23 aa, Mycobacterium tuberculosis
VKDRIGVAMLQAGRAGRFDQAGH

SEQ ID NO: 1472552 - protein, 17 aa, Mycobacterium tuberculosis
VKHPSAWRGWLTTMRSR

SEQ ID NO: 1472553 - protein, 17 aa, Mycobacterium tuberculosis
VKVVGFVASAPGFHGQP

SEQ ID NO: 1472554 - protein, 22 aa, Mycobacterium tuberculosis
VKWFNAEKGFGFIAPEDGSADV

SEQ ID NO: 1472555 - protein, 25 aa, Mycobacterium tuberculosis
VLAISINGPRAWDLDLAIDFTFTEP

SEQ ID NO: 1472556 - protein, 21 aa, Mycobacterium tuberculosis
VLAVLQRLVSRWDRPLRDVDI

SEQ ID NO: 1472557 - protein, 25 aa, Mycobacterium tuberculosis
VLISRGGWCTVTVRYDRASVRNDEL

SEQ ID NO: 1472558 - protein, 17 aa, Mycobacterium tuberculosis
VLPDPFITIDHYGPPLG

SEQ ID NO: 1472559 - protein, 17 aa, Mycobacterium tuberculosis
VLRLVGRRRLWGRGLGA

SEQ ID NO: 1472560 - protein, 19 aa, Mycobacterium tuberculosis
VLSGSACSALVFATLAAGD

SEQ ID NO: 1472561 - protein, 20 aa, Mycobacterium tuberculosis
VLTPLAVDPAHPFPFVSGLS

SEQ ID NO: 1472562 - protein, 31 aa, Mycobacterium tuberculosis
VMLESFLFYSGFYLPMYWSSRGKLTNTADLI

SEQ ID NO: 1472563 - protein, 22 aa, Mycobacterium tuberculosis
VNHLPLTLPLRYLGISDAEVDQ

SEQ ID NO: 1472564 - protein, 18 aa, Mycobacterium tuberculosis
VNSARIFAGAGLGPMLAA

SEQ ID NO: 1472565 - protein, 21 aa, Mycobacterium tuberculosis
VNSPGWRRAMAARKRIDDLID

SEQ ID NO: 1472566 - protein, 17 aa, Mycobacterium tuberculosis
VNVMLARDTIRRRLAGE

SEQ ID NO: 1472567 - protein, 17 aa, Mycobacterium tuberculosis
VPGEAWARHGVEHPMGA

SEQ ID NO: 1472568 - protein, 22 aa, Mycobacterium tuberculosis
VPGIYQVRGFDISNISFVEGDT

SEQ ID NO: 1472569 - protein, 17 aa, Mycobacterium tuberculosis
VPRSLWFVDEVKRSPAG

SEQ ID NO: 1472570 - protein, 17 aa, Mycobacterium tuberculosis
VPSLLGLFLSLPGVSQW

SEQ ID NO: 1472571 - protein, 17 aa, Mycobacterium tuberculosis
VQAAWAVLVAYFNRLRC

SEQ ID NO: 1472572 - protein, 24 aa, Mycobacterium tuberculosis
VQKAQKQARRWSRDTVATAMRLVA

SEQ ID NO: 1472573 - protein, 26 aa, Mycobacterium tuberculosis
VQVIGNRPKIGWRRLEAQAVLSRLLN

SEQ ID NO: 1472574 - protein, 18 aa, Mycobacterium tuberculosis
VRGRTMYPPEVGLHAEAS

SEQ ID NO: 1472575 - protein, 18 aa, Mycobacterium tuberculosis
VRQVCARALSLPSLPCEV

SEQ ID NO: 1472576 - protein, 29 aa, Mycobacterium tuberculosis
VRRLARLHTPLPLLAFTAWPEVRSQLAMT

SEQ ID NO: 1472577 - protein, 22 aa, Mycobacterium tuberculosis
VRVPAKALWRAQTQRAVENFPI

SEQ ID NO: 1472578 - protein, 28 aa, Mycobacterium tuberculosis
VRYAATRLRELCKMDGAVVLSTDGSRIV

SEQ ID NO: 1472579 - protein, 20 aa, Mycobacterium tuberculosis
VSAAVAALFGAHGQTYQVLS

SEQ ID NO: 1472580 - protein, 20 aa, Mycobacterium tuberculosis
VSALRVPGRHPAVAAWADSV

SEQ ID NO: 1472581 - protein, 18 aa, Mycobacterium tuberculosis
VSARWKFLAENTKGKPAV

SEQ ID NO: 1472582 - protein, 22 aa, Mycobacterium tuberculosis
VSGLDRKNCWTIAEHRGDTTPM

SEQ ID NO: 1472583 - protein, 22 aa, Mycobacterium tuberculosis
VSLGKRKGKIVVEFGSVDDLAR

SEQ ID NO: 1472584 - protein, 26 aa, Mycobacterium tuberculosis
VSLPCAPFLHLFVAYGRLTLEGGGEL

SEQ ID NO: 1472585 - protein, 21 aa, Mycobacterium tuberculosis
VSRLPAPLRRGQIRPLGLDRY

SEQ ID NO: 1472586 - protein, 18 aa, Mycobacterium tuberculosis
VTGGLTFAGGPWSNYVTH

SEQ ID NO: 1472587 - protein, 24 aa, Mycobacterium tuberculosis
VTGSPIPVGLDPTGVAVNPVTGVV

SEQ ID NO: 1472588 - protein, 20 aa, Mycobacterium tuberculosis
VTIPQLTIPAGITIGGFSLP

SEQ ID NO: 1472589 - protein, 17 aa, Mycobacterium tuberculosis
VTLTRAWCLRELGDDDA

SEQ ID NO: 1472590 - protein, 26 aa, Mycobacterium tuberculosis
VTTMFRPKLDALALLHRRSLKSPVRH

SEQ ID NO: 1472591 - protein, 24 aa, Mycobacterium tuberculosis
VVGLPMRCVFALTAMGFLPQSAET

SEQ ID NO: 1472592 - protein, 24 aa, Mycobacterium tuberculosis
VVQRLELVRRIGLVIDYDVVELGT

SEQ ID NO: 1472593 - protein, 17 aa, Mycobacterium tuberculosis
VVRGEACADSFYAALES

SEQ ID NO: 1472594 - protein, 19 aa, Mycobacterium tuberculosis
VVVLPDFGERYLSTPLFAD

SEQ ID NO: 1472595 - protein, 23 aa, Mycobacterium tuberculosis
VWNTILAIGFEWGVALQHLEIGK

SEQ ID NO: 1472596 - protein, 17 aa, Mycobacterium tuberculosis
VYADSTVIYPGHGDDTE

SEQ ID NO: 1472597 - protein, 18 aa, Mycobacterium tuberculosis
VYFCWATRNYRELYGLLA

SEQ ID NO: 1472598 - protein, 19 aa, Mycobacterium tuberculosis
WAAWQRSGLQRRWLAASEH

SEQ ID NO: 1472599 - protein, 24 aa, Mycobacterium tuberculosis
WASANWRLRRGRIVLLEGDSPAGL

SEQ ID NO: 1472600 - protein, 22 aa, Mycobacterium tuberculosis
WAVRWKPALNALAITFADRMPA

SEQ ID NO: 1472601 - protein, 19 aa, Mycobacterium tuberculosis
WCRDRETFGRPLISRQSVQ

SEQ ID NO: 1472602 - protein, 23 aa, Mycobacterium tuberculosis
WEEVRDRLAASFPKIGPLMDDAR

SEQ ID NO: 1472603 - protein, 19 aa, Mycobacterium tuberculosis
WEKMPEQFLAALDREFGIT

SEQ ID NO: 1472604 - protein, 17 aa, Mycobacterium tuberculosis
WGESMSRQAGGRAGGSG

SEQ ID NO: 1472605 - protein, 23 aa, Mycobacterium tuberculosis
WGGATYDVALRFLKEDPWERLAT

SEQ ID NO: 1472606 - protein, 21 aa, Mycobacterium tuberculosis
WGQDAEAMYGYAATAATATEA

SEQ ID NO: 1472607 - protein, 24 aa, Mycobacterium tuberculosis
WHGQRLRALAALPELIAAKPDGPR

SEQ ID NO: 1472608 - protein, 18 aa, Mycobacterium tuberculosis
WIHPDHRKKGYGTAALRK

SEQ ID NO: 1472609 - protein, 19 aa, Mycobacterium tuberculosis
WIPPHVRLPANVTLLEPTA

SEQ ID NO: 1472610 - protein, 23 aa, Mycobacterium tuberculosis
WLDDRKWAYVRLEGRAFGDVPLN

SEQ ID NO: 1472611 - protein, 18 aa, Mycobacterium tuberculosis
WLGDHRIHNVAALPGAAY

SEQ ID NO: 1472612 - protein, 21 aa, Mycobacterium tuberculosis
WLIERLQRPTLVMAPNKTLAA

SEQ ID NO: 1472613 - protein, 17 aa, Mycobacterium tuberculosis
WNGLVWINLDADAEPIA

SEQ ID NO: 1472614 - protein, 19 aa, Mycobacterium tuberculosis
WNPEFLREGFAVHDTLNPD

SEQ ID NO: 1472615 - protein, 30 aa, Mycobacterium tuberculosis; identical to SEQ ID NO: 212045

SEQ ID NO: 1472616 - protein, 17 aa, Mycobacterium tuberculosis
WPVALVIATGHILANNH

SEQ ID NO: 1472617 - protein, 23 aa, Mycobacterium tuberculosis
WQAARCVANWDGARVDKGLRRWR

SEQ ID NO: 1472618 - protein, 25 aa, Mycobacterium tuberculosis
WQENWARLGTFNVPNPVGSLAPPDG

SEQ ID NO: 1472619 - protein, 18 aa, Mycobacterium tuberculosis
WQRLRTDVGAVFDTEVYL

SEQ ID NO: 1472620 - protein, 19 aa, Mycobacterium tuberculosis
WRHLPDWPPATTERAWYLQ

SEQ ID NO: 1472621 - protein, 20 aa, Mycobacterium tuberculosis
WRRESELFADVAVPDDVDVT

SEQ ID NO: 1472622 - protein, 17 aa, Mycobacterium tuberculosis
WSGAGVVASHMTATEIT

SEQ ID NO: 1472623 - protein, 17 aa, Mycobacterium tuberculosis
WSPTALRILGAAAELIA

SEQ ID NO: 1472624 - protein, 17 aa, Mycobacterium tuberculosis
WVDNMVNELAARPPDDP

SEQ ID NO: 1472625 - protein, 30 aa, Mycobacterium tuberculosis
WVGAVNFGPISVQGFGLFGHGGDGGNGGDV

SEQ ID NO: 1472626 - protein, 23 aa, Mycobacterium tuberculosis
WVVGRLQLWHGYRLGLIEITPSS

SEQ ID NO: 1472627 - protein, 24 aa, Mycobacterium tuberculosis
WVVGRLQLWHGYRLGLIEITPSSA

SEQ ID NO: 1472628 - protein, 27 aa, Mycobacterium tuberculosis
YACASAWLDALVGWRRASGLPAAVINW

SEQ ID NO: 1472629 - protein, 28 aa, Mycobacterium tuberculosis
YAKALRRYRFRAGIAKVDFVLSDEIPWS

SEQ ID NO: 1472630 - protein, 17 aa, Mycobacterium tuberculosis
YATARARSGEELKVLLT

SEQ ID NO: 1472631 - protein, 18 aa, Mycobacterium tuberculosis
YGAALPWPASSADGTARP

SEQ ID NO: 1472632 - protein, 22 aa, Mycobacterium tuberculosis
YGAECATWRNFFLTGAAELRDG

SEQ ID NO: 1472633 - protein, 17 aa, Mycobacterium tuberculosis
YIAALLWFGEFSGCGIK

SEQ ID NO: 1472634 - protein, 20 aa, Mycobacterium tuberculosis
YKIRGVAAVTFYGRGRLVSA

SEQ ID NO: 1472635 - protein, 26 aa, Mycobacterium tuberculosis
YKPPAARCPLCPGPTGLSSEVPAPDY

SEQ ID NO: 1472636 - protein, 22 aa, Mycobacterium tuberculosis
YKTSRGSIRMRGVVEVEEDSRG

SEQ ID NO: 1472637 - protein, 20 aa, Mycobacterium tuberculosis
YMKYLRGCEHYFTDEMLDCS

SEQ ID NO: 1472638 - protein, 17 aa, Mycobacterium tuberculosis
YNLRYRVLADWDFNIRC

SEQ ID NO: 1472639 - protein, 27 aa, Mycobacterium tuberculosis
YNPLRFLRAAMKWCRKAQELGTLDEDA

SEQ ID NO: 1472640 - protein, 21 aa, Mycobacterium tuberculosis
YPGPDRAAAIVRRTVPGATAP

SEQ ID NO: 1472641 - protein, 23 aa, Mycobacterium tuberculosis
YPKVVLVTGACRFLGGYLTARLA

SEQ ID NO: 1472642 - protein, 19 aa, Mycobacterium tuberculosis
YPPGARCLVHESMAEGLAA

SEQ ID NO: 1472643 - protein, 22 aa, Mycobacterium tuberculosis
YPSAPWVPGGPILPWMPELPPG

SEQ ID NO: 1472644 - protein, 25 aa, Mycobacterium tuberculosis
YRAERYLGIIERVRAAIPHAAITTD

SEQ ID NO: 1472645 - protein, 23 aa, Mycobacterium tuberculosis
YRFRRLELARFLAALHATVLDNP

SEQ ID NO: 1472646 - protein, 25 aa, Mycobacterium tuberculosis
YRLVALRLATVGLRAQSLGRHTDQS

SEQ ID NO: 1472647 - protein, 18 aa, Mycobacterium tuberculosis
YRMTGSLHDAEDLVQETL

SEQ ID NO: 1472648 - protein, 17 aa, Mycobacterium tuberculosis
YRRCRRALRQIGVLERP

SEQ ID NO: 1472649 - protein, 17 aa, Mycobacterium tuberculosis
YSCWPVPGGDIALMAAR

SEQ ID NO: 1472650 - protein, 33 aa, Mycobacterium tuberculosis
YTDAAQPIWWVVRAIEFSKDFETFVQKLFVNPV

SEQ ID NO: 1472651 - protein, 22 aa, Mycobacterium tuberculosis
YTEARLTPLAMEMLREIDEETV

SEQ ID NO: 1472652 - protein, 23 aa, Mycobacterium tuberculosis
YWDRVLFDAGLSVITWPAKYGGR

SEQ ID NO: 1472653 - protein, 17 aa, Mycobacterium tuberculosis
AAADPAAVWATHFPSTD

SEQ ID NO: 1472654 - protein, 24 aa, Mycobacterium tuberculosis
AAAGRAGGNALLFGNGGNGGSGAS

SEQ ID NO: 1472655 - protein, 17 aa, Mycobacterium tuberculosis
AADRPTILMLHGGGQNR

SEQ ID NO: 1472656 - protein, 18 aa, Mycobacterium tuberculosis
AADRPTILMLHGGGQNRF

SEQ ID NO: 1472657 - protein, 18 aa, Mycobacterium tuberculosis
AADTGARIILACGFDSIP

SEQ ID NO: 1472658 - protein, 19 aa, Mycobacterium tuberculosis
AAECRWIRENLGVDVPVHF

SEQ ID NO: 1472659 - protein, 18 aa, Mycobacterium tuberculosis
AAEHTQSYVRACHLVGYQ

SEQ ID NO: 1472660 - protein, 18 aa, Mycobacterium tuberculosis
AAFAGRPALLSEMTDDDV

SEQ ID NO: 1472661 - protein, 27 aa, Mycobacterium tuberculosis
AAGKPLLGICGGFQMLGRVIRDPYGIE

SEQ ID NO: 1472662 - protein, 21 aa, Mycobacterium tuberculosis
AAGNLARLGSMISAANSAAAA

SEQ ID NO: 1472663 - protein, 19 aa, Mycobacterium tuberculosis
AAGPTMGILAAGADEVSVA

SEQ ID NO: 1472664 - protein, 18 aa, Mycobacterium tuberculosis
AAGVWAFGALVDPLEPQA

SEQ ID NO: 1472665 - protein, 22 aa, Mycobacterium tuberculosis
AAIEIKSAATLRGRDTRSISRL

SEQ ID NO: 1472666 - protein, 28 aa, Mycobacterium tuberculosis
AALAALELIDWPVALVIATGHILANNHH

SEQ ID NO: 1472667 - protein, 17 aa, Mycobacterium tuberculosis
AALRRVELARPRSVVGK

SEQ ID NO: 1472668 - protein, 18 aa, Mycobacterium tuberculosis
AANSWLDTFTHWRRAQDL

SEQ ID NO: 1472669 - protein, 23 aa, Mycobacterium tuberculosis
AARRCPEATFLPSNPAAYNAASE

SEQ ID NO: 1472670 - protein, 24 aa, Mycobacterium tuberculosis
AARRVGGTDVAVWLGTLSTLSRTA

SEQ ID NO: 1472671 - protein, 19 aa, Mycobacterium tuberculosis
AARWDLARIISALGDEVAF

SEQ ID NO: 1472672 - protein, 17 aa, Mycobacterium tuberculosis
AASSLRKAKKLRVRLPL

SEQ ID NO: 1472673 - protein, 25 aa, Mycobacterium tuberculosis
AAVEAEYELMWAADVAAMAGYHSGA

SEQ ID NO: 1472674 - protein, 17 aa, Mycobacterium tuberculosis
AAVGSYVSAEATNAAPL

SEQ ID NO: 1472675 - protein, 26 aa, Mycobacterium tuberculosis
AAVSWAERRRMFELPRSSWGDYDRSL

SEQ ID NO: 1472676 - protein, 17 aa, Mycobacterium tuberculosis
ACGAIELGIKWLSLYAF

SEQ ID NO: 1472677 - protein, 27 aa, Mycobacterium tuberculosis
ACPAALVDRWAPGRVMLNAYGPTETTI

SEQ ID NO: 1472678 - protein, 24 aa, Mycobacterium tuberculosis
ADDVSAAIAALFGAHAQAYQTISA

SEQ ID NO: 1472679 - protein, 23 aa, Mycobacterium tuberculosis
ADEVSAAIASLFSGNAQAYQALS

SEQ ID NO: 1472680 - protein, 23 aa, Mycobacterium tuberculosis
ADEVSAAMAALFGAHAQEYQRLS

SEQ ID NO: 1472681 - protein, 23 aa, Mycobacterium tuberculosis
ADEVSAGIAALFGAQAQSYQAVS

SEQ ID NO: 1472682 - protein, 18 aa, Mycobacterium tuberculosis
ADGCLVDGPLGRVGLEME

SEQ ID NO: 1472683 - protein, 23 aa, Mycobacterium tuberculosis
ADHHPRELLVVGIATFDQKRPAV

SEQ ID NO: 1472684 - protein, 27 aa, Mycobacterium tuberculosis
ADLARPWLAEAVGLARAVGDKWRLAEV

SEQ ID NO: 1472685 - protein, 18 aa, Mycobacterium tuberculosis
ADPRAWLTTVVSRLGLDK

SEQ ID NO: 1472686 - protein, 20 aa, Mycobacterium tuberculosis
ADPVADCPEAGEPVGTPGRR

SEQ ID NO: 1472687 - protein, 17 aa, Mycobacterium tuberculosis
ADPVSLQTAAGFSAQGV

SEQ ID NO: 1472688 - protein, 17 aa, Mycobacterium tuberculosis
ADRWADPTPAPGWTIAH

SEQ ID NO: 1472689 - protein, 21 aa, Mycobacterium tuberculosis
ADRYRRLHVIIGDANLAETST

SEQ ID NO: 1472690 - protein, 19 aa, Mycobacterium tuberculosis
ADTHPSGGCSRHLAECPAG

SEQ ID NO: 1472691 - protein, 19 aa, Mycobacterium tuberculosis
ADVHIAIELACPLVYGAAV

SEQ ID NO: 1472692 - protein, 19 aa, Mycobacterium tuberculosis
ADVLLAHLVLRPFLDAYHI

SEQ ID NO: 1472693 - protein, 22 aa, Mycobacterium tuberculosis
ADVPGLIPGASRGRGLGLDFLR

SEQ ID NO: 1472694 - protein, 28 aa, Mycobacterium tuberculosis
ADWLSVKRLAGWLAAAGYCGRAPRPAHR

SEQ ID NO: 1472695 - protein, 24 aa, Mycobacterium tuberculosis
AEAAAAAPLEGLLNIVNTPTQLLL

SEQ ID NO: 1472696 - protein, 26 aa, Mycobacterium tuberculosis
AEAANASPLQSAMGAVSASAQTLLSR

SEQ ID NO: 1472697 - protein, 24 aa, Mycobacterium tuberculosis
AEAKARRGPLCLGIDPHPELLRGW

SEQ ID NO: 1472698 - protein, 28 aa, Mycobacterium tuberculosis
AECGIAKGSLRGGLVLGLEDSSSRMSRL

SEQ ID NO: 1472699 - protein, 22 aa, Mycobacterium tuberculosis
AEDGAGWLAFFRDLVARGLSGV

SEQ ID NO: 1472700 - protein, 20 aa, Mycobacterium tuberculosis
AEERRTCVFFESPRRLAACL

SEQ ID NO: 1472701 - protein, 20 aa, Mycobacterium tuberculosis
AEKLVRARLRREVLIDDGTD

SEQ ID NO: 1472702 - protein, 20 aa, Mycobacterium tuberculosis
AELLPADWPGAGLRAAYHDF

SEQ ID NO: 1472703 - protein, 20 aa, Mycobacterium tuberculosis
AELLSAVGALAEATRDGVVA

SEQ ID NO: 1472704 - protein, 19 aa, Mycobacterium tuberculosis
AEMMRACRPITVPLTQAQG

SEQ ID NO: 1472705 - protein, 19 aa, Mycobacterium tuberculosis
AESCTAGLLAARLTDRPGS

SEQ ID NO: 1472706 - protein, 18 aa, Mycobacterium tuberculosis
AESQWFAAAGCNLVNMTG

SEQ ID NO: 1472707 - protein, 18 aa, Mycobacterium tuberculosis
AEYWPAFGANGKATLTVR

SEQ ID NO: 1472708 - protein, 34 aa, Mycobacterium tuberculosis; identical to SEQ ID NO: 233116

SEQ ID NO: 1472709 - protein, 18 aa, Mycobacterium tuberculosis
AFSIVWDGQKLHGLNASG

SEQ ID NO: 1472710 - protein, 33 aa, Mycobacterium tuberculosis
AFWTGDYQGLLDFSFPVGPLIPQTHLVHLRETV

SEQ ID NO: 1472711 - protein, 19 aa, Mycobacterium tuberculosis
AGAAAPYVGWLSAAAGQAE

SEQ ID NO: 1472712 - protein, 17 aa, Mycobacterium tuberculosis
AGCLVSFATQTSVQPPS

SEQ ID NO: 1472713 - protein, 31 aa, Mycobacterium tuberculosis
AGDPNNLLWRAFRPGTHVPIIDYTVPAPVES

SEQ ID NO: 1472714 - protein, 18 aa, Mycobacterium tuberculosis
AGDTWAAIGVALGITRQA

SEQ ID NO: 1472715 - protein, 29 aa, Mycobacterium tuberculosis
AGGAGGRGGKGIDGGFGGDGGNGGSNNGT

SEQ ID NO: 1472716 - protein, 28 aa, Mycobacterium tuberculosis
AGGAGGSGFFGGKGGFGGDGGQGGPNGG

SEQ ID NO: 1472717 - protein, 20 aa, Mycobacterium tuberculosis
AGGAGGWLSGHSGAHGAMGS

SEQ ID NO: 1472718 - protein, 17 aa, Mycobacterium tuberculosis
AGGAGWSPDSDLKGFDG

SEQ ID NO: 1472719 - protein, 17 aa, Mycobacterium tuberculosis
AGGEQWCDAEVLRILRR

SEQ ID NO: 1472720 - protein, 17 aa, Mycobacterium tuberculosis
AGGFGIPVGSGGAGGSR

SEQ ID NO: 1472721 - protein, 20 aa, Mycobacterium tuberculosis
AGGLFGVSGSSGLGGAAGSG

SEQ ID NO: 1472722 - protein, 20 aa, Mycobacterium tuberculosis
AGGRGGDAGLFLGAAGTGGQ

SEQ ID NO: 1472723 - protein, 20 aa, Mycobacterium tuberculosis
AGGVGGLFGAGGAGGSGGGG

SEQ ID NO: 1472724 - protein, 21 aa, Mycobacterium tuberculosis
AGKIAAVVAWDLDRLHRRPIE

SEQ ID NO: 1472725 - protein, 27 aa, Mycobacterium tuberculosis
AGLLFGAGGAGGFGFGGAGGAGGLGGK

SEQ ID NO: 1472726 - protein, 17 aa, Mycobacterium tuberculosis
AGLPRRGTPDAIVVVRD

SEQ ID NO: 1472727 - protein, 17 aa, Mycobacterium tuberculosis
AGLPRTMTFKVIKRQLS

SEQ ID NO: 1472728 - protein, 28 aa, Mycobacterium tuberculosis
AGNGGLGGDGFTYLADFDGEPGGDGGDG

SEQ ID NO: 1472729 - protein, 28 aa, Mycobacterium tuberculosis
AGQGSARWRRWLLLLALVGAGDQRRPAG

SEQ ID NO: 1472730 - protein, 27 aa, Mycobacterium tuberculosis
AGQPGRWGRTAVCARLSSADQKVDLDR

SEQ ID NO: 1472731 - protein, 18 aa, Mycobacterium tuberculosis
AGQRFVIDVTVWIDLAEA

SEQ ID NO: 1472732 - protein, 17 aa, Mycobacterium tuberculosis
AGRHLARPKRYIAGFAV

SEQ ID NO: 1472733 - protein, 24 aa, Mycobacterium tuberculosis
AGRRCSGHFPVTDRSAAMMAAGVG

SEQ ID NO: 1472734 - protein, 19 aa, Mycobacterium tuberculosis
AGRYLDWLTKHSRQILETA

SEQ ID NO: 1472735 - protein, 19 aa, Mycobacterium tuberculosis
AGSIGLFLEPFRLSDPFIT

SEQ ID NO: 1472736 - protein, 18 aa, Mycobacterium tuberculosis
AGSWPMAGTPAWRQLDDA

SEQ ID NO: 1472737 - protein, 18 aa, Mycobacterium tuberculosis
AGVDGMWLTVQVSSDGVP

SEQ ID NO: 1472738 - protein, 24 aa, Mycobacterium tuberculosis
AGVVRLRFGLTDGQPRTLDEIGQV

SEQ ID NO: 1472739 - protein, 18 aa, Mycobacterium tuberculosis
AGYLRLMRSGVYVNPVAP

SEQ ID NO: 1472740 - protein, 22 aa, Mycobacterium tuberculosis
AHAIPGLRQALGLAEDGTDERA

SEQ ID NO: 1472741 - protein, 21 aa, Mycobacterium tuberculosis
AHDWGGPVAFIMMLRHPEKVT

SEQ ID NO: 1472742 - protein, 21 aa, Mycobacterium tuberculosis
AHGGLQRWRAAETVHGRVRTG

SEQ ID NO: 1472743 - protein, 17 aa, Mycobacterium tuberculosis
AHGKGHFNIEDWDAILA

SEQ ID NO: 1472744 - protein, 24 aa, Mycobacterium tuberculosis
AHPQGRISLAIAHRPGERNGVADL

SEQ ID NO: 1472745 - protein, 18 aa, Mycobacterium tuberculosis
AIHRKYGDVFSLRVPPYA

SEQ ID NO: 1472746 - protein, 28 aa, Mycobacterium tuberculosis
AIPKLRQGSYFPDWLLQRRKRAERALTS

SEQ ID NO: 1472747 - protein, 17 aa, Mycobacterium tuberculosis
AIREWARRNGHNVSTRG

SEQ ID NO: 1472748 - protein, 20 aa, Mycobacterium tuberculosis
AIVGALGRLGHLGISDVRQG

SEQ ID NO: 1472749 - protein, 22 aa, Mycobacterium tuberculosis
AKTARRPRVIGVVSNGDTAAAP

SEQ ID NO: 1472750 - protein, 18 aa, Mycobacterium tuberculosis
ALAADWRVSGDNVKFGAT

SEQ ID NO: 1472751 - protein, 17 aa, Mycobacterium tuberculosis
ALDAARMLAEHRLPGLL

SEQ ID NO: 1472752 - protein, 32 aa, Mycobacterium tuberculosis
ALGGKGGSGGLIGRAGSDGGVGAGGAGGAGGA

SEQ ID NO: 1472753 - protein, 19 aa, Mycobacterium tuberculosis
ALHGAWGVRVHDVRASVDA

SEQ ID NO: 1472754 - protein, 18 aa, Mycobacterium tuberculosis
ALLGRPLIGNGANGAPGT

SEQ ID NO: 1472755 - protein, 34 aa, Mycobacterium tuberculosis
ALMSGNFSNGILWRGNFEGLFGLNVGITIPEFPI

SEQ ID NO: 1472756 - protein, 25 aa, Mycobacterium tuberculosis
ALNARAATFHAEFVSLLNGGAAAYT

SEQ ID NO: 1472757 - protein, 20 aa, Mycobacterium tuberculosis
ALRVADLFDSQGIWLVSSMT

SEQ ID NO: 1472758 - protein, 17 aa, Mycobacterium tuberculosis
ALTRDWFTSTFAAPTAA

SEQ ID NO: 1472759 - protein, 17 aa, Mycobacterium tuberculosis
ALYMSGSVPGVIAQALF

SEQ ID NO: 1472760 - protein, 22 aa, Mycobacterium tuberculosis
AMFDLWFPAALGARAVITTEDE

SEQ ID NO: 1472761 - protein, 19 aa, Mycobacterium tuberculosis
AMGVRVATSFSARLFNLLI

SEQ ID NO: 1472762 - protein, 21 aa, Mycobacterium tuberculosis
AMPAALRAAQMLAAEWDVAAD

SEQ ID NO: 1472763 - protein, 27 aa, Mycobacterium tuberculosis
ANGIDAPALWPGLPIRPVKGEVLRLRW

SEQ ID NO: 1472764 - protein, 19 aa, Mycobacterium tuberculosis
ANITVCVGGGIGTPRRAAE

SEQ ID NO: 1472765 - protein, 18 aa, Mycobacterium tuberculosis
ANLGRAASVGSLSVPPAW

SEQ ID NO: 1472766 - protein, 21 aa, Mycobacterium tuberculosis
APFQPEELMPEYSIGTMTFAG

SEQ ID NO: 1472767 - protein, 27 aa, Mycobacterium tuberculosis
APGGIGVNTGTGWAYGGNGGNGGDGGA

SEQ ID NO: 1472768 - protein, 22 aa, Mycobacterium tuberculosis
APLAPIRLRIGMHTGEVSSPDE

SEQ ID NO: 1472769 - protein, 17 aa, Mycobacterium tuberculosis
APLGYRPARSTAVMSTM

SEQ ID NO: 1472770 - protein, 26 aa, Mycobacterium tuberculosis
APLHTDLKEFGRWAADRIAEAIEFEG

SEQ ID NO: 1472771 - protein, 21 aa, Mycobacterium tuberculosis
APLPSWTHRTLMLSREDSHRS

SEQ ID NO: 1472772 - protein, 19 aa, Mycobacterium tuberculosis
APSAGTPVGPWLRTGDSGF

SEQ ID NO: 1472773 - protein, 22 aa, Mycobacterium tuberculosis
APTKRQLLSAAFIDHLRHLGRI

SEQ ID NO: 1472774 - protein, 17 aa, Mycobacterium tuberculosis
APYTGSAIAQHWMYEGK

SEQ ID NO: 1472775 - protein, 24 aa, Mycobacterium tuberculosis
AQAFPHVYCELDFTTPLELAVATI

SEQ ID NO: 1472776 - protein, 22 aa, Mycobacterium tuberculosis
AQGYSRVRVDGVVHPLTDPPKL

SEQ ID NO: 1472777 - protein, 18 aa, Mycobacterium tuberculosis
AQLPSGWMVTAAKFEVEW

SEQ ID NO: 1472778 - protein, 25 aa, Mycobacterium tuberculosis
AQMGRDGWLALGWPKEYGGQGRSAM

SEQ ID NO: 1472779 - protein, 17 aa, Mycobacterium tuberculosis
AQWGNNVAILAGDYLLA

SEQ ID NO: 1472780 - protein, 19 aa, Mycobacterium tuberculosis
ARHIRAVVRFGDSVRSAHC

SEQ ID NO: 1472781 - protein, 17 aa, Mycobacterium tuberculosis
ARIQLRLADPGESQMGH

SEQ ID NO: 1472782 - protein, 30 aa, Mycobacterium tuberculosis
ARIVGGRCLMPASSAARCAARIVGGRCLMP

SEQ ID NO: 1472783 - protein, 19 aa, Mycobacterium tuberculosis
ARPIRKGRLGKPVEFGYKA

SEQ ID NO: 1472784 - protein, 17 aa, Mycobacterium tuberculosis
ARRRGISVLGDRPPMVS

SEQ ID NO: 1472785 - protein, 17 aa, Mycobacterium tuberculosis
ARTGGFVDGVADFDPAF

SEQ ID NO: 1472786 - protein, 20 aa, Mycobacterium tuberculosis
ARTTVLLDEIVTLVGTDQRL

SEQ ID NO: 1472787 - protein, 17 aa, Mycobacterium tuberculosis
ARVLALAADKSMPLLER

SEQ ID NO: 1472788 - protein, 21 aa, Mycobacterium tuberculosis
ARYSNRFSVPTARSDAPLSVT

SEQ ID NO: 1472789 - protein, 18 aa, Mycobacterium tuberculosis
ASCGSDFGAVVDVIDTRT

SEQ ID NO: 1472790 - protein, 19 aa, Mycobacterium tuberculosis
ASGAGRAGVVPRYGVRLTV

SEQ ID NO: 1472791 - protein, 25 aa, Mycobacterium tuberculosis
ASIQRTGRCVVMHEGPRSLGYGAGL

SEQ ID NO: 1472792 - protein, 33 aa, Mycobacterium tuberculosis; identical to SEQ ID NO: 197095

SEQ ID NO: 1472793 - protein, 26 aa, Mycobacterium tuberculosis
ASLTGWQWLGPSSVRMGAAVTPYVEW

SEQ ID NO: 1472794 - protein, 23 aa, Mycobacterium tuberculosis
ASMPAMIRAGGKMYGADGKLKDT

SEQ ID NO: 1472795 - protein, 17 aa, Mycobacterium tuberculosis
ASRRLRVGQPIQPSPAP

SEQ ID NO: 1472796 - protein, 17 aa, Mycobacterium tuberculosis
ATAKAFAREGAVVALAA

SEQ ID NO: 1472797 - protein, 25 aa, Mycobacterium tuberculosis
ATASKGKWDTLRAMGFDDDHISDSR

SEQ ID NO: 1472798 - protein, 18 aa, Mycobacterium tuberculosis
ATDVARPAETVRGWLRRF

SEQ ID NO: 1472799 - protein, 28 aa, Mycobacterium tuberculosis
ATFHEDPVAGVWAVGGVGGDGGSGGSSL

SEQ ID NO: 1472800 - protein, 18 aa, Mycobacterium tuberculosis
ATGALLLIGDPAAGDPLL

SEQ ID NO: 1472801 - protein, 17 aa, Mycobacterium tuberculosis
ATLASDLMEVWRAPIID

SEQ ID NO: 1472802 - protein, 19 aa, Mycobacterium tuberculosis
ATLPGGFTISARKAYGRNS

SEQ ID NO: 1472803 - protein, 21 aa, Mycobacterium tuberculosis
ATNLAEIGSAISTANGAAALP

SEQ ID NO: 1472804 - protein, 20 aa, Mycobacterium tuberculosis
ATRVQVLWSLADREMSVNEL

SEQ ID NO: 1472805 - protein, 22 aa, Mycobacterium tuberculosis
ATVGGLMLPVGVRRLRNYHSTR

SEQ ID NO: 1472806 - protein, 17 aa, Mycobacterium tuberculosis
AVAARTRSGVILRSPAA

SEQ ID NO: 1472807 - protein, 34 aa, Mycobacterium tuberculosis; identical to SEQ ID NO: 233252

SEQ ID NO: 1472808 - protein, 25 aa, Mycobacterium tuberculosis
AVIYFLRKVIWFLPDFTVEGYHDRL

SEQ ID NO: 1472809 - protein, 23 aa, Mycobacterium tuberculosis
AVLALASVEAFFGAGAQRQLDGD

SEQ ID NO: 1472810 - protein, 26 aa, Mycobacterium tuberculosis
AVLSRAQLLELVWGYDFAADTNVVDV

SEQ ID NO: 1472811 - protein, 18 aa, Mycobacterium tuberculosis
AVRNELNLSVLQRELTRL

SEQ ID NO: 1472812 - protein, 18 aa, Mycobacterium tuberculosis
AVSSFGLSGTNAHVVVEQ

SEQ ID NO: 1472813 - protein, 26 aa, Mycobacterium tuberculosis
AVVSELFLRAAQAYGVKRGQRMLGLS

SEQ ID NO: 1472814 - protein, 18 aa, Mycobacterium tuberculosis
AVWSDGTPITWRDIASQI

SEQ ID NO: 1472815 - protein, 19 aa, Mycobacterium tuberculosis
AWDYRARARAARALHGEPV

SEQ ID NO: 1472816 - protein, 22 aa, Mycobacterium tuberculosis
CAALPVLDTRAADTILGYDERG

SEQ ID NO: 1472817 - protein, 33 aa, Mycobacterium tuberculosis
CAARIVGGRCLMPASSAARCAARIVGGRCLMPA

SEQ ID NO: 1472818 - protein, 20 aa, Mycobacterium tuberculosis
CADGRYVAVGAIEPQFYAAM

SEQ ID NO: 1472819 - protein, 33 aa, Mycobacterium tuberculosis
CCADGDPQLARARWRRVRSLPHLQDRWVAMFGD

SEQ ID NO: 1472820 - protein, 20 aa, Mycobacterium tuberculosis
CEAVARLGRHQFPLVCTDTV

SEQ ID NO: 1472821 - protein, 33 aa, Mycobacterium tuberculosis; identical to SEQ ID NO: 197423

SEQ ID NO: 1472822 - protein, 25 aa, Mycobacterium tuberculosis
CGSPTTARCGWLLSLGGAATDRLLS

SEQ ID NO: 1472823 - protein, 19 aa, Mycobacterium tuberculosis
CKLPEAIAAVSHERIALLV

SEQ ID NO: 1472824 - protein, 17 aa, Mycobacterium tuberculosis
CKSNVLYKGALQGDPAS

SEQ ID NO: 1472825 - protein, 24 aa, Mycobacterium tuberculosis
CLTLKGFTYSQMRLPGGDTVDVYN

SEQ ID NO: 1472826 - protein, 24 aa, Mycobacterium tuberculosis
CPASAYSRMCLTTFFTSLTQRFPQ

SEQ ID NO: 1472827 - protein, 29 aa, Mycobacterium tuberculosis
CPDRRIAVETCWRKAIQMDYETDTDTELV

SEQ ID NO: 1472828 - protein, 26 aa, Mycobacterium tuberculosis
CQVAAMALRIGVAVAHRDRDYEAIRT

SEQ ID NO: 1472829 - protein, 22 aa, Mycobacterium tuberculosis
CRAKHRLPGLQFVQGDAQNLPF

SEQ ID NO: 1472830 - protein, 28 aa, Mycobacterium tuberculosis
CRYCMPEAEYAWLPRADLLSVDEISLIV

SEQ ID NO: 1472831 - protein, 20 aa, Mycobacterium tuberculosis
CSWRRWWPDLRLQVTEDRAD

SEQ ID NO: 1472832 - protein, 21 aa, Mycobacterium tuberculosis
CTAAARAVSWPAVTSPAGPVT

SEQ ID NO: 1472833 - protein, 18 aa, Mycobacterium tuberculosis
CTGQDSFADPVRVDPITD

SEQ ID NO: 1472834 - protein, 17 aa, Mycobacterium tuberculosis
CTYHVAHPGGRAYDEPP

SEQ ID NO: 1472835 - protein, 17 aa, Mycobacterium tuberculosis
CVRDGLMSSRAAEAAET

SEQ ID NO: 1472836 - protein, 22 aa, Mycobacterium tuberculosis
DAASVFARRVPLAAAVWTQRGW

SEQ ID NO: 1472837 - protein, 21 aa, Mycobacterium tuberculosis
DAGVLGALAGVLAKRQHQTRV

SEQ ID NO: 1472838 - protein, 24 aa, Mycobacterium tuberculosis
DAHTWLRDHGVSLDAPARPRPVTA

SEQ ID NO: 1472839 - protein, 18 aa, Mycobacterium tuberculosis
DAPAGRAGSQGVGGDGGA

SEQ ID NO: 1472840 - protein, 42 aa, Mycobacterium tuberculosis
DASDLSNILLLGPVGDLFPILSIPGAMSQNFTNVVMTVTDTT

SEQ ID NO: 1472841 - protein, 24 aa, Mycobacterium tuberculosis
DASRRIRDAFVVGDGYAELMTADY

SEQ ID NO: 1472842 - protein, 22 aa, Mycobacterium tuberculosis
DATRVQVLWSLADREMSVNELA

SEQ ID NO: 1472843 - protein, 18 aa, Mycobacterium tuberculosis
DCKSNVLYKGALQGDPAS

SEQ ID NO: 1472844 - protein, 17 aa, Mycobacterium tuberculosis
DDSRRLLQMVGRDLGLD

SEQ ID NO: 1472845 - protein, 41 aa, Mycobacterium tuberculosis; identical to SEQ ID NO: 197680

SEQ ID NO: 1472846 - protein, 33 aa, Mycobacterium tuberculosis
DEIARCATYPVLAVQAWAAFHDMTLRAVIGTAE

SEQ ID NO: 1472847 - protein, 21 aa, Mycobacterium tuberculosis
DEIWQCDGCSITHQRDDNAAI

SEQ ID NO: 1472848 - protein, 21 aa, Mycobacterium tuberculosis
DFDPIYCWPKPVTKPYPPLYV

SEQ ID NO: 1472849 - protein, 30 aa, Mycobacterium tuberculosis; identical to SEQ ID NO: 214614

SEQ ID NO: 1472850 - protein, 24 aa, Mycobacterium tuberculosis
DGKPVVRRRILLPEHKDFGRIAPD

SEQ ID NO: 1472851 - protein, 26 aa, Mycobacterium tuberculosis
DGLRVICRRSRLMSRIAGSGAMASVE

SEQ ID NO: 1472852 - protein, 19 aa, Mycobacterium tuberculosis
DGPDRVRISGVIGEPPPPT

SEQ ID NO: 1472853 - protein, 20 aa, Mycobacterium tuberculosis
DGQWRLRQQRHFGCGGQPEF

SEQ ID NO: 1472854 - protein, 20 aa, Mycobacterium tuberculosis
DGRMLPLLVVNGLTVIRTAR

SEQ ID NO: 1472855 - protein, 21 aa, Mycobacterium tuberculosis
DGYFSRPGLARVAAGKVSPSA

SEQ ID NO: 1472856 - protein, 17 aa, Mycobacterium tuberculosis
DITCPILAFVGEVDDIG

SEQ ID NO: 1472857 - protein, 17 aa, Mycobacterium tuberculosis
DKPWFSYVCPGAGHAPH

SEQ ID NO: 1472858 - protein, 19 aa, Mycobacterium tuberculosis
DKRRFWLSAEGSGADVSGL

SEQ ID NO: 1472859 - protein, 21 aa, Mycobacterium tuberculosis
DKVTALQLVWADRRGRWPWAA

SEQ ID NO: 1472860 - protein, 19 aa, Mycobacterium tuberculosis
DLAAAIPMMVFSGVMNAGQ

SEQ ID NO: 1472861 - protein, 24 aa, Mycobacterium tuberculosis
DLAAAVSWTLGRGVISHESALALH

SEQ ID NO: 1472862 - protein, 20 aa, Mycobacterium tuberculosis
DLADAWARRLHIGRSELLRD

SEQ ID NO: 1472863 - protein, 17 aa, Mycobacterium tuberculosis
DLDALWTALKTLYPVGI

SEQ ID NO: 1472864 - protein, 24 aa, Mycobacterium tuberculosis
DLETDWPIRAALLSTPEQTVLSLV

SEQ ID NO: 1472865 - protein, 26 aa, Mycobacterium tuberculosis
DLLAFTAFPKQIWRQIGSNNPQERLN

SEQ ID NO: 1472866 - protein, 23 aa, Mycobacterium tuberculosis
DLLDSWAGTLIVVSHDRYLLERV

SEQ ID NO: 1472867 - protein, 20 aa, Mycobacterium tuberculosis
DLLLVPSIVEPSNFLENISR

SEQ ID NO: 1472868 - protein, 22 aa, Mycobacterium tuberculosis
DLRADWPAALQAAGLDSTAPTA

SEQ ID NO: 1472869 - protein, 24 aa, Mycobacterium tuberculosis
DLVEAIGVDAARYSLIRSSVDTAI

SEQ ID NO: 1472870 - protein, 17 aa, Mycobacterium tuberculosis
DMFRLDLDGIVARLRPA

SEQ ID NO: 1472871 - protein, 22 aa, Mycobacterium tuberculosis
DNKRFKVVWQVLNALRSHDERF

SEQ ID NO: 1472872 - protein, 24 aa, Mycobacterium tuberculosis
DPERTADLATRFGVESSIARLQKA

SEQ ID NO: 1472873 - protein, 17 aa, Mycobacterium tuberculosis
DPLEPGGRLPIDREPRA

SEQ ID NO: 1472874 - protein, 20 aa, Mycobacterium tuberculosis
DPMQWRVLERAFSRHSALIL

SEQ ID NO: 1472875 - protein, 18 aa, Mycobacterium tuberculosis
DPQQRLMLEVSWEALEHA

SEQ ID NO: 1472876 - protein, 23 aa, Mycobacterium tuberculosis
DPRSNLARYGIAPTYPGDFAADV

SEQ ID NO: 1472877 - protein, 25 aa, Mycobacterium tuberculosis
DQARTIRIPVHMVEVINKLGRIQRE

SEQ ID NO: 1472878 - protein, 20 aa, Mycobacterium tuberculosis
DQRTFGGWLLADLVTVDGSV

SEQ ID NO: 1472879 - protein, 24 aa, Mycobacterium tuberculosis
DRDVIDAFLAWYVPGLDISDHTML

SEQ ID NO: 1472880 - protein, 19 aa, Mycobacterium tuberculosis
DRERIALSNVRIKSSVQNY

SEQ ID NO: 1472881 - protein, 23 aa, Mycobacterium tuberculosis
DRGFYAGAVGWCDGRGDGHWVVS

SEQ ID NO: 1472882 - protein, 22 aa, Mycobacterium tuberculosis
DRGMPVLGICNGFQVLCEAGLL

SEQ ID NO: 1472883 - protein, 20 aa, Mycobacterium tuberculosis
DRGSMDWMPLGDYETFRHWS

SEQ ID NO: 1472884 - protein, 28 aa, Mycobacterium tuberculosis
DRRATRLVAEWPPRLNIPDPDPLRLIYF

SEQ ID NO: 1472885 - protein, 25 aa, Mycobacterium tuberculosis
DRRFTRTRLRTEVLPLLEDVLGGGV

SEQ ID NO: 1472886 - protein, 17 aa, Mycobacterium tuberculosis
DRSTLQTSLLLTVMIDE

SEQ ID NO: 1472887 - protein, 19 aa, Mycobacterium tuberculosis
DRVIDRAPLWCAVDLRDGN

SEQ ID NO: 1472888 - protein, 17 aa, Mycobacterium tuberculosis
DRVNLAITALRDEVEAE

SEQ ID NO: 1472889 - protein, 17 aa, Mycobacterium tuberculosis
DRWFLPLAVPLGLGPKN

SEQ ID NO: 1472890 - protein, 24 aa, Mycobacterium tuberculosis
DRYRMYPLVRRLLFLIPPEHAHKL

SEQ ID NO: 1472891 - protein, 17 aa, Mycobacterium tuberculosis
DSFLRAAELLGVTPDAA

SEQ ID NO: 1472892 - protein, 20 aa, Mycobacterium tuberculosis
DSLRIFPATHYVAGPERMAH

SEQ ID NO: 1472893 - protein, 20 aa, Mycobacterium tuberculosis
DSRLRELVIMRIGWLTDCDY

SEQ ID NO: 1472894 - protein, 18 aa, Mycobacterium tuberculosis
DSRLRVLARREFAGMISV

SEQ ID NO: 1472895 - protein, 22 aa, Mycobacterium tuberculosis
DSSSWKGWGHVRWFIEEVPAGA

SEQ ID NO: 1472896 - protein, 23 aa, Mycobacterium tuberculosis
DSSYHAELFWWTGAFETSEGIPH

SEQ ID NO: 1472897 - protein, 24 aa, Mycobacterium tuberculosis
DTPCDLLIAVGVSFGGLVTRSFSP

SEQ ID NO: 1472898 - protein, 25 aa, Mycobacterium tuberculosis
DVIGLRIAGGAIVWATPDHKVLTEY

SEQ ID NO: 1472899 - protein, 23 aa, Mycobacterium tuberculosis
DVMPEDLIKFGLIPEFIGRLPVV

SEQ ID NO: 1472900 - protein, 25 aa, Mycobacterium tuberculosis
DVVEAIVAQGVWCGMTIPRVYPEMP

SEQ ID NO: 1472901 - protein, 33 aa, Mycobacterium tuberculosis; identical to SEQ ID NO: 209256

SEQ ID NO: 1472902 - protein, 18 aa, Mycobacterium tuberculosis
DWVRINGFGTPWWADDLA

SEQ ID NO: 1472903 - protein, 17 aa, Mycobacterium tuberculosis
EAAHGRRLLRIAASSAF

SEQ ID NO: 1472904 - protein, 24 aa, Mycobacterium tuberculosis
EAAHGRRLLRIAASSAFAEHAAPG

SEQ ID NO: 1472905 - protein, 18 aa, Mycobacterium tuberculosis
EAALRVARDIAAKDTRVI

SEQ ID NO: 1472906 - protein, 18 aa, Mycobacterium tuberculosis
EAARRTLNRPGFGLTESL

SEQ ID NO: 1472907 - protein, 21 aa, Mycobacterium tuberculosis
EADRLASRLARIDDIEGDRDR

SEQ ID NO: 1472908 - protein, 24 aa, Mycobacterium tuberculosis
EAELRRGRRYSVARRLAGLFASYA

SEQ ID NO: 1472909 - protein, 19 aa, Mycobacterium tuberculosis
EAIVDRIDYIVSLGETVMS

SEQ ID NO: 1472910 - protein, 18 aa, Mycobacterium tuberculosis
EALEHAGIDPLSLRGSAT

SEQ ID NO: 1472911 - protein, 17 aa, Mycobacterium tuberculosis
EALGRWDKPFLAIFGYR

SEQ ID NO: 1472912 - protein, 17 aa, Mycobacterium tuberculosis
EALMSVASEVAGIGSAL

SEQ ID NO: 1472913 - protein, 34 aa, Mycobacterium tuberculosis; identical to SEQ ID NO: 209263

SEQ ID NO: 1472914 - protein, 17 aa, Mycobacterium tuberculosis
ECVLRRFPILGFQHPLS

SEQ ID NO: 1472915 - protein, 25 aa, Mycobacterium tuberculosis
EDGWVRAQLLHYMRSAPRRNVADPD

SEQ ID NO: 1472916 - protein, 22 aa, Mycobacterium tuberculosis
EDLSWLWDVRFEHFEKTRVVAA

SEQ ID NO: 1472917 - protein, 21 aa, Mycobacterium tuberculosis
EDRYLEVWNLVFMQNERGEGT

SEQ ID NO: 1472918 - protein, 18 aa, Mycobacterium tuberculosis
EELLGVVASEGWQGQAAE

SEQ ID NO: 1472919 - protein, 18 aa, Mycobacterium tuberculosis
EESYVLLVRVASARALED

SEQ ID NO: 1472920 - protein, 21 aa, Mycobacterium tuberculosis
EFDGRIITVPFSFKEIDDDGL

SEQ ID NO: 1472921 - protein, 19 aa, Mycobacterium tuberculosis
EGFAPRKGAARRAWLAELA

SEQ ID NO: 1472922 - protein, 23 aa, Mycobacterium tuberculosis
EGIGRPRVEPSFLPGVVDRMVAV

SEQ ID NO: 1472923 - protein, 19 aa, Mycobacterium tuberculosis
EGLGPFPTDRGWALRELFD

SEQ ID NO: 1472924 - protein, 19 aa, Mycobacterium tuberculosis
EGLRFAIREGGRTVGAGRV

SEQ ID NO: 1472925 - protein, 18 aa, Mycobacterium tuberculosis
EGPKGGPGMREMLAITGA

SEQ ID NO: 1472926 - protein, 20 aa, Mycobacterium tuberculosis
EGTYSLPLIGSWHGTDGGYL

SEQ ID NO: 1472927 - protein, 18 aa, Mycobacterium tuberculosis
EGVLDVINAPALALLGRP

SEQ ID NO: 1472928 - protein, 20 aa, Mycobacterium tuberculosis
EGVSALLIRVGESGVAPDRL

SEQ ID NO: 1472929 - protein, 20 aa, Mycobacterium tuberculosis
EGVTLRFGSKVPGTAMEVRD

SEQ ID NO: 1472930 - protein, 17 aa, Mycobacterium tuberculosis
EGWAERVRLAHALGPTM

SEQ ID NO: 1472931 - protein, 26 aa, Mycobacterium tuberculosis
EGWAGCFTEDGAFEFDGWVIRGRPAL

SEQ ID NO: 1472932 - protein, 18 aa, Mycobacterium tuberculosis
EHAIVQFVKAICSPMALA

SEQ ID NO: 1472933 - protein, 17 aa, Mycobacterium tuberculosis
EHILLRTVRCVSGTVEL

SEQ ID NO: 1472934 - protein, 17 aa, Mycobacterium tuberculosis
EHIRVFPLSNWTEFDIW

SEQ ID NO: 1472935 - protein, 25 aa, Mycobacterium tuberculosis
EIAESPIDWDIAWPAGDLQVNLTPA

SEQ ID NO: 1472936 - protein, 20 aa, Mycobacterium tuberculosis
EIAGIGAGVTWAADNRTVYY

SEQ ID NO: 1472937 - protein, 21 aa, Mycobacterium tuberculosis
EIKSQDLLTANGFQPFEDEEV

SEQ ID NO: 1472938 - protein, 20 aa, Mycobacterium tuberculosis
EINSGRMFFGAGSGPMLAAA

SEQ ID NO: 1472939 - protein, 33 aa, Mycobacterium tuberculosis; identical to SEQ ID NO: 209281

SEQ ID NO: 1472940 - protein, 24 aa, Mycobacterium tuberculosis
ELAAPSLDIGIPWRQYLRVQQGIR

SEQ ID NO: 1472941 - protein, 25 aa, Mycobacterium tuberculosis
ELGANHALHGVLMATNFFGINTIPI

SEQ ID NO: 1472942 - protein, 22 aa, Mycobacterium tuberculosis
ELLVRGGVVFSGYWRNEQATTE

SEQ ID NO: 1472943 - protein, 24 aa, Mycobacterium tuberculosis
ELPSRLAANPSIAGWLRELEAVCT

SEQ ID NO: 1472944 - protein, 22 aa, Mycobacterium tuberculosis
ELREKIGAVAMGRVLTLSIAPD

SEQ ID NO: 1472945 - protein, 19 aa, Mycobacterium tuberculosis
ELRQITGRVPVEIPRMRGA

SEQ ID NO: 1472946 - protein, 17 aa, Mycobacterium tuberculosis
ELSEICGHIASLPATAV

SEQ ID NO: 1472947 - protein, 19 aa, Mycobacterium tuberculosis
ELWMLMSPTMIARGVKGTN

SEQ ID NO: 1472948 - protein, 19 aa, Mycobacterium tuberculosis
ELYDPEILTARYSVGAVDA

SEQ ID NO: 1472949 - protein, 21 aa, Mycobacterium tuberculosis
EMLGAAATDLASIGSAISTAN

SEQ ID NO: 1472950 - protein, 25 aa, Mycobacterium tuberculosis
EMLTTAATDLAKIGSTITAANTAAA

SEQ ID NO: 1472951 - protein, 25 aa, Mycobacterium tuberculosis
ENNRGRAGYRLLYSVRQYALEKLSE

SEQ ID NO: 1472952 - protein, 18 aa, Mycobacterium tuberculosis
EPAFFGVRPHVVLKGGAI

SEQ ID NO: 1472953 - protein, 23 aa, Mycobacterium tuberculosis
EPEPHWGPFGGAAPVSAGVGHAA

SEQ ID NO: 1472954 - protein, 24 aa, Mycobacterium tuberculosis
EPSGWAYWVAESLLGPGTQLADLK

SEQ ID NO: 1472955 - protein, 22 aa, Mycobacterium tuberculosis
ERARCIAGGLAAAGVGLGDVVG

SEQ ID NO: 1472956 - protein, 23 aa, Mycobacterium tuberculosis
ERFRTRYAIPIERHGHTEPAERL

SEQ ID NO: 1472957 - protein, 24 aa, Mycobacterium tuberculosis
ERGPGQMLGGLPVGQMGARAGGGL

SEQ ID NO: 1472958 - protein, 21 aa, Mycobacterium tuberculosis
ERLDDRFQFGVLLTAAPEATP

SEQ ID NO: 1472959 - protein, 46 aa, Mycobacterium tuberculosis
ERLTCSPWLNAEWRLVSDHIRAIVALGGFAWQVALRLAGASGTPKP

SEQ ID NO: 1472960 - protein, 18 aa, Mycobacterium tuberculosis
ERYRICSTVHTKIAVVKS

SEQ ID NO: 1472961 - protein, 18 aa, Mycobacterium tuberculosis
ESDQRSAAVIARNIEALG

SEQ ID NO: 1472962 - protein, 17 aa, Mycobacterium tuberculosis
ESEFRTSLRSCPAEKRR

SEQ ID NO: 1472963 - protein, 25 aa, Mycobacterium tuberculosis
ESGKMTGRSRLEVVDPSAAAQLADT

SEQ ID NO: 1472964 - protein, 19 aa, Mycobacterium tuberculosis
ESPIVFLRLRKAARRHRVP

SEQ ID NO: 1472965 - protein, 18 aa, Mycobacterium tuberculosis
ETLPERWSADAGPEQMAI

SEQ ID NO: 1472966 - protein, 25 aa, Mycobacterium tuberculosis
ETLVRAASDLANIGSTLGAANAAAL

SEQ ID NO: 1472967 - protein, 19 aa, Mycobacterium tuberculosis
EVHPCCADGDPQLARARWR

SEQ ID NO: 1472968 - protein, 19 aa, Mycobacterium tuberculosis
EVIAAAATDLASLESSIAA

SEQ ID NO: 1472969 - protein, 19 aa, Mycobacterium tuberculosis
EVKAKILSLLDEVAQGEEI

SEQ ID NO: 1472970 - protein, 20 aa, Mycobacterium tuberculosis
EVNSALMFAGAGSGPTLAAA

SEQ ID NO: 1472971 - protein, 17 aa, Mycobacterium tuberculosis
EVPADRIVNTWPADTLL

SEQ ID NO: 1472972 - protein, 22 aa, Mycobacterium tuberculosis
EVSALTAAQFAAHAQMYQTVSA

SEQ ID NO: 1472973 - protein, 18 aa, Mycobacterium tuberculosis
FAKLGVRDEIVRALGEEG

SEQ ID NO: 1472974 - protein, 23 aa, Mycobacterium tuberculosis
FASLDRWPGTVGEYLNTMFDPSL

SEQ ID NO: 1472975 - protein, 18 aa, Mycobacterium tuberculosis
FDRLPRRLVERVTPKPGT

SEQ ID NO: 1472976 - protein, 24 aa, Mycobacterium tuberculosis
FDSVWLCDHFLKISPGEYAKVAGI

SEQ ID NO: 1472977 - protein, 21 aa, Mycobacterium tuberculosis
FEAACSVIPGGVNSPVRAFTA

SEQ ID NO: 1472978 - protein, 21 aa, Mycobacterium tuberculosis
FEQHLRAVLDYPLGDSDAVVP

SEQ ID NO: 1472979 - protein, 18 aa, Mycobacterium tuberculosis
FEQRPGEALALGQVLDTL

SEQ ID NO: 1472980 - protein, 25 aa, Mycobacterium tuberculosis
FERIARGVPVAAPWDARRARELDDV

SEQ ID NO: 1472981 - protein, 19 aa, Mycobacterium tuberculosis
FESHCGWPSFFDPKSSDAV

SEQ ID NO: 1472982 - protein, 17 aa, Mycobacterium tuberculosis
FEVEQMLPLDGHTPLTT

SEQ ID NO: 1472983 - protein, 19 aa, Mycobacterium tuberculosis
FFYIKGRSSEMIICGGVNI

SEQ ID NO: 1472984 - protein, 20 aa, Mycobacterium tuberculosis
FGGGASGFWNLASATSGLSG

SEQ ID NO: 1472985 - protein, 25 aa, Mycobacterium tuberculosis
FGISGEVTFDYGIAYDRSRKVAEGR

SEQ ID NO: 1472986 - protein, 26 aa, Mycobacterium tuberculosis
FGLIPEFIGRLPVVASVTNLDKESLV

SEQ ID NO: 1472987 - protein, 18 aa, Mycobacterium tuberculosis
FGNHGARLSGILNNGSGP

SEQ ID NO: 1472988 - protein, 20 aa, Mycobacterium tuberculosis
FGQRFPDRLFDVGIAEQHAM

SEQ ID NO: 1472989 - protein, 17 aa, Mycobacterium tuberculosis
FGRPGGAPRRGRKSKRQ

SEQ ID NO: 1472990 - protein, 19 aa, Mycobacterium tuberculosis
FIGECKVWSGPRTMDDALK

SEQ ID NO: 1472991 - protein, 21 aa, Mycobacterium tuberculosis
FIVTEIFPGGRLPSIPMVQEC

SEQ ID NO: 1472992 - protein, 23 aa, Mycobacterium tuberculosis
FKHLHRAGLRRVFIGVETGSYEQ

SEQ ID NO: 1472993 - protein, 18 aa, Mycobacterium tuberculosis
FKTALRLARHRELVDGAD

SEQ ID NO: 1472994 - protein, 29 aa, Mycobacterium tuberculosis
FLHIPFPPVELFMQMPWRTEIIQGLLGAD

SEQ ID NO: 1472995 - protein, 17 aa, Mycobacterium tuberculosis
FLISACGILTVPKLPDI

SEQ ID NO: 1472996 - protein, 17 aa, Mycobacterium tuberculosis
FLKRVRKVVDDEFPGRV

SEQ ID NO: 1472997 - protein, 24 aa, Mycobacterium tuberculosis
FNVNLKLQFLHDAFPNEFPDPTIS

SEQ ID NO: 1472998 - protein, 17 aa, Mycobacterium tuberculosis
FPEDIWVPERDPGTTRL

SEQ ID NO: 1472999 - protein, 17 aa, Mycobacterium tuberculosis
FPGGLTFPRASAGVTGL

SEQ ID NO: 1473000 - protein, 29 aa, Mycobacterium tuberculosis
FPKVAAMHYPVWRQSWTGILDPYLLDMIG

SEQ ID NO: 1473001 - protein, 21 aa, Mycobacterium tuberculosis
FPVTVNWSTPAVTIFPNGISI

SEQ ID NO: 1473002 - protein, 23 aa, Mycobacterium tuberculosis
FPYAWPRMPILATNVVCTSQPLA

SEQ ID NO: 1473003 - protein, 18 aa, Mycobacterium tuberculosis
FQHGHSAWREDGNYSPQL

SEQ ID NO: 1473004 - protein, 17 aa, Mycobacterium tuberculosis
FQHQKFWLAPAPSVSDP

SEQ ID NO: 1473005 - protein, 17 aa, Mycobacterium tuberculosis
FRLSPPVLSGAMGPFMH

SEQ ID NO: 1473006 - protein, 18 aa, Mycobacterium tuberculosis
FRPATLHQAYLALRAWGL

SEQ ID NO: 1473007 - protein, 17 aa, Mycobacterium tuberculosis
FRSPEALIALAMLALGG

SEQ ID NO: 1473008 - protein, 17 aa, Mycobacterium tuberculosis
FSAKFASAVSKNPFVGE

SEQ ID NO: 1473009 - protein, 21 aa, Mycobacterium tuberculosis
FSDKQLDMMAAFADQAALAWR

SEQ ID NO: 1473010 - protein, 22 aa, Mycobacterium tuberculosis
FSMHGELYKAIARQAHVIHESF

SEQ ID NO: 1473011 - protein, 26 aa, Mycobacterium tuberculosis
FSRWNVGKDLSFVPLRPERVVEVRYD

SEQ ID NO: 1473012 - protein, 22 aa, Mycobacterium tuberculosis
FTAFPKAHWQKIWSTNPLERIN

SEQ ID NO: 1473013 - protein, 18 aa, Mycobacterium tuberculosis
FTKARLSDGVLGVRAEYL

SEQ ID NO: 1473014 - protein, 18 aa, Mycobacterium tuberculosis
FTVADAYQGRGIGSFLIG

SEQ ID NO: 1473015 - protein, 18 aa, Mycobacterium tuberculosis
FVAALRAIWLAWQDGTKL

SEQ ID NO: 1473016 - protein, 18 aa, Mycobacterium tuberculosis
FVDAMCRKVLRLTPEDTG

SEQ ID NO: 1473017 - protein, 20 aa, Mycobacterium tuberculosis
FVIAANRSRLVSLALSNLFG

SEQ ID NO: 1473018 - protein, 23 aa, Mycobacterium tuberculosis
FVIGASNRFAHAAALAIAEAPAR

SEQ ID NO: 1473019 - protein, 32 aa, Mycobacterium tuberculosis
FWTGDYQGLLDFSFPVGPLIPQTHLVHLRETV

SEQ ID NO: 1473020 - protein, 24 aa, Mycobacterium tuberculosis
FWYQIPMSLPVIGPRVISDPKGRY

SEQ ID NO: 1473021 - protein, 18 aa, Mycobacterium tuberculosis
FYDSCRVLPQGDEQPTDL

SEQ ID NO: 1473022 - protein, 22 aa, Mycobacterium tuberculosis
FYEADYWKARLAETPVDVATLE

SEQ ID NO: 1473023 - protein, 20 aa, Mycobacterium tuberculosis
GAAGLLGVGGHGGAGGHGAE

SEQ ID NO: 1473024 - protein, 24 aa, Mycobacterium tuberculosis
GAALLPTHCWFEGRGWGFQVYPAL

SEQ ID NO: 1473025 - protein, 26 aa, Mycobacterium tuberculosis
GAAQRAGIELLAFGGRFVEIGKRDIY

SEQ ID NO: 1473026 - protein, 19 aa, Mycobacterium tuberculosis
GACRRVRRVARVRVLRADT

SEQ ID NO: 1473027 - protein, 33 aa, Mycobacterium tuberculosis; identical to SEQ ID NO: 235141

SEQ ID NO: 1473028 - protein, 21 aa, Mycobacterium tuberculosis
GAEALLRWEHPTLGTLLPGRF

SEQ ID NO: 1473029 - protein, 17 aa, Mycobacterium tuberculosis
GAGGFGLTTGGPGAAGG

SEQ ID NO: 1473030 - protein, 20 aa, Mycobacterium tuberculosis
GAGGQGGLLFGDGGNGGAGG

SEQ ID NO: 1473031 - protein, 35 aa, Mycobacterium tuberculosis; identical to SEQ ID NO: 199487

SEQ ID NO: 1473032 - protein, 21 aa, Mycobacterium tuberculosis
GAGGSAMLFGAGGAGGAGGAA

SEQ ID NO: 1473033 - protein, 26 aa, Mycobacterium tuberculosis
GAGGTGGPGGFGIFGGGAGGDGGSGG

SEQ ID NO: 1473034 - protein, 26 aa, Mycobacterium tuberculosis
GAIELGIKWLSLYAFSTENWKRSPEE

SEQ ID NO: 1473035 - protein, 17 aa, Mycobacterium tuberculosis
GALLPRLHKLVRADCTT

SEQ ID NO: 1473036 - protein, 20 aa, Mycobacterium tuberculosis
GARTRYFDAFFRDATSAGIR

SEQ ID NO: 1473037 - protein, 23 aa, Mycobacterium tuberculosis
GATVGFAGSGGFGGAGGIAQLFG

SEQ ID NO: 1473038 - protein, 17 aa, Mycobacterium tuberculosis
GAVALVAGWAARNLPAD

SEQ ID NO: 1473039 - protein, 31 aa, Mycobacterium tuberculosis; identical to SEQ ID NO: 199577

SEQ ID NO: 1473040 - protein, 33 aa, Mycobacterium tuberculosis
GCDGVVIGRGCLGRPWLFAELSAAFTGSPAPTP

SEQ ID NO: 1473041 - protein, 22 aa, Mycobacterium tuberculosis
GCGKCGNHLAGSYRTDGQVVYV

SEQ ID NO: 1473042 - protein, 17 aa, Mycobacterium tuberculosis
GCGKTTLLSCLGGILRP

SEQ ID NO: 1473043 - protein, 21 aa, Mycobacterium tuberculosis
GDAASFVGEIGKILADSVEQL

SEQ ID NO: 1473044 - protein, 30 aa, Mycobacterium tuberculosis; identical to SEQ ID NO: 199618

SEQ ID NO: 1473045 - protein, 17 aa, Mycobacterium tuberculosis
GDGGQFGAGGNGGAGGS

SEQ ID NO: 1473046 - protein, 25 aa, Mycobacterium tuberculosis
GDGGRGAHGTLFSSLAGTGGTGGNG

SEQ ID NO: 1473047 - protein, 24 aa, Mycobacterium tuberculosis
GDILTRLTAPVIRGLGIGIVPAAT

SEQ ID NO: 1473048 - protein, 18 aa, Mycobacterium tuberculosis
GDISVCLHDPCLPVDLTV

SEQ ID NO: 1473049 - protein, 20 aa, Mycobacterium tuberculosis
GDKLSVAKGMMLRRDPDREA

SEQ ID NO: 1473050 - protein, 22 aa, Mycobacterium tuberculosis
GDKVTALQLVWADRRGRWPWAA

SEQ ID NO: 1473051 - protein, 29 aa, Mycobacterium tuberculosis
GDLATIWRGGCIIRAKFLNHIKEAFDASP

SEQ ID NO: 1473052 - protein, 21 aa, Mycobacterium tuberculosis
GDLPGWLALHGYQNSRKRAVA

SEQ ID NO: 1473053 - protein, 24 aa, Mycobacterium tuberculosis
GDLWAAPSGWRGGGHMAPVRTAMR

SEQ ID NO: 1473054 - protein, 32 aa, Mycobacterium tuberculosis
GDMGNGAFWRGDQQGLFSAGYRVHVPEIPAHV

SEQ ID NO: 1473055 - protein, 17 aa, Mycobacterium tuberculosis
GDTMVFFGGIEPVALHE

SEQ ID NO: 1473056 - protein, 20 aa, Mycobacterium tuberculosis
GEESYVLLVRVASARALEDL

SEQ ID NO: 1473057 - protein, 20 aa, Mycobacterium tuberculosis
GEMWAQDAAAMFGYAAATAT

SEQ ID NO: 1473058 - protein, 26 aa, Mycobacterium tuberculosis
GENRLKIARLLALIDMLSDRFIGEPA

SEQ ID NO: 1473059 - protein, 22 aa, Mycobacterium tuberculosis
GEPAPHVKPAALAEQPGVPGQH

SEQ ID NO: 1473060 - protein, 21 aa, Mycobacterium tuberculosis
GEVGVGFVVGSAHHFDTAIGE

SEQ ID NO: 1473061 - protein, 27 aa, Mycobacterium tuberculosis
GEVRYFIDRLAGWYVITSSDRMSREGY

SEQ ID NO: 1473062 - protein, 17 aa, Mycobacterium tuberculosis
GFGSLRPLLEVAAAHGR

SEQ ID NO: 1473063 - protein, 19 aa, Mycobacterium tuberculosis
GFVDARGFDSLPIEERRRD

SEQ ID NO: 1473064 - protein, 20 aa, Mycobacterium tuberculosis
GGAAGLFGHGGNGGAGGSNA

SEQ ID NO: 1473065 - protein, 24 aa, Mycobacterium tuberculosis
GGADALRYPARYLFVFLDHHGMLS

SEQ ID NO: 1473066 - protein, 32 aa, Mycobacterium tuberculosis
GGADRLGCGCGRADCAAGKRPAAPPVVIHLIA

SEQ ID NO: 1473067 - protein, 26 aa, Mycobacterium tuberculosis
GGAGDRGGAGGTGFISSDGGAGGDGG

SEQ ID NO: 1473068 - protein, 31 aa, Mycobacterium tuberculosis; identical to SEQ ID NO: 199783

SEQ ID NO: 1473069 - protein, 26 aa, Mycobacterium tuberculosis
GGAGGDGGNAGFFGNGGNGGMGGAGA

SEQ ID NO: 1473070 - protein, 26 aa, Mycobacterium tuberculosis
GGAGGDRAGALVGRDGGPGGNGGAGG

SEQ ID NO: 1473071 - protein, 27 aa, Mycobacterium tuberculosis
GGAGGNGGRGGMLIGNGGAGGAGGTGG

SEQ ID NO: 1473072 - protein, 25 aa, Mycobacterium tuberculosis
GGAGGRSGLFEVLAAGGAGGTGGLS

SEQ ID NO: 1473073 - protein, 23 aa, Mycobacterium tuberculosis
GGAGGSGGWLLGNGGVGGAGGQS

SEQ ID NO: 1473074 - protein, 25 aa, Mycobacterium tuberculosis
GGAIARLPAIFTHRDVGNTDCPGNA

SEQ ID NO: 1473075 - protein, 25 aa, Mycobacterium tuberculosis
GGDGGKGGSGLGVGGAGGTGGAGGN

SEQ ID NO: 1473076 - protein, 27 aa, Mycobacterium tuberculosis
GGDGVFEGIAVLGLGFGGAAGAGGAAT

SEQ ID NO: 1473077 - protein, 21 aa, Mycobacterium tuberculosis
GGFERRGRWNVPKKLTTFTLW

SEQ ID NO: 1473078 - protein, 23 aa, Mycobacterium tuberculosis
GGGGNRQSIVIDFVRHGQTPGNA

SEQ ID NO: 1473079 - protein, 23 aa, Mycobacterium tuberculosis
GGGVRRCLGFGFALTEGAVILQE

SEQ ID NO: 1473080 - protein, 27 aa, Mycobacterium tuberculosis
GGKGADPGGLFPIPGAGGKGGTGGTGG

SEQ ID NO: 1473081 - protein, 26 aa, Mycobacterium tuberculosis
GGLGGAGRDGGAPGGDGGDGGTGGSG

SEQ ID NO: 1473082 - protein, 26 aa, Mycobacterium tuberculosis
GGLGGQLLGRDGFNAPASTPLHTLQQ

SEQ ID NO: 1473083 - protein, 17 aa, Mycobacterium tuberculosis
GGLLPAWSPGGHIDVQL

SEQ ID NO: 1473084 - protein, 17 aa, Mycobacterium tuberculosis
GGLPLSGLLRGVGDEPE

SEQ ID NO: 1473085 - protein, 21 aa, Mycobacterium tuberculosis
GGLPLSGLLRGVGDEPELTDF

SEQ ID NO: 1473086 - protein, 23 aa, Mycobacterium tuberculosis
GGMSPNGCWATFVTCDARLATRL

SEQ ID NO: 1473087 - protein, 17 aa, Mycobacterium tuberculosis
GGNAGAGGTGFTQGADG

SEQ ID NO: 1473088 - protein, 25 aa, Mycobacterium tuberculosis
GGNGGSAGLWGNGGAGGAGGSGGAA

SEQ ID NO: 1473089 - protein, 24 aa, Mycobacterium tuberculosis
GGPGGQGGQAFGANNIGGTGGAGG

SEQ ID NO: 1473090 - protein, 18 aa, Mycobacterium tuberculosis
GGSCGRKVLGEGWGDVLV

SEQ ID NO: 1473091 - protein, 18 aa, Mycobacterium tuberculosis
GGSGGAWAGNGGTGGAGG

SEQ ID NO: 1473092 - protein, 24 aa, Mycobacterium tuberculosis
GGSGGFGAPPPRSIGGGDGGDGGR

SEQ ID NO: 1473093 - protein, 17 aa, Mycobacterium tuberculosis
GGSVRWDPTNGQGRVYY

SEQ ID NO: 1473094 - protein, 20 aa, Mycobacterium tuberculosis
GGTAGLFGVGGAGGAGGNGI

SEQ ID NO: 1473095 - protein, 23 aa, Mycobacterium tuberculosis
GGVGGHGGTAILFGDGGAGGAGA

SEQ ID NO: 1473096 - protein, 29 aa, Mycobacterium tuberculosis
GGVGGNGGRGGWLLGNGGAGGVGGVGGAG

SEQ ID NO: 1473097 - protein, 19 aa, Mycobacterium tuberculosis
GIDGVGLGLLLQHKRIRRT

SEQ ID NO: 1473098 - protein, 18 aa, Mycobacterium tuberculosis
GIFAAPGLMRNCHHGGSA

SEQ ID NO: 1473099 - protein, 21 aa, Mycobacterium tuberculosis
GILGEVWEFITNALNGLKELW

SEQ ID NO: 1473100 - protein, 19 aa, Mycobacterium tuberculosis
GISDVRQGKRFELEVDDTV

SEQ ID NO: 1473101 - protein, 28 aa, Mycobacterium tuberculosis
GITIPEFPIHWTSTGGIGPIIIPDTTIL

SEQ ID NO: 1473102 - protein, 27 aa, Mycobacterium tuberculosis
GKGGEGGVGSILGGPGGNGGTGGNASA

SEQ ID NO: 1473103 - protein, 26 aa, Mycobacterium tuberculosis
GKKCYSLRIASAMAHDEGWLAEHMLI

SEQ ID NO: 1473104 - protein, 18 aa, Mycobacterium tuberculosis
GKPPTWWDSLPTDRPIVY

SEQ ID NO: 1473105 - protein, 20 aa, Mycobacterium tuberculosis
GKTYTRWGAFLDDATGFDAG

SEQ ID NO: 1473106 - protein, 24 aa, Mycobacterium tuberculosis
GLGGAGRDGGAPGGDGGDGGTGGS

SEQ ID NO: 1473107 - protein, 24 aa, Mycobacterium tuberculosis
GLGGQGNHTGGHGGAGGSAGLLAL

SEQ ID NO: 1473108 - protein, 17 aa, Mycobacterium tuberculosis
GLMQLLAATNWFGQNAP

SEQ ID NO: 1473109 - protein, 20 aa, Mycobacterium tuberculosis
GLPRTAFKPSYGIAEATLLV

SEQ ID NO: 1473110 - protein, 25 aa, Mycobacterium tuberculosis
GLPYLGLEHRAAWVEAEADGTITSM

SEQ ID NO: 1473111 - protein, 22 aa, Mycobacterium tuberculosis
GLRAGRNGGFALVIAVDAHGDA

SEQ ID NO: 1473112 - protein, 19 aa, Mycobacterium tuberculosis
GLRDLHAPGYVRAYAYDQD

SEQ ID NO: 1473113 - protein, 19 aa, Mycobacterium tuberculosis
GLRGAGFAGRIVSFEPLPG

SEQ ID NO: 1473114 - protein, 19 aa, Mycobacterium tuberculosis
GLTAIRLAAMAPDLVGELV

SEQ ID NO: 1473115 - protein, 18 aa, Mycobacterium tuberculosis
GLTIPVLLIRGKLSDVVS

SEQ ID NO: 1473116 - protein, 18 aa, Mycobacterium tuberculosis
GLVRGRTGILLVDTGTTL

SEQ ID NO: 1473117 - protein, 33 aa, Mycobacterium tuberculosis
GLVRRSRVHWVRARVVQLERGWVLRDETGGRWQ

SEQ ID NO: 1473118 - protein, 17 aa, Mycobacterium tuberculosis
GLYAVVVDREMSALLDG

SEQ ID NO: 1473119 - protein, 17 aa, Mycobacterium tuberculosis
GLYPGRKFGGGALSVYI

SEQ ID NO: 1473120 - protein, 25 aa, Mycobacterium tuberculosis
GMGPGPLLAAARAWHALAAQYTEIA

SEQ ID NO: 1473121 - protein, 19 aa, Mycobacterium tuberculosis
GNAGILFGAGGIGGTGGTG

SEQ ID NO: 1473122 - protein, 22 aa, Mycobacterium tuberculosis
GNFGGGASGFWNLASATSGLSG

SEQ ID NO: 1473123 - protein, 31 aa, Mycobacterium tuberculosis; identical to SEQ ID NO: 200122

SEQ ID NO: 1473124 - protein, 23 aa, Mycobacterium tuberculosis
GNGGAGGLFMNGGDGGAGGQGGD

SEQ ID NO: 1473125 - protein, 23 aa, Mycobacterium tuberculosis
GNGGTGGQLWGSGGAGGEGGAAL

SEQ ID NO: 1473126 - protein, 17 aa, Mycobacterium tuberculosis
GNGGYSLNGTGGDGGTG

SEQ ID NO: 1473127 - protein, 26 aa, Mycobacterium tuberculosis
GNMIKPMLARGELRLVGATTLDEYRK

SEQ ID NO: 1473128 - protein, 24 aa, Mycobacterium tuberculosis
GPAKMLRLNAGLGNVGNYNVGLGN

SEQ ID NO: 1473129 - protein, 25 aa, Mycobacterium tuberculosis
GPEPVGITAVAARAGHPAQDTRHGR

SEQ ID NO: 1473130 - protein, 19 aa, Mycobacterium tuberculosis
GPEVGRYVPDPAPTKRQLL

SEQ ID NO: 1473131 - protein, 18 aa, Mycobacterium tuberculosis
GPGIPRHHRAAGGLQSVA

SEQ ID NO: 1473132 - protein, 21 aa, Mycobacterium tuberculosis
GPGIPRHHRAAGGLQSVAKAS

SEQ ID NO: 1473133 - protein, 24 aa, Mycobacterium tuberculosis
GPGQPGGPGGLLYGNGGHGGAGAA

SEQ ID NO: 1473134 - protein, 17 aa, Mycobacterium tuberculosis
GPGSIVVEGRDIGTVVF

SEQ ID NO: 1473135 - protein, 30 aa, Mycobacterium tuberculosis; identical to SEQ ID NO: 200181

SEQ ID NO: 1473136 - protein, 18 aa, Mycobacterium tuberculosis
GPNNGFPGTSSIVTAMPG

SEQ ID NO: 1473137 - protein, 17 aa, Mycobacterium tuberculosis
GPRMPMVPGTWEQGSNE

SEQ ID NO: 1473138 - protein, 21 aa, Mycobacterium tuberculosis
GPSLARWARANGWSAPPGAGA

SEQ ID NO: 1473139 - protein, 22 aa, Mycobacterium tuberculosis
GPTGCGKTYLAQTLAKMLNVPF

SEQ ID NO: 1473140 - protein, 20 aa, Mycobacterium tuberculosis
GPTLMVSDLFDFSLYVDARI

SEQ ID NO: 1473141 - protein, 20 aa, Mycobacterium tuberculosis
GPTTELLAAGADEVSAAIAS

SEQ ID NO: 1473142 - protein, 24 aa, Mycobacterium tuberculosis
GQAGGAGGILWGNGGAGGSGAPGQ

SEQ ID NO: 1473143 - protein, 21 aa, Mycobacterium tuberculosis
GQAGGPGGLLYGNGGNGAAGG

SEQ ID NO: 1473144 - protein, 18 aa, Mycobacterium tuberculosis
GQLVSFIGPIVIDTTIPG

SEQ ID NO: 1473145 - protein, 21 aa, Mycobacterium tuberculosis
GRAAVPVLVHPAPRGVLGGLA

SEQ ID NO: 1473146 - protein, 18 aa, Mycobacterium tuberculosis
GRARVLAITVRRNGTRLD

SEQ ID NO: 1473147 - protein, 24 aa, Mycobacterium tuberculosis
GRAYLDFGEPLPLRKRLQEMRADK

SEQ ID NO: 1473148 - protein, 17 aa, Mycobacterium tuberculosis
GRFASIYDRVHAWASVP

SEQ ID NO: 1473149 - protein, 23 aa, Mycobacterium tuberculosis
GRGCQLLRLGGRWLSVVCCRNGS

SEQ ID NO: 1473150 - protein, 21 aa, Mycobacterium tuberculosis
GRGPVATVLVQRGTLRVGDSV

SEQ ID NO: 1473151 - protein, 20 aa, Mycobacterium tuberculosis
GRIHKLLRIFANPKLPTIGD

SEQ ID NO: 1473152 - protein, 21 aa, Mycobacterium tuberculosis
GRLDLGLGAGWFRRESQAYGI

SEQ ID NO: 1473153 - protein, 20 aa, Mycobacterium tuberculosis
GRPYYNAIVWQDTRTDRIAS

SEQ ID NO: 1473154 - protein, 19 aa, Mycobacterium tuberculosis
GRSEFAYGSFVRTVSLPVG

SEQ ID NO: 1473155 - protein, 18 aa, Mycobacterium tuberculosis
GRVVSLFDRVEALRVTAL

SEQ ID NO: 1473156 - protein, 18 aa, Mycobacterium tuberculosis
GRYFRLLTGWVGGGFRVP

SEQ ID NO: 1473157 - protein, 26 aa, Mycobacterium tuberculosis
GSGGAGGLIGWAGAAGGTGAGGTGGQ

SEQ ID NO: 1473158 - protein, 19 aa, Mycobacterium tuberculosis
GSSGIQGNMGPPGTQGADG

SEQ ID NO: 1473159 - protein, 25 aa, Mycobacterium tuberculosis
GSTPGAKGAHGFTPTSGGDGGDGGN

SEQ ID NO: 1473160 - protein, 25 aa, Mycobacterium tuberculosis
GTGANGGDAGWLIGNGGAGGSGAKG

SEQ ID NO: 1473161 - protein, 24 aa, Mycobacterium tuberculosis
GTGANGGDGGWLIGNGGAGGSGAA

SEQ ID NO: 1473162 - protein, 20 aa, Mycobacterium tuberculosis
GTGGFAGFGGTAGNGGSGGT

SEQ ID NO: 1473163 - protein, 25 aa, Mycobacterium tuberculosis
GTGGNGGNGALLIGGGGLGGAGGMG

SEQ ID NO: 1473164 - protein, 22 aa, Mycobacterium tuberculosis
GTGGNGGYAQLIGDGGDGGPGD

SEQ ID NO: 1473165 - protein, 23 aa, Mycobacterium tuberculosis
GTIEMADWWAYLNGVRKTYPLSY

SEQ ID NO: 1473166 - protein, 21 aa, Mycobacterium tuberculosis
GTMPNRLYWISATVNPDGDQG

SEQ ID NO: 1473167 - protein, 27 aa, Mycobacterium tuberculosis
GTQAAAFHERFIQALSTAAGAYGSAEA

SEQ ID NO: 1473168 - protein, 17 aa, Mycobacterium tuberculosis
GTVGEYLNTMFDPSLTF

SEQ ID NO: 1473169 - protein, 19 aa, Mycobacterium tuberculosis
GVGCVDRIVTELAVIDVCA

SEQ ID NO: 1473170 - protein, 25 aa, Mycobacterium tuberculosis
GVHLGYKCSIRKPWWSTPSLWMPDL

SEQ ID NO: 1473171 - protein, 17 aa, Mycobacterium tuberculosis
GVHRVQRVPVTESQGRV

SEQ ID NO: 1473172 - protein, 24 aa, Mycobacterium tuberculosis
GVIANGSFAPSFVGFGGNGGNGVN

SEQ ID NO: 1473173 - protein, 17 aa, Mycobacterium tuberculosis
GVKDVILESAITTIMDF

SEQ ID NO: 1473174 - protein, 17 aa, Mycobacterium tuberculosis
GVLAIAYRCPNGEPGVV

SEQ ID NO: 1473175 - protein, 17 aa, Mycobacterium tuberculosis
GVLHEFTTVPGVKEDVT

SEQ ID NO: 1473176 - protein, 17 aa, Mycobacterium tuberculosis
GVLNFGSGVSGLYNTGG

SEQ ID NO: 1473177 - protein, 18 aa, Mycobacterium tuberculosis
GVSKPVLYQHFSSKLELY

SEQ ID NO: 1473178 - protein, 21 aa, Mycobacterium tuberculosis
GWFWPAAAAHPSLPRGALLQI

SEQ ID NO: 1473179 - protein, 18 aa, Mycobacterium tuberculosis
GYGSLGLMTSVLMTADGK

SEQ ID NO: 1473180 - protein, 19 aa, Mycobacterium tuberculosis
GYHGDTFLAMSICDPHGGM

SEQ ID NO: 1473181 - protein, 18 aa, Mycobacterium tuberculosis
GYIGTALRLLERKIAQLP

SEQ ID NO: 1473182 - protein, 20 aa, Mycobacterium tuberculosis
HAARRCATRLLDLHVVDGRL

SEQ ID NO: 1473183 - protein, 17 aa, Mycobacterium tuberculosis
HALRASNRIAIERGTHF

SEQ ID NO: 1473184 - protein, 28 aa, Mycobacterium tuberculosis
HDYFWRWDTDWFWCSRSFGAQNPRLRRW

SEQ ID NO: 1473185 - protein, 26 aa, Mycobacterium tuberculosis
HEMRDRWAGFFNEFDVLLLPVTPTPA

SEQ ID NO: 1473186 - protein, 17 aa, Mycobacterium tuberculosis
HGIGRRTGLPGSPTRGP

SEQ ID NO: 1473187 - protein, 21 aa, Mycobacterium tuberculosis
HGQLPNMRAIVGFAAETGDAN

SEQ ID NO: 1473188 - protein, 17 aa, Mycobacterium tuberculosis
HGRQARYSGLGSMEPKP

SEQ ID NO: 1473189 - protein, 21 aa, Mycobacterium tuberculosis
HGRRLLRIAASSAFAEHAAPG

SEQ ID NO: 1473190 - protein, 21 aa, Mycobacterium tuberculosis
HGRSPRLWLVTGGGLSVADDE

SEQ ID NO: 1473191 - protein, 22 aa, Mycobacterium tuberculosis
HIDTAILPNGWRDRLVSWTVES

SEQ ID NO: 1473192 - protein, 19 aa, Mycobacterium tuberculosis
HKERRLAEIAASGVTRIGG

SEQ ID NO: 1473193 - protein, 21 aa, Mycobacterium tuberculosis
HKPQLAFLPRQAFLDTNIIGT

SEQ ID NO: 1473194 - protein, 19 aa, Mycobacterium tuberculosis
HLEACPGCLRHYGLEERIK

SEQ ID NO: 1473195 - protein, 24 aa, Mycobacterium tuberculosis
HLGARLFSIIAWRTYLVRDPHALS

SEQ ID NO: 1473196 - protein, 18 aa, Mycobacterium tuberculosis
HLGLTGQANYGFAVPDIP

SEQ ID NO: 1473197 - protein, 18 aa, Mycobacterium tuberculosis
HLQDRWVAMFGDDHCSHN

SEQ ID NO: 1473198 - protein, 21 aa, Mycobacterium tuberculosis
HLRVVFPGVVGLFADLDSPIS

SEQ ID NO: 1473199 - protein, 28 aa, Mycobacterium tuberculosis
HNKTLRADACFVIGFGILRHIRCAGIDE

SEQ ID NO: 1473200 - protein, 17 aa, Mycobacterium tuberculosis
HPPDVVILDLGLPDMSG

SEQ ID NO: 1473201 - protein, 24 aa, Mycobacterium tuberculosis
HRLLETWHPLGVVGVITAFNFPVA

SEQ ID NO: 1473202 - protein, 18 aa, Mycobacterium tuberculosis
HSRAALLSAARTDAAAGA

SEQ ID NO: 1473203 - protein, 25 aa, Mycobacterium tuberculosis
HSRVLRVGVAEFRRSLDRVMPRDAD

SEQ ID NO: 1473204 - protein, 18 aa, Mycobacterium tuberculosis
HTNLGLAIDLQGKDGKRS

SEQ ID NO: 1473205 - protein, 24 aa, Mycobacterium tuberculosis
HTPPPHWRPDVLLVAVGAMSRPRM

SEQ ID NO: 1473206 - protein, 22 aa, Mycobacterium tuberculosis
HTQSYVRACHLVGYQHPDLTAY

SEQ ID NO: 1473207 - protein, 17 aa, Mycobacterium tuberculosis
HTYAFDDTVAWLAVACS

SEQ ID NO: 1473208 - protein, 17 aa, Mycobacterium tuberculosis
HVAYWWSAEPQRLSMAA

SEQ ID NO: 1473209 - protein, 17 aa, Mycobacterium tuberculosis
HVQDIGWDEKWQCDGCS

SEQ ID NO: 1473210 - protein, 20 aa, Mycobacterium tuberculosis
HWPQGRLSKAYAAYSTPFWR

SEQ ID NO: 1473211 - protein, 23 aa, Mycobacterium tuberculosis
HYDFRLERDGVLVSWAVPKNLPD

SEQ ID NO: 1473212 - protein, 17 aa, Mycobacterium tuberculosis
IAAIAARAADLDVLGAD

SEQ ID NO: 1473213 - protein, 23 aa, Mycobacterium tuberculosis
IACAVLRRPDHRDTYDAMFDLWF

SEQ ID NO: 1473214 - protein, 21 aa, Mycobacterium tuberculosis
IAIELACPLVYGAAVSLEPRD

SEQ ID NO: 1473215 - protein, 19 aa, Mycobacterium tuberculosis
IAPSRFHVVPVLAYSPDPG

SEQ ID NO: 1473216 - protein, 17 aa, Mycobacterium tuberculosis
IAPVGPSAVSIELADGL

SEQ ID NO: 1473217 - protein, 19 aa, Mycobacterium tuberculosis
IAYTKKLWQAIRAQDVCGN

SEQ ID NO: 1473218 - protein, 23 aa, Mycobacterium tuberculosis
IDHSAPWPLGPTHPSNLKCACRK

SEQ ID NO: 1473219 - protein, 18 aa, Mycobacterium tuberculosis
IDRMTWSQLYSRVTAVSA

SEQ ID NO: 1473220 - protein, 28 aa, Mycobacterium tuberculosis
IDVSGRLGPINIPIEIAGTPGFGNSTTT

SEQ ID NO: 1473221 - protein, 17 aa, Mycobacterium tuberculosis
IEEAMRLAAEMGEQDPG

SEQ ID NO: 1473222 - protein, 24 aa, Mycobacterium tuberculosis
IELALRLGATVERVAEASGVDPWF

SEQ ID NO: 1473223 - protein, 19 aa, Mycobacterium tuberculosis
IGAILPLLASVADPSNFGA

SEQ ID NO: 1473224 - protein, 21 aa, Mycobacterium tuberculosis
IGEAHIKVIRALFRPPARRGG

SEQ ID NO: 1473225 - protein, 17 aa, Mycobacterium tuberculosis
IGKRLNAYYVANVQEDF

SEQ ID NO: 1473226 - protein, 21 aa, Mycobacterium tuberculosis
IGNTEWPKWETVMAADPVDPA

SEQ ID NO: 1473227 - protein, 22 aa, Mycobacterium tuberculosis
IGQMSVPPAWKAPAVTTVRAFD

SEQ ID NO: 1473228 - protein, 19 aa, Mycobacterium tuberculosis
IHAALRINGFTVMLNDDVP

SEQ ID NO: 1473229 - protein, 22 aa, Mycobacterium tuberculosis
IHIPSIPLGFAAIGHIGPISIP

SEQ ID NO: 1473230 - protein, 19 aa, Mycobacterium tuberculosis
IHLRGHTPGSIALALGGPV

SEQ ID NO: 1473231 - protein, 19 aa, Mycobacterium tuberculosis
IKVTPEILLQVLTTPPASG

SEQ ID NO: 1473232 - protein, 23 aa, Mycobacterium tuberculosis
INGQPCRPPHCVASVSPARPSAG

SEQ ID NO: 1473233 - protein, 27 aa, Mycobacterium tuberculosis
INLELIDSPTLPTCERIAVLSQSGVNL

SEQ ID NO: 1473234 - protein, 20 aa, Mycobacterium tuberculosis
INRHIKRGGKVWINIFPDRP

SEQ ID NO: 1473235 - protein, 17 aa, Mycobacterium tuberculosis
INSYARYCELRAAGRID

SEQ ID NO: 1473236 - protein, 22 aa, Mycobacterium tuberculosis
IPGFTIPGGTLIPTLPLGLALS

SEQ ID NO: 1473237 - protein, 18 aa, Mycobacterium tuberculosis
IPHTLAALDWGGITCQSG

SEQ ID NO: 1473238 - protein, 18 aa, Mycobacterium tuberculosis
IPPLVAVAQQLGVCGAEL

SEQ ID NO: 1473239 - protein, 17 aa, Mycobacterium tuberculosis
IPRHHRAAGGLQSVAKA

SEQ ID NO: 1473240 - protein, 17 aa, Mycobacterium tuberculosis
IPVTFSYSTPALTLFPV

SEQ ID NO: 1473241 - protein, 18 aa, Mycobacterium tuberculosis
IRADFPILKRIMRGGNPL

SEQ ID NO: 1473242 - protein, 17 aa, Mycobacterium tuberculosis
IRIGGRVVSLFDRVEAL

SEQ ID NO: 1473243 - protein, 25 aa, Mycobacterium tuberculosis
IRTCAATGCELHLVEPLGFDLSEPK

SEQ ID NO: 1473244 - protein, 23 aa, Mycobacterium tuberculosis
ISAVRGPNFLGWIHPAATATAPA

SEQ ID NO: 1473245 - protein, 20 aa, Mycobacterium tuberculosis
ITKRAGVSVGALFRHFETMG

SEQ ID NO: 1473246 - protein, 19 aa, Mycobacterium tuberculosis
IVGAKGKAALLRELSDVVP

SEQ ID NO: 1473247 - protein, 18 aa, Mycobacterium tuberculosis
IVSVVNWADCLVALQQRE

SEQ ID NO: 1473248 - protein, 18 aa, Mycobacterium tuberculosis
IWTRLFGVRLVKLLYRLE

SEQ ID NO: 1473249 - protein, 18 aa, Mycobacterium tuberculosis
IYRRSFAVIRAEADLARF

SEQ ID NO: 1473250 - protein, 27 aa, Mycobacterium tuberculosis
KAARRGLVPGLPRLLRVVGHYYKPGFH

SEQ ID NO: 1473251 - protein, 17 aa, Mycobacterium tuberculosis
KAFNWTVTALKADIKAW

SEQ ID NO: 1473252 - protein, 18 aa, Mycobacterium tuberculosis
KALEGGAIYQRWQALGGM

SEQ ID NO: 1473253 - protein, 17 aa, Mycobacterium tuberculosis
KEHTCYYAHVLGSDLPL

SEQ ID NO: 1473254 - protein, 20 aa, Mycobacterium tuberculosis
KELNVMGAMQLFAACQKAPS

SEQ ID NO: 1473255 - protein, 28 aa, Mycobacterium tuberculosis
KFARCSWRAGPCGMPILDDAAAWFIGRT

SEQ ID NO: 1473256 - protein, 18 aa, Mycobacterium tuberculosis
KGAARRAWLAELAEERRT

SEQ ID NO: 1473257 - protein, 32 aa, Mycobacterium tuberculosis; identical to SEQ ID NO: 201620

SEQ ID NO: 1473258 - protein, 24 aa, Mycobacterium tuberculosis
KGGPGMREMLAITGAIKGAGLGKD

SEQ ID NO: 1473259 - protein, 18 aa, Mycobacterium tuberculosis
KHHLLKTFWTGWRDVQLP

SEQ ID NO: 1473260 - protein, 19 aa, Mycobacterium tuberculosis
KIKLHQLGLSLKDSPPSFD

SEQ ID NO: 1473261 - protein, 40 aa, Mycobacterium tuberculosis; identical to SEQ ID NO: 99181

SEQ ID NO: 1473262 - protein, 17 aa, Mycobacterium tuberculosis
KLGKSVAIVERGRMLGG

SEQ ID NO: 1473263 - protein, 20 aa, Mycobacterium tuberculosis
KLKDAGFYWATRSGVTVSMA

SEQ ID NO: 1473264 - protein, 18 aa, Mycobacterium tuberculosis
KLLQEVRSTIRAARALLE

SEQ ID NO: 1473265 - protein, 22 aa, Mycobacterium tuberculosis
KLRDRPRLGVSVLAEGHDAACM

SEQ ID NO: 1473266 - protein, 17 aa, Mycobacterium tuberculosis
KMVFWSMVTPRAADMAV

SEQ ID NO: 1473267 - protein, 20 aa, Mycobacterium tuberculosis
KPPVGAALWKLMERARQVGL

SEQ ID NO: 1473268 - protein, 17 aa, Mycobacterium tuberculosis
KRIVGAKGKAALLRELS

SEQ ID NO: 1473269 - protein, 17 aa, Mycobacterium tuberculosis
KRPARGWGSLTPTERDV

SEQ ID NO: 1473270 - protein, 20 aa, Mycobacterium tuberculosis
KSFASVGGFIAGDRPVVDYI

SEQ ID NO: 1473271 - protein, 23 aa, Mycobacterium tuberculosis
KSMILHEILPIDVSINLEDAVFI

SEQ ID NO: 1473272 - protein, 17 aa, Mycobacterium tuberculosis
KSVYLCCRAALRHMVLA

SEQ ID NO: 1473273 - protein, 19 aa, Mycobacterium tuberculosis
KTFDELDCLLDRLDGTVPF

SEQ ID NO: 1473274 - protein, 20 aa, Mycobacterium tuberculosis
KTLTCVLPAYLNALAGNGVH

SEQ ID NO: 1473275 - protein, 24 aa, Mycobacterium tuberculosis
KTRAEAMAALDIWRDRYPGAAALL

SEQ ID NO: 1473276 - protein, 24 aa, Mycobacterium tuberculosis
KTVVCAALASAARQAGIDVAVCKP

SEQ ID NO: 1473277 - protein, 18 aa, Mycobacterium tuberculosis
KVALEHRTSYTFDRLVRV

SEQ ID NO: 1473278 - protein, 19 aa, Mycobacterium tuberculosis
KVDGGWLLNGQKIWSSRVP

SEQ ID NO: 1473279 - protein, 17 aa, Mycobacterium tuberculosis
KVPTPLLDFIAPKVAGL

SEQ ID NO: 1473280 - protein, 20 aa, Mycobacterium tuberculosis
KWQCDGCSITHQRDDNAAIN

SEQ ID NO: 1473281 - protein, 17 aa, Mycobacterium tuberculosis
KYGMTLCALGIAEEMRA

SEQ ID NO: 1473282 - protein, 17 aa, Mycobacterium tuberculosis
KYLLARIGDAFLALPNG

SEQ ID NO: 1473283 - protein, 23 aa, Mycobacterium tuberculosis
KYLNRLSDLLFILSRVANPDGDV

SEQ ID NO: 1473284 - protein, 19 aa, Mycobacterium tuberculosis
LAAAAAWDGLADELAVAAS

SEQ ID NO: 1473285 - protein, 22 aa, Mycobacterium tuberculosis
LAATGRPLIGNGANGAPGTGAN

SEQ ID NO: 1473286 - protein, 24 aa, Mycobacterium tuberculosis
LAAYPGHIARMFGLVYGGESRDHA

SEQ ID NO: 1473287 - protein, 19 aa, Mycobacterium tuberculosis
LACGCGKPDCPSGAGNDER

SEQ ID NO: 1473288 - protein, 22 aa, Mycobacterium tuberculosis
LADHLRRRWARNTGGLLVVTHD

SEQ ID NO: 1473289 - protein, 18 aa, Mycobacterium tuberculosis
LAGLAARGGSAPTPAAAA

SEQ ID NO: 1473290 - protein, 23 aa, Mycobacterium tuberculosis
LAGLARAIADIAARARSGNLKPD

SEQ ID NO: 1473291 - protein, 24 aa, Mycobacterium tuberculosis
LAGLARAIADIAARARSGNLKPDE

SEQ ID NO: 1473292 - protein, 18 aa, Mycobacterium tuberculosis
LAGQSWQGAAAAMAAAAA

SEQ ID NO: 1473293 - protein, 17 aa, Mycobacterium tuberculosis
LAGQWGDRVRPLVGDLT

SEQ ID NO: 1473294 - protein, 18 aa, Mycobacterium tuberculosis
LAPGPARCCVVLKRCSAH

SEQ ID NO: 1473295 - protein, 17 aa, Mycobacterium tuberculosis
LAPGTGLRDGLERILRG

SEQ ID NO: 1473296 - protein, 24 aa, Mycobacterium tuberculosis
LAPVRFFNPIAMRFAQKATREDID

SEQ ID NO: 1473297 - protein, 26 aa, Mycobacterium tuberculosis
LARGDLALRMGLPVLAVVAFAQSFGD

SEQ ID NO: 1473298 - protein, 17 aa, Mycobacterium tuberculosis
LARPRTDFHTEILRMQK

SEQ ID NO: 1473299 - protein, 34 aa, Mycobacterium tuberculosis
LASCLQPLWRARGRLQEGLAWFAAALADHDAHPA

SEQ ID NO: 1473300 - protein, 17 aa, Mycobacterium tuberculosis
LASRLIDVTGWLATQPD

SEQ ID NO: 1473301 - protein, 18 aa, Mycobacterium tuberculosis
LATDSWLSAASFQETTRV

SEQ ID NO: 1473302 - protein, 18 aa, Mycobacterium tuberculosis
LATFRDAQGLTFPLLSDP

SEQ ID NO: 1473303 - protein, 17 aa, Mycobacterium tuberculosis
LAVDGCVPLDVDTWDDY

SEQ ID NO: 1473304 - protein, 19 aa, Mycobacterium tuberculosis
LCGYGPIPAAVARTMVASA

SEQ ID NO: 1473305 - protein, 17 aa, Mycobacterium tuberculosis
LCLLAGAIQARRVLEIG

SEQ ID NO: 1473306 - protein, 17 aa, Mycobacterium tuberculosis
LDELAIWAAGGVLGEIT

SEQ ID NO: 1473307 - protein, 19 aa, Mycobacterium tuberculosis
LDHVREVVCEDSLGLAEEF

SEQ ID NO: 1473308 - protein, 19 aa, Mycobacterium tuberculosis
LDIDLVFSPFFNALPIRRL

SEQ ID NO: 1473309 - protein, 17 aa, Mycobacterium tuberculosis
LDLQEQFGLSYLFVSHD

SEQ ID NO: 1473310 - protein, 19 aa, Mycobacterium tuberculosis
LDNTGNLTLNFGVANQGGL

SEQ ID NO: 1473311 - protein, 25 aa, Mycobacterium tuberculosis
LDPFTEFRFPRIGTAVFDGIEIELR

SEQ ID NO: 1473312 - protein, 21 aa, Mycobacterium tuberculosis
LDPGDLYDVLAINAASASTQL

SEQ ID NO: 1473313 - protein, 17 aa, Mycobacterium tuberculosis
LDSLVLIASGGAFGPNG

SEQ ID NO: 1473314 - protein, 21 aa, Mycobacterium tuberculosis
LDSWRNYQWHQLARAFLMYVT

SEQ ID NO: 1473315 - protein, 17 aa, Mycobacterium tuberculosis
LDVDGRLICLVRAESDE

SEQ ID NO: 1473316 - protein, 17 aa, Mycobacterium tuberculosis
LDYFPEDFLLVIDESHV

SEQ ID NO: 1473317 - protein, 35 aa, Mycobacterium tuberculosis; identical to SEQ ID NO: 202173

SEQ ID NO: 1473318 - protein, 17 aa, Mycobacterium tuberculosis
LEDWLWRNATRVLRLDT

SEQ ID NO: 1473319 - protein, 22 aa, Mycobacterium tuberculosis
LEEEMRLHPAFLGRQRAAERSA

SEQ ID NO: 1473320 - protein, 17 aa, Mycobacterium tuberculosis
LEEVRGAAAAAIADGAR

SEQ ID NO: 1473321 - protein, 22 aa, Mycobacterium tuberculosis
LELLPFRRNLAFYGLDLGLMSV

SEQ ID NO: 1473322 - protein, 17 aa, Mycobacterium tuberculosis
LEVLRLGGLETGSVPSP

SEQ ID NO: 1473323 - protein, 24 aa, Mycobacterium tuberculosis
LFLIPPEHAHKLVFAVLRGVAAVA

SEQ ID NO: 1473324 - protein, 19 aa, Mycobacterium tuberculosis
LGAFVKRVSNPVAGHTTWT

SEQ ID NO: 1473325 - protein, 21 aa, Mycobacterium tuberculosis
LGGDGGGRGIFGQFGAGGAGG

SEQ ID NO: 1473326 - protein, 34 aa, Mycobacterium tuberculosis; identical to SEQ ID NO: 202308

SEQ ID NO: 1473327 - protein, 31 aa, Mycobacterium tuberculosis
LGGKGGSGGLIGRAGSDGGVGAGGAGGAGGA

SEQ ID NO: 1473328 - protein, 20 aa, Mycobacterium tuberculosis
LGIDVGGGLGPFTVFPDGYS

SEQ ID NO: 1473329 - protein, 18 aa, Mycobacterium tuberculosis
LGIVPLLLLDMWEHAFYL

SEQ ID NO: 1473330 - protein, 19 aa, Mycobacterium tuberculosis
LGLPPAPAPPVRRLAERGA

SEQ ID NO: 1473331 - protein, 19 aa, Mycobacterium tuberculosis
LGPAGRFASIYDRVHAWAS

SEQ ID NO: 1473332 - protein, 17 aa, Mycobacterium tuberculosis
LGPHEFLSFIEGRAAMF

SEQ ID NO: 1473333 - protein, 30 aa, Mycobacterium tuberculosis
LGSGVSGFANRGILPFSVASVVSGFANIGT

SEQ ID NO: 1473334 - protein, 19 aa, Mycobacterium tuberculosis
LGTASFALGNARRALVESL

SEQ ID NO: 1473335 - protein, 17 aa, Mycobacterium tuberculosis
LGVCVGMQILFACGVEF

SEQ ID NO: 1473336 - protein, 34 aa, Mycobacterium tuberculosis; identical to SEQ ID NO: 202391

SEQ ID NO: 1473337 - protein, 20 aa, Mycobacterium tuberculosis
LHIPRTTWYDGVRFEEVSVG

SEQ ID NO: 1473338 - protein, 17 aa, Mycobacterium tuberculosis
LHKGHRAGELLLKPPRS

SEQ ID NO: 1473339 - protein, 19 aa, Mycobacterium tuberculosis
LILRFFPTPACARLTEQNL

SEQ ID NO: 1473340 - protein, 17 aa, Mycobacterium tuberculosis
LKDAFVYPETMPAWFTE

SEQ ID NO: 1473341 - protein, 19 aa, Mycobacterium tuberculosis
LKLIRARFGVPVPNMTAWR

SEQ ID NO: 1473342 - protein, 17 aa, Mycobacterium tuberculosis
LKTARGLLEVKRFDTAQ

SEQ ID NO: 1473343 - protein, 18 aa, Mycobacterium tuberculosis
LLAAAARDAFGLDVHPAV

SEQ ID NO: 1473344 - protein, 29 aa, Mycobacterium tuberculosis
LLAGERPYREFPLDWMLGRLGLAGFRILE

SEQ ID NO: 1473345 - protein, 21 aa, Mycobacterium tuberculosis
LLARIGDAFLALPNGFTAHPR

SEQ ID NO: 1473346 - protein, 17 aa, Mycobacterium tuberculosis
LLDLLWRNRRGELELSV

SEQ ID NO: 1473347 - protein, 17 aa, Mycobacterium tuberculosis
LLDRVCALGSPDRVAAR

SEQ ID NO: 1473348 - protein, 18 aa, Mycobacterium tuberculosis
LLEPLRSVPIVGNPLANL

SEQ ID NO: 1473349 - protein, 23 aa, Mycobacterium tuberculosis
LLGGFERRGRWNVPKKLTTFTLW

SEQ ID NO: 1473350 - protein, 25 aa, Mycobacterium tuberculosis
LLGNGNFGFGNAFGDGNLGSGNVGS

SEQ ID NO: 1473351 - protein, 18 aa, Mycobacterium tuberculosis
LLLWIRGVRFMYSVDPYL

SEQ ID NO: 1473352 - protein, 18 aa, Mycobacterium tuberculosis
LLPYSDLDVLLLHDGKPA

SEQ ID NO: 1473353 - protein, 19 aa, Mycobacterium tuberculosis
LLQRCYSGLELRDDRLVLS

SEQ ID NO: 1473354 - protein, 17 aa, Mycobacterium tuberculosis
LLSGLGITGSIDISGIQ

SEQ ID NO: 1473355 - protein, 17 aa, Mycobacterium tuberculosis
LLTRIAFGFRSPQALIA

SEQ ID NO: 1473356 - protein, 18 aa, Mycobacterium tuberculosis
LMAALGMLEARHIAGDQQ

SEQ ID NO: 1473357 - protein, 18 aa, Mycobacterium tuberculosis
LMRNCHHGGSAPSAVGGS

SEQ ID NO: 1473358 - protein, 19 aa, Mycobacterium tuberculosis
LNHPEAIAVIADHILEGAR

SEQ ID NO: 1473359 - protein, 18 aa, Mycobacterium tuberculosis
LPALKSFVLPGGSPLSAL

SEQ ID NO: 1473360 - protein, 20 aa, Mycobacterium tuberculosis
LPASQVVRFIVPRYVQDDPL

SEQ ID NO: 1473361 - protein, 24 aa, Mycobacterium tuberculosis
LPDDQVCLVVEVFRMLADATRVQV

SEQ ID NO: 1473362 - protein, 29 aa, Mycobacterium tuberculosis
LPDGISRLRFRLRWRGFRLIVDANHTDVT

SEQ ID NO: 1473363 - protein, 20 aa, Mycobacterium tuberculosis
LPEGTRYVLSITWSDVETPG

SEQ ID NO: 1473364 - protein, 23 aa, Mycobacterium tuberculosis
LPEVPQIDAGSWLLLSASEADPL

SEQ ID NO: 1473365 - protein, 17 aa, Mycobacterium tuberculosis
LPFTLGAGAHLQADIAL

SEQ ID NO: 1473366 - protein, 40 aa, Mycobacterium tuberculosis; identical to SEQ ID NO: 202714

SEQ ID NO: 1473367 - protein, 18 aa, Mycobacterium tuberculosis
LPPTPWHHQRFWVTDRSA

SEQ ID NO: 1473368 - protein, 17 aa, Mycobacterium tuberculosis
LPSNCFDKPPVVNPGLE

SEQ ID NO: 1473369 - protein, 26 aa, Mycobacterium tuberculosis
LPTAAPRWVVDPDFNLDFHVRRVRVS

SEQ ID NO: 1473370 - protein, 20 aa, Mycobacterium tuberculosis
LPTDPNALVFPGRKGGFLPL

SEQ ID NO: 1473371 - protein, 19 aa, Mycobacterium tuberculosis
LPVRVCTICTDPWNLDHET

SEQ ID NO: 1473372 - protein, 25 aa, Mycobacterium tuberculosis
LQPLFDVINAPTLALLNRPLIGNGA

SEQ ID NO: 1473373 - protein, 20 aa, Mycobacterium tuberculosis
LQSFLPPPFDAIPNPIEDLD

SEQ ID NO: 1473374 - protein, 26 aa, Mycobacterium tuberculosis
LQTPGRINALWSLRPVLPMPGRGCQL

SEQ ID NO: 1473375 - protein, 20 aa, Mycobacterium tuberculosis
LRAAAQHWATWAMQKQELAR

SEQ ID NO: 1473376 - protein, 18 aa, Mycobacterium tuberculosis
LRAGEVGVGFVVGSAHHF

SEQ ID NO: 1473377 - protein, 22 aa, Mycobacterium tuberculosis
LRAHVPDAGGMIIASDRTTARA

SEQ ID NO: 1473378 - protein, 21 aa, Mycobacterium tuberculosis
LRALKPWEGPRHFVLIDDVQD

SEQ ID NO: 1473379 - protein, 20 aa, Mycobacterium tuberculosis
LRASNRIAIERGTHFKGFER

SEQ ID NO: 1473380 - protein, 17 aa, Mycobacterium tuberculosis
LRAVVCAPACAVDDADR

SEQ ID NO: 1473381 - protein, 18 aa, Mycobacterium tuberculosis
LRDIEWRIGPGERIGIVG

SEQ ID NO: 1473382 - protein, 20 aa, Mycobacterium tuberculosis
LRELIQVLGHAGVRSLVSQP

SEQ ID NO: 1473383 - protein, 19 aa, Mycobacterium tuberculosis
LRFQPRWKELFPTARQLQV

SEQ ID NO: 1473384 - protein, 18 aa, Mycobacterium tuberculosis
LRIGVPALADPGTGELVG

SEQ ID NO: 1473385 - protein, 21 aa, Mycobacterium tuberculosis
LRIVLGHELFHYAARADTALD

SEQ ID NO: 1473386 - protein, 17 aa, Mycobacterium tuberculosis
LRLTGRRVMLVPTMGAL

SEQ ID NO: 1473387 - protein, 18 aa, Mycobacterium tuberculosis
LRNLAAIKDVAARPTRTI

SEQ ID NO: 1473388 - protein, 20 aa, Mycobacterium tuberculosis
LRPIESIRVGDFVTDHDGRP

SEQ ID NO: 1473389 - protein, 20 aa, Mycobacterium tuberculosis
LRPPATVVFARRGKQIARGS

SEQ ID NO: 1473390 - protein, 26 aa, Mycobacterium tuberculosis
LRQLGCAGAACLGEFGGRDNSVIAGV

SEQ ID NO: 1473391 - protein, 23 aa, Mycobacterium tuberculosis
LRQTAARLADWVDAQGPELAPAD

SEQ ID NO: 1473392 - protein, 19 aa, Mycobacterium tuberculosis
LRRGGIQFADTRGYAYDRR

SEQ ID NO: 1473393 - protein, 19 aa, Mycobacterium tuberculosis
LRRSGRISGAKAWLGTALA

SEQ ID NO: 1473394 - protein, 21 aa, Mycobacterium tuberculosis
LRSDPSIEFVDRFAEQLAGVR

SEQ ID NO: 1473395 - protein, 18 aa, Mycobacterium tuberculosis
LRTATIRMLLAAIQTEEV

SEQ ID NO: 1473396 - protein, 21 aa, Mycobacterium tuberculosis
LRTAVRRAKVLAGLDEDTEVR

SEQ ID NO: 1473397 - protein, 17 aa, Mycobacterium tuberculosis
LRTVRCVSGTVELMMSC

SEQ ID NO: 1473398 - protein, 19 aa, Mycobacterium tuberculosis
LRVPDSHLIYVARPDDPAD

SEQ ID NO: 1473399 - protein, 21 aa, Mycobacterium tuberculosis
LSAALAEWRGPVLDDLREFSF

SEQ ID NO: 1473400 - protein, 18 aa, Mycobacterium tuberculosis
LSALLHVARTVVRRAERS

SEQ ID NO: 1473401 - protein, 17 aa, Mycobacterium tuberculosis
LSFGRFGDEPALTASDD

SEQ ID NO: 1473402 - protein, 17 aa, Mycobacterium tuberculosis
LSIAFAIGERHELGPVP

SEQ ID NO: 1473403 - protein, 20 aa, Mycobacterium tuberculosis
LSPDGRCKAFAAAADGTGFS

SEQ ID NO: 1473404 - protein, 24 aa, Mycobacterium tuberculosis
LSRNTTLWASWAFVGPNHRAYFGG

SEQ ID NO: 1473405 - protein, 20 aa, Mycobacterium tuberculosis
LSSSVPILGPYEDLIANTVA

SEQ ID NO: 1473406 - protein, 19 aa, Mycobacterium tuberculosis
LSVRAARDYHNGILDGDAV

SEQ ID NO: 1473407 - protein, 23 aa, Mycobacterium tuberculosis
LTAEQRGTVALMHGEREFPSFQA

SEQ ID NO: 1473408 - protein, 18 aa, Mycobacterium tuberculosis
LTDIPVRVYWPPVVRDNL

SEQ ID NO: 1473409 - protein, 17 aa, Mycobacterium tuberculosis
LTGRRVMLVPTMGALHE

SEQ ID NO: 1473410 - protein, 17 aa, Mycobacterium tuberculosis
LTPGYLTMGGFIPAQDE

SEQ ID NO: 1473411 - protein, 25 aa, Mycobacterium tuberculosis
LTVEGLRLAAGISEHERANRVFDER

SEQ ID NO: 1473412 - protein, 20 aa, Mycobacterium tuberculosis
LVAFGRYPTFEGYRQQLGID

SEQ ID NO: 1473413 - protein, 29 aa, Mycobacterium tuberculosis
LVDLILFDWPTHMLQLATWLAENPQLLVA

SEQ ID NO: 1473414 - protein, 17 aa, Mycobacterium tuberculosis
LVDSLGFTLSGLQPGFT

SEQ ID NO: 1473415 - protein, 34 aa, Mycobacterium tuberculosis
LVGLGAVGRAVRWRLSGLGLRVIAHDPYRDDAGH

SEQ ID NO: 1473416 - protein, 20 aa, Mycobacterium tuberculosis
LVHHPCVGDLGWIADAPKAP

SEQ ID NO: 1473417 - protein, 19 aa, Mycobacterium tuberculosis
LVIPFWKIGWQNLGLPTGF

SEQ ID NO: 1473418 - protein, 17 aa, Mycobacterium tuberculosis
LVKLTCRGRDLPTAVSR

SEQ ID NO: 1473419 - protein, 20 aa, Mycobacterium tuberculosis
LVKVPAGWSHTAAATTSVVF

SEQ ID NO: 1473420 - protein, 21 aa, Mycobacterium tuberculosis
LVLRHLAAKRIRVMEQFTVQA

SEQ ID NO: 1473421 - protein, 18 aa, Mycobacterium tuberculosis
LVRGRFVLVGVTPAVLAS

SEQ ID NO: 1473422 - protein, 19 aa, Mycobacterium tuberculosis
LVRHHLLLPITATRRDLND

SEQ ID NO: 1473423 - protein, 17 aa, Mycobacterium tuberculosis
LVSRAHRDKVAGYVPDD

SEQ ID NO: 1473424 - protein, 17 aa, Mycobacterium tuberculosis
LWIPVRRSWRLNERHYG

SEQ ID NO: 1473425 - protein, 19 aa, Mycobacterium tuberculosis
LWSPAGKPPTWWDSLPTDR

SEQ ID NO: 1473426 - protein, 18 aa, Mycobacterium tuberculosis
LYDLLAQAVAPKFYERDE

SEQ ID NO: 1473427 - protein, 19 aa, Mycobacterium tuberculosis
LYISYLRKKIDNGREPMIH

SEQ ID NO: 1473428 - protein, 25 aa, Mycobacterium tuberculosis
LYPRKGVSELTRFTPEAVVEKYGLP

SEQ ID NO: 1473429 - protein, 23 aa, Mycobacterium tuberculosis
MAGLRICARIAQARPLRDLLGSI

SEQ ID NO: 1473430 - protein, 25 aa, Mycobacterium tuberculosis
MAPGARPGPVPKPGIRTPRVGNNPF

SEQ ID NO: 1473431 - protein, 18 aa, Mycobacterium tuberculosis
MAVAAIRRLNARKECQKT

SEQ ID NO: 1473432 - protein, 17 aa, Mycobacterium tuberculosis
MEEVLLPVMYDIPSRDD

SEQ ID NO: 1473433 - protein, 17 aa, Mycobacterium tuberculosis
MGVQVIAGRGELIDSTP

SEQ ID NO: 1473434 - protein, 17 aa, Mycobacterium tuberculosis
MHIDAEYNADGSLRKPG

SEQ ID NO: 1473435 - protein, 32 aa, Mycobacterium tuberculosis; identical to SEQ ID NO: 203330

SEQ ID NO: 1473436 - protein, 24 aa, Mycobacterium tuberculosis
MLAMSAPYVEWLERTAAQTKQTAT

SEQ ID NO: 1473437 - protein, 18 aa, Mycobacterium tuberculosis
MLVPVHWGTFRLAPHPWG

SEQ ID NO: 1473438 - protein, 18 aa, Mycobacterium tuberculosis
MMINLFWLGLKGAPVDRL

SEQ ID NO: 1473439 - protein, 17 aa, Mycobacterium tuberculosis
MMSSMLGGMGIPGIGRK

SEQ ID NO: 1473440 - protein, 28 aa, Mycobacterium tuberculosis
MNNGVFYRGVGQGSLQFSITTPDLTLPP

SEQ ID NO: 1473441 - protein, 17 aa, Mycobacterium tuberculosis
MNSMAFDAMVPLKEALA

SEQ ID NO: 1473442 - protein, 21 aa, Mycobacterium tuberculosis
MPELMSELLWSRIGAQCDATI

SEQ ID NO: 1473443 - protein, 18 aa, Mycobacterium tuberculosis
MPENLVAVVQDGWRNIRR

SEQ ID NO: 1473444 - protein, 18 aa, Mycobacterium tuberculosis
MPTMTGLVPAGGEEVSAQ

SEQ ID NO: 1473445 - protein, 17 aa, Mycobacterium tuberculosis
MQLLAATNWFGQNAPAL

SEQ ID NO: 1473446 - protein, 19 aa, Mycobacterium tuberculosis
MRALIVVAGLRMSRTPPDI

SEQ ID NO: 1473447 - protein, 17 aa, Mycobacterium tuberculosis
MRALTGRSWRAGLRQRA

SEQ ID NO: 1473448 - protein, 25 aa, Mycobacterium tuberculosis
MRANLERWAPLLPEGATLVSLAKGI

SEQ ID NO: 1473449 - protein, 17 aa, Mycobacterium tuberculosis
MRAPLSASGDAVPAELL

SEQ ID NO: 1473450 - protein, 29 aa, Mycobacterium tuberculosis
MSAQAAAFHARFVQALAGAMGAYAAAEAA

SEQ ID NO: 1473451 - protein, 24 aa, Mycobacterium tuberculosis
MSEFPTDRGWDLAGLFDPDPDAAG

SEQ ID NO: 1473452 - protein, 17 aa, Mycobacterium tuberculosis
MSRPCMDAARCLSEEQI

SEQ ID NO: 1473453 - protein, 24 aa, Mycobacterium tuberculosis
MTDAALRYLKWLSKHSKRLWQTAN

SEQ ID NO: 1473454 - protein, 18 aa, Mycobacterium tuberculosis
MVKRLKKVADYVGTLSDD

SEQ ID NO: 1473455 - protein, 20 aa, Mycobacterium tuberculosis
NAGAGGTGFTQGADGNAGNG

SEQ ID NO: 1473456 - protein, 28 aa, Mycobacterium tuberculosis
NANYYARVCVDLLKPRKAQPLLPGIGKT

SEQ ID NO: 1473457 - protein, 23 aa, Mycobacterium tuberculosis
NDVADYLAGSGWQVTTSTGKELF

SEQ ID NO: 1473458 - protein, 22 aa, Mycobacterium tuberculosis
NEGLRSRFTRNIDFPSYTSHEL

SEQ ID NO: 1473459 - protein, 18 aa, Mycobacterium tuberculosis
NEGVKGAWVLARYDDGRP

SEQ ID NO: 1473460 - protein, 29 aa, Mycobacterium tuberculosis
NELDPAGARLCVRPMSEFQSNEAYRELHA

SEQ ID NO: 1473461 - protein, 22 aa, Mycobacterium tuberculosis
NERYKLVWKNRLGFARLAIQHG

SEQ ID NO: 1473462 - protein, 19 aa, Mycobacterium tuberculosis
NFGDCLSYALAIDRREPLL

SEQ ID NO: 1473463 - protein, 32 aa, Mycobacterium tuberculosis; identical to SEQ ID NO: 233926

SEQ ID NO: 1473464 - protein, 23 aa, Mycobacterium tuberculosis
NGGAGGLLIGNGGAGGVGGTAGA

SEQ ID NO: 1473465 - protein, 23 aa, Mycobacterium tuberculosis
NGGMGGNAVGLFGQGGAGGAGGS

SEQ ID NO: 1473466 - protein, 20 aa, Mycobacterium tuberculosis
NGGNGALLIGAGGVGGAGGI

SEQ ID NO: 1473467 - protein, 18 aa, Mycobacterium tuberculosis
NGGPAILSGNGGNGGAGG

SEQ ID NO: 1473468 - protein, 27 aa, Mycobacterium tuberculosis
NGGVGGRGGDGVFAGAGGQGGLGGQGG

SEQ ID NO: 1473469 - protein, 20 aa, Mycobacterium tuberculosis
NGIEVSRYFAELDWERNFLR

SEQ ID NO: 1473470 - protein, 18 aa, Mycobacterium tuberculosis
NGQPCRPPHCVASVSPAR

SEQ ID NO: 1473471 - protein, 25 aa, Mycobacterium tuberculosis
NGSLCKELSADIARRPMAKPVDFGS

SEQ ID NO: 1473472 - protein, 20 aa, Mycobacterium tuberculosis
NHLSCLRGCGLVVATYEGRQ

SEQ ID NO: 1473473 - protein, 20 aa, Mycobacterium tuberculosis
NILRRNGIEVSRYFAELDWE

SEQ ID NO: 1473474 - protein, 24 aa, Mycobacterium tuberculosis
NISIIDIPALPGFGNSTELPSSGF

SEQ ID NO: 1473475 - protein, 20 aa, Mycobacterium tuberculosis
NLLEEIGILLLPIAPELTPF

SEQ ID NO: 1473476 - protein, 25 aa, Mycobacterium tuberculosis
NLPICGQVKIPRPEHLAYYGGLAAL

SEQ ID NO: 1473477 - protein, 27 aa, Mycobacterium tuberculosis
NPRLTALMCTADILALSAMDYLRAHGI

SEQ ID NO: 1473478 - protein, 24 aa, Mycobacterium tuberculosis
NQIKLAVLVATNFFGINTIPIAIN

SEQ ID NO: 1473479 - protein, 20 aa, Mycobacterium tuberculosis
NRDGIPIAVRNELNLSVLQR

SEQ ID NO: 1473480 - protein, 20 aa, Mycobacterium tuberculosis
NRHQLVSLVLSNLFGQNAPA

SEQ ID NO: 1473481 - protein, 22 aa, Mycobacterium tuberculosis
NRLPPVHMFGGINLSFGLMGPL

SEQ ID NO: 1473482 - protein, 37 aa, Mycobacterium tuberculosis; identical to SEQ ID NO: 203675

SEQ ID NO: 1473483 - protein, 25 aa, Mycobacterium tuberculosis
NSPNGYRTDVDWATQISYSGVFVHS

SEQ ID NO: 1473484 - protein, 25 aa, Mycobacterium tuberculosis
NTGFGNAGFFNMGIGNAGNEDMGVG

SEQ ID NO: 1473485 - protein, 26 aa, Mycobacterium tuberculosis
NTPTQLLLGRPLIGNGANGAPGTGQA

SEQ ID NO: 1473486 - protein, 18 aa, Mycobacterium tuberculosis
PAACGGPFARLTLNSPHN

SEQ ID NO: 1473487 - protein, 19 aa, Mycobacterium tuberculosis
PAAGPAWFDIAGVRMAPAE

SEQ ID NO: 1473488 - protein, 20 aa, Mycobacterium tuberculosis
PAALLRWGVSQFDAEVRPVR

SEQ ID NO: 1473489 - protein, 20 aa, Mycobacterium tuberculosis
PAKLAGWWAEQFDGTTRELL

SEQ ID NO: 1473490 - protein, 21 aa, Mycobacterium tuberculosis
PAQAIAQVCELTWQLRGQATG

SEQ ID NO: 1473491 - protein, 19 aa, Mycobacterium tuberculosis
PATLDRVLAIGGPDASYVP

SEQ ID NO: 1473492 - protein, 27 aa, Mycobacterium tuberculosis
PATLKRFVDRFSRFNLREFAIRPAYGL

SEQ ID NO: 1473493 - protein, 17 aa, Mycobacterium tuberculosis
PAVAPWPGPTGERADWW

SEQ ID NO: 1473494 - protein, 20 aa, Mycobacterium tuberculosis
PDARGIYYGRLTEMTTTDFQ

SEQ ID NO: 1473495 - protein, 25 aa, Mycobacterium tuberculosis
PDELAEALAGFIAEFGLSLVGGCCG

SEQ ID NO: 1473496 - protein, 26 aa, Mycobacterium tuberculosis
PDEYVKGLAELGCFGLKIPSEYGGLN

SEQ ID NO: 1473497 - protein, 21 aa, Mycobacterium tuberculosis
PDGKVSPYHAVIVNTGESFMI

SEQ ID NO: 1473498 - protein, 23 aa, Mycobacterium tuberculosis
PDGMELPNKVYLASADHAIPVDE

SEQ ID NO: 1473499 - protein, 18 aa, Mycobacterium tuberculosis
PDHPKFHGPKGIGYAELP

SEQ ID NO: 1473500 - protein, 19 aa, Mycobacterium tuberculosis
PEDAWQFAGRVRELTGGTG

SEQ ID NO: 1473501 - protein, 26 aa, Mycobacterium tuberculosis
PEGKSIASFARRLQVAGVRVAAHTSH

SEQ ID NO: 1473502 - protein, 21 aa, Mycobacterium tuberculosis
PEINSALMFAGAGPGPMLAAA

SEQ ID NO: 1473503 - protein, 33 aa, Mycobacterium tuberculosis
PELISRWAAYWPPAGAEALFRWLSERDGRTRYS

SEQ ID NO: 1473504 - protein, 17 aa, Mycobacterium tuberculosis
PELPVAAAAAVPTASAT

SEQ ID NO: 1473505 - protein, 20 aa, Mycobacterium tuberculosis
PEVNSALMYAGPGSGPMLAA

SEQ ID NO: 1473506 - protein, 21 aa, Mycobacterium tuberculosis
PFGGAYRLIDFVLSNLVNARY

SEQ ID NO: 1473507 - protein, 25 aa, Mycobacterium tuberculosis
PGAEASWVVGITWWSAVVGGFQMSF

SEQ ID NO: 1473508 - protein, 22 aa, Mycobacterium tuberculosis
PGGPGQPGTEFGQTGGTGGTGG

SEQ ID NO: 1473509 - protein, 19 aa, Mycobacterium tuberculosis
PGGSTAIRIPATASVGPFD

SEQ ID NO: 1473510 - protein, 18 aa, Mycobacterium tuberculosis
PGGTAFPHCSGVLVAGDE

SEQ ID NO: 1473511 - protein, 17 aa, Mycobacterium tuberculosis
PGLATPVTPAANGGNGL

SEQ ID NO: 1473512 - protein, 18 aa, Mycobacterium tuberculosis
PGMHALRASTIVAALQYM

SEQ ID NO: 1473513 - protein, 17 aa, Mycobacterium tuberculosis
PGMSLFDIHELVNIGPF

SEQ ID NO: 1473514 - protein, 25 aa, Mycobacterium tuberculosis
PGPWKESLRLLAHEVMPRLNARLAT

SEQ ID NO: 1473515 - protein, 18 aa, Mycobacterium tuberculosis
PGQVLGLTFTRKAAGQLL

SEQ ID NO: 1473516 - protein, 17 aa, Mycobacterium tuberculosis
PGQVRTRMSAHLKEAPL

SEQ ID NO: 1473517 - protein, 36 aa, Mycobacterium tuberculosis
PGSGGIRGPLGLGFRVPCIVISPYSRGPLMVSDTFD

SEQ ID NO: 1473518 - protein, 18 aa, Mycobacterium tuberculosis
PHYIKTLRIWGDTLQSNK

SEQ ID NO: 1473519 - protein, 17 aa, Mycobacterium tuberculosis
PKIKQWLSQVLGNFPVY

SEQ ID NO: 1473520 - protein, 22 aa, Mycobacterium tuberculosis
PLATLEHNVLNALNAPTQALLG

SEQ ID NO: 1473521 - protein, 35 aa, Mycobacterium tuberculosis; identical to SEQ ID NO: 204163

SEQ ID NO: 1473522 - protein, 19 aa, Mycobacterium tuberculosis
PLRADLRGKAPYGAPQLAV

SEQ ID NO: 1473523 - protein, 20 aa, Mycobacterium tuberculosis
PLSLGRLDRGWVVASETAAL

SEQ ID NO: 1473524 - protein, 25 aa, Mycobacterium tuberculosis
PLTPGRMTTKWGGFVPDVAGFDAEF

SEQ ID NO: 1473525 - protein, 18 aa, Mycobacterium tuberculosis
PMAVGPLRVSAGVIRLRP

SEQ ID NO: 1473526 - protein, 21 aa, Mycobacterium tuberculosis
PMGCSICWHGPAGTPTMSVTI

SEQ ID NO: 1473527 - protein, 23 aa, Mycobacterium tuberculosis
PMSFLRRPARWMQLLATSGRCFS

SEQ ID NO: 1473528 - protein, 20 aa, Mycobacterium tuberculosis
PMYVGLLLILRRPRAGLSYE

SEQ ID NO: 1473529 - protein, 20 aa, Mycobacterium tuberculosis
PNAADWPLILADASQPLTLE

SEQ ID NO: 1473530 - protein, 21 aa, Mycobacterium tuberculosis
PNRLYWLSANIDPAGTDGGPQ

SEQ ID NO: 1473531 - protein, 17 aa, Mycobacterium tuberculosis
PPERGSRVRLCPTPGHL

SEQ ID NO: 1473532 - protein, 17 aa, Mycobacterium tuberculosis
PPGIPVDIGPGATVAHL

SEQ ID NO: 1473533 - protein, 19 aa, Mycobacterium tuberculosis
PPGSWTKYGHWLREPVGPI

SEQ ID NO: 1473534 - protein, 21 aa, Mycobacterium tuberculosis
PPYQGTVRMAFLLQGDHDAYF

SEQ ID NO: 1473535 - protein, 23 aa, Mycobacterium tuberculosis
PQARRADLRAGVLGEHQDQRRDR

SEQ ID NO: 1473536 - protein, 19 aa, Mycobacterium tuberculosis
PREWSDWVTRTAMPPLRIP

SEQ ID NO: 1473537 - protein, 20 aa, Mycobacterium tuberculosis
PRGDLDMKLRSVRAAARHEF

SEQ ID NO: 1473538 - protein, 20 aa, Mycobacterium tuberculosis
PRLRKPTVLVIDQIPDREGE

SEQ ID NO: 1473539 - protein, 19 aa, Mycobacterium tuberculosis
PRQVLGHRSPAELFTALLT

SEQ ID NO: 1473540 - protein, 17 aa, Mycobacterium tuberculosis
PRRGHRVLTRCQMSFVV

SEQ ID NO: 1473541 - protein, 18 aa, Mycobacterium tuberculosis
PSDRPWRLAMSTAGTFEN

SEQ ID NO: 1473542 - protein, 17 aa, Mycobacterium tuberculosis
PSLHPTVLVGMRNRLRA

SEQ ID NO: 1473543 - protein, 17 aa, Mycobacterium tuberculosis
PSRVWRAVREARDVLDD

SEQ ID NO: 1473544 - protein, 19 aa, Mycobacterium tuberculosis
PSSGPNLGRFGSFGRGVTP

SEQ ID NO: 1473545 - protein, 19 aa, Mycobacterium tuberculosis
PSVPLRIDVDGGIPGFTLF

SEQ ID NO: 1473546 - protein, 22 aa, Mycobacterium tuberculosis
PSWLRRWVRDGYAWVQPRLSPV

SEQ ID NO: 1473547 - protein, 21 aa, Mycobacterium tuberculosis
PTFSARLTAVAGRRVATGRDF

SEQ ID NO: 1473548 - protein, 18 aa, Mycobacterium tuberculosis
PTGTFTFAELLAHELSVE

SEQ ID NO: 1473549 - protein, 26 aa, Mycobacterium tuberculosis
PTMALLGRPLIGHGADGAPGTGQAGG

SEQ ID NO: 1473550 - protein, 21 aa, Mycobacterium tuberculosis
PTQIPSVAVPVTGAGGTGGNG

SEQ ID NO: 1473551 - protein, 21 aa, Mycobacterium tuberculosis
PVGEVRSRFYARAPELHRSPV

SEQ ID NO: 1473552 - protein, 25 aa, Mycobacterium tuberculosis
PVHAATLLPFIGRLLAARYAELNTA

SEQ ID NO: 1473553 - protein, 21 aa, Mycobacterium tuberculosis
PYLIRLPVGAGLVFATSDVWP

SEQ ID NO: 1473554 - protein, 29 aa, Mycobacterium tuberculosis
PYTLTGPIVIGSFFLPAFNIPGIDVPAIN

SEQ ID NO: 1473555 - protein, 21 aa, Mycobacterium tuberculosis
QALLGRPLIGDGAAGAPGTGQ

SEQ ID NO: 1473556 - protein, 21 aa, Mycobacterium tuberculosis
QALTGRPLIGNGANGTPGTGA

SEQ ID NO: 1473557 - protein, 17 aa, Mycobacterium tuberculosis
QAVGGAFVRLLDSSDEF

SEQ ID NO: 1473558 - protein, 19 aa, Mycobacterium tuberculosis
QAVIPGKCQLTVVPGATHL

SEQ ID NO: 1473559 - protein, 24 aa, Mycobacterium tuberculosis
QDAFGEKVLPLYLPSGDGLIGLLS

SEQ ID NO: 1473560 - protein, 24 aa, Mycobacterium tuberculosis
QDTRHGRPTLSAGTAIAQQHPAGT

SEQ ID NO: 1473561 - protein, 24 aa, Mycobacterium tuberculosis
QDYLATVITWHRHIAGLIEQAKSD

SEQ ID NO: 1473562 - protein, 20 aa, Mycobacterium tuberculosis
QEAWLRWDSQDTVIADPRAW

SEQ ID NO: 1473563 - protein, 24 aa, Mycobacterium tuberculosis
QEELMRAGTALTDIARMYGDTDDN

SEQ ID NO: 1473564 - protein, 17 aa, Mycobacterium tuberculosis
QEWIEGVPMAEIIRHGT

SEQ ID NO: 1473565 - protein, 19 aa, Mycobacterium tuberculosis
QIDIPGMSLFDVHEIVEIG

SEQ ID NO: 1473566 - protein, 18 aa, Mycobacterium tuberculosis
QLGRGYEYLDLDPETGHD

SEQ ID NO: 1473567 - protein, 25 aa, Mycobacterium tuberculosis
QLRSRSWWSGFDVVLLVDDWHMIVG

SEQ ID NO: 1473568 - protein, 18 aa, Mycobacterium tuberculosis
QNFGNLLSGWANLGNTVS

SEQ ID NO: 1473569 - protein, 17 aa, Mycobacterium tuberculosis
QNGFILPSFPPFSTPDV

SEQ ID NO: 1473570 - protein, 25 aa, Mycobacterium tuberculosis
QPDPGKWAGFELHRDVTVTEEFTLG

SEQ ID NO: 1473571 - protein, 24 aa, Mycobacterium tuberculosis
QPFQATAVIPVIGPVTVTLEGTPA

SEQ ID NO: 1473572 - protein, 21 aa, Mycobacterium tuberculosis
QPRKLRVMAEHVELPRGGRLG

SEQ ID NO: 1473573 - protein, 22 aa, Mycobacterium tuberculosis
QQEELWLLRGGDPGQPGLLPPA

SEQ ID NO: 1473574 - protein, 21 aa, Mycobacterium tuberculosis
QRAPQLGFGRYLVSATTPFTR

SEQ ID NO: 1473575 - protein, 20 aa, Mycobacterium tuberculosis
QRASSMPVNRYRPFAEEVEP

SEQ ID NO: 1473576 - protein, 17 aa, Mycobacterium tuberculosis
QRFLRALICRRWAGIAA

SEQ ID NO: 1473577 - protein, 18 aa, Mycobacterium tuberculosis
QRGLRPIQIWVPDVNAPE

SEQ ID NO: 1473578 - protein, 26 aa, Mycobacterium tuberculosis
QRGRGDALRLARRIAAALNASDNNAG

SEQ ID NO: 1473579 - protein, 20 aa, Mycobacterium tuberculosis
QRLSGPLQRLRAMAGGDVPV

SEQ ID NO: 1473580 - protein, 17 aa, Mycobacterium tuberculosis
QRTAPWVESLGLDHVRE

SEQ ID NO: 1473581 - protein, 26 aa, Mycobacterium tuberculosis
QSAVSEIPWSYDIGSNIEIPIEGDIN

SEQ ID NO: 1473582 - protein, 22 aa, Mycobacterium tuberculosis
QSPRHCGCEIVVLTTRQHGHPV

SEQ ID NO: 1473583 - protein, 23 aa, Mycobacterium tuberculosis
QSTSWAQRWLAATGNRDYLGAFV

SEQ ID NO: 1473584 - protein, 23 aa, Mycobacterium tuberculosis
QTGMGRTGAFFAHQHDGITPDVV

SEQ ID NO: 1473585 - protein, 23 aa, Mycobacterium tuberculosis
QTLLGRPLIGNGTNGAPGTGQAG

SEQ ID NO: 1473586 - protein, 24 aa, Mycobacterium tuberculosis
QTRRWNPKMKRFIFTDRNGIYIID

SEQ ID NO: 1473587 - protein, 25 aa, Mycobacterium tuberculosis
QVAAYQERFVLALSQASSTYAVAEA

SEQ ID NO: 1473588 - protein, 17 aa, Mycobacterium tuberculosis
QYQAWKHTQLIIDVVPG

SEQ ID NO: 1473589 - protein, 21 aa, Mycobacterium tuberculosis
RAAVDSGYYPGQFQVGQTGKT

SEQ ID NO: 1473590 - protein, 22 aa, Mycobacterium tuberculosis
RADLAAARRVCRRLTTSAPALA

SEQ ID NO: 1473591 - protein, 18 aa, Mycobacterium tuberculosis
RAKVLAGLDEDTEVRIVS

SEQ ID NO: 1473592 - protein, 23 aa, Mycobacterium tuberculosis
RALAEAACRAFDALAARYDVVVA

SEQ ID NO: 1473593 - protein, 30 aa, Mycobacterium tuberculosis
RALGEIRAIWRINELLNWQVASAGEDINMA

SEQ ID NO: 1473594 - protein, 17 aa, Mycobacterium tuberculosis
RALGYRLDGVHIAAVVW

SEQ ID NO: 1473595 - protein, 23 aa, Mycobacterium tuberculosis
RAPLAPIRLRIGMHTGEVSSPDE

SEQ ID NO: 1473596 - protein, 20 aa, Mycobacterium tuberculosis
RARHAKFATVIARDRAEAIA

SEQ ID NO: 1473597 - protein, 25 aa, Mycobacterium tuberculosis
RAVQAWRGFSRWLMRAYDVLVDEDQ

SEQ ID NO: 1473598 - protein, 21 aa, Mycobacterium tuberculosis
RAVVARARQKGCTLLVTDGDW

SEQ ID NO: 1473599 - protein, 18 aa, Mycobacterium tuberculosis
RDGVIPRRLVTSCEHFHR

SEQ ID NO: 1473600 - protein, 19 aa, Mycobacterium tuberculosis
RDLPRQPVHPELRVVDLAI

SEQ ID NO: 1473601 - protein, 20 aa, Mycobacterium tuberculosis
RDTLLWAKLIDKYQGTMTAA

SEQ ID NO: 1473602 - protein, 18 aa, Mycobacterium tuberculosis
REILDSRGNPTVEVEVAL

SEQ ID NO: 1473603 - protein, 19 aa, Mycobacterium tuberculosis
RELIQVLGHAGVRSLVSQP

SEQ ID NO: 1473604 - protein, 20 aa, Mycobacterium tuberculosis
RELRQLWEDRGCPRMPPRPR

SEQ ID NO: 1473605 - protein, 22 aa, Mycobacterium tuberculosis
RELTARTGGVVGRRVCAVVGSG

SEQ ID NO: 1473606 - protein, 17 aa, Mycobacterium tuberculosis
RERRKLISVLRHRGRIL

SEQ ID NO: 1473607 - protein, 20 aa, Mycobacterium tuberculosis
REVLTAWGAYGEKQMYGKTV

SEQ ID NO: 1473608 - protein, 17 aa, Mycobacterium tuberculosis
RFGDAFIPMDETLAHAA

SEQ ID NO: 1473609 - protein, 18 aa, Mycobacterium tuberculosis
RFHVVPVLAYSPDPGPVA

SEQ ID NO: 1473610 - protein, 18 aa, Mycobacterium tuberculosis
RFKVVWQALNALRSHDER

SEQ ID NO: 1473611 - protein, 21 aa, Mycobacterium tuberculosis
RFNLREFAIRPAYGLAEATVY

SEQ ID NO: 1473612 - protein, 20 aa, Mycobacterium tuberculosis
RFSGWQSTRQRVWGQMDSAR

SEQ ID NO: 1473613 - protein, 19 aa, Mycobacterium tuberculosis
RFVIDVTVWIDLAEAANSD

SEQ ID NO: 1473614 - protein, 25 aa, Mycobacterium tuberculosis
RGAEYSVDFVPKVRIEVVVDDSIVD

SEQ ID NO: 1473615 - protein, 19 aa, Mycobacterium tuberculosis
RGLLAPGCFIPVAESINLA

SEQ ID NO: 1473616 - protein, 19 aa, Mycobacterium tuberculosis
RGPAKRPARKAARKVPAKK

SEQ ID NO: 1473617 - protein, 19 aa, Mycobacterium tuberculosis
RGPTVPILLDTGSSSLVIP

SEQ ID NO: 1473618 - protein, 21 aa, Mycobacterium tuberculosis
RGRDRLLVLGLARGGVPVGWE

SEQ ID NO: 1473619 - protein, 18 aa, Mycobacterium tuberculosis
RGSRCARCARGWHDQGRH

SEQ ID NO: 1473620 - protein, 23 aa, Mycobacterium tuberculosis
RGTGARGLRAIMEEVLLPVMYDI

SEQ ID NO: 1473621 - protein, 17 aa, Mycobacterium tuberculosis
RHALALGPSKALLDGQI

SEQ ID NO: 1473622 - protein, 19 aa, Mycobacterium tuberculosis
RHELLSGLVPQISIILGKC

SEQ ID NO: 1473623 - protein, 26 aa, Mycobacterium tuberculosis
RHGLSSLGWNLCRIFTDGDHTLYADV

SEQ ID NO: 1473624 - protein, 18 aa, Mycobacterium tuberculosis
RHPGWPMAVGPLRVSAGV

SEQ ID NO: 1473625 - protein, 20 aa, Mycobacterium tuberculosis
RINQSFPVTVNWSTPAVTIF

SEQ ID NO: 1473626 - protein, 20 aa, Mycobacterium tuberculosis
RIRDVTELWCQGYSEPGAGS

SEQ ID NO: 1473627 - protein, 24 aa, Mycobacterium tuberculosis
RISIPSCRPGWCGPITASTECWDV

SEQ ID NO: 1473628 - protein, 18 aa, Mycobacterium tuberculosis
RIVPYPGTPLYQAYSDAG

SEQ ID NO: 1473629 - protein, 24 aa, Mycobacterium tuberculosis
RIVSYPGSSLWDMVRPRPSSRPAA

SEQ ID NO: 1473630 - protein, 20 aa, Mycobacterium tuberculosis
RKPPPAWARPQQLQIETDDA

SEQ ID NO: 1473631 - protein, 20 aa, Mycobacterium tuberculosis
RKSVRPRPHRPAGARAAFKP

SEQ ID NO: 1473632 - protein, 19 aa, Mycobacterium tuberculosis
RLAALYGLQLAHESQCCQM

SEQ ID NO: 1473633 - protein, 21 aa, Mycobacterium tuberculosis
RLAGEMLELAGIHGRDPAQTL

SEQ ID NO: 1473634 - protein, 26 aa, Mycobacterium tuberculosis
RLDERGVLRLRALMESFWSDELDRLV

SEQ ID NO: 1473635 - protein, 17 aa, Mycobacterium tuberculosis
RLHRVLGPLAHVNLIPL

SEQ ID NO: 1473636 - protein, 22 aa, Mycobacterium tuberculosis
RLLDCCQETDGAVAIVLTSAAR

SEQ ID NO: 1473637 - protein, 17 aa, Mycobacterium tuberculosis
RLLGEAITQAQLVLADH

SEQ ID NO: 1473638 - protein, 31 aa, Mycobacterium tuberculosis
RLLRATKYTVCFKFMSRIVPYPGTPLYQAYS

SEQ ID NO: 1473639 - protein, 17 aa, Mycobacterium tuberculosis
RLMRFDKHGPLDLILYH

SEQ ID NO: 1473640 - protein, 18 aa, Mycobacterium tuberculosis
RLPLSASVWDIAQRYNKG

SEQ ID NO: 1473641 - protein, 18 aa, Mycobacterium tuberculosis
RLPPTLPARSSMAAATVM

SEQ ID NO: 1473642 - protein, 25 aa, Mycobacterium tuberculosis
RLSTEHWMVPASLSMAAAVQPYLVW

SEQ ID NO: 1473643 - protein, 21 aa, Mycobacterium tuberculosis
RLVAACIDAGVSVTCLPGPSA

SEQ ID NO: 1473644 - protein, 17 aa, Mycobacterium tuberculosis
RLVTSCEHFHRQAVGIV

SEQ ID NO: 1473645 - protein, 18 aa, Mycobacterium tuberculosis
RLWEHPKDKLSHYSDRTV

SEQ ID NO: 1473646 - protein, 17 aa, Mycobacterium tuberculosis
RLYERLLGWLADIQQPR

SEQ ID NO: 1473647 - protein, 18 aa, Mycobacterium tuberculosis
RMLMDAAIFKDTLIMSYE

SEQ ID NO: 1473648 - protein, 19 aa, Mycobacterium tuberculosis
RMWAASGVDYPTLLATMIE

SEQ ID NO: 1473649 - protein, 33 aa, Mycobacterium tuberculosis; identical to SEQ ID NO: 205635

SEQ ID NO: 1473650 - protein, 20 aa, Mycobacterium tuberculosis
RNQGAFGFSEPCTDCRGSGS

SEQ ID NO: 1473651 - protein, 24 aa, Mycobacterium tuberculosis
RNTQPGWVVAPGMQGVQVGPITQG

SEQ ID NO: 1473652 - protein, 20 aa, Mycobacterium tuberculosis
RPACGVCVLAKDCPSFGLGP

SEQ ID NO: 1473653 - protein, 18 aa, Mycobacterium tuberculosis
RPEHLAYYGGLAALAALE

SEQ ID NO: 1473654 - protein, 26 aa, Mycobacterium tuberculosis
RPELGLRPRLAIGIHQPGVGALRPPV

SEQ ID NO: 1473655 - protein, 20 aa, Mycobacterium tuberculosis
RPGDVISLGATSWRITEITH

SEQ ID NO: 1473656 - protein, 20 aa, Mycobacterium tuberculosis
RPGQYEAPLGITLRELLDYA

SEQ ID NO: 1473657 - protein, 23 aa, Mycobacterium tuberculosis
RPGVPRPGASPGSMPPRPGGAVG

SEQ ID NO: 1473658 - protein, 17 aa, Mycobacterium tuberculosis
RPWQLGTEMLRVTKPGG

SEQ ID NO: 1473659 - protein, 18 aa, Mycobacterium tuberculosis
RQAAVAAGIGWDVPALTI

SEQ ID NO: 1473660 - protein, 17 aa, Mycobacterium tuberculosis
RQGCGKTTALVAIGEAV

SEQ ID NO: 1473661 - protein, 19 aa, Mycobacterium tuberculosis
RQGEPAVSFLLISSGSAEV

SEQ ID NO: 1473662 - protein, 18 aa, Mycobacterium tuberculosis
RQGIRVNALCPGPVNTPL

SEQ ID NO: 1473663 - protein, 18 aa, Mycobacterium tuberculosis
RQGVRLGRGRGFYDRSLR

SEQ ID NO: 1473664 - protein, 21 aa, Mycobacterium tuberculosis
RQVPDNGGMYFVPAFSGLFAP

SEQ ID NO: 1473665 - protein, 19 aa, Mycobacterium tuberculosis
RRAAFGLATEIGRELTART

SEQ ID NO: 1473666 - protein, 21 aa, Mycobacterium tuberculosis
RRDGWWQGLGPYDVVLDALGG

SEQ ID NO: 1473667 - protein, 21 aa, Mycobacterium tuberculosis
RRDRGWLAWCARFDRGHRGDR

SEQ ID NO: 1473668 - protein, 22 aa, Mycobacterium tuberculosis
RRGRDRIPLTGRIAVIVDDGIA

SEQ ID NO: 1473669 - protein, 17 aa, Mycobacterium tuberculosis
RRKVLEEAFRVLRPGGE

SEQ ID NO: 1473670 - protein, 20 aa, Mycobacterium tuberculosis
RRLAEKLWNLRVLADEKSAS

SEQ ID NO: 1473671 - protein, 26 aa, Mycobacterium tuberculosis
RRLAKELDFRPRKSLGQNFVHDANTV

SEQ ID NO: 1473672 - protein, 21 aa, Mycobacterium tuberculosis
RRLRHACALIADNVTQPLTLQ

SEQ ID NO: 1473673 - protein, 20 aa, Mycobacterium tuberculosis
RRLRVGPRQPGVQWHQARLR

SEQ ID NO: 1473674 - protein, 20 aa, Mycobacterium tuberculosis
RRPSWEEITEVLEWLSPLPG

SEQ ID NO: 1473675 - protein, 17 aa, Mycobacterium tuberculosis
RRRFRHVLVDEYQDTNH

SEQ ID NO: 1473676 - protein, 21 aa, Mycobacterium tuberculosis
RRRLIKYISQIDVERYRSLIE

SEQ ID NO: 1473677 - protein, 17 aa, Mycobacterium tuberculosis
RRRRSVVAPGLRHHHVQ

SEQ ID NO: 1473678 - protein, 18 aa, Mycobacterium tuberculosis
RRSASVTAVAWRTSAGAA

SEQ ID NO: 1473679 - protein, 19 aa, Mycobacterium tuberculosis
RRSLFGRRIAKYGWPNLSD

SEQ ID NO: 1473680 - protein, 24 aa, Mycobacterium tuberculosis
RRSLRPVGIVEVDGFPVFDVPPDA

SEQ ID NO: 1473681 - protein, 18 aa, Mycobacterium tuberculosis
RRTGLPGSPTRGPANSIT

SEQ ID NO: 1473682 - protein, 17 aa, Mycobacterium tuberculosis
RRVIVYFYPAASTPGCT

SEQ ID NO: 1473683 - protein, 25 aa, Mycobacterium tuberculosis
RRWWPRRYRRSSVYWRLMALDQRFG

SEQ ID NO: 1473684 - protein, 19 aa, Mycobacterium tuberculosis
RSLERLECLVRRLPAVGHT

SEQ ID NO: 1473685 - protein, 18 aa, Mycobacterium tuberculosis
RSLLGGRLTGVVVVTGPP

SEQ ID NO: 1473686 - protein, 17 aa, Mycobacterium tuberculosis
RSPHGVSAGGSRLVGVA

SEQ ID NO: 1473687 - protein, 17 aa, Mycobacterium tuberculosis
RSRRGGRGWVVPAGGAV

SEQ ID NO: 1473688 - protein, 20 aa, Mycobacterium tuberculosis
RSTCRSLEFHRAVEVIAVGR

SEQ ID NO: 1473689 - protein, 22 aa, Mycobacterium tuberculosis
RTLPAHELATALNLMNERTLFA

SEQ ID NO: 1473690 - protein, 22 aa, Mycobacterium tuberculosis
RTRRPPAFPEDIWVPERDPGTT

SEQ ID NO: 1473691 - protein, 28 aa, Mycobacterium tuberculosis
RTSGEQRLSGFLLWQSAYSEMWFTEAHW

SEQ ID NO: 1473692 - protein, 19 aa, Mycobacterium tuberculosis
RTSNDLLLVPSIVEPSNFL

SEQ ID NO: 1473693 - protein, 18 aa, Mycobacterium tuberculosis
RTTPSIVAFARNGEVLVG

SEQ ID NO: 1473694 - protein, 26 aa, Mycobacterium tuberculosis
RVAQTRAAPHLARITCPALVLNAEAD

SEQ ID NO: 1473695 - protein, 20 aa, Mycobacterium tuberculosis
RVCGAIGVIECDRPVDLAVA

SEQ ID NO: 1473696 - protein, 17 aa, Mycobacterium tuberculosis
RVNDPRNEWLFNDAWGV

SEQ ID NO: 1473697 - protein, 33 aa, Mycobacterium tuberculosis; identical to SEQ ID NO: 234201

SEQ ID NO: 1473698 - protein, 21 aa, Mycobacterium tuberculosis
RVQVGHGLVVDFVRSCGMTAI

SEQ ID NO: 1473699 - protein, 19 aa, Mycobacterium tuberculosis
RVRATLVLDGDTLRVEANS

SEQ ID NO: 1473700 - protein, 20 aa, Mycobacterium tuberculosis
RVYPEMPENLVAVVQDGWRN

SEQ ID NO: 1473701 - protein, 21 aa, Mycobacterium tuberculosis
RWMGSGPLTGLAEIQLPDLQP

SEQ ID NO: 1473702 - protein, 18 aa, Mycobacterium tuberculosis
RWSPTALRILGAAAELIA

SEQ ID NO: 1473703 - protein, 20 aa, Mycobacterium tuberculosis
RYDPGALRRSRISARTRDLC

SEQ ID NO: 1473704 - protein, 23 aa, Mycobacterium tuberculosis
RYMLDRRRALGGFVPERRTKSKA

SEQ ID NO: 1473705 - protein, 17 aa, Mycobacterium tuberculosis
RYPNMLRLRYEKKRNLP

SEQ ID NO: 1473706 - protein, 20 aa, Mycobacterium tuberculosis
SACRPHSGTDLLAGIGGTPE

SEQ ID NO: 1473707 - protein, 25 aa, Mycobacterium tuberculosis
SADEVSVAVAALFGTHAQEYQTVSA

SEQ ID NO: 1473708 - protein, 31 aa, Mycobacterium tuberculosis; identical to SEQ ID NO: 206199

SEQ ID NO: 1473709 - protein, 24 aa, Mycobacterium tuberculosis
SAGGDGGRGGFGGDGLDASSGGNG

SEQ ID NO: 1473710 - protein, 19 aa, Mycobacterium tuberculosis
SAGKWPDKFLAGAAGVAHG

SEQ ID NO: 1473711 - protein, 26 aa, Mycobacterium tuberculosis
SAGVQLFRPAFLLAVPTALGGVGSLA

SEQ ID NO: 1473712 - protein, 23 aa, Mycobacterium tuberculosis
SAPGSRLAFEFVPDTAIFADERW

SEQ ID NO: 1473713 - protein, 19 aa, Mycobacterium tuberculosis
SAPRAHFEIPDDLGPGRQP

SEQ ID NO: 1473714 - protein, 23 aa, Mycobacterium tuberculosis
SAQAATFHAQFVQTLSAGAGAYA

SEQ ID NO: 1473715 - protein, 23 aa, Mycobacterium tuberculosis
SAQMSAFHAQFVQTFTAGAGAYA

SEQ ID NO: 1473716 - protein, 17 aa, Mycobacterium tuberculosis
SAWIAEGLLIYLPATAQ

SEQ ID NO: 1473717 - protein, 20 aa, Mycobacterium tuberculosis
SCQAIWRLDDGYLAASDPRR

SEQ ID NO: 1473718 - protein, 20 aa, Mycobacterium tuberculosis
SDLLICQKMDMNVHGKPDGL

SEQ ID NO: 1473719 - protein, 24 aa, Mycobacterium tuberculosis
SDNNAGDYGFFWITAVTTDGSIVV

SEQ ID NO: 1473720 - protein, 17 aa, Mycobacterium tuberculosis
SDPWRKLSANRDNRVFV

SEQ ID NO: 1473721 - protein, 17 aa, Mycobacterium tuberculosis
SDVVLFPGTGFVELAIR

SEQ ID NO: 1473722 - protein, 25 aa, Mycobacterium tuberculosis
SEARRTLEEISQWRVGILEQLARIH

SEQ ID NO: 1473723 - protein, 21 aa, Mycobacterium tuberculosis
SEFPPLSWRRDLSVDALLARN

SEQ ID NO: 1473724 - protein, 25 aa, Mycobacterium tuberculosis
SEFPWCGQAAEVLRSHFGSSLPVRV

SEQ ID NO: 1473725 - protein, 19 aa, Mycobacterium tuberculosis
SEGAISCYQYSKVTIELSD

SEQ ID NO: 1473726 - protein, 19 aa, Mycobacterium tuberculosis
SESLRLAREREANLIPGGK

SEQ ID NO: 1473727 - protein, 27 aa, Mycobacterium tuberculosis
SFAHVVRAVHRCLLAGRFATALGADDD

SEQ ID NO: 1473728 - protein, 17 aa, Mycobacterium tuberculosis
SGDACRVPWAAPDVPSA

SEQ ID NO: 1473729 - protein, 26 aa, Mycobacterium tuberculosis
SGGAGGAGGWLWGNGGAGGNGGVGVA

SEQ ID NO: 1473730 - protein, 20 aa, Mycobacterium tuberculosis
SGHLDWYADGMFPPMHIDAE

SEQ ID NO: 1473731 - protein, 38 aa, Mycobacterium tuberculosis
SGLADAAWRGPAAVAMARAVAPYLGWLISATAQAEQAA

SEQ ID NO: 1473732 - protein, 23 aa, Mycobacterium tuberculosis
SGMPRLYREAPLMGIWEGSGNVS

SEQ ID NO: 1473733 - protein, 20 aa, Mycobacterium tuberculosis
SGNFSTGLFNPGHGNTGFLN

SEQ ID NO: 1473734 - protein, 17 aa, Mycobacterium tuberculosis
SGNRGSYNIGPANLGNY

SEQ ID NO: 1473735 - protein, 36 aa, Mycobacterium tuberculosis
SGNYSNGAFWRGDYQGLLGFSYRPAVLPQTPFLDLT

SEQ ID NO: 1473736 - protein, 25 aa, Mycobacterium tuberculosis
SGRFEFRAGPIFTNLLLADEINRTP

SEQ ID NO: 1473737 - protein, 20 aa, Mycobacterium tuberculosis
SGTGRTRCAGRSGVISSAAM

SEQ ID NO: 1473738 - protein, 24 aa, Mycobacterium tuberculosis
SGVAVSPVTGLVFVTNFDSNTVSV

SEQ ID NO: 1473739 - protein, 25 aa, Mycobacterium tuberculosis
SHGPAVLGAPAWKPPHPLSDSITAA

SEQ ID NO: 1473740 - protein, 21 aa, Mycobacterium tuberculosis
SHGSPFRSGPIRTLADLEDIA

SEQ ID NO: 1473741 - protein, 17 aa, Mycobacterium tuberculosis
SIPYRVPYPQVMPTQET

SEQ ID NO: 1473742 - protein, 23 aa, Mycobacterium tuberculosis
SIRTILRALAIHRRPSANSKLGA

SEQ ID NO: 1473743 - protein, 24 aa, Mycobacterium tuberculosis
SKGWNLPGLMCAQVILSNRRDAHD

SEQ ID NO: 1473744 - protein, 24 aa, Mycobacterium tuberculosis
SKTVIGLNMLRLWDDRRTLEPWIA

SEQ ID NO: 1473745 - protein, 18 aa, Mycobacterium tuberculosis
SLARLLAPVLPKLDTVHT

SEQ ID NO: 1473746 - protein, 18 aa, Mycobacterium tuberculosis
SLARPVADTVWPTPFLAH

SEQ ID NO: 1473747 - protein, 18 aa, Mycobacterium tuberculosis
SLIPVAAVVGTVRTGVGV

SEQ ID NO: 1473748 - protein, 23 aa, Mycobacterium tuberculosis
SLLVRSLVAWFWDQPLRAPLIRH

SEQ ID NO: 1473749 - protein, 31 aa, Mycobacterium tuberculosis; identical to SEQ ID NO: 206518

SEQ ID NO: 1473750 - protein, 24 aa, Mycobacterium tuberculosis
SLPIFGFGGAPGFGNDTTAPSSGF

SEQ ID NO: 1473751 - protein, 19 aa, Mycobacterium tuberculosis
SLRDPYHAYTIDWLPEGWF

SEQ ID NO: 1473752 - protein, 21 aa, Mycobacterium tuberculosis
SLTAPAPFVYGLGAVGPALTT

SEQ ID NO: 1473753 - protein, 17 aa, Mycobacterium tuberculosis
SLVDDLVRRCRMVMAGE

SEQ ID NO: 1473754 - protein, 20 aa, Mycobacterium tuberculosis
SLVIRIAPPVGRQLDWMVCR

SEQ ID NO: 1473755 - protein, 24 aa, Mycobacterium tuberculosis
SMQVCQKAQCPFSTADSENLQIPQ

SEQ ID NO: 1473756 - protein, 27 aa, Mycobacterium tuberculosis
SNGMLWRGDHEGLFGLSYGITIPQFPI

SEQ ID NO: 1473757 - protein, 24 aa, Mycobacterium tuberculosis
SPEAFIRKPARWMQLLAKHQAPFS

SEQ ID NO: 1473758 - protein, 20 aa, Mycobacterium tuberculosis
SPFAASLLFGYVGAFMYEGD

SEQ ID NO: 1473759 - protein, 40 aa, Mycobacterium tuberculosis
SPGAEASWVVGITWWSAVVGGFQMSFVIAVPETIAAAATD

SEQ ID NO: 1473760 - protein, 18 aa, Mycobacterium tuberculosis
SPGLMIAMGPGFCSELVL

SEQ ID NO: 1473761 - protein, 17 aa, Mycobacterium tuberculosis
SPHVVAVGFTFDPKTHI

SEQ ID NO: 1473762 - protein, 23 aa, Mycobacterium tuberculosis
SQLRSRFGFLAIHGGGLEQATDL

SEQ ID NO: 1473763 - protein, 21 aa, Mycobacterium tuberculosis
SRDALTFARRRGVLVANAVGE

SEQ ID NO: 1473764 - protein, 19 aa, Mycobacterium tuberculosis
SRDPERHPGLAIGAVAVVN

SEQ ID NO: 1473765 - protein, 17 aa, Mycobacterium tuberculosis
SRFEHLVGYPFAPHYVD

SEQ ID NO: 1473766 - protein, 24 aa, Mycobacterium tuberculosis
SRHARIPVSVMPNAGLPVLGAKGA

SEQ ID NO: 1473767 - protein, 23 aa, Mycobacterium tuberculosis
SRLPRWRAMAAHALCKRDDLARQ

SEQ ID NO: 1473768 - protein, 18 aa, Mycobacterium tuberculosis
SRPLAAPVVRKLAKELAV

SEQ ID NO: 1473769 - protein, 19 aa, Mycobacterium tuberculosis
SRRRGIGTAMARAALAKTA

SEQ ID NO: 1473770 - protein, 22 aa, Mycobacterium tuberculosis
SRVRVWCGGTLVADHDRIWAKH

SEQ ID NO: 1473771 - protein, 18 aa, Mycobacterium tuberculosis
SSGSEFESAVGYSRAVRI

SEQ ID NO: 1473772 - protein, 17 aa, Mycobacterium tuberculosis
SSSALGWIIDHATTDET

SEQ ID NO: 1473773 - protein, 19 aa, Mycobacterium tuberculosis
SSSASEFCGIFAAPGLMRN

SEQ ID NO: 1473774 - protein, 21 aa, Mycobacterium tuberculosis
STFIEVCYLLIYGELPDTDQL

SEQ ID NO: 1473775 - protein, 19 aa, Mycobacterium tuberculosis
SVFELQARAILGLAVDTLM

SEQ ID NO: 1473776 - protein, 19 aa, Mycobacterium tuberculosis
SVFRADFLSELDAPAQAGT

SEQ ID NO: 1473777 - protein, 17 aa, Mycobacterium tuberculosis
SVGGMSVPPSWAAATPA

SEQ ID NO: 1473778 - protein, 18 aa, Mycobacterium tuberculosis
SVNGTVVVSVWQPGEPAA

SEQ ID NO: 1473779 - protein, 18 aa, Mycobacterium tuberculosis
SVPLRIDVDGGIPGFTLF

SEQ ID NO: 1473780 - protein, 22 aa, Mycobacterium tuberculosis
SVRMGAAVTPYVEWLTTTAAQA

SEQ ID NO: 1473781 - protein, 20 aa, Mycobacterium tuberculosis
SVSMTAQWWLDAREPKKEVV

SEQ ID NO: 1473782 - protein, 21 aa, Mycobacterium tuberculosis
SWQAREWLPFVGIERADTDRP

SEQ ID NO: 1473783 - protein, 20 aa, Mycobacterium tuberculosis
SYNGMLYFGINADRDAMSDV

SEQ ID NO: 1473784 - protein, 20 aa, Mycobacterium tuberculosis
TAAARAVSWPAVTSPAGPVT

SEQ ID NO: 1473785 - protein, 22 aa, Mycobacterium tuberculosis
TACSSGLTAVHMACRSLHEGES

SEQ ID NO: 1473786 - protein, 19 aa, Mycobacterium tuberculosis
TALWEEWPPSGARASIHSY

SEQ ID NO: 1473787 - protein, 22 aa, Mycobacterium tuberculosis
TAPRPATLYRLSVVDVLLGSQV

SEQ ID NO: 1473788 - protein, 17 aa, Mycobacterium tuberculosis
TAPSGRKPLRFTSFGDQ

SEQ ID NO: 1473789 - protein, 22 aa, Mycobacterium tuberculosis
TAPSGRKPLRFTSFGDQSTPAL

SEQ ID NO: 1473790 - protein, 17 aa, Mycobacterium tuberculosis
TDALIRFGVEAYEGADL

SEQ ID NO: 1473791 - protein, 20 aa, Mycobacterium tuberculosis
TDGNPGMGGSPGSAGQPGQP

SEQ ID NO: 1473792 - protein, 17 aa, Mycobacterium tuberculosis
TDIDAVLEFRVSEEVLL

SEQ ID NO: 1473793 - protein, 23 aa, Mycobacterium tuberculosis
TDVPTGVVVPYFWSDQYDVKIQC

SEQ ID NO: 1473794 - protein, 19 aa, Mycobacterium tuberculosis
TEKGRWYLVGHDRDRDATR

SEQ ID NO: 1473795 - protein, 25 aa, Mycobacterium tuberculosis
TELSRAVFSKGIFPAVDPLASSSTI

SEQ ID NO: 1473796 - protein, 42 aa, Mycobacterium tuberculosis; identical to SEQ ID NO: 210187

SEQ ID NO: 1473797 - protein, 25 aa, Mycobacterium tuberculosis
TFGYKFRPWRHVKVLADGASIRQYI

SEQ ID NO: 1473798 - protein, 17 aa, Mycobacterium tuberculosis
TGAMYRIVTLAVLRAGA

SEQ ID NO: 1473799 - protein, 25 aa, Mycobacterium tuberculosis
TGDLARYWHDGTLEFVGRADHRVKI

SEQ ID NO: 1473800 - protein, 26 aa, Mycobacterium tuberculosis
TGGAGGRGGLLIGDGGAGGAGGVGGT

SEQ ID NO: 1473801 - protein, 28 aa, Mycobacterium tuberculosis
TGGGGGNGGTGWNGGKGDTGSGGGAGDG

SEQ ID NO: 1473802 - protein, 22 aa, Mycobacterium tuberculosis
TGGLGGLGLFLAEKMANAGAGR

SEQ ID NO: 1473803 - protein, 28 aa, Mycobacterium tuberculosis
TGGLGGLGLVVARWLVDRGAGRVVLGGR

SEQ ID NO: 1473804 - protein, 24 aa, Mycobacterium tuberculosis
TGGTAHLGPLAIIGQSGQPGQFGS

SEQ ID NO: 1473805 - protein, 17 aa, Mycobacterium tuberculosis
TGLARQGYQAEYHGTAI

SEQ ID NO: 1473806 - protein, 24 aa, Mycobacterium tuberculosis
TGLRPDFPRPALLSGAGDAVEFRL

SEQ ID NO: 1473807 - protein, 23 aa, Mycobacterium tuberculosis
TGQAGGNGGWLWGNGGNGGSGAP

SEQ ID NO: 1473808 - protein, 23 aa, Mycobacterium tuberculosis
TGQAGGPGGILYGNGGNGGSGAP

SEQ ID NO: 1473809 - protein, 24 aa, Mycobacterium tuberculosis
TGREAAHLRAFRAYAAHSQEIALH

SEQ ID NO: 1473810 - protein, 17 aa, Mycobacterium tuberculosis
TGRTHLQFRRFAACPIC

SEQ ID NO: 1473811 - protein, 20 aa, Mycobacterium tuberculosis
TGSPIPVGLDPTGVAVNPVT

SEQ ID NO: 1473812 - protein, 27 aa, Mycobacterium tuberculosis
TGVGSCRDSAWLLVSILRQFGLAARFV

SEQ ID NO: 1473813 - protein, 19 aa, Mycobacterium tuberculosis
TGWRLHGRTARWIEIAAEW

SEQ ID NO: 1473814 - protein, 25 aa, Mycobacterium tuberculosis
TIRTGRANPGMFSRITIDYYGAATP

SEQ ID NO: 1473815 - protein, 30 aa, Mycobacterium tuberculosis
TITIPEIPYRYDLSVPIDIPITGTVVATTP

SEQ ID NO: 1473816 - protein, 18 aa, Mycobacterium tuberculosis
TLAELRVGVLAAATTDIR

SEQ ID NO: 1473817 - protein, 18 aa, Mycobacterium tuberculosis
TLLGRPLVGDGADGASGP

SEQ ID NO: 1473818 - protein, 29 aa, Mycobacterium tuberculosis
TLSTQAAAFHSRFVQALTTAAASYASVEA

SEQ ID NO: 1473819 - protein, 23 aa, Mycobacterium tuberculosis
TMKHLRAGYWRQVRAQLTVTPVM

SEQ ID NO: 1473820 - protein, 24 aa, Mycobacterium tuberculosis
TMLPTGEVVRRCYTDVLAAARPAT

SEQ ID NO: 1473821 - protein, 22 aa, Mycobacterium tuberculosis
TMLREYLEAMRALWTQEEACYD

SEQ ID NO: 1473822 - protein, 17 aa, Mycobacterium tuberculosis
TNREAWAAYAAFLDDDR

SEQ ID NO: 1473823 - protein, 18 aa, Mycobacterium tuberculosis
TNVLLLRGMIGKPGAGVC

SEQ ID NO: 1473824 - protein, 24 aa, Mycobacterium tuberculosis
TPDSLHWDCFSFGVIQRADSFTFY

SEQ ID NO: 1473825 - protein, 22 aa, Mycobacterium tuberculosis
TPKLRARQLISQWERYRRGIYC

SEQ ID NO: 1473826 - protein, 18 aa, Mycobacterium tuberculosis
TQQLKKLAGLSERLTSAA

SEQ ID NO: 1473827 - protein, 26 aa, Mycobacterium tuberculosis
TQRAFLRYGKGRHRAALNFGDCMTYA

SEQ ID NO: 1473828 - protein, 26 aa, Mycobacterium tuberculosis
TRFVYRRLGADAGVPVIFLHHLGAVL

SEQ ID NO: 1473829 - protein, 19 aa, Mycobacterium tuberculosis
TRGAPTVRIRGFSLWGDVG

SEQ ID NO: 1473830 - protein, 17 aa, Mycobacterium tuberculosis
TRKSRRLRTDLVGGDQA

SEQ ID NO: 1473831 - protein, 21 aa, Mycobacterium tuberculosis
TRLWEHWGKPEIVWYPGGHTG

SEQ ID NO: 1473832 - protein, 21 aa, Mycobacterium tuberculosis
TRRPPAFPEDIWVPERRHHAV

SEQ ID NO: 1473833 - protein, 19 aa, Mycobacterium tuberculosis
TRVQVLWSLADREMSVNEL

SEQ ID NO: 1473834 - protein, 25 aa, Mycobacterium tuberculosis
TSDIKNLLPMLAVFKPTVVVSVPRV

SEQ ID NO: 1473835 - protein, 22 aa, Mycobacterium tuberculosis
TSGRLTDTWSRPRCMRRHWPPG

SEQ ID NO: 1473836 - protein, 25 aa, Mycobacterium tuberculosis
TSLRRSYTLLRPGGRLVGYGISNMQ

SEQ ID NO: 1473837 - protein, 18 aa, Mycobacterium tuberculosis
TSTRCWTNAWMCWTRRRN

SEQ ID NO: 1473838 - protein, 20 aa, Mycobacterium tuberculosis
TTIRNLVHGIGFQRDVLGAE

SEQ ID NO: 1473839 - protein, 20 aa, Mycobacterium tuberculosis
TTLLSALGITGQFRFGPITV

SEQ ID NO: 1473840 - protein, 23 aa, Mycobacterium tuberculosis
TTTGARYRATFAHNVDAYKSTAV

SEQ ID NO: 1473841 - protein, 24 aa, Mycobacterium tuberculosis
TVAVLLRITEVFGVDATFFASQDD

SEQ ID NO: 1473842 - protein, 17 aa, Mycobacterium tuberculosis
TVGLGPFTVPPISIPSL

SEQ ID NO: 1473843 - protein, 21 aa, Mycobacterium tuberculosis
TVKTFKRAGGQVWLMPHNPAF

SEQ ID NO: 1473844 - protein, 22 aa, Mycobacterium tuberculosis
TVSAADRPAHWRATDVAPTDAG

SEQ ID NO: 1473845 - protein, 23 aa, Mycobacterium tuberculosis
TVSAADRPAHWRATDVAPTDAGG

SEQ ID NO: 1473846 - protein, 17 aa, Mycobacterium tuberculosis
TVSGLYVCEMVTARALI

SEQ ID NO: 1473847 - protein, 25 aa, Mycobacterium tuberculosis
TWSRPRCMRRHWPPGWHVPTCLRLA

SEQ ID NO: 1473848 - protein, 18 aa, Mycobacterium tuberculosis
TYAFQHQKFWLAPAPSVS

SEQ ID NO: 1473849 - protein, 22 aa, Mycobacterium tuberculosis
TYARIGERWRIGSDGLVLEVSA

SEQ ID NO: 1473850 - protein, 17 aa, Mycobacterium tuberculosis
VALRARLYPLLGPRHDP

SEQ ID NO: 1473851 - protein, 18 aa, Mycobacterium tuberculosis
VALRARLYPLLGPRHDPT

SEQ ID NO: 1473852 - protein, 17 aa, Mycobacterium tuberculosis
VAMGRAIVRRPRVFCMD

SEQ ID NO: 1473853 - protein, 21 aa, Mycobacterium tuberculosis
VARLRVILRRAGKGNKEPRNV

SEQ ID NO: 1473854 - protein, 26 aa, Mycobacterium tuberculosis
VASAFGGGNAFGGRGGDGGDGGDGGT

SEQ ID NO: 1473855 - protein, 28 aa, Mycobacterium tuberculosis
VAVDLRDEWQIALCNNGFDANRPSAWIA

SEQ ID NO: 1473856 - protein, 21 aa, Mycobacterium tuberculosis
VCDLGRQIGYLLASQEPALAE

SEQ ID NO: 1473857 - protein, 18 aa, Mycobacterium tuberculosis
VDALNRLNRNSCSSPRAG

SEQ ID NO: 1473858 - protein, 25 aa, Mycobacterium tuberculosis
VDDPDFDLGRHVWRIALPRPGNEDQ

SEQ ID NO: 1473859 - protein, 20 aa, Mycobacterium tuberculosis
VDEFERWVVEHGFRGLNLRP

SEQ ID NO: 1473860 - protein, 18 aa, Mycobacterium tuberculosis
VDGARWLSLEGRVAVNSD

SEQ ID NO: 1473861 - protein, 18 aa, Mycobacterium tuberculosis
VDRQLARLADRVAAKHTE

SEQ ID NO: 1473862 - protein, 24 aa, Mycobacterium tuberculosis
VDTHFGRLVRRWRWTTAEDPVKVE

SEQ ID NO: 1473863 - protein, 18 aa, Mycobacterium tuberculosis
VDVPLKFHHPMWREHCKV

SEQ ID NO: 1473864 - protein, 17 aa, Mycobacterium tuberculosis
VDYRLIPKHSIGMALDD

SEQ ID NO: 1473865 - protein, 30 aa, Mycobacterium tuberculosis
VEASHCYPHFRRFLAEVVRVLRPGRYFPYA

SEQ ID NO: 1473866 - protein, 18 aa, Mycobacterium tuberculosis
VEGFRPATLHQAYLALRA

SEQ ID NO: 1473867 - protein, 21 aa, Mycobacterium tuberculosis
VEGGWKINGQKVWTSGAQYCA

SEQ ID NO: 1473868 - protein, 22 aa, Mycobacterium tuberculosis
VENLRYTVRFAAAVQAALKDGY

SEQ ID NO: 1473869 - protein, 19 aa, Mycobacterium tuberculosis
VEPRMLLVHFLRDQLRLTG

SEQ ID NO: 1473870 - protein, 20 aa, Mycobacterium tuberculosis
VEQRPELVLDRVRAFLAAGT

SEQ ID NO: 1473871 - protein, 21 aa, Mycobacterium tuberculosis
VFARMWRGYARGVLEKLSALL

SEQ ID NO: 1473872 - protein, 24 aa, Mycobacterium tuberculosis
VFFESPRRLAACLNDAVEQLGGAR

SEQ ID NO: 1473873 - protein, 18 aa, Mycobacterium tuberculosis
VFGSPTWRTVTGGSANYV

SEQ ID NO: 1473874 - protein, 17 aa, Mycobacterium tuberculosis
VFRAWKLHDELGLNIVM

SEQ ID NO: 1473875 - protein, 24 aa, Mycobacterium tuberculosis
VFVPRPETEAILAWATAQSLPARP

SEQ ID NO: 1473876 - protein, 25 aa, Mycobacterium tuberculosis
VGAMSRPRMDAARCLSEEQIGVTVV

SEQ ID NO: 1473877 - protein, 19 aa, Mycobacterium tuberculosis
VGAVVGRYAAGGYEVDFTA

SEQ ID NO: 1473878 - protein, 18 aa, Mycobacterium tuberculosis
VGDPSGFVKLVADAKHGE

SEQ ID NO: 1473879 - protein, 25 aa, Mycobacterium tuberculosis
VGFDIPNDFVVGYGLDYDERYRDLS

SEQ ID NO: 1473880 - protein, 24 aa, Mycobacterium tuberculosis
VGGDGGRGGLLAGNGGTGGAGGNG

SEQ ID NO: 1473881 - protein, 17 aa, Mycobacterium tuberculosis
VGLFGVDVGDVLAGVDR

SEQ ID NO: 1473882 - protein, 19 aa, Mycobacterium tuberculosis
VGPAEKIYDPGIILDKDRG

SEQ ID NO: 1473883 - protein, 17 aa, Mycobacterium tuberculosis
VGVLAGFPVEIAPTAQA

SEQ ID NO: 1473884 - protein, 17 aa, Mycobacterium tuberculosis
VGVLDMLAVFYNDTPDE

SEQ ID NO: 1473885 - protein, 17 aa, Mycobacterium tuberculosis
VGWCDGRGDGHWVVSIR

SEQ ID NO: 1473886 - protein, 20 aa, Mycobacterium tuberculosis
VGYPREWRRRKPYSWLRQVL

SEQ ID NO: 1473887 - protein, 21 aa, Mycobacterium tuberculosis
VHAAGARWILDLGPGDILTRL

SEQ ID NO: 1473888 - protein, 24 aa, Mycobacterium tuberculosis
VHADAGIDFFEVFCDTPLQDCERR

SEQ ID NO: 1473889 - protein, 29 aa, Mycobacterium tuberculosis
VHADAGIDFFEVFCDTPLQDCERRDPKGL

SEQ ID NO: 1473890 - protein, 26 aa, Mycobacterium tuberculosis
VIATGPRWRCPAGRCRRRPSDRAYRL

SEQ ID NO: 1473891 - protein, 19 aa, Mycobacterium tuberculosis
VIDCARPQSNHAFGAEPGV

SEQ ID NO: 1473892 - protein, 19 aa, Mycobacterium tuberculosis
VIISDFLGPINWMRPLRAI

SEQ ID NO: 1473893 - protein, 17 aa, Mycobacterium tuberculosis
VIVTGDFNARYSDDQSA

SEQ ID NO: 1473894 - protein, 17 aa, Mycobacterium tuberculosis
VKLPNRWPLTDAAGVPV

SEQ ID NO: 1473895 - protein, 20 aa, Mycobacterium tuberculosis
VKTFDELDCLLDRLDGTVPF

SEQ ID NO: 1473896 - protein, 22 aa, Mycobacterium tuberculosis
VKWTGSRVDLVFGSNSELRALV

SEQ ID NO: 1473897 - protein, 20 aa, Mycobacterium tuberculosis
VLAKDCPSFGLGPTEPLLAA

SEQ ID NO: 1473898 - protein, 23 aa, Mycobacterium tuberculosis
VLDVTHITRWAGCIGNRSTVIAV

SEQ ID NO: 1473899 - protein, 36 aa, Mycobacterium tuberculosis
VLERGLLLRLRFELDHHINLRPARLYPGVASPLSGN

SEQ ID NO: 1473900 - protein, 19 aa, Mycobacterium tuberculosis
VLFCGVVGPGPAHIRTVRL

SEQ ID NO: 1473901 - protein, 17 aa, Mycobacterium tuberculosis
VLHEVRIMLDQYWPSVP

SEQ ID NO: 1473902 - protein, 19 aa, Mycobacterium tuberculosis
VLMATNFFGINTIPIALNE

SEQ ID NO: 1473903 - protein, 20 aa, Mycobacterium tuberculosis
VLRLEGLEVIPSVLPPAPAG

SEQ ID NO: 1473904 - protein, 18 aa, Mycobacterium tuberculosis
VLRSMGIPCRYVSGYLHP

SEQ ID NO: 1473905 - protein, 18 aa, Mycobacterium tuberculosis
VLVHPAPRGVLGGLAATV

SEQ ID NO: 1473906 - protein, 29 aa, Mycobacterium tuberculosis
VMTIPGMRLPFTSIVPFVVYYGPVELPQS

SEQ ID NO: 1473907 - protein, 29 aa, Mycobacterium tuberculosis
VNAPTQALFGRPLIGNGADGSPGTGQAGG

SEQ ID NO: 1473908 - protein, 23 aa, Mycobacterium tuberculosis
VNDARFLIYPAMKALTLDIASMV

SEQ ID NO: 1473909 - protein, 25 aa, Mycobacterium tuberculosis
VNPPGDERHMLWFELMKPMTSTATG

SEQ ID NO: 1473910 - protein, 17 aa, Mycobacterium tuberculosis
VNTGAFIGGNFSNGAFW

SEQ ID NO: 1473911 - protein, 18 aa, Mycobacterium tuberculosis
VNTGAFIGGNFSNGAFWQ

SEQ ID NO: 1473912 - protein, 20 aa, Mycobacterium tuberculosis
VPDIPIPAIHIGINGVVTVG

SEQ ID NO: 1473913 - protein, 23 aa, Mycobacterium tuberculosis
VPIWGDVELAWRLDAAGCYGPPR

SEQ ID NO: 1473914 - protein, 23 aa, Mycobacterium tuberculosis
VPPCAPFARRASSSGYARADRRI

SEQ ID NO: 1473915 - protein, 17 aa, Mycobacterium tuberculosis
VPSARRYLPGSLIMETT

SEQ ID NO: 1473916 - protein, 26 aa, Mycobacterium tuberculosis
VPSLPFRLIHIADTYTPIAPEDLPGR

SEQ ID NO: 1473917 - protein, 20 aa, Mycobacterium tuberculosis
VQDLGIEVFLVMPFTTDFMK

SEQ ID NO: 1473918 - protein, 19 aa, Mycobacterium tuberculosis
VQEIGWAEHWQCDSCSASH

SEQ ID NO: 1473919 - protein, 18 aa, Mycobacterium tuberculosis
VQGSGWAALGWDTLGNKL

SEQ ID NO: 1473920 - protein, 17 aa, Mycobacterium tuberculosis
VQLASLLVGEWDVIALD

SEQ ID NO: 1473921 - protein, 17 aa, Mycobacterium tuberculosis
VQVIAGRGELIDSTPGL

SEQ ID NO: 1473922 - protein, 20 aa, Mycobacterium tuberculosis
VRARLRQSWLERGATDAELG

SEQ ID NO: 1473923 - protein, 21 aa, Mycobacterium tuberculosis
VRARWERRLAEVGVDRLHAEL

SEQ ID NO: 1473924 - protein, 25 aa, Mycobacterium tuberculosis
VRATMKVSWRLYAYVSKDADRAQRR

SEQ ID NO: 1473925 - protein, 22 aa, Mycobacterium tuberculosis
VRRPAIAAVRAEYERVLRQRTA

SEQ ID NO: 1473926 - protein, 20 aa, Mycobacterium tuberculosis
VRSRRPGETASIFVPSVPNL

SEQ ID NO: 1473927 - protein, 21 aa, Mycobacterium tuberculosis
VRSRRPGETASIFVPSVPNLL

SEQ ID NO: 1473928 - protein, 19 aa, Mycobacterium tuberculosis
VRSTIRAARALLERIEAGE

SEQ ID NO: 1473929 - protein, 17 aa, Mycobacterium tuberculosis
VRTDELLDLWAAAYPGG

SEQ ID NO: 1473930 - protein, 17 aa, Mycobacterium tuberculosis
VRVAEGMVLGQWSAVVG

SEQ ID NO: 1473931 - protein, 28 aa, Mycobacterium tuberculosis
VSALKALEGDAKWVASVEELMNAVDESI

SEQ ID NO: 1473932 - protein, 17 aa, Mycobacterium tuberculosis
VSFKVRRGEVIGLLGPN

SEQ ID NO: 1473933 - protein, 20 aa, Mycobacterium tuberculosis
VSTQIAALFGAHARSYQTLS

SEQ ID NO: 1473934 - protein, 25 aa, Mycobacterium tuberculosis
VTADPRLNTGLTPFLLGPVYISNNP

SEQ ID NO: 1473935 - protein, 27 aa, Mycobacterium tuberculosis
VTADPRLNTGLTPFLLGPVYISNNPSG

SEQ ID NO: 1473936 - protein, 22 aa, Mycobacterium tuberculosis
VTARLWPTLIEPLRTREQARRD

SEQ ID NO: 1473937 - protein, 25 aa, Mycobacterium tuberculosis
VTVWQGRTGAMAVPVGWAATVVGEG

SEQ ID NO: 1473938 - protein, 19 aa, Mycobacterium tuberculosis
VVNLHRRYRITTAQLAAAT

SEQ ID NO: 1473939 - protein, 25 aa, Mycobacterium tuberculosis
VVRVLRPGRYFPYADLRPNNEIAAW

SEQ ID NO: 1473940 - protein, 19 aa, Mycobacterium tuberculosis
VVSKPAALVHGMFVALPAA

SEQ ID NO: 1473941 - protein, 22 aa, Mycobacterium tuberculosis
VVSLSSLAARRGRIHFDDLQFE

SEQ ID NO: 1473942 - protein, 20 aa, Mycobacterium tuberculosis
VVSPGDLWDLLRDGREAAGS

SEQ ID NO: 1473943 - protein, 17 aa, Mycobacterium tuberculosis
VWTLRLYLTGKRLWHDP

SEQ ID NO: 1473944 - protein, 25 aa, Mycobacterium tuberculosis
VYPALGRTPLVVWPAGPGTRRQPGI

SEQ ID NO: 1473945 - protein, 17 aa, Mycobacterium tuberculosis
WAALPFDERAAVFLRAA

SEQ ID NO: 1473946 - protein, 17 aa, Mycobacterium tuberculosis
WADLIVFAGNCALESMG

SEQ ID NO: 1473947 - protein, 20 aa, Mycobacterium tuberculosis
WADLRRRVAALAGALSGRGV

SEQ ID NO: 1473948 - protein, 18 aa, Mycobacterium tuberculosis
WASSGHVGFKGSRKSTPF

SEQ ID NO: 1473949 - protein, 17 aa, Mycobacterium tuberculosis
WCGMTIPRVYPEMPENL

SEQ ID NO: 1473950 - protein, 22 aa, Mycobacterium tuberculosis
WDELAAELWLAAASFESVCSGL

SEQ ID NO: 1473951 - protein, 18 aa, Mycobacterium tuberculosis
WDQLKWNALANIAGTPAT

SEQ ID NO: 1473952 - protein, 17 aa, Mycobacterium tuberculosis
WEAAAGLTVHAPSLHPT

SEQ ID NO: 1473953 - protein, 21 aa, Mycobacterium tuberculosis
WEQVADWDFVCEQLAAAEPWW

SEQ ID NO: 1473954 - protein, 17 aa, Mycobacterium tuberculosis
WGRRHVVMGANQVDRYG

SEQ ID NO: 1473955 - protein, 25 aa, Mycobacterium tuberculosis
WGTPRPRWRSAQALTSRSCNGSLDT

SEQ ID NO: 1473956 - protein, 24 aa, Mycobacterium tuberculosis
WIEGRRYLGLEVLTRARAALTSTE

SEQ ID NO: 1473957 - protein, 20 aa, Mycobacterium tuberculosis
WLDTFTHWRRAQDLPATSIA

SEQ ID NO: 1473958 - protein, 20 aa, Mycobacterium tuberculosis
WLPCFHDMGMVGFLTIPMFF

SEQ ID NO: 1473959 - protein, 21 aa, Mycobacterium tuberculosis
WLRERPREMARTVFIELLAWQ

SEQ ID NO: 1473960 - protein, 17 aa, Mycobacterium tuberculosis
WLVDRGAGRVVLGGRSD

SEQ ID NO: 1473961 - protein, 17 aa, Mycobacterium tuberculosis
WNGTLCDDRTILLDAVG

SEQ ID NO: 1473962 - protein, 25 aa, Mycobacterium tuberculosis
WPASYDASLRVSWRQLQPTDPRTLP

SEQ ID NO: 1473963 - protein, 18 aa, Mycobacterium tuberculosis
WPDPRASLCDIARALRPG

SEQ ID NO: 1473964 - protein, 19 aa, Mycobacterium tuberculosis
WPLTDAAGVPVVFLTAYYA

SEQ ID NO: 1473965 - protein, 21 aa, Mycobacterium tuberculosis
WPSYVRVSAGLPRTMTFKVIK

SEQ ID NO: 1473966 - protein, 18 aa, Mycobacterium tuberculosis
WRTIGRVLDGPARVLVDG

SEQ ID NO: 1473967 - protein, 19 aa, Mycobacterium tuberculosis
WRWDMLAAKLADFLRGDDA

SEQ ID NO: 1473968 - protein, 25 aa, Mycobacterium tuberculosis
WSLAVALRLAAYQLLRVDGGEPVLL

SEQ ID NO: 1473969 - protein, 25 aa, Mycobacterium tuberculosis
WSPDSDLKGFDGFDGGSGGAGGDGG

SEQ ID NO: 1473970 - protein, 18 aa, Mycobacterium tuberculosis
WVVEHGFRGLNLRPFMIG

SEQ ID NO: 1473971 - protein, 18 aa, Mycobacterium tuberculosis
YARHTGGTFVFRIEDTDA

SEQ ID NO: 1473972 - protein, 18 aa, Mycobacterium tuberculosis
YDQIWKDHVLALNGAYQM

SEQ ID NO: 1473973 - protein, 18 aa, Mycobacterium tuberculosis
YDQLSVRAARDYHNGILD

SEQ ID NO: 1473974 - protein, 19 aa, Mycobacterium tuberculosis
YERVGKRGLGFGAEVRSKA

SEQ ID NO: 1473975 - protein, 18 aa, Mycobacterium tuberculosis
YGAAGFAVLERTIAELRA

SEQ ID NO: 1473976 - protein, 23 aa, Mycobacterium tuberculosis
YGEMWAQDAAAMFGYAAATATAT

SEQ ID NO: 1473977 - protein, 17 aa, Mycobacterium tuberculosis
YGGVEFYSAIAAGSPER

SEQ ID NO: 1473978 - protein, 25 aa, Mycobacterium tuberculosis
YGVHLMCSAGGWIHGQRQSLLQNVT

SEQ ID NO: 1473979 - protein, 20 aa, Mycobacterium tuberculosis
YHWIDYPGPDRAAAIVRRTV

SEQ ID NO: 1473980 - protein, 19 aa, Mycobacterium tuberculosis
YLVAEILRIISGGRLIWDP

SEQ ID NO: 1473981 - protein, 20 aa, Mycobacterium tuberculosis
YLVAEILRIISGGRLIWDPA

SEQ ID NO: 1473982 - protein, 36 aa, Mycobacterium tuberculosis
YNIAGLPFPLSSAILPRFFYTKEIGKRLNAYYVANV

SEQ ID NO: 1473983 - protein, 20 aa, Mycobacterium tuberculosis
YQAISTQVAAFHDRFAQTLS

SEQ ID NO: 1473984 - protein, 17 aa, Mycobacterium tuberculosis
YQPGRRCASWVKDKHWN

SEQ ID NO: 1473985 - protein, 18 aa, Mycobacterium tuberculosis
YRESLGFEVLPLSGGERP

SEQ ID NO: 1473986 - protein, 19 aa, Mycobacterium tuberculosis
YRLRAVSAVGLRFPLNGTA

SEQ ID NO: 1473987 - protein, 28 aa, Mycobacterium tuberculosis
YTAPEISARILMKLKRDAEAYLGEDITD

SEQ ID NO: 1473988 - protein, 31 aa, Mycobacterium tuberculosis; identical to SEQ ID NO: 210415

SEQ ID NO: 1473989 - protein, 22 aa, Mycobacterium tuberculosis
YTGELAGGFAFVPGLETVGTIA

SEQ ID NO: 1473990 - protein, 17 aa, Mycobacterium tuberculosis
YVGLLLILRRPRAGLSY

SEQ ID NO: 1473991 - protein, 19 aa, Mycobacterium tuberculosis
YWLQEFHIDGLRVDAVASM

SEQ ID NO: 1473992 - protein, 17 aa, Mycobacterium tuberculosis
AAAARLTPFSPLAPIAN

SEQ ID NO: 1473993 - protein, 26 aa, Mycobacterium tuberculosis
AAACLARAGLRVRLLERLAQTGGAAV

SEQ ID NO: 1473994 - protein, 27 aa, Mycobacterium tuberculosis
AAAGGWPTWVWAISGWPTPAPATSGSG

SEQ ID NO: 1473995 - protein, 19 aa, Mycobacterium tuberculosis
AAANAFLDGLVAYRRSRGL

SEQ ID NO: 1473996 - protein, 23 aa, Mycobacterium tuberculosis
AAARTGHPWWTLSQLSDESAIEL

SEQ ID NO: 1473997 - protein, 23 aa, Mycobacterium tuberculosis
AAATRGGWRAGGVRDGRIGTLVP

SEQ ID NO: 1473998 - protein, 29 aa, Mycobacterium tuberculosis
AAAVLRFAATEVIPRLAGTATEIEQVLRA

SEQ ID NO: 1473999 - protein, 23 aa, Mycobacterium tuberculosis
AAAYETAYRLTVPPPVIAENRTE

SEQ ID NO: 1474000 - protein, 18 aa, Mycobacterium tuberculosis
AACTKLGTEHLVGTTLNV

SEQ ID NO: 1474001 - protein, 17 aa, Mycobacterium tuberculosis
AADAARIGSAINTANTA

SEQ ID NO: 1474002 - protein, 18 aa, Mycobacterium tuberculosis
AADVAAMVSYHSGASAVA

SEQ ID NO: 1474003 - protein, 21 aa, Mycobacterium tuberculosis
AAFCYAAAVVTELGGPMSHAA

SEQ ID NO: 1474004 - protein, 18 aa, Mycobacterium tuberculosis
AAFQLARSDADIAALAEV

SEQ ID NO: 1474005 - protein, 26 aa, Mycobacterium tuberculosis
AAGDEVSAAIAALFSSHGQQYQAMSA

SEQ ID NO: 1474006 - protein, 29 aa, Mycobacterium tuberculosis
AAGGLNWASLPLKLFAGGNAKFWHPADID

SEQ ID NO: 1474007 - protein, 22 aa, Mycobacterium tuberculosis
AAGNLARLGSMISAANSAAAAQ

SEQ ID NO: 1474008 - protein, 24 aa, Mycobacterium tuberculosis
AAGRAAPRLTVCVPVAVNPGAAAH

SEQ ID NO: 1474009 - protein, 17 aa, Mycobacterium tuberculosis
AAHGLGRPPADVTAEHL

SEQ ID NO: 1474010 - protein, 20 aa, Mycobacterium tuberculosis
AAHRRVWRDREPALASPRRP

SEQ ID NO: 1474011 - protein, 20 aa, Mycobacterium tuberculosis
AALARSRATLVLHLAAAQID

SEQ ID NO: 1474012 - protein, 24 aa, Mycobacterium tuberculosis
AALDYSALYPAGWLVDAPLPAWTH

SEQ ID NO: 1474013 - protein, 19 aa, Mycobacterium tuberculosis
AALEHRGFESLFLAEHTHI

SEQ ID NO: 1474014 - protein, 17 aa, Mycobacterium tuberculosis
AALERRTGELAHELGQA

SEQ ID NO: 1474015 - protein, 23 aa, Mycobacterium tuberculosis
AALKNPEFDATLVTRAFSGRYAR

SEQ ID NO: 1474016 - protein, 24 aa, Mycobacterium tuberculosis
AALRIVLGHELFHYAARADTALDA

SEQ ID NO: 1474017 - protein, 18 aa, Mycobacterium tuberculosis
AALSGRPFIGNGTNGAPG

SEQ ID NO: 1474018 - protein, 26 aa, Mycobacterium tuberculosis
AAMARTCVDAGWLLSLSGTVSFRTAR

SEQ ID NO: 1474019 - protein, 25 aa, Mycobacterium tuberculosis
AANSWLDAFAHWRRAQGLPATSIAW

SEQ ID NO: 1474020 - protein, 17 aa, Mycobacterium tuberculosis
AAPIGRAVIEAALQGEP

SEQ ID NO: 1474021 - protein, 17 aa, Mycobacterium tuberculosis
AAPYVAWMSVTAVRAEQ

SEQ ID NO: 1474022 - protein, 19 aa, Mycobacterium tuberculosis
AARFPGPFIYTVHPSKIVR

SEQ ID NO: 1474023 - protein, 27 aa, Mycobacterium tuberculosis
AASAEAAAFHGRFVQALTTGGGAYAAA

SEQ ID NO: 1474024 - protein, 17 aa, Mycobacterium tuberculosis
AAVEQHLLEVLGASVDV

SEQ ID NO: 1474025 - protein, 25 aa, Mycobacterium tuberculosis
AAWFPSAEHLASWVRLCPGNHESAG

SEQ ID NO: 1474026 - protein, 23 aa, Mycobacterium tuberculosis
AAYQQRFVLALSQAGSTYAVAEA

SEQ ID NO: 1474027 - protein, 17 aa, Mycobacterium tuberculosis
ADAAVRLGPAPARESYL

SEQ ID NO: 1474028 - protein, 22 aa, Mycobacterium tuberculosis
ADARGVRACRGPGAGTRAPAWA

SEQ ID NO: 1474029 - protein, 17 aa, Mycobacterium tuberculosis
ADDRFWLAVGRTRSNAY

SEQ ID NO: 1474030 - protein, 24 aa, Mycobacterium tuberculosis
ADEVSAGIAALFSAHAQEYQALSA

SEQ ID NO: 1474031 - protein, 17 aa, Mycobacterium tuberculosis
ADIAAALAVQCRGGEAF

SEQ ID NO: 1474032 - protein, 17 aa, Mycobacterium tuberculosis
ADISGVYNTGALGLITS

SEQ ID NO: 1474033 - protein, 18 aa, Mycobacterium tuberculosis
ADLARLGREGVLALSTAE

SEQ ID NO: 1474034 - protein, 25 aa, Mycobacterium tuberculosis
ADLTNRSTIRWTLHQMVASGVVSVY

SEQ ID NO: 1474035 - protein, 17 aa, Mycobacterium tuberculosis
ADPSEWHGLAPVSTSDP

SEQ ID NO: 1474036 - protein, 26 aa, Mycobacterium tuberculosis
ADQRADWACDFWDCAAAEVAAALTIS

SEQ ID NO: 1474037 - protein, 17 aa, Mycobacterium tuberculosis
ADRLYERLLGWLADIQQ

SEQ ID NO: 1474038 - protein, 17 aa, Mycobacterium tuberculosis
ADVLLAHLVLRPFLDAY

SEQ ID NO: 1474039 - protein, 20 aa, Mycobacterium tuberculosis
ADVLPLPGGLTVHLPQPPNY

SEQ ID NO: 1474040 - protein, 22 aa, Mycobacterium tuberculosis
ADVTWLDCLGIPTVQAVRPASL

SEQ ID NO: 1474041 - protein, 23 aa, Mycobacterium tuberculosis
AEADLFYSDFVERVAEGRKMTTD

SEQ ID NO: 1474042 - protein, 18 aa, Mycobacterium tuberculosis
AEGVAGAAGEDLSPHGTS

SEQ ID NO: 1474043 - protein, 18 aa, Mycobacterium tuberculosis
AEGVRLFRFDRIVDAAEL

SEQ ID NO: 1474044 - protein, 17 aa, Mycobacterium tuberculosis
AEILVYGHVPFELVSYV

SEQ ID NO: 1474045 - protein, 23 aa, Mycobacterium tuberculosis
AELALRLAEHGLRDERLADILTR

SEQ ID NO: 1474046 - protein, 23 aa, Mycobacterium tuberculosis
AELSVWPPVGARAMDVADGYQVL

SEQ ID NO: 1474047 - protein, 22 aa, Mycobacterium tuberculosis
AEMEMKVLLWAVQRLIGGLSTI

SEQ ID NO: 1474048 - protein, 20 aa, Mycobacterium tuberculosis
AEMWAQDAMAMYGYAGSSAT

SEQ ID NO: 1474049 - protein, 17 aa, Mycobacterium tuberculosis
AENALLRGFPMASAGQS

SEQ ID NO: 1474050 - protein, 21 aa, Mycobacterium tuberculosis
AEPGWTMFMISHFHYDPVWWN

SEQ ID NO: 1474051 - protein, 22 aa, Mycobacterium tuberculosis
AEPITAVSLAWLPAGDYERALD

SEQ ID NO: 1474052 - protein, 18 aa, Mycobacterium tuberculosis
AESFSEVHPLPGRDLMPV

SEQ ID NO: 1474053 - protein, 19 aa, Mycobacterium tuberculosis
AEVAALGRFASAYTESLEN

SEQ ID NO: 1474054 - protein, 26 aa, Mycobacterium tuberculosis
AFAEFLEVRGSLLPDDERLLAEQWLL

SEQ ID NO: 1474055 - protein, 18 aa, Mycobacterium tuberculosis
AFGASRFTGIDFSDEAVA

SEQ ID NO: 1474056 - protein, 20 aa, Mycobacterium tuberculosis
AFKPSYGIAEATLLVATIDH

SEQ ID NO: 1474057 - protein, 19 aa, Mycobacterium tuberculosis
AFRVLRPGGELIFTDPMQA

SEQ ID NO: 1474058 - protein, 17 aa, Mycobacterium tuberculosis
AFTIPGFSIPEQPLPLA

SEQ ID NO: 1474059 - protein, 30 aa, Mycobacterium tuberculosis
AGADEISAAIAALFGAHGRAYQAASAEAAA

SEQ ID NO: 1474060 - protein, 57 aa, Mycobacterium tuberculosis; identical to SEQ ID NO: 233120

SEQ ID NO: 1474061 - protein, 19 aa, Mycobacterium tuberculosis
AGAGLMRAGSLPGEAGSAA

SEQ ID NO: 1474062 - protein, 23 aa, Mycobacterium tuberculosis
AGAGLMRAGSLPGEAGSAARTPL

SEQ ID NO: 1474063 - protein, 30 aa, Mycobacterium tuberculosis
AGDFWGGAGSVACQGFITQLGRNFQVIYEQ

SEQ ID NO: 1474064 - protein, 17 aa, Mycobacterium tuberculosis
AGDRARLAVTIGSRAHA

SEQ ID NO: 1474065 - protein, 19 aa, Mycobacterium tuberculosis
AGFPLGWVHDVVWAPRPIG

SEQ ID NO: 1474066 - protein, 24 aa, Mycobacterium tuberculosis
AGGAGGAGGFGFGGAGGAGGLGGK

SEQ ID NO: 1474067 - protein, 24 aa, Mycobacterium tuberculosis
AGGAGGNGGWLYGNGGPGGAAGLG

SEQ ID NO: 1474068 - protein, 20 aa, Mycobacterium tuberculosis
AGGIAQLFGTGGMGGSGGGI

SEQ ID NO: 1474069 - protein, 19 aa, Mycobacterium tuberculosis
AGGKAGLIGNGGNGGAGGA

SEQ ID NO: 1474070 - protein, 19 aa, Mycobacterium tuberculosis
AGGKAGLYGNGGDGGAGGD

SEQ ID NO: 1474071 - protein, 21 aa, Mycobacterium tuberculosis
AGGNGAHGFNAVLVSDGGNGG

SEQ ID NO: 1474072 - protein, 17 aa, Mycobacterium tuberculosis
AGGNGGWLWGNGGNGGS

SEQ ID NO: 1474073 - protein, 20 aa, Mycobacterium tuberculosis
AGGVGGRPAGNSFASGAAGT

SEQ ID NO: 1474074 - protein, 23 aa, Mycobacterium tuberculosis
AGKAGPAGSILHDGGNGGHGGHG

SEQ ID NO: 1474075 - protein, 18 aa, Mycobacterium tuberculosis
AGKVAALLPGRDPYHPSQ

SEQ ID NO: 1474076 - protein, 17 aa, Mycobacterium tuberculosis
AGLDGYSAADCVALLRE

SEQ ID NO: 1474077 - protein, 17 aa, Mycobacterium tuberculosis
AGLLFGSGGAGGAGGSG

SEQ ID NO: 1474078 - protein, 28 aa, Mycobacterium tuberculosis
AGLRAAGRVAGLIGTIGIRVGGADLPSA

SEQ ID NO: 1474079 - protein, 17 aa, Mycobacterium tuberculosis
AGLTSRHPLAGGSGASA

SEQ ID NO: 1474080 - protein, 24 aa, Mycobacterium tuberculosis
AGPDRIAAMLSEVVGLLAAGVLAR

SEQ ID NO: 1474081 - protein, 27 aa, Mycobacterium tuberculosis
AGPPEHLQWIGQWGIFDALRAGREVVR

SEQ ID NO: 1474082 - protein, 23 aa, Mycobacterium tuberculosis
AGQLGRPIGFRGLAGGCPVSPLG

SEQ ID NO: 1474083 - protein, 24 aa, Mycobacterium tuberculosis
AGRGARFLLGLVVSTGVGGGLVLD

SEQ ID NO: 1474084 - protein, 17 aa, Mycobacterium tuberculosis
AGSNNWGLANLGVGNIG

SEQ ID NO: 1474085 - protein, 17 aa, Mycobacterium tuberculosis
AGTEPRKIFDLLEHAPV

SEQ ID NO: 1474086 - protein, 17 aa, Mycobacterium tuberculosis
AGVDIARVEAAGVGVAG

SEQ ID NO: 1474087 - protein, 17 aa, Mycobacterium tuberculosis
AGVKITWTPIEPTLPSI

SEQ ID NO: 1474088 - protein, 19 aa, Mycobacterium tuberculosis
AGVTYWREAAQLKRNEAND

SEQ ID NO: 1474089 - protein, 17 aa, Mycobacterium tuberculosis
AIGHAYALWLRDTGRVT

SEQ ID NO: 1474090 - protein, 19 aa, Mycobacterium tuberculosis
AIRADFPILKRIMRGGNPL

SEQ ID NO: 1474091 - protein, 23 aa, Mycobacterium tuberculosis
AISAERAAAMVIRGLVEKPARID

SEQ ID NO: 1474092 - protein, 21 aa, Mycobacterium tuberculosis
AKMFNCTGWKIGWACGPAELI

SEQ ID NO: 1474093 - protein, 19 aa, Mycobacterium tuberculosis
AKMLRLAVDEVFQMQSEAR

SEQ ID NO: 1474094 - protein, 25 aa, Mycobacterium tuberculosis
AKTAASRNKHGWVTVGYLDDDGYLF

SEQ ID NO: 1474095 - protein, 19 aa, Mycobacterium tuberculosis
AKVGVFRPITRLSAERDYI

SEQ ID NO: 1474096 - protein, 21 aa, Mycobacterium tuberculosis
ALAPRRTTLPGGLRVVTEFLP

SEQ ID NO: 1474097 - protein, 18 aa, Mycobacterium tuberculosis
ALASRAGDHVDFLAHDRI

SEQ ID NO: 1474098 - protein, 28 aa, Mycobacterium tuberculosis
ALDPPLRLRACLRRRRLAARRHPGAQRA

SEQ ID NO: 1474099 - protein, 17 aa, Mycobacterium tuberculosis
ALERAGIDPTGLRGSAT

SEQ ID NO: 1474100 - protein, 17 aa, Mycobacterium tuberculosis
ALLRRLVEAGTRVVQYG

SEQ ID NO: 1474101 - protein, 22 aa, Mycobacterium tuberculosis
ALMGAFPMRLILATMLVAGRLL

SEQ ID NO: 1474102 - protein, 18 aa, Mycobacterium tuberculosis
ALPDRQRHASLLPLLHNY

SEQ ID NO: 1474103 - protein, 22 aa, Mycobacterium tuberculosis
ALPSRPVQVIGFTSVPGAGDNF

SEQ ID NO: 1474104 - protein, 19 aa, Mycobacterium tuberculosis
ALQAGRIAVPLSVPQGGVT

SEQ ID NO: 1474105 - protein, 23 aa, Mycobacterium tuberculosis
ALRAAAQHWATWAMQKQELARNL

SEQ ID NO: 1474106 - protein, 20 aa, Mycobacterium tuberculosis
ALRPPVFAGTIWVQQGSQPL

SEQ ID NO: 1474107 - protein, 17 aa, Mycobacterium tuberculosis
ALTAPAPHHTRPTRFVW

SEQ ID NO: 1474108 - protein, 26 aa, Mycobacterium tuberculosis
AMGPEGRAAIGLGDGVVRISVGLEDT

SEQ ID NO: 1474109 - protein, 40 aa, Mycobacterium tuberculosis
AMPNRLVRSLQRWRPFGLPPHRWRLAPWYWRGLQVTLEPG

SEQ ID NO: 1474110 - protein, 17 aa, Mycobacterium tuberculosis
ANAQWGNNVAILAGDYL

SEQ ID NO: 1474111 - protein, 26 aa, Mycobacterium tuberculosis
ANGGAGGNGGWLYGNGGLGGNGGAAT

SEQ ID NO: 1474112 - protein, 17 aa, Mycobacterium tuberculosis
ANLGRAASVGSLSVPQA

SEQ ID NO: 1474113 - protein, 32 aa, Mycobacterium tuberculosis
ANLNFFPMGAWAKRTGAIFIRRQTKDIPVYRF

SEQ ID NO: 1474114 - protein, 25 aa, Mycobacterium tuberculosis
ANRRRFPVEIIRRSRAAVGCDFIIC

SEQ ID NO: 1474115 - protein, 27 aa, Mycobacterium tuberculosis
APDAGPPQRWFVVWLGTANNPVDKGAA

SEQ ID NO: 1474116 - protein, 18 aa, Mycobacterium tuberculosis
APDGIRMLVEAARRIDEA

SEQ ID NO: 1474117 - protein, 18 aa, Mycobacterium tuberculosis
APDRRKVLEEAFRVLRPG

SEQ ID NO: 1474118 - protein, 18 aa, Mycobacterium tuberculosis
APEVSGWLDGLRAAKRAL

SEQ ID NO: 1474119 - protein, 25 aa, Mycobacterium tuberculosis
APGQPGGAGGLLFGNGGNGAAGAVG

SEQ ID NO: 1474120 - protein, 21 aa, Mycobacterium tuberculosis
APGSDALALGQPGGNGGQGDA

SEQ ID NO: 1474121 - protein, 19 aa, Mycobacterium tuberculosis
APGSFSWHVLTALADDVQT

SEQ ID NO: 1474122 - protein, 24 aa, Mycobacterium tuberculosis
APIPGRLFAGPGLSQPSDVLPADD

SEQ ID NO: 1474123 - protein, 22 aa, Mycobacterium tuberculosis
APKAGDTTRSWYVIDATDVVLG

SEQ ID NO: 1474124 - protein, 18 aa, Mycobacterium tuberculosis
APLGYRPARSTAVMSTMS

SEQ ID NO: 1474125 - protein, 24 aa, Mycobacterium tuberculosis
APPGNSLRDIAFRTLDVCVRDGLM

SEQ ID NO: 1474126 - protein, 24 aa, Mycobacterium tuberculosis
APRFHPSYRHAAAVRREIGVPTVF

SEQ ID NO: 1474127 - protein, 18 aa, Mycobacterium tuberculosis
APRTTVGVVEYVRRRKNG

SEQ ID NO: 1474128 - protein, 23 aa, Mycobacterium tuberculosis
APSEILPFTVLLSSLGVTHLTPE

SEQ ID NO: 1474129 - protein, 19 aa, Mycobacterium tuberculosis
APTHFLGALFALRSGTATL

SEQ ID NO: 1474130 - protein, 23 aa, Mycobacterium tuberculosis
APVRFFNPIAMRFAQKATREDID

SEQ ID NO: 1474131 - protein, 29 aa, Mycobacterium tuberculosis
AQCLRGMAARNRLDIVAALQNFRTAFEVG

SEQ ID NO: 1474132 - protein, 27 aa, Mycobacterium tuberculosis
AQCVKAEMLAASSWRVAVNAGADSTGR

SEQ ID NO: 1474133 - protein, 31 aa, Mycobacterium tuberculosis; identical to SEQ ID NO: 210564

SEQ ID NO: 1474134 - protein, 17 aa, Mycobacterium tuberculosis
AQIAHEFTYGRWDCDLA

SEQ ID NO: 1474135 - protein, 17 aa, Mycobacterium tuberculosis
AQLWPPHVPAMLVAGCD

SEQ ID NO: 1474136 - protein, 24 aa, Mycobacterium tuberculosis
AQPLEWFCLFSSAAALVGSPGQGA

SEQ ID NO: 1474137 - protein, 32 aa, Mycobacterium tuberculosis
AQQYDAVWRWIDWPERRGRTGTGIDLVARERD

SEQ ID NO: 1474138 - protein, 21 aa, Mycobacterium tuberculosis
AQQYRLGRLILLAQAGALLDR

SEQ ID NO: 1474139 - protein, 19 aa, Mycobacterium tuberculosis
AQRPELWNLYNGRHHKGEH

SEQ ID NO: 1474140 - protein, 20 aa, Mycobacterium tuberculosis
AQRRLPLLIASGADVHVIAP

SEQ ID NO: 1474141 - protein, 18 aa, Mycobacterium tuberculosis
AQRRTVEGLNRVEAAHDN

SEQ ID NO: 1474142 - protein, 18 aa, Mycobacterium tuberculosis
AQYGEMWAQDIVAMEGYA

SEQ ID NO: 1474143 - protein, 23 aa, Mycobacterium tuberculosis
ARAFQTLLRYGRAYSGYAPIMGT

SEQ ID NO: 1474144 - protein, 19 aa, Mycobacterium tuberculosis
ARATFEAVLAKLAAPGATN

SEQ ID NO: 1474145 - protein, 18 aa, Mycobacterium tuberculosis
ARFRSHPDLEVLTHGLTL

SEQ ID NO: 1474146 - protein, 18 aa, Mycobacterium tuberculosis
ARGRGGGRIPEPRRRRNV

SEQ ID NO: 1474147 - protein, 24 aa, Mycobacterium tuberculosis
ARIAGRPAAVLLHLGPGLGNGLAN

SEQ ID NO: 1474148 - protein, 17 aa, Mycobacterium tuberculosis
ARIFAGAGLGPMLAAAS

SEQ ID NO: 1474149 - protein, 21 aa, Mycobacterium tuberculosis
ARPDTAPALALAARSSASFPL

SEQ ID NO: 1474150 - protein, 21 aa, Mycobacterium tuberculosis
ARPSVTAGGVGGRPAGNSFAS

SEQ ID NO: 1474151 - protein, 19 aa, Mycobacterium tuberculosis
ARPVPAGDTMVFFGGIEPV

SEQ ID NO: 1474152 - protein, 21 aa, Mycobacterium tuberculosis
ARRILGWRVASTMATSMVLDA

SEQ ID NO: 1474153 - protein, 23 aa, Mycobacterium tuberculosis
ARRVGGTDVAVWLGTLSTLSRTA

SEQ ID NO: 1474154 - protein, 23 aa, Mycobacterium tuberculosis
ARRVRARAAAAIEHGIELMLAER

SEQ ID NO: 1474155 - protein, 20 aa, Mycobacterium tuberculosis
ARSIGCSWCVDFGAMLQRLD

SEQ ID NO: 1474156 - protein, 27 aa, Mycobacterium tuberculosis
ARSSTEHSRHCYFFRTRRYRPLHRPSD

SEQ ID NO: 1474157 - protein, 27 aa, Mycobacterium tuberculosis
ARVPGMIRLVRHSIALVAAGLAAALSG

SEQ ID NO: 1474158 - protein, 18 aa, Mycobacterium tuberculosis
ARVSALSRRRRGPETTAV

SEQ ID NO: 1474159 - protein, 18 aa, Mycobacterium tuberculosis
ARYLFVFLDHHGMLSVFG

SEQ ID NO: 1474160 - protein, 27 aa, Mycobacterium tuberculosis
ASGGKGGTGGWLWGSGGAGGAGGSGGG

SEQ ID NO: 1474161 - protein, 23 aa, Mycobacterium tuberculosis
ASGGRHSVRFAYDSAIVSLIKST

SEQ ID NO: 1474162 - protein, 25 aa, Mycobacterium tuberculosis
ASGVRLAIVASSWHGKICDALLDGA

SEQ ID NO: 1474163 - protein, 23 aa, Mycobacterium tuberculosis
ASIDPEWSRPPGSITDDHVFDAP

SEQ ID NO: 1474164 - protein, 20 aa, Mycobacterium tuberculosis
ASPPRPPLPPNPAKPSLETP

SEQ ID NO: 1474165 - protein, 17 aa, Mycobacterium tuberculosis
ASQWRRLGGTFPTNSQL

SEQ ID NO: 1474166 - protein, 27 aa, Mycobacterium tuberculosis
ASRGADSWLIRRCSVVQGCLDDPGATV

SEQ ID NO: 1474167 - protein, 17 aa, Mycobacterium tuberculosis
ASRGMGGDGGTGGAGGN

SEQ ID NO: 1474168 - protein, 18 aa, Mycobacterium tuberculosis
ASVSSMQALLDAVNAPTQ

SEQ ID NO: 1474169 - protein, 20 aa, Mycobacterium tuberculosis
ATAVLRPHLSLVPEAPAPFE

SEQ ID NO: 1474170 - protein, 20 aa, Mycobacterium tuberculosis
ATDVSKGIVVAAALAGDGNV

SEQ ID NO: 1474171 - protein, 20 aa, Mycobacterium tuberculosis
ATENYLRWVSDVDRSAPRPN

SEQ ID NO: 1474172 - protein, 18 aa, Mycobacterium tuberculosis
ATFHAQFVQTLSAGAGAY

SEQ ID NO: 1474173 - protein, 17 aa, Mycobacterium tuberculosis
ATKWAELGLSRLLVDAG

SEQ ID NO: 1474174 - protein, 17 aa, Mycobacterium tuberculosis
ATLRCRRLGAVLHAAAD

SEQ ID NO: 1474175 - protein, 26 aa, Mycobacterium tuberculosis
ATLSLVKFACAWTYIALDPAVVQSVP

SEQ ID NO: 1474176 - protein, 18 aa, Mycobacterium tuberculosis
ATNAAPLATLEHNVLNAL

SEQ ID NO: 1474177 - protein, 17 aa, Mycobacterium tuberculosis
ATQRPVHLITCLAEPDP

SEQ ID NO: 1474178 - protein, 17 aa, Mycobacterium tuberculosis
ATVHPMLVAANRNAFVQ

SEQ ID NO: 1474179 - protein, 23 aa, Mycobacterium tuberculosis
AVAEFPGFAFFEIQLRLPVNGRW

SEQ ID NO: 1474180 - protein, 19 aa, Mycobacterium tuberculosis
AVAGRRCGGLVRAVNDLTE

SEQ ID NO: 1474181 - protein, 18 aa, Mycobacterium tuberculosis
AVCDGRRLVTLDGPEIGA

SEQ ID NO: 1474182 - protein, 18 aa, Mycobacterium tuberculosis
AVCELMRIAWRTVGAIVA

SEQ ID NO: 1474183 - protein, 29 aa, Mycobacterium tuberculosis
AVERLCRRLADQAVRQWGFMQGLKQKLGP

SEQ ID NO: 1474184 - protein, 25 aa, Mycobacterium tuberculosis
AVGGKGGTGGLLFGNGGAGGQGGLG

SEQ ID NO: 1474185 - protein, 24 aa, Mycobacterium tuberculosis
AVGGVGGNGGWLYGNGGAGGLGGT

SEQ ID NO: 1474186 - protein, 17 aa, Mycobacterium tuberculosis
AVGSPITTAIAFAESTT

SEQ ID NO: 1474187 - protein, 17 aa, Mycobacterium tuberculosis
AVMAAVFAENGAIDVFS

SEQ ID NO: 1474188 - protein, 18 aa, Mycobacterium tuberculosis
AVPFRLSIDDGIEAVRQR

SEQ ID NO: 1474189 - protein, 22 aa, Mycobacterium tuberculosis
AVTIPGFAINPFGLDVPLSGGT

SEQ ID NO: 1474190 - protein, 18 aa, Mycobacterium tuberculosis
AVTVPELGTFLAECPPMA

SEQ ID NO: 1474191 - protein, 17 aa, Mycobacterium tuberculosis
AVWTACVDDPAAFTEPV

SEQ ID NO: 1474192 - protein, 25 aa, Mycobacterium tuberculosis
AWHKICVERAILPGMQELVRRIGDD

SEQ ID NO: 1474193 - protein, 17 aa, Mycobacterium tuberculosis
AWHTSWHNPNRAFEDDV

SEQ ID NO: 1474194 - protein, 23 aa, Mycobacterium tuberculosis
AWKAPAVTTVRAFDATPMTTLPG

SEQ ID NO: 1474195 - protein, 25 aa, Mycobacterium tuberculosis
AWTSTWRRWCILANAATSSTTCAPR

SEQ ID NO: 1474196 - protein, 18 aa, Mycobacterium tuberculosis
AYATRAGITCAVLIPQGK

SEQ ID NO: 1474197 - protein, 25 aa, Mycobacterium tuberculosis
AYSEPRLQPPNGYKDTTVPGIWVPD

SEQ ID NO: 1474198 - protein, 32 aa, Mycobacterium tuberculosis
CAARIVGGRCLMPASSAARCAARIVGGPRLYG

SEQ ID NO: 1474199 - protein, 23 aa, Mycobacterium tuberculosis
CAEAFAEFVDWSLVDVLRGAPGA

SEQ ID NO: 1474200 - protein, 17 aa, Mycobacterium tuberculosis
CAERLPGAVLAIGNAPT

SEQ ID NO: 1474201 - protein, 17 aa, Mycobacterium tuberculosis
CCRVRPIDIAEIGRALT

SEQ ID NO: 1474202 - protein, 19 aa, Mycobacterium tuberculosis
CDAPGWFLYLTDIPRAGVE

SEQ ID NO: 1474203 - protein, 17 aa, Mycobacterium tuberculosis
CDLQRPAAVNQLQVVGE

SEQ ID NO: 1474204 - protein, 18 aa, Mycobacterium tuberculosis
CEHFFRKGISNVGQFTLT

SEQ ID NO: 1474205 - protein, 25 aa, Mycobacterium tuberculosis
CEIHYTCACCCLPPNLRRPLRRTAR

SEQ ID NO: 1474206 - protein, 21 aa, Mycobacterium tuberculosis
CKSCEQRDNLSIKFVAHEGEV

SEQ ID NO: 1474207 - protein, 20 aa, Mycobacterium tuberculosis
CLATPALFFAVGQGYRNFTQ

SEQ ID NO: 1474208 - protein, 20 aa, Mycobacterium tuberculosis
CMDNGMPILVFNLLTDGNIA

SEQ ID NO: 1474209 - protein, 17 aa, Mycobacterium tuberculosis
CQAGHRVLFATAAEWVA

SEQ ID NO: 1474210 - protein, 20 aa, Mycobacterium tuberculosis
CQLLRLGGRWLSVVCCRNGS

SEQ ID NO: 1474211 - protein, 18 aa, Mycobacterium tuberculosis
CQYDPLMSPLVWDLAHIG

SEQ ID NO: 1474212 - protein, 17 aa, Mycobacterium tuberculosis
CRARVSLATFGGNAHQG

SEQ ID NO: 1474213 - protein, 26 aa, Mycobacterium tuberculosis
CREGHCGACACTLRAGKVNIGVNDVL

SEQ ID NO: 1474214 - protein, 20 aa, Mycobacterium tuberculosis
CSCPARPERSSLVSAEEQDT

SEQ ID NO: 1474215 - protein, 23 aa, Mycobacterium tuberculosis
CSSGLTAIHLACRSLHDGESDIA

SEQ ID NO: 1474216 - protein, 21 aa, Mycobacterium tuberculosis
CSVSNRPAIYVATYFGDPGAA

SEQ ID NO: 1474217 - protein, 19 aa, Mycobacterium tuberculosis
CTSIGSAARPRAVNHPSIE

SEQ ID NO: 1474218 - protein, 23 aa, Mycobacterium tuberculosis
CVSCPIRRQCLAAALQRAEPWAF

SEQ ID NO: 1474219 - protein, 18 aa, Mycobacterium tuberculosis
DAARGRMGAVRFGIYQAG

SEQ ID NO: 1474220 - protein, 18 aa, Mycobacterium tuberculosis
DAATRAGFEAGFEADPVL

SEQ ID NO: 1474221 - protein, 26 aa, Mycobacterium tuberculosis
DAAVSWAERRRMFELPRSSWSDYDRS

SEQ ID NO: 1474222 - protein, 24 aa, Mycobacterium tuberculosis
DAEGCAYLLVSVALRRLWFHGTKA

SEQ ID NO: 1474223 - protein, 18 aa, Mycobacterium tuberculosis
DAGDCAVLARALVACGCG

SEQ ID NO: 1474224 - protein, 18 aa, Mycobacterium tuberculosis
DAHILVLCGPIWLGDNSS

SEQ ID NO: 1474225 - protein, 18 aa, Mycobacterium tuberculosis
DALRCFASLFGDEALDPL

SEQ ID NO: 1474226 - protein, 18 aa, Mycobacterium tuberculosis
DALVAHLPADRWADPTPA

SEQ ID NO: 1474227 - protein, 22 aa, Mycobacterium tuberculosis
DARTYLADHGWRTASASTTDLL

SEQ ID NO: 1474228 - protein, 22 aa, Mycobacterium tuberculosis
DASLRLLPRGGRFIEMGKTEFG

SEQ ID NO: 1474229 - protein, 18 aa, Mycobacterium tuberculosis
DAVARMAEFGRHVEELVA

SEQ ID NO: 1474230 - protein, 20 aa, Mycobacterium tuberculosis
DCRRIRGVPVFDGYTRMVAR

SEQ ID NO: 1474231 - protein, 22 aa, Mycobacterium tuberculosis
DEIAGIGAGVTWAADNHCLLHH

SEQ ID NO: 1474232 - protein, 22 aa, Mycobacterium tuberculosis
DEIARRAGVGAGTVYRHFPTKE

SEQ ID NO: 1474233 - protein, 17 aa, Mycobacterium tuberculosis
DELARYAQRVMDWLHPD

SEQ ID NO: 1474234 - protein, 21 aa, Mycobacterium tuberculosis
DELCDRVAFVVDGRIVALDSP

SEQ ID NO: 1474235 - protein, 22 aa, Mycobacterium tuberculosis
DELRPRMRVVNEFQRRYPDIKV

SEQ ID NO: 1474236 - protein, 22 aa, Mycobacterium tuberculosis
DEVSAAVAALFGSYAQSYQAFG

SEQ ID NO: 1474237 - protein, 29 aa, Mycobacterium tuberculosis
DEVSAAVSRLFGAYGQQFQALNARAATFH

SEQ ID NO: 1474238 - protein, 25 aa, Mycobacterium tuberculosis
DEYVKGLAELGCFGLKIPSEYGGLN

SEQ ID NO: 1474239 - protein, 23 aa, Mycobacterium tuberculosis
DGENCRRCGAVIRRERFMNRSSF

SEQ ID NO: 1474240 - protein, 24 aa, Mycobacterium tuberculosis
DGGTGGRGGWLAGAGGAGGAGGVG

SEQ ID NO: 1474241 - protein, 19 aa, Mycobacterium tuberculosis
DGGYGGWGGAGGNGGAGGS

SEQ ID NO: 1474242 - protein, 34 aa, Mycobacterium tuberculosis
DGLVRRSRVHWVRARVVQLERGWVLRDETGGRWQ

SEQ ID NO: 1474243 - protein, 17 aa, Mycobacterium tuberculosis
DGVIPPNRSLDCVDDEL

SEQ ID NO: 1474244 - protein, 19 aa, Mycobacterium tuberculosis
DHVLQHWTVDISIDEHEGL

SEQ ID NO: 1474245 - protein, 26 aa, Mycobacterium tuberculosis
DIAPRKTRCCVHVAKPNRIRLADQLA

SEQ ID NO: 1474246 - protein, 25 aa, Mycobacterium tuberculosis
DIPGFADSLLRVWQAKKRTSTRISN

SEQ ID NO: 1474247 - protein, 25 aa, Mycobacterium tuberculosis
DIPSWMARMGFQMMDPLKTAKARVD

SEQ ID NO: 1474248 - protein, 26 aa, Mycobacterium tuberculosis
DIYGDTRLGLFPFRRNLSLYAVDLAL

SEQ ID NO: 1474249 - protein, 20 aa, Mycobacterium tuberculosis
DKRTEMRAPLSASGDAVPAE

SEQ ID NO: 1474250 - protein, 23 aa, Mycobacterium tuberculosis
DLASRACVVINHIMPGEPNVAVK

SEQ ID NO: 1474251 - protein, 18 aa, Mycobacterium tuberculosis
DLASSVGLTATMVAAARA

SEQ ID NO: 1474252 - protein, 17 aa, Mycobacterium tuberculosis
DLAYFRVLIHSTRNRAL

SEQ ID NO: 1474253 - protein, 23 aa, Mycobacterium tuberculosis
DLDKPKLVFFFDEAHLLFTDASK

SEQ ID NO: 1474254 - protein, 26 aa, Mycobacterium tuberculosis
DLTDLLWRMGIRTIGQFAALSRTDVA

SEQ ID NO: 1474255 - protein, 17 aa, Mycobacterium tuberculosis
DLYSCFPSAVQVAAIEL

SEQ ID NO: 1474256 - protein, 29 aa, Mycobacterium tuberculosis
DMNNGVFYRGVGQGSLQFSITTPDLTLPP

SEQ ID NO: 1474257 - protein, 37 aa, Mycobacterium tuberculosis; identical to SEQ ID NO: 197967

SEQ ID NO: 1474258 - protein, 23 aa, Mycobacterium tuberculosis
DPDRPLPEYGLDSLGALELRTRI

SEQ ID NO: 1474259 - protein, 26 aa, Mycobacterium tuberculosis
DPGAKSARPATVWIAQDGSHHLVRAS

SEQ ID NO: 1474260 - protein, 22 aa, Mycobacterium tuberculosis
DPGLGARLFQVGSRGGDGGVGG

SEQ ID NO: 1474261 - protein, 24 aa, Mycobacterium tuberculosis
DPHAWLGDAFHAWVQQFYGAELLF

SEQ ID NO: 1474262 - protein, 22 aa, Mycobacterium tuberculosis
DPLELAAKLHAVYPALGRTPLV

SEQ ID NO: 1474263 - protein, 19 aa, Mycobacterium tuberculosis
DPMQWRVLERAFSRHSALI

SEQ ID NO: 1474264 - protein, 24 aa, Mycobacterium tuberculosis
DPQQRLLLEVAWEALEHAGIPPGT

SEQ ID NO: 1474265 - protein, 17 aa, Mycobacterium tuberculosis
DPSRDALTFARRRGVLV

SEQ ID NO: 1474266 - protein, 26 aa, Mycobacterium tuberculosis
DQFVHTLTAAARWYTATEIANAAAMR

SEQ ID NO: 1474267 - protein, 24 aa, Mycobacterium tuberculosis
DQRLLVKVPAGWSHTAAATTSVVF

SEQ ID NO: 1474268 - protein, 23 aa, Mycobacterium tuberculosis
DRAEPTTRWWVLTVNVGGDSGPS

SEQ ID NO: 1474269 - protein, 24 aa, Mycobacterium tuberculosis
DRDWSPKVFGSWNLHRATLGQPLD

SEQ ID NO: 1474270 - protein, 24 aa, Mycobacterium tuberculosis
DRPSWLSSSAWPWQPYLLSHHQGG

SEQ ID NO: 1474271 - protein, 21 aa, Mycobacterium tuberculosis
DRQLARFALRGDRTMFLFVFR

SEQ ID NO: 1474272 - protein, 27 aa, Mycobacterium tuberculosis
DRRRQRGRCGLDNGVADRRRRRSVGGD

SEQ ID NO: 1474273 - protein, 21 aa, Mycobacterium tuberculosis
DRTCVVPGCGATRGLHAHHIR

SEQ ID NO: 1474274 - protein, 18 aa, Mycobacterium tuberculosis
DSAEAVGGAGGKGGDGGV

SEQ ID NO: 1474275 - protein, 19 aa, Mycobacterium tuberculosis
DSHLLLLWGAANRDPAQFE

SEQ ID NO: 1474276 - protein, 17 aa, Mycobacterium tuberculosis
DSLFFAAEQLRLMYNSA

SEQ ID NO: 1474277 - protein, 18 aa, Mycobacterium tuberculosis
DSPELLWKALLRGDDLIT

SEQ ID NO: 1474278 - protein, 52 aa, Mycobacterium tuberculosis
DSPGAEASWVVGITWWSAVVGGFQMSFVIAVPETIAAAATDLADLGSTIAGA

SEQ ID NO: 1474279 - protein, 17 aa, Mycobacterium tuberculosis
DSPLARALAKLGVAADD

SEQ ID NO: 1474280 - protein, 26 aa, Mycobacterium tuberculosis
DSRAYRLRWPAGTIVFEVDQPQVIDF

SEQ ID NO: 1474281 - protein, 19 aa, Mycobacterium tuberculosis
DTFLAMSICDPHGGMHSLW

SEQ ID NO: 1474282 - protein, 18 aa, Mycobacterium tuberculosis
DVAEGPVYVRKQIVHNTV

SEQ ID NO: 1474283 - protein, 21 aa, Mycobacterium tuberculosis
DVAGPQFLLSLIVSSAVCGTS

SEQ ID NO: 1474284 - protein, 17 aa, Mycobacterium tuberculosis
DVDTPWRKLPAKARKAI

SEQ ID NO: 1474285 - protein, 28 aa, Mycobacterium tuberculosis
DVLLKVRLRQGLPLARLGAAERERAEAV

SEQ ID NO: 1474286 - protein, 18 aa, Mycobacterium tuberculosis
DVMMPGMDGFGVLRRLRA

SEQ ID NO: 1474287 - protein, 17 aa, Mycobacterium tuberculosis
DVRRWWRSDSLWQAHDA

SEQ ID NO: 1474288 - protein, 26 aa, Mycobacterium tuberculosis
DVSKRALAGLPYRAAEIGLLVLATST

SEQ ID NO: 1474289 - protein, 19 aa, Mycobacterium tuberculosis
DWAKYALKAPVMMVRSPDT

SEQ ID NO: 1474290 - protein, 24 aa, Mycobacterium tuberculosis
DYFKRGAIELAWALLTNSLAAGGY

SEQ ID NO: 1474291 - protein, 22 aa, Mycobacterium tuberculosis
EAIKELFSMSATRYYQVLNALV

SEQ ID NO: 1474292 - protein, 20 aa, Mycobacterium tuberculosis
EALAAVATDLAGIGSTIGTA

SEQ ID NO: 1474293 - protein, 19 aa, Mycobacterium tuberculosis
EALEHAGIDPLSLRGSATG

SEQ ID NO: 1474294 - protein, 19 aa, Mycobacterium tuberculosis
EALFTLGDRPEARWRQARE

SEQ ID NO: 1474295 - protein, 19 aa, Mycobacterium tuberculosis
EALTGRPLIGNGDSGTPGT

SEQ ID NO: 1474296 - protein, 21 aa, Mycobacterium tuberculosis
EASWLPASLLTPAMLGAHYRL

SEQ ID NO: 1474297 - protein, 20 aa, Mycobacterium tuberculosis
EAVDNRLGRRVAVKVLKSEF

SEQ ID NO: 1474298 - protein, 20 aa, Mycobacterium tuberculosis
ECLRAGVPATALYVALGTEA

SEQ ID NO: 1474299 - protein, 29 aa, Mycobacterium tuberculosis
ECQEVLKQAAAFHGEFTRALAAAGAAYAQ

SEQ ID NO: 1474300 - protein, 20 aa, Mycobacterium tuberculosis
EFLSAAATDLANLGSTISAA

SEQ ID NO: 1474301 - protein, 20 aa, Mycobacterium tuberculosis
EFPADRGWDVAGLFDPDPDA

SEQ ID NO: 1474302 - protein, 17 aa, Mycobacterium tuberculosis
EFTFGWDELLSKVIEEK

SEQ ID NO: 1474303 - protein, 22 aa, Mycobacterium tuberculosis
EFTYPLKWGWLDVDEVVDVLRA

SEQ ID NO: 1474304 - protein, 17 aa, Mycobacterium tuberculosis
EGFHVNPAFVLFGQTAM

SEQ ID NO: 1474305 - protein, 17 aa, Mycobacterium tuberculosis
EGFTDAYRDLAFPGGIR

SEQ ID NO: 1474306 - protein, 23 aa, Mycobacterium tuberculosis
EGGAIYQRWQALGGMNSALGAPT

SEQ ID NO: 1474307 - protein, 19 aa, Mycobacterium tuberculosis
EGLAAVLRGAADQARAAVV

SEQ ID NO: 1474308 - protein, 17 aa, Mycobacterium tuberculosis
EGLARLAGQVETMRARV

SEQ ID NO: 1474309 - protein, 17 aa, Mycobacterium tuberculosis
EIACGRADSVISELEEL

SEQ ID NO: 1474310 - protein, 23 aa, Mycobacterium tuberculosis
EIAESPIDWDIAWPADDLQVNLT

SEQ ID NO: 1474311 - protein, 23 aa, Mycobacterium tuberculosis
EIDNWRWAGVPIFVRAGKELPAK

SEQ ID NO: 1474312 - protein, 17 aa, Mycobacterium tuberculosis
EIFGDLKQRVAALDAAG

SEQ ID NO: 1474313 - protein, 32 aa, Mycobacterium tuberculosis
EIGDAFLSRSCRWALAAANLWQGNLEAAVGLS

SEQ ID NO: 1474314 - protein, 24 aa, Mycobacterium tuberculosis
EINSGRMFFGAGSGPMLAAAAAWD

SEQ ID NO: 1474315 - protein, 25 aa, Mycobacterium tuberculosis
EKHDLAFGTSRWSSKLVHGGLRYLA

SEQ ID NO: 1474316 - protein, 19 aa, Mycobacterium tuberculosis
EKLVRARLRREVLIDDGTD

SEQ ID NO: 1474317 - protein, 20 aa, Mycobacterium tuberculosis
EKPSLPAHIGMTLRSRGFTD

SEQ ID NO: 1474318 - protein, 27 aa, Mycobacterium tuberculosis
ELGYKGLLAPLTFICVFGYKAQAAFFK

SEQ ID NO: 1474319 - protein, 26 aa, Mycobacterium tuberculosis
ELKCAIADGCGDVPALKSCTAAGTSC

SEQ ID NO: 1474320 - protein, 24 aa, Mycobacterium tuberculosis
ELLAHCYRMTGSLHDAEDLVQETL

SEQ ID NO: 1474321 - protein, 17 aa, Mycobacterium tuberculosis
ELLRSRVFFDWFDAMGV

SEQ ID NO: 1474322 - protein, 20 aa, Mycobacterium tuberculosis
ELMRAGTALTDIARMYGDTD

SEQ ID NO: 1474323 - protein, 21 aa, Mycobacterium tuberculosis
ELNGGSLIGLEWAEIVRGQIA

SEQ ID NO: 1474324 - protein, 17 aa, Mycobacterium tuberculosis
ELPECLNALSADPSPAA

SEQ ID NO: 1474325 - protein, 21 aa, Mycobacterium tuberculosis
ELRIGLATAEDIRQWSYGEVK

SEQ ID NO: 1474326 - protein, 17 aa, Mycobacterium tuberculosis
ELRNRLTAVTAVTLPAT

SEQ ID NO: 1474327 - protein, 17 aa, Mycobacterium tuberculosis
ELTGLALQRIYLDRVAK

SEQ ID NO: 1474328 - protein, 26 aa, Mycobacterium tuberculosis
ELTNRLRLGTAPFALGNARRALVESL

SEQ ID NO: 1474329 - protein, 20 aa, Mycobacterium tuberculosis
EMIAAAAGELASIRSAINAA

SEQ ID NO: 1474330 - protein, 26 aa, Mycobacterium tuberculosis
ENNRGRAGYRLLYSVRQYALEKLSES

SEQ ID NO: 1474331 - protein, 29 aa, Mycobacterium tuberculosis
ENVPISPIWLCPLRLRDHAGWPLYPIRPD

SEQ ID NO: 1474332 - protein, 17 aa, Mycobacterium tuberculosis
EPAPALLWIHAGGYVMG

SEQ ID NO: 1474333 - protein, 23 aa, Mycobacterium tuberculosis
EPGGPGQPGTEFGQTGGTGGTGG

SEQ ID NO: 1474334 - protein, 24 aa, Mycobacterium tuberculosis
EPGKRPRSSMAPTLVFDHSSAGRG

SEQ ID NO: 1474335 - protein, 28 aa, Mycobacterium tuberculosis
EPGVPGRTDCKWGAYLDNVGDFDPEFFG

SEQ ID NO: 1474336 - protein, 22 aa, Mycobacterium tuberculosis
EPHITGPRIKQPHIPATGIETT

SEQ ID NO: 1474337 - protein, 20 aa, Mycobacterium tuberculosis
EPPMRRAVAFAKDIKTSKQV

SEQ ID NO: 1474338 - protein, 21 aa, Mycobacterium tuberculosis
EPRRFGVGAAEFHHRAATRAR

SEQ ID NO: 1474339 - protein, 19 aa, Mycobacterium tuberculosis
EQAPHDWRVDRKLLAWERP

SEQ ID NO: 1474340 - protein, 18 aa, Mycobacterium tuberculosis
ERMCARIAAVMGYTDQST

SEQ ID NO: 1474341 - protein, 19 aa, Mycobacterium tuberculosis
ERMCARIAAVMGYTDQSTV

SEQ ID NO: 1474342 - protein, 20 aa, Mycobacterium tuberculosis
ERYRTKMIWWDRRTLANHAE

SEQ ID NO: 1474343 - protein, 25 aa, Mycobacterium tuberculosis
ESAELCAQYLAPVLDAIKFNYFPFG

SEQ ID NO: 1474344 - protein, 21 aa, Mycobacterium tuberculosis
ESIASMAAFAWLNSHGEGGSV

SEQ ID NO: 1474345 - protein, 20 aa, Mycobacterium tuberculosis
ESLAELMGGPDIAPPSSGLQ

SEQ ID NO: 1474346 - protein, 20 aa, Mycobacterium tuberculosis
ESMKMEIPVLAEAAGTVSKV

SEQ ID NO: 1474347 - protein, 26 aa, Mycobacterium tuberculosis
ESPDGMTPPVRWRSGRRVHFDLDPLL

SEQ ID NO: 1474348 - protein, 22 aa, Mycobacterium tuberculosis
ETAGLWGKRADMIVRGCLPYNA

SEQ ID NO: 1474349 - protein, 23 aa, Mycobacterium tuberculosis
ETAWKVAKQYFKLTGKPGKQKVI

SEQ ID NO: 1474350 - protein, 19 aa, Mycobacterium tuberculosis
ETPVAVVAFASWPQQRTLR

SEQ ID NO: 1474351 - protein, 19 aa, Mycobacterium tuberculosis
ETVAAAASDVARIGSSIGV

SEQ ID NO: 1474352 - protein, 24 aa, Mycobacterium tuberculosis
ETVNRCPVYMPFDDVDIALNLGDA

SEQ ID NO: 1474353 - protein, 24 aa, Mycobacterium tuberculosis
ETWERLWPELGLLALPQSPRGTPV

SEQ ID NO: 1474354 - protein, 19 aa, Mycobacterium tuberculosis
EVMAAAATDLANIGSSISA

SEQ ID NO: 1474355 - protein, 34 aa, Mycobacterium tuberculosis; identical to SEQ ID NO: 96427

SEQ ID NO: 1474356 - protein, 19 aa, Mycobacterium tuberculosis
EVRDIRFEQMLLLDDETPI

SEQ ID NO: 1474357 - protein, 23 aa, Mycobacterium tuberculosis
EYAEMWAQDAAVMYSYEGASAAA

SEQ ID NO: 1474358 - protein, 19 aa, Mycobacterium tuberculosis
EYLQLAARVSAPAPAERPA

SEQ ID NO: 1474359 - protein, 29 aa, Mycobacterium tuberculosis
EYLSGRWAQAYGFPLMPIDGILVGTAAMA

SEQ ID NO: 1474360 - protein, 20 aa, Mycobacterium tuberculosis
FAASHLRDGAVLLDVSRIDH

SEQ ID NO: 1474361 - protein, 19 aa, Mycobacterium tuberculosis
FAAVRAELAKRGWVPSPQT

SEQ ID NO: 1474362 - protein, 22 aa, Mycobacterium tuberculosis
FADVRRELAIRAAVEAATVTDS

SEQ ID NO: 1474363 - protein, 17 aa, Mycobacterium tuberculosis
FAELSVRAISLRAGVAR

SEQ ID NO: 1474364 - protein, 25 aa, Mycobacterium tuberculosis
FAERGFRRARTWLGATAEAIEACEC

SEQ ID NO: 1474365 - protein, 21 aa, Mycobacterium tuberculosis
FAIELGRLGGLGVLNGEGLIG

SEQ ID NO: 1474366 - protein, 18 aa, Mycobacterium tuberculosis
FASTAWTSTWRRWCILAN

SEQ ID NO: 1474367 - protein, 23 aa, Mycobacterium tuberculosis
FATELRNLLARCAERGLDPLELQ

SEQ ID NO: 1474368 - protein, 20 aa, Mycobacterium tuberculosis
FAVGPDRLARFVLVVLTQAE

SEQ ID NO: 1474369 - protein, 24 aa, Mycobacterium tuberculosis
FDAWRFENRCELLAFRHDLDPNDA

SEQ ID NO: 1474370 - protein, 20 aa, Mycobacterium tuberculosis
FDDMARLGAQVTIFRLGSDP

SEQ ID NO: 1474371 - protein, 17 aa, Mycobacterium tuberculosis
FDKDRDGFVFGEAGALM

SEQ ID NO: 1474372 - protein, 17 aa, Mycobacterium tuberculosis
FDLDDTWIGGSSAFMTD

SEQ ID NO: 1474373 - protein, 17 aa, Mycobacterium tuberculosis
FDLPQLVVHPYTLTGPI

SEQ ID NO: 1474374 - protein, 18 aa, Mycobacterium tuberculosis
FDREWPLRVGDIDRAGRL

SEQ ID NO: 1474375 - protein, 17 aa, Mycobacterium tuberculosis
FEGGLWSGGAANAANGA

SEQ ID NO: 1474376 - protein, 23 aa, Mycobacterium tuberculosis
FEHLPRGSFGRILSVLNAAADHH

SEQ ID NO: 1474377 - protein, 21 aa, Mycobacterium tuberculosis
FFKDPVKGFFRALDYTLPWDV

SEQ ID NO: 1474378 - protein, 17 aa, Mycobacterium tuberculosis
FGEACLLGGMRRIATVR

SEQ ID NO: 1474379 - protein, 17 aa, Mycobacterium tuberculosis
FGIPGGAVLPVYDPLFD

SEQ ID NO: 1474380 - protein, 21 aa, Mycobacterium tuberculosis
FGVEPPVALILQGASLHDLTA

SEQ ID NO: 1474381 - protein, 20 aa, Mycobacterium tuberculosis
FHDRFTASRLFGAPPGYVGY

SEQ ID NO: 1474382 - protein, 17 aa, Mycobacterium tuberculosis
FIGAPAMNLIDAAVAHG

SEQ ID NO: 1474383 - protein, 23 aa, Mycobacterium tuberculosis
FISGNFNNGVLWVGDYQGLFGVS

SEQ ID NO: 1474384 - protein, 23 aa, Mycobacterium tuberculosis
FLCGAIQAASRLGGEQAAKLCVQ

SEQ ID NO: 1474385 - protein, 18 aa, Mycobacterium tuberculosis
FLGKPAAVLCSTGYQSNL

SEQ ID NO: 1474386 - protein, 25 aa, Mycobacterium tuberculosis
FLNGEARLPLALPTSATGGIPVTVE

SEQ ID NO: 1474387 - protein, 21 aa, Mycobacterium tuberculosis
FLRRFRPYNLMPAAVKPSYGM

SEQ ID NO: 1474388 - protein, 23 aa, Mycobacterium tuberculosis
FNPGTLNTGFFSAMTQAGPNSGF

SEQ ID NO: 1474389 - protein, 20 aa, Mycobacterium tuberculosis
FNWPALPVAMADTIVPDFPL

SEQ ID NO: 1474390 - protein, 40 aa, Mycobacterium tuberculosis
FPESHALSFASLVFYSAWFKLHHPAAFCAALLRAQPMGFY

SEQ ID NO: 1474391 - protein, 23 aa, Mycobacterium tuberculosis
FPESYNRRALMRFVTSVKSGSDY

SEQ ID NO: 1474392 - protein, 30 aa, Mycobacterium tuberculosis
FPGEISGGMRKRAGLARVLVLDPQIILCDE

SEQ ID NO: 1474393 - protein, 29 aa, Mycobacterium tuberculosis
FQALNARAATFHAEFVSLLNGGAAAYTGA

SEQ ID NO: 1474394 - protein, 25 aa, Mycobacterium tuberculosis
FQHVRAAMLSHGWIDGPPPGQYFHG

SEQ ID NO: 1474395 - protein, 23 aa, Mycobacterium tuberculosis
FQRGPCWSWSRMVGSARSILLAP

SEQ ID NO: 1474396 - protein, 22 aa, Mycobacterium tuberculosis
FQTRLAQFVAIAARYHIKPLFV

SEQ ID NO: 1474397 - protein, 20 aa, Mycobacterium tuberculosis
FRELSIPYLPVRWSTDNPDS

SEQ ID NO: 1474398 - protein, 19 aa, Mycobacterium tuberculosis
FRPATLHQAYLALRAWGLP

SEQ ID NO: 1474399 - protein, 20 aa, Mycobacterium tuberculosis
FRSAAPVWRHDPAPTVLNAH

SEQ ID NO: 1474400 - protein, 17 aa, Mycobacterium tuberculosis
FRVEFLTPTAFKQSGEY

SEQ ID NO: 1474401 - protein, 30 aa, Mycobacterium tuberculosis
FSAASAFQSVVWGLTVGSWIGSSAGLMAAA

SEQ ID NO: 1474402 - protein, 20 aa, Mycobacterium tuberculosis
FSDKQLDMMAAFADQAALAW

SEQ ID NO: 1474403 - protein, 27 aa, Mycobacterium tuberculosis
FSFNVKGGRCEACTGDGTIKIEMNFLP

SEQ ID NO: 1474404 - protein, 18 aa, Mycobacterium tuberculosis
FSKLPASTIDELKTNSSL

SEQ ID NO: 1474405 - protein, 25 aa, Mycobacterium tuberculosis
FSMDGCCKFAAISAHVYCPHQITKT

SEQ ID NO: 1474406 - protein, 23 aa, Mycobacterium tuberculosis
FSRISDVLLPFLVTRQLICGAGK

SEQ ID NO: 1474407 - protein, 20 aa, Mycobacterium tuberculosis
FTATPRTGMWRLNHDGRVSF

SEQ ID NO: 1474408 - protein, 22 aa, Mycobacterium tuberculosis
FTEFRFPRIGTAVFDGIEIELR

SEQ ID NO: 1474409 - protein, 20 aa, Mycobacterium tuberculosis
FTRAALPAIRPVNHLVVDGR

SEQ ID NO: 1474410 - protein, 19 aa, Mycobacterium tuberculosis
FTSHGLRLGVEASLRSLAR

SEQ ID NO: 1474411 - protein, 17 aa, Mycobacterium tuberculosis
FTSPHPAEFTDDVIEAM

SEQ ID NO: 1474412 - protein, 23 aa, Mycobacterium tuberculosis
FTTGVPVQWSAVFAGSGGRRVQL

SEQ ID NO: 1474413 - protein, 17 aa, Mycobacterium tuberculosis
FVAAFDVDAKKVGFDLS

SEQ ID NO: 1474414 - protein, 19 aa, Mycobacterium tuberculosis
FVARGEYKSAANLFTEDGF

SEQ ID NO: 1474415 - protein, 18 aa, Mycobacterium tuberculosis
FVKIFCRRSTGVVIGGVV

SEQ ID NO: 1474416 - protein, 24 aa, Mycobacterium tuberculosis
FVPAFSGLFAPYWRSDARGAIVGL

SEQ ID NO: 1474417 - protein, 17 aa, Mycobacterium tuberculosis
FVQALAGAMGAYAAAEA

SEQ ID NO: 1474418 - protein, 21 aa, Mycobacterium tuberculosis
FVRGEGAGVVVLKRLTDAQRD

SEQ ID NO: 1474419 - protein, 17 aa, Mycobacterium tuberculosis
FVVPYPPGFPVLVPGQL

SEQ ID NO: 1474420 - protein, 17 aa, Mycobacterium tuberculosis
FYFLTGRGALLQLGLLQ

SEQ ID NO: 1474421 - protein, 20 aa, Mycobacterium tuberculosis
GAAGGAGWSPDSDLKGFDGF

SEQ ID NO: 1474422 - protein, 18 aa, Mycobacterium tuberculosis
GAAGSLIGLGGGGGAGGV

SEQ ID NO: 1474423 - protein, 22 aa, Mycobacterium tuberculosis
GAAPRARVPAVRESIYSSIDDL

SEQ ID NO: 1474424 - protein, 22 aa, Mycobacterium tuberculosis
GACPECSGLGIRKEVDPELVVP

SEQ ID NO: 1474425 - protein, 39 aa, Mycobacterium tuberculosis
GADEVSAGIAALFSAHAQEYQALSAQAAAFHDQFVHTLT
